United States Patent
Kabadi et al.

(10) Patent No.: US 11,369,692 B2
(45) Date of Patent: Jun. 28, 2022

(54) MATERIALS AND METHODS FOR TREATMENT OF DUCHENNE MUSCULAR DYSTROPHY

(71) Applicant: Vertex Pharmaceuticals Incorporated, Boston, MA (US)

(72) Inventors: Ami Meda Kabadi, Cambridge, MA (US); Chad Albert Cowan, Cambridge, MA (US); Ante Sven Lundberg, Cambridge, MA (US)

(73) Assignee: Vertex Pharmaceuticals Incorporated, Boston, MA (US)

( * ) Notice: Subject to any disclaimer, the term of this patent is extended or adjusted under 35 U.S.C. 154(b) by 645 days.

(21) Appl. No.: 15/763,328

(22) PCT Filed: Oct. 28, 2016

(86) PCT No.: PCT/IB2016/001679
§ 371 (c)(1),
(2) Date: Jun. 22, 2018

(87) PCT Pub. No.: WO2017/072590
PCT Pub. Date: May 4, 2017

(65) Prior Publication Data
US 2019/0374655 A1 Dec. 12, 2019

Related U.S. Application Data

(60) Provisional application No. 62/324,064, filed on Apr. 18, 2016, provisional application No. 62/247,484, filed on Oct. 28, 2015.

(51) Int. Cl.
*C12N 15/63* (2006.01)
*A61K 48/00* (2006.01)
*A61P 25/14* (2006.01)
*A61P 21/00* (2006.01)
*A61K 38/46* (2006.01)
*C12N 9/22* (2006.01)
*C12N 15/113* (2010.01)
*C12N 15/90* (2006.01)

(52) U.S. Cl.
CPC ........ *A61K 48/0058* (2013.01); *A61K 38/465* (2013.01); *A61P 21/00* (2018.01); *A61P 25/14* (2018.01); *C12N 9/22* (2013.01); *C12N 15/113* (2013.01); *C12N 15/907* (2013.01)

(58) Field of Classification Search
CPC ... A61K 48/0058; A61K 38/465; A61P 25/14; A61P 21/00; C12N 9/22; C12N 15/113; C12N 15/907
See application file for complete search history.

(56) References Cited

U.S. PATENT DOCUMENTS

| | | |
|---|---|---|
| 2015/0024500 A1 | 1/2015 | Yu et al. |
| 2017/0362635 A1 | 12/2017 | Chamberlain et al. |
| 2018/0320197 A1 | 11/2018 | Gersbach et al. |
| 2019/0048337 A1* | 2/2019 | Hsu ...................... C12N 15/102 |

FOREIGN PATENT DOCUMENTS

| | | | |
|---|---|---|---|
| CN | 103930550 A | 7/2014 | |
| WO | 2013170385 A1 | 11/2013 | |
| WO | WO 2014/197748 A2 | 12/2014 | |
| WO | WO-2014197748 A2 * | 12/2014 | ............... C12N 9/22 |
| WO | 2016020399 A1 | 2/2016 | |
| WO | 2016025469 A1 | 2/2016 | |
| WO | 2016115543 A2 | 7/2016 | |
| WO | 2016161380 A1 | 10/2016 | |
| WO | 2016174056 A1 | 11/2016 | |
| WO | 2017062862 A2 | 4/2017 | |
| WO | 2017095967 A2 | 6/2017 | |

OTHER PUBLICATIONS

Score report for Gersbach WO-2014197748-A2 published Dec. 2014. (Year: 2014).*
International Search Report for Application No. PCT/IB2016/001679, dated Feb. 9, 2017.
Written Opinion for Application No. PCT/IB2016/001679, dated Feb. 9, 2017.
Hongmei, Lisa Li et al., "Precise Correction of the Dystrophin Gene in Duchenne Muscular Dystrophy Patient Induced Pluripotent Stem Cells by TALEN and CRISPR-Cas9," Stem Cell Reports, vol. 4. No. 1, Jan. 1, 2015 (Jan. 1, 2015), pp. 143-154, XP055233644, United States ISSN: 2213-6711. DOI: 10.1016jj.stemcr.2014.10.013.
Ousterout, David G. et al, "Multiplex CRISPR/Cas9-based genome editing for correction of dystrophin mutations that cause Duchenne muscular dystrophy," Nature Communications, vol. 6., Feb. 18, 2015 (Feb. 18, 2015), pp. 1-13. XP055196515, DOI: 10.1038/ncomms7244.
Amoasii et al., "Single-cut genome editing restores dystrophin expression in a new mouse model of muscular dystrophy," Science Translational Medicine, 9(418): eaan8081 (11 pages), 2017.
Bengtsson et al., "Progress and prospects of gene therapy clinical trials for the muscular dystrophies," Human Molecular Genetics, 25(R1): R9-R17, 2015.
Kabadi et al., "Multiplex CRISPR/Cas9-based genome engineering from a single lentiviral vector," Nucleic Acids Research, 42(19): e147 (11 pages), 2014.
Li et al., "Precise Correction of the Dystrophin Gene in Duchenne Muscular Dystrophy Patient Induced Pluripotent Stem Cells by TALEN and CRISPR-Cas9," Stem Cell Reports, 4:143-154, 2015.
Long et al., "Prevention of muscular dystrophy in mice by CRISPR/Cas9-mediated editing of germline DNA," Science, 345(6201): 1184-1188, 2014.
Wei et al., "Prevention of Muscle Wasting by CRISPR/Cas9-mediated Disruption of Myostatin In Vivo," Molecular Therapy, 24(11):1889-1891, 2016.

* cited by examiner

*Primary Examiner* — Catherine S Hibbert
(74) *Attorney, Agent, or Firm* — McNeill Baur PLLC

(57) ABSTRACT

The present application provides materials and methods for treating a patient with Duchenne Muscular Dystrophy (DMD) both ex vivo and in vivo. In addition, the present application provides materials and methods for editing a dystrophin gene in a cell by genome editing.

3 Claims, 76 Drawing Sheets
Specification includes a Sequence Listing.

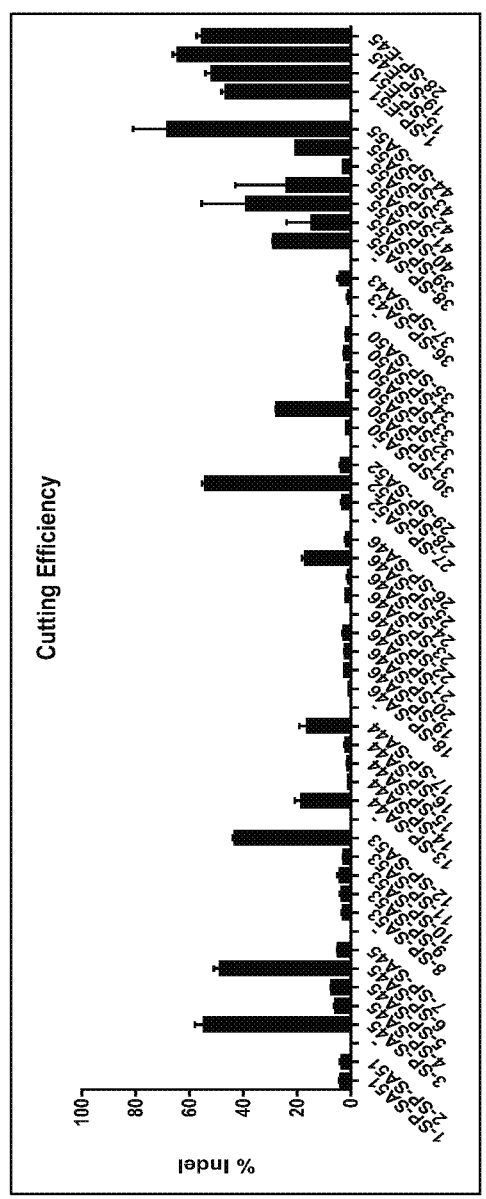

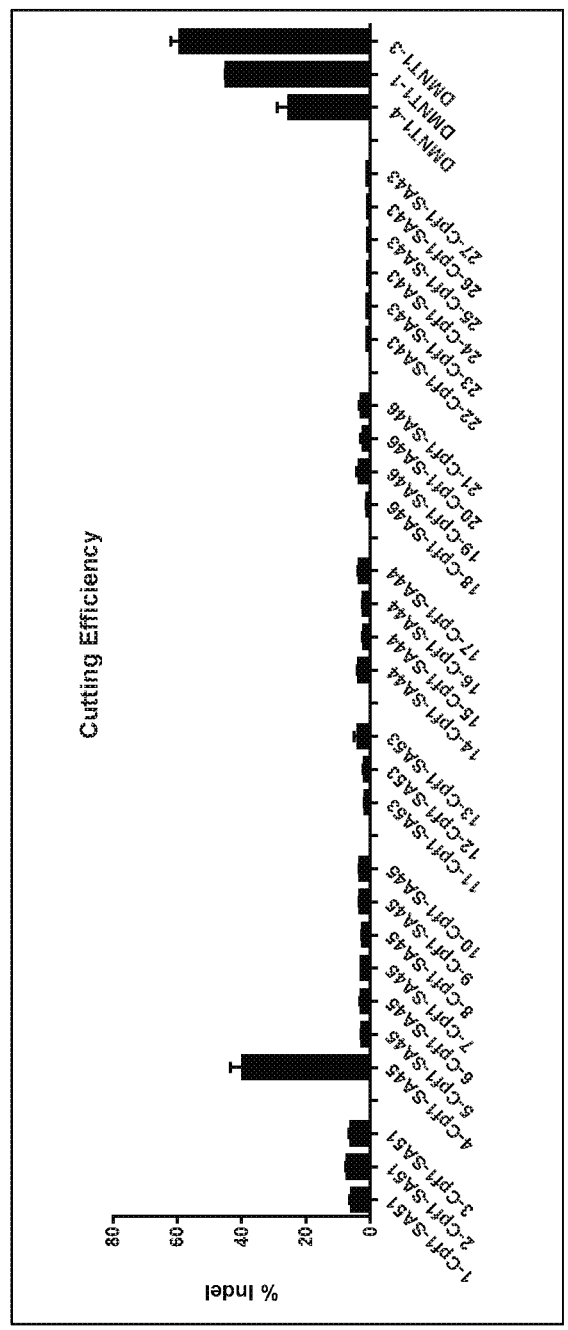

FIGURE 5A

| gRNA name | SEQ ID NO | gRNA sequence | Avg % Indel | Indel SEM | Avg % Splice Acceptor Knock Out | Splice Acceptor Knock Out SEM |
|---|---|---|---|---|---|---|
| 1-SP-SA51 | 145442 | AAAATATTTTAGCTCCTACT |  | 0.000 |  | 0.000 |
| 2-SP-SA51 | 145443 | TGCAAAAACCCAAAATATTT |  | 0.000 |  | 0.000 |
| 3-SP-SA45 | 186216 | TGGTATCTTACAGGAACTCC |  | 0.015 | 11.6 | 0.006 |
| 4-SP-SA45 | 186217 | TTGGTATCTTACAGGAACTC | 1.3 | 0.001 | 0.3 | 0.000 |
| 5-SP-SA45 | 186218 | TGCCATCTGGAGTTCCTGT | 5.6 | 0.002 | 2.5 | 0.001 |
| 6-SP-SA45 | 186219 | TTGCCTTTTTGGTATCTTAC |  | 0.011 | 12.9 | 0.004 |
| 7-SP-SA45 | 186220 | TTTGCCTTTTTGGTATCTTA | 0.5 | 0.000 |  | 0.000 |
| 8-SP-SA53 | 125451 | TGATTCTGAATTCTTTCAAC |  | 0.000 |  | 0.000 |
| 9-SP-SA53 | 125452 | TTTCCTTTTATTCTAGTTGA |  | 0.000 |  | 0.000 |
| 10-SP-SA53 | 125453 | AATTCTTTCAACTAGAATAA | 2.5 | 0.001 | 0.5 | 0.000 |
| 11-SP-SA53 | 125455 | ATTTATTTTTCCTTTTATTC |  | 0.000 |  | 0.000 |
| 12-SP-SA53 | 125454 | ATTCTTTCAACTAGAATAAA |  | 0.010 | 7.4 | 0.004 |
| 13-SP-SA44 | 237600 | AGATCTGTCAAATCGCCTGC | 26.7 | 0.017 | 16.1 | 0.011 |
| 14-SP-SA44 | 237599 | CAGATCTGTCAAATCGCCTG |  | 0.000 |  | 0.000 |
| 15-SP-SA44 | 237602 | GTCAAATCGCCTGCAGGTAA | 0.4 | 0.000 | 0.1 | 0.000 |
| 16-SP-SA44 | 237603 | GATCCATATGCTTTTACCTG |  | 0.000 |  | 0.000 |
| 17-SP-SA44 | 237601 | ATCCATATGCTTTTACCTGC | 21.6 | 0.011 | 2.5 | 0.002 |
| 18-SP-SA46 | 178873 | TTGTTCTTCTAGCCTGGAGA |  | 0.000 |  | 0.000 |
| 19-SP-SA46 | 178869 | ATTCTTTTGTTCTTCTAGCC |  | 0.000 |  | 0.000 |
| 20-SP-SA46 | 178875 | TTCTTCTAGCCTGGAGAAAG | 0.6 | 0.001 | 0.1 | 0.000 |
| 21-SP-SA46 | 178870 | TTCTTCTTTCTCCAGGCTAG |  | 0.000 |  | 0.000 |
| 22-SP-SA46 | 178871 | TCTTTTGTTCTTCTAGCCTG |  | 0.000 |  | 0.000 |
| 23-SP-SA46 | 178868 | AAGATATTCTTTTGTTCTTC |  | 0.000 |  | 0.000 |
| 24-SP-SA46 | 178872 | TTATTCTTCTTTCTCCAGGC |  | 0.000 |  | 0.000 |
| 25-SP-SA46 | 178874 | AATTTTATTCTTCTTTCTCC | 14.7 | 0.008 | 2.5 | 0.001 |
| 26-SP-SA46 | 178876 | CAATTTTATTCTTCTTTCTC |  | 0.000 |  | 0.000 |
| 27-SP-SA52 | 136213 | AATCCTGCATTGTTGCCTGT | 0.4 | 0.000 | 0.2 | 0.000 |
| 28-SP-SA52 | 136214 | TAAGGGATATTTGTTCTTAC |  | 0.008 | 15.1 | 0.005 |
| 29-SP-SA52 | 136215 | CTAAGGGATATTTGTTCTTA |  | 0.000 |  | 0.000 |
| 30-SP-SA50 | 155685 | ATGCTTTTCTGTTAAAGAGG | 0.4 | 0.000 | 0.1 | 0.000 |
| 31-SP-SA50 | 155687 | TGTATGCTTTTCTGTTAAAG | 49.0 | 0.010 |  | 0.008 |
| 32-SP-SA50 | 155686 | TCTTCTAACTTCCTCTTTAA | 0.3 | 0.000 | 0.1 | 0.000 |
| 33-SP-SA50 | 155689 | ATGTGTATGCTTTTCTGTTA |  | 0.000 |  | 0.000 |
| 34-SP-SA50 | 155684 | TTTTCTGTTAAAGAGGAAGT |  | 0.000 |  | 0.000 |
| 35-SP-SA50 | 155688 | GTGTATGCTTTTCTGTTAAA |  | 0.000 |  | 0.000 |
| 36-SP-SA43 | 252293 | TTTTATATTACAGAATATAA |  | 0.000 |  | 0.000 |
| 38-SP-SA55 | 114755 | CTGAACATTTGGTCCTTTGC | 39.2 | 0.021 | 7.0 | 0.003 |
| 39-SP-SA55 | 114751 | CATTTGGTCCTTTGCAGGGT | 2.5 | 0.021 | 1.0 | 0.000 |
| 40-SP-SA55 | 114753 | CTCGCTCACTCACCCTGCAA |  | 0.021 |  | 0.013 |

FIGURE 5B

| | | | | | | | |
|---|---|---|---|---|---|---|---|
| 41-SP-SA55 | 114756 | TCTGAACATTGGTCCTTTG | 0.6 | 0.021 | | | 0.000 |
| 42-SP-SA55 | 114758 | TGGTCCTTTGCAGGGTGAGT | 14.1 | 0.021 | 2.1 | | 0.000 |
| 43-SP-SA55 | 114762 | TCTCGCTCACTCACCCTGCA | 26.2 | 0.021 | 16.4 | | 0.003 |
| 44-SP-SA55 | 114764 | TGAACATTGGTCCTTTGCA | | 0.021 | 8.4 | | 0.001 |
| 1-SP-E51 | 1410430 | CCTACTCAGACTGTTACTC | | 0.021 | 2.0 | | 0.001 |
| 15-SP-E51 | 1410444 | CCAGAGTAACAGTCTGAGT | | 0.021 | 8.2 | | 0.003 |
| 19-SP-E45 | 1410448 | GGAACTCCAGGATGGCATT | | 0.021 | 4.4 | | 0.002 |
| 28-SP-E45 | 1410457 | CCGCTGCCCAATGCCATCC | | 0.021 | 3.7 | | 0.001 |

FIGURE 6

| gRNA name | SEQ ID NO | gRNA sequence | Avg % Indel | Indel SEM | Avg % Splice Acceptor Knock Out | Splice Acceptor Knock Out SEM |
|---|---|---|---|---|---|---|
| 1-NM-SA51 | 1410400 | AGTCTGAGTAGGAGCTAAAATATT | 0.1 | 0.000 | 0.0 | 0.000 |
| 2-NM-SA44 | 1410401 | CTTGATCCATATGCTTTTACCTGC | 0.0 | 0.000 | 0.0 | 0.000 |
| 3-NM-SA52 | 1410402 | ATATTTGTTCTTACAGGCAACAAT | 0.6 | 0.000 | 0.1 | 0.000 |
| 1-SA-SA51 | 485512 | TGAGTAGGAGCTAAAATATT | 0.8 | 0.001 | 0.1 | 0.000 |
| 2-SA-SA45 | 490807 | TTGGTATCTTACAGGAACTC | 10.8 | 0.005 | 2.9 | 0.001 |
| 3-SA-SA53 | 482860 | TGATTCTGAATTCTTTCAAC | 0.0 | 0.000 | 0.0 | 0.000 |
| 4-SA-SA53 | 482861 | TTTCCTTTTATTCTAGTTGA | 0.0 | 0.000 | 0.0 | 0.000 |
| 5-SA-SA46 | 489814 | TTCTTCTAGCCTGGAGAAAG | 26.0 | 0.013 | 4.4 | 0.002 |
| 7-SA-SA55 | 481421 | TCTGAACATTTGGTCCTTTG | 36.7 | 0.024 | 7.6 | 0.006 |
| 8-SA-SA55 | 481420 | AACATTTGGTCCTTTGCAGG | 35.4 | 0.039 | 22.4 | 0.025 |
| 1-ST-SA53 | 534494 | CTGATTCTGAATTCTTTCAA | 0.1 | 0.000 | 0.0 | 0.000 |
| 2-ST-SA53 | 534495 | TTTTCCTTTTATTCTAGTTG | 0.1 | 0.000 | 0.0 | 0.000 |
| 3-ST-SA46 | 537307 | TTCTTTTGTTCTTCTAGCCT | 0.1 | 0.000 | 0.0 | 0.000 |
| 4-ST-SA46 | 537308 | GTTCTTCTAGCCTGGAGAAA | 1.6 | 0.002 | 0.4 | 0.000 |
| 5-ST-SA50 | 536097 | ATCTTCTAACTTCCTCTTTA | 0.5 | 0.001 | 0.1 | 0.000 |
| 19-SP-E45 | 1410448 | GGAACTCCAGGATGGCATT | 35.4 | 0.040 | 2.0 | 0.003 |
| 15-SP-E51 | 1410444 | CCAGAGTAACAGTCTGAGT | 30.0 | 0.042 | 4.3 | 0.006 |

Δ52 PCR Analysis

Δ44 PCR Analysis

FIGURE 10C

|  | Δ52 cell line generation | | Δ44 cell line generation | |
|---|---|---|---|---|
|  | gRNA 1-SP-152 + 2-SP-153 | gRNA 2-SP-152 + 2-SP-153 | gRNA 2-SP-144 + 3-SP-145 | gRNA 2-SP-144 + 4-SP-145 |
| # of clones | 128 | 133 | 132 | 124 |
| # of deletions | 24 | 33 | 7 | 9 |
| Deletion Efficiency (%) | 18.8 | 24.8 | 5.3 | 7.3 |
| Overall # of clones | 261 | | 256 | |
| Overall # of deletions | 57 | | 16 | |
| Overall Deletion Efficiency (%) | 21.8 | | 6.3 | |

FIGURE 11A gRNA 1-SP-I52 + 2-SP-I53 tactcaaggcattcagacagtggtttaagtaatgtagggtgggcaggaactttggtaagaccca
++++++++++++++++++++++++++++++++++++++++++++++++++++++++++++++++
atgagttccgtaagtctgtcaccaaattcattacatcccacccgtccttgaaaccattctgggt
                        ▬▬▬▬▬▬▬▬▬▬▬▬▬
                                    Right gRNA tactcaaggcattcagacagtggtttaagtaatgtagggtgggcaggaactttggtaagaccca

TACTCAAGGCATTCAGACAGTGGTTTAAGTA▬▬▬▬▬GGTGGGCAGGAACTTTGGTAAGACCCA

TACTCAAGGCATTCAGACAGTGGT▬▬▬▬▬▬▬▬▬▬▬▬GGGCAGGAACTTTGGTAAGACCCA

FIGURE 11B gRNA 2-SP-I52 + 2-SP-I53 cagtggtttaagtaatccgagg gtagggtgggcaggaactttggtaagacccatctgactagacgctgtgcatattctttcttctga
++++++++++++++++++++++ +++++++++++++++++++++++++++++++++++++++++++++++++++++++++++++++
gtcaccaaattcattaggctcc catcccacccgtccttgaaaccattctgggtagactgatctgcgacacgtataagaaagaagact
            ▬▬  ▬▬
          Left gRNA
                Right gRNA cagtggtttaagtaatccgagg gtagggtgggcaggaactttggtaagacccatctgactagacgctgtgcatattctttcttctga CAGTGGTTTAAGTAATCCGAGG ▬AGGGTGGGCAGGAACTTTGGTAAGACCCATCTGACTAGACGCTGTGCATATTCTTTCTTCTGA

CAGTGGTTTAAGTAATCCGAGG ▬▬▬▬▬▬ACTTTGGTAAGACCCATCTGACTAGACGCTGTGCATATTCTTTCTTCTGA

CAGTGGTTTAAGTAATCCGAGG ▬▬▬▬▬AGGAACTTTGGTAAGACCCATCTGACTAGACGCTGTGCATATTCTTTCTTCTGA

CAGTGGTTTAAGTAATCCGAG▬▬TAGGGTGGGCAGGAACTTTGGTAAGACCCATCTGACTAGACGCTGTGCATATTCTTTCTTCTGA

CAGTGGTTTAAGTA▬▬▬▬▬▬▬▬▬▬▬▬▬▬▬▬▬▬▬▬▬▬▬▬▬▬▬▬▬▬▬▬▬▬▬▬▬▬▬▬TCTTTCTTCTGA

FIGURE 12A

| SEQ ID NO | gRNA Sequence | % Indel |
|---|---|---|
| 236915 | ATCGATGAAGGTATCTTACG | 70.2 |
| 236163 | AAGGTAGAAACAAGCATTCT | 29.3 |
| 236084 | ATCAATTTTTCTACGTACCG | 5.8 |
| 232401 | ACCTAGATGACACAGCGTCG | 27.5 |
| 230005 | TGTTCTGTAGATGTAGCGCC | 12.8 |
| 229558 | TACAGGAGACGTAATTGACG | 37.4 |
| 229557 | ACAGGAGACGTAATTGACGG | 54.9 |
| 229303 | ACACTCAGGCATTACTACGG | 44.8 |
| 228978 | ATGGGCTAGTTACGGCTTGA | 54.8 |
| 228448 | CCTATCACTAGTATTCGGTA | 51.1 |
| 227602 | CAGGGACGTTGTTAGACCGT | 28.9 |
| 226063 | GGGAGCTTATACAAGACCGT | 33.0 |
| 226062 | GGGGAGCTTATACAAGACCG | 22.8 |
| 225417 | ACTAGATGCTTGTCTACGGC | 16.4 |
| 225410 | AGCATCTAGTAATTGACGGT | 6.9 |
| 225047 | TCCGCCAAGCGCCTATTTAC | 37.9 |
| 224650 | ATGCTGAGGTCCGGATTAAG | 29.7 |
| 224549 | GGCGCCAAGATTCCCCTAGC | 24.0 |
| 224378 | GATTAATGAACGTGCGCACC | 13.9 |
| 224127 | TGTCCAACACTATGATCCGA | 8.5 |
| 224126 | GTCCAACACTATGATCCGAT | 41.7 |
| 223418 | GGTTTTCTCGTGACGAGCCA | 15.6 |
| 221914 | CCCCGTGTGTAGCAGCGCAA | 24.3 |
| 221143 | GACGAGTTGGCTCGGGATTA | 28.8 |
| 219974 | AATAATACGTGGACCTGCGC | 17.7 |
| 218293 | CCCGTCTTACCGGTCTTGAT | 40.6 |
| 218297 | CCGATCAAGACCGGTAAGAC | 26.9 |
| 218207 | ACGTAACCCTAGTTTCGCTC | 10.8 |
| 218173 | ACTCTAGCTTCGGACAACGT | 38.3 |
| 217734 | CACTGCTTTAGCTACGCTAT | 5.5 |
| 217322 | GATTCTGACGTGAGTACTAC | 24.3 |
| 217090 | GATTAGCATACAACCGCACT | 16.5 |
| 217082 | TAGGAGCCTAGTTATACGAA | 61.6 |
| 216165 | TCTGATGTGGACTAGTAACG | 27.0 |
| 215619 | TCTTCCCATGAACGAAATCG | 16.1 |
| 213660 | TTTAGGAATCGATTGTTTCG | 8.8 |
| 213620 | TATTCAAGTGCTAACGCGTG | 12.8 |
| 213618 | ATTCAAGTGCTAACGCGTGT | 8.4 |
| 213617 | TTCAAGTGCTAACGCGTGTG | 8.0 |

FIGURE 12B

| 213420 | AAGCTAAGTGAGGTTCGACC | 23.4 |
|---|---|---|
| 212990 | ATCATGTTTAGTTATGCCCG | |
| 211529 | TAAACCAGCGGATTACGGTG | 47.6 |
| 211528 | AAACCAGCGGATTACGGTGT | 28.8 |
| 211531 | TCACCCACACCGTAATCCGC | |
| 210516 | CGGACTAGCGGGTCAATATC | 50.6 |
| 210514 | TGATACATCGTGTTGTGCGT | |
| 208854 | ACGTGCAATTTTGGGCGCAC | |
| 208853 | CGTGCAATTTTGGGCGCACT | |
| 205628 | CAACGAGTATACAAAGATCG | 21.6 |
| 205319 | GCTAAGAAACCAATGTACGG | 48.9 |
| 203517 | GGCCCTTTAATTACGCACTG | 30.4 |
| 202709 | AAATGTAAATTCCACAACAA | 17.3 |
| 200544 | GATTATACACTAGGTTCGTC | 14.7 |
| 200019 | AACGTTAGGATCGCTGATTC | |
| 199808 | TACATTTTGGGCAGTAACGC | |
| 199078 | ACAACTGCCCTCTATACGGC | 15.3 |
| 198782 | TCTTAAAACGCGGTCCTCCT | |
| 198508 | GCTTTCCCCTACCATCGAGC | 13.4 |
| 198507 | CTTTCCCCTACCATCGAGCG | 45.2 |
| 198514 | AGAACCCCGCTCGATGGTAG | 51.7 |
| 198512 | AAGAACCCCGCTCGATGGTA | 14.3 |
| 198511 | GAAGAACCCCGCTCGATGGT | 38.1 |
| 196798 | CACTAGTAGATCACGATCAG | 31.9 |
| 196503 | ACCACCCGTGTTCTTTGCGG | 20.4 |
| 196502 | TACCACCCGTGTTCTTTGCG | 25.5 |
| 195761 | AAAAGCGTCGATCGAACTGT | |
| 195585 | ATCTACTCTAGTTGTACCGA | 18.7 |
| 195575 | TTGATTTGGTCGAGGCCCAA | 17.4 |
| 194966 | GGTTGCAGGTCCTGCCGAAC | 18.4 |
| 194292 | GCTTATACAACCACACCGTT | 62.9 |
| 193612 | GAAACAGCTTTTGGCCCGCG | 19.5 |
| 192745 | TCCTATTCTGATCACGGACG | 18.1 |
| 192221 | GCATGCCTGTTAATACGTTC | 43.1 |
| 191869 | TCAGCCTTACGTAGCGTTGC | 19.2 |
| 191741 | AAGCACCCATGAATCGGCCA | 27.4 |
| 191550 | TCAACTCACTTGCGGCCCTA | 38.1 |
| 191478 | GCGATTAATCCGGAGTGCTA | |
| 191477 | CGATTAATCCGGAGTGCTAA | |
| 191409 | TAATAACCCTACGTATCATC | 37.7 |
| 191324 | ACGCCAACTGTTAGAAGCGT | 18.4 |

FIGURE 12C

| 191323 | AACGCCAACTGTTAGAAGCG | 18.4 |
|---|---|---|
| 190635 | TAGTAGGTTAACACTCCGTG | 6.3 |
| 190493 | TCGGAGTGCCTAATTCGTGT | 3.8 |
| 189640 | ATGTATGACGCTCCCGAGTC | 4.4 |
| 189321 | AGATTCCCATTATTCGGTAC | 10.8 |
| 186914 | AGTGCATATCTAACTCCCGT | 32.0 |
| 186912 | AAGTGCATATCTAACTCCCG | 9.2 |
| 186670 | CAGGCCCCAATATACACGGA | 53.2 |
| 186673 | GTACAGCCCTCGGTGTATAT | 35.9 |
| 186301 | TTAGTGATCGTGGATACGAG | 45.0 |
| 186219 | TTGCCTTTTTGGTATCTTAC | 19.3 |
| 186220 | TTTGCCTTTTTGGTATCTTA | 5.8 |
| 186216 | TGGTATCTTACAGGAACTCC | 40.7 |
| 186217 | TTGGTATCTTACAGGAACTC | 5.3 |
| 186215 | ATCTTACAGGAACTCCAGGA | 79.0 |
| 186218 | TGCCATCCTGGAGTTCCTGT | 5.5 |
| 186212 | CAGGAACTCCAGGATGGCAT | 25.2 |
| 186209 | TCCAGGATGGCATTGGGCAG | 46.8 |
| 186213 | GCCGCTGCCCAATGCCATCC | 50.4 |
| 186206 | GTCAGAACATTGAATGCAAC | 8.3 |
| 186204 | CAGAACATTGAATGCAACTG | 59.2 |
| 186194 | AACAGATGCCAGTATTCTAC | 22.5 |
| 186189 | AATTGGGAAGCCTGAATCTG | 34.6 |
| 186186 | TGGGAAGCCTGAATCTGCGG | 56.4 |
| 186184 | AAGCCTGAATCTGCGGTGGC | 16.9 |
| 186188 | CCTCCTGCCACGCAGATTC | 37.0 |
| 186065 | CAACTGCAGCAGCACGCATT | 27.1 |
| 185720 | AAAACCTATCATCGGCTGTA | 23.5 |
| 185719 | AAACCTATCATCGGCTGTAA | 27.1 |
| 185718 | AACCTATCATCGGCTGTAAG | 54.6 |
| 185723 | TTCCCCTTACAGCCGATGAT | 51.8 |
| 185608 | AGGAGAAGACATACCAGTCG | 27.5 |
| 185607 | GGAGAAGACATACCAGTCGA | 56.9 |
| 185606 | GAGAAGACATACCAGTCGAG | 39.2 |
| 185604 | ACATACCAGTCGAGGGGTTC | 1.8 |
| 185603 | CATACCAGTCGAGGGGTTCT | 27.5 |
| 185602 | ATACCAGTCGAGGGGTTCTG | 76.8 |
| 185320 | AGTACGTAGAAACGTACATC | 8.3 |
| 185319 | GTACGTAGAAACGTACATCT | 65.7 |
| 185181 | CTGGTTCACACGGATATACT | 51.7 |
| 185180 | ACTGGTTCACACGGATATAC | 31.4 |

FIGURE 12D

| 185166 | CAAGCGGACGGGACAGATCC | 29.2 |
|---|---|---|
| 184987 | ATCTAGAGTAAGGACTCCGG | 68.6 |
| 184958 | CTACTACGTGTGGCCATCAA | 33.2 |
| 184954 | AATTCTTTTGCTACTACGTG | 14.9 |
| 184429 | GTAAGTGGATAGGCGGTTTT | 30.0 |
| 183819 | ATCTTAGTCCTATTATCCGT | 33.3 |
| 183822 | GCACATGGCCTACGGATAAT | 59.0 |
| 183811 | ACACTTTCCGTATTAGCACT | 21.2 |
| 183734 | ATCTGCCAGTAGGTAGTCCG | 58.3 |
| 183736 | ACCAACCTCGGACTACCTAC | 44.3 |
| 183581 | GCTTATGATCTCGAAGAGTC | 31.9 |
| 183534 | AAGCAGCTAATAGTGACGAC | 31.3 |
| 183533 | AGCAGCTAATAGTGACGACA | 47.5 |
| 183311 | GTGAATGTGGATACGGTTTC | 37.1 |
| 183270 | TTTAACGAATATGGGTCACG | 5.7 |
| 183269 | TTAACGAATATGGGTCACGT | 18.0 |
| 183144 | TATGCCGTTGGTTGATATCC | 29.1 |
| 183120 | ACTATTATGCTTGACCAAGC | 10.7 |
| 183054 | CAAAATGAGGCAGCCGTAAT | 28.6 |
| 182400 | AACATCTGCTAAGATGTCGA | 24.0 |
| 182061 | GTCAAACCATCGTAGTCAGT | 15.5 |
| 182060 | TCAAACCATCGTAGTCAGTC | 7.7 |
| 182059 | CAAACCATCGTAGTCAGTCG | 30.8 |
| 182062 | TCTTCCCCGACTGACTACGA | 34.2 |
| 182055 | GTATTTAAGGTGTACACGAT | 30.6 |
| 181660 | GACACCATAAGCTACGTGTA | 59.1 |
| 181658 | CATAAGCTACGTGTATGGAC | 53.7 |
| 181661 | CAGTCCATACACGTAGCTTA | 33.4 |
| 181240 | TGGAAAGAATTACTACCACG | 51.1 |
| 181160 | TTCATGACTTCGCATACCAC | 5.5 |
| 181032 | GGGCTGTGGGACTACATAAC | 16.9 |
| 181030 | CCAACCCAGGTATAGGTCAC | 32.7 |
| 180840 | CATACAGTCACGCCTTTTGT | 20.2 |
| 180766 | AAACCTGTACGTATACTACC | 41.3 |
| 180768 | GATCCAGGTAGTATACGTAC | 53.2 |
| 180731 | ACATGCTTATTGATACGCTC | 14.7 |
| 180730 | CATGCTTATTGATACGCTCT | 35.9 |
| 180695 | ACAGAGGAGCACGTTTAGGC | 34.6 |
| 180630 | CTAGGGCTCAGTTAGTTGAT | 33.2 |
| 180612 | CCCAGAAACTGAATTCGATG | 10.9 |
| 180609 | AACTGAATTCGATGTGGGAT | 7.9 |

FIGURE 12E

| 180516 | GGCCCCCCTGATCCACCATT | 52.3 |
|---|---|---|
| 180505 | GCCACAAAAGCGAAGTGCCC | 51.9 |
| 180439 | GCTAGCCAGTCCCTACCACG | 47.8 |
| 180438 | TGAGCAAAGTCCTCGTGGTA | 13.8 |
| 180381 | CTTCCTCCCAATCGGATGTA | 49.5 |
| 180389 | CTTACATCCGATTGGGAGGA | 32.3 |
| 180386 | GGACCTTACATCCGATTGGG | 54.1 |
| 180373 | GGGATTGCTGCCGATATTCA | 56.9 |
| 180371 | GATATTCACGGCCATATCAA | 45.5 |
| 180372 | ATTGATATGGCCGTGAATAT | 48.5 |
| 180355 | CACCTAGAAGTAGTCTCATC | 23.8 |
| 180266 | TCAGCTGAGTACGTGAACAC | 67.6 |
| 180265 | ATCAGCTGAGTACGTGAACA | 33.6 |
| 180207 | GCCAACATGTCTACCATACC | 53.9 |
| 180196 | ATTCTGATAATGACCTACGG | 52.8 |
| 180192 | ATAATGACCTACGGAGGGTA | 37.8 |
| 180194 | CCTCAGGCCATACCCTCCGT | 40.1 |
| 180175 | TATAAGTTGACCCTTCCCGA | 47.2 |

FIGURE 14A
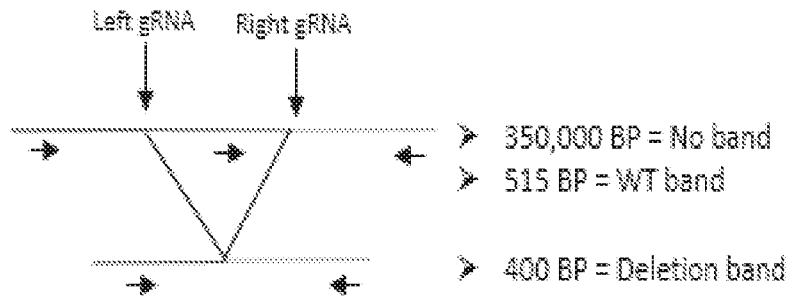
FIGURE 14B
Subset of promising clones
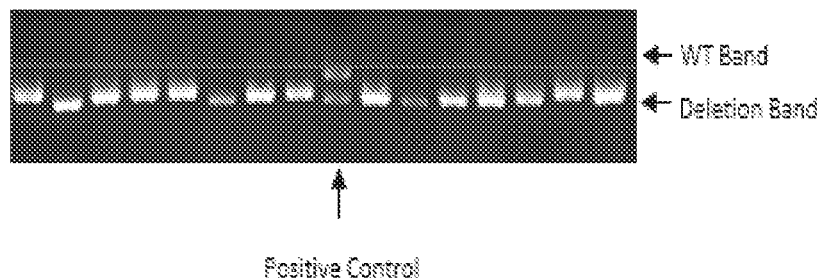
FIGURE 14C
| Positive Clones | 26/100 |
| % Positive Clones | 26% |

FIGURE 19A

| SEQ ID NO | Sequence | PAM | Cutting percentage estimate |
|---|---|---|---|
| 147118 | GTACATCTAGGAGGGAGCTC | TGG | 46 |
| 155566 | GCACAGCCAGCCCAGATGTA | GGG | 42 |
| 155568 | TCTCGCAGGAGCCCTACATC | TGG | 42 |
| 148128 | CTCCAGTGTCCCTGTCACAT | GGG | 37 |
| 152460 | ATGAGGTGCAAAGCAGCCAT | AGG | 37 |
| 136774 | TGGGAGAGTAACATCTGGTA | GGG | 33 |
| 141161 | AGGGATGTGAATGAATCAGT | AGG | 33 |
| 144187 | GGAGACAGGAGGGAGAAAGG | TGG | 33 |
| 150266 | GAGCAATGCAGACTAGGAAT | GGG | 33 |
| 144200 | GGAAAGGAGGAAATGGAAGA | GGG | 29 |
| 145692 | ACACACAGCTGGGTTATCAG | AGG | 29 |
| 148083 | GCAACCACACCACAAATACT | AGG | 29 |
| 149491 | AGCCTAGCCTACCTTCAACA | TGG | 29 |
| 149492 | AAGTGTTCTGACCATGTTGA | AGG | 29 |
| 151562 | TAAGACTACTGTAACAGTCC | AGG | 29 |
| 137443 | AGAGATGGCAAAAGGAACTT | TGG | 25 |
| 139634 | AGACAGCAGAAGAGGGTTAG | GGG | 25 |
| 139727 | AACATCCGAATGGAGAAGAG | AGG | 25 |
| 139793 | TTGCAGTGAAGTGTTGCTGG | GGG | 25 |
| 140099 | TGTAGTAATTGCTACGCTGT | AGG | 25 |
| 140846 | CCTCCCCTACATCCCTTAGA | GGG | 25 |

FIGURE 19B

| | | | |
|---|---|---|---|
| 140875 | TGGCATTGAAGATGAAGGAC | AGG | 25 |
| 141455 | GTACATCTCCCTGGCTTGTA | TGG | 25 |
| 142903 | AAGAAGGAAAGAAAGGGTAT | CGG | 25 |
| 142930 | TAACTTCTAAGGATCTTGGG | AGG | 25 |
| 144071 | GAATTGATGGGACAATGTGT | GGG | 25 |
| 144198 | AGGAAATGGAAGAGGGATGG | TGG | 25 |
| 145433 | TACTCTGGTGACACAACCTG | TGG | 25 |
| 146015 | ATGATGACTAAATATGCCAT | TGG | 25 |
| 146037 | GCCATCCCTGCGCCAGTCAT | GGG | 25 |
| 146066 | TATCTGTACACTGCTGGGAA | AGG | 25 |
| 146305 | GAGAGAATGCACAATAGACA | TGG | 25 |
| 148098 | ACTAGCCAAGAGCAGGCACC | AGG | 25 |
| 149229 | GCTCTCAACTCCTCACTGGA | GGG | 25 |
| 150627 | TCCAGAGACAAAGCTAGCTA | GGG | 25 |
| 150656 | TGGAAACAAGGAGTACCAAA | GGG | 25 |
| 150671 | GACTCTGATCCCCAGCTCAA | GGG | 25 |
| 150673 | CAGAGAAGGAACCCTTGAGC | TGG | 25 |
| 152763 | GAATTGACAGTTACAGATGT | GGG | 25 |
| 153531 | TAACAGGAAAGGCACTACAG | TGG | 25 |
| 136492 | AAGACAGCTATTGAAGTAAG | TGG | 21 |
| 137567 | GTTAGAAGTGGTTCCAAGGT | GGG | 21 |
| 137568 | TAGTGATGACAGTCCCACCT | TGG | 21 |
| 138502 | TCATCCATAAGCAGCAACTC | TGG | 21 |

FIGURE 19C

| 138514 | GAATGAGAAGTGGAGTCAGA | AGG | 21 |
|---|---|---|---|
| 139580 | CAGGTAGTACTCCTATTTCT | AGG | 21 |
| 139581 | AGTACTCCTTTCCTAGAAAT | AGG | 21 |
| 141151 | AAACAACAGGAACACACAGT | GGG | 21 |
| 141156 | TGGGTGGCAAATTCAGCCCA | GGG | 21 |
| 141507 | AATCAGAAAGGCCAGTCTCC | TGG | 21 |
| 141512 | AAAGGCCAGTCTCCTGGGGT | GGG | 21 |
| 141509 | TAGAACCCACCCCAGGAGAC | TGG | 21 |
| 141942 | CCAGCTGCTAGGAGTGCTGC | TGG | 21 |
| 141954 | TAGCGGCCCAGACTAAGACA | AGG | 21 |
| 142085 | CCAGTGCATGACTTGACACG | GGG | 21 |
| 142148 | GCATGCTCACCTCAATCTCA | GGG | 21 |
| 142901 | GGAAAGAAAGGGTATCGGAT | AGG | 21 |
| 143381 | GTTAGCTGGCTGTGATGGTG | TGG | 21 |
| 143418 | GAGGACGGGTCCAGACACAA | TGG | 21 |
| 144192 | GAGGGATGGTGGGAGACAGG | AGG | 21 |
| 144201 | AGGAAAGGAGGAAATGGAAG | AGG | 21 |
| 145652 | AACACAGTGATGAACAACTG | TGG | 21 |
| 146029 | GATGGAGAGGTCTAGCAATG | CGG | 21 |
| 146064 | ACATCTATCTGTACACTGCT | GGG | 21 |
| 146313 | GAAAGCGTATGAAAGGACAC | AGG | 21 |
| 146702 | GTTCCTCCAGTAACAGATTT | GGG | 21 |
| 146837 | TAGCTTTGTTGAATGAATGT | GGG | 21 |

FIGURE 19D

| 147207 | AGATGCAAGAGGAGAATCTG | TGG | 21 |
| --- | --- | --- | --- |
| 147385 | AATAATAAGAGCCAAGAAGT | AGG | 21 |
| 147386 | GCACTGGGCTGCCTACTTCT | TGG | 21 |
| 147395 | CAGCCCAGTGCAGAAGACAA | GGG | 21 |
| 148095 | ATCACAGCTGCATTTCTCCC | TGG | 21 |
| 148126 | GCTCCAGTGTCCCTGTCACA | TGG | 21 |
| 148129 | GAGGCTTCAGCCCATGTGAC | AGG | 21 |
| 148760 | GTAGGGTTAGTTTACTACTG | GGG | 21 |
| 149569 | AAATGCTAAGAAATTTAGAT | TGG | 21 |
| 149639 | CTGTGATCGGGATGATTGAG | AGG | 21 |
| 150481 | GCAAACAACGAGACAGCAGG | AGG | 21 |
| 150553 | TCTGGGAGTCTACTTGATCT | GGG | 21 |
| 150569 | GGTAAATGTGGCACAGGCAA | TGG | 21 |
| 150595 | AAAAAAGTAAGAGAGTGAGA | GGG | 21 |
| 150927 | CCATGATAGCAGCTGGGAGG | GGG | 21 |
| 151568 | AAGAGATGATGAGATTGTAC | AGG | 21 |
| 151593 | GTGGATGTCCAGCAGGGGTG | AGG | 21 |
| 151665 | CTGTACCCAAGTCCTCATCC | AGG | 21 |
| 152114 | TGATTGGATAAGAGCAACTT | TGG | 21 |
| 152120 | GATTACTCTGGCTGAAGAAT | AGG | 21 |
| 152347 | TACTTCAATATCTAAATATA | TGG | 21 |
| 152746 | AGTAGATCTGGAAAATCTAT | AGG | 21 |
| 153510 | AACTACCAAAAGGTTAAGAG | AGG | 21 |

FIGURE 19E

| | | | |
|---|---|---|---|
| 153549 | AAGGACCTGGCCTGGGACCA | GGG | 21 |
| 153980 | ATTGGAGGTGTCCTACCCAA | GGG | 21 |
| 153982 | ACCTTCTTCTCCCCTTGGGT | AGG | 21 |
| 154086 | AAGCTGGGGGATAAAGGTGT | TGG | 21 |
| 154381 | AAGGCTTGCATGGCAGATGG | AGG | 21 |
| 154967 | ACAAAACAAAACACAGGCTG | TGG | 21 |
| 154970 | AGGCTGTGGAGCTTGACATG | TGG | 21 |
| 155237 | AGTCTACAGATTGATGTCAA | TGG | 21 |
| 155531 | GCCAGCCATTGGCCAGGGGC | TGG | 21 |
| 155565 | TGCACAGCCAGCCCAGATGT | AGG | 21 |
| 155567 | CTCGCAGGAGCCCTACATCT | GGG | 21 |
| 155607 | TGTTGCATGACAACGGGATA | TGG | 21 |
| 136958 | AGTTACCGAAAGGGTTTTAC | TGG | 17 |
| 137226 | TATTGGGTCTTAACTGACTG | AGG | 17 |
| 137247 | CTTCTCCTCACCCAATGATT | GGG | 17 |
| 137249 | TTCCCACCACACCCAATCAT | TGG | 17 |
| 137301 | GACTCTGCAAGGAAGAGAGA | GGG | 17 |
| 137401 | GTGCATGACCATTATTTCCA | AGG | 17 |
| 137399 | TCTGCGCTCCTTGGAAATAA | TGG | 17 |
| 137474 | TACGTTCAAGAAGCTGGTCC | TGG | 17 |
| 137599 | TGTGGCTTCAGCAACAATGA | TGG | 17 |
| 137816 | CAGGGACAAGACCTCTTGAC | AGG | 17 |
| 137817 | CAGCCCCAGCTCCTGTCAAG | AGG | 17 |

FIGURE 19F

| | | | |
|---|---|---|---|
| 137910 | GAATGAGAAGAGCATTATAA | GGG | 17 |
| 138780 | AGTGCTACTCTGTTGAACAC | AGG | 17 |
| 139236 | CTGCATTGAGCAAGTCCGTC | GGG | 17 |
| 139370 | CCATCTCTCAGAATCCCATT | AGG | 17 |
| 139434 | ATTAGTTAGCAGAATTACGA | TGG | 17 |
| 139443 | TCAAGTTGAGAAGGGAAGCT | GGG | 17 |
| 139462 | GACATCATGTTGAAGGCCAT | GGG | 17 |
| 140845 | AGAGCTTGCATTCCCTCTAA | GGG | 17 |
| 140895 | AAGAGTCCTCCTAAGAGAGA | AGG | 17 |
| 140959 | GACATACTGACATACTTCTT | CGG | 17 |
| 140997 | TAACCAAAGGCCTCCGGAAG | TGG | 17 |
| 141058 | GAAGGCTGCAGGAAAGGCTA | GGG | 17 |
| 141081 | ATGTTTATGAGTGGGTGTGG | AGG | 17 |
| 141089 | GAGGAAGACAGCTGGGAAGA | AGG | 17 |
| 141511 | GAAAGGCCAGTCTCCTGGGG | TGG | 17 |
| 141792 | CTTATCAATGGCATTGCCTT | GGG | 17 |
| 141809 | CAAAAGTGGTACAAGCTAAC | TGG | 17 |
| 141993 | GAGGGCCCACTCCTGTTAAA | TGG | 17 |
| 141994 | CACCGAAGATGCCATTTAAC | AGG | 17 |
| 142090 | GTGCTAGGAAACGAAGAAAG | GGG | 17 |
| 142114 | ACTCCCTGAACGGTCAGCTG | AGG | 17 |
| 142133 | TGTTCTTGGGGTCAACGTGT | AGG | 17 |
| 142785 | TTAGAACAACCATAGAAGGA | GGG | 17 |

FIGURE 19G

| | | | | |
|---|---|---|---|---|
| 142843 | TGAACTCAGTGGGTTTATTT | GGG | | 17 |
| 142994 | CACAGGAAAAAAAGTCTTGC | TGG | | 17 |
| 143092 | TCTCATGTTGGAGATGACTG | GGG | | 17 |
| 143503 | GTGGAGAGGAGAGAGTAATT | TGG | | 17 |
| 144197 | GGAAATGGAAGAGGGATGGT | GGG | | 17 |
| 144641 | GAAGTTAAGGGTATATGATG | AGG | | 17 |
| 144649 | AGAGGAATTGTGATTCCATA | TGG | | 17 |
| 144695 | CTAGCATCCATTCTCTCTCC | TGG | | 17 |
| 145034 | GGTAGACTAGGCTACAGAAG | CGG | | 17 |
| 145201 | GATTGTGGTCAAGCCATCTC | TGG | | 17 |
| 145360 | ACAGTTGCCTAAGAACTGGT | GGG | | 17 |
| 145414 | GATGTTGGAGGTACCTGCTC | TGG | | 17 |
| 145582 | ACCAAGGTCCCAGAGTTCCT | AGG | | 17 |
| 145618 | CTTAAAAGAGGAATAATAAC | AGG | | 17 |
| 145933 | GGAAAGAAGAAAGTCAGGGA | GGG | | 17 |
| 146023 | ATTAGCTGAAGCATATTCAG | AGG | | 17 |
| 146056 | GTTCTTCAGGTGGTGCATGC | TGG | | 17 |
| 146058 | ACAGATAGATGTTCTTCAGG | TGG | | 17 |
| 146287 | ATGGAGAGAGGTAAGTCTGG | AGG | | 17 |
| 146372 | AATCCTCCAAAACCTAATAG | TGG | | 17 |
| 146603 | AGCCATTTCCCATGCTCCTT | AGG | | 17 |
| 146659 | AGTCTCTGAGGTGGTTAGAG | AGG | | 17 |
| 147672 | AAGTTAGACCTTAGTAAGTT | GGG | | 17 |

FIGURE 19H

| | | | |
|---|---|---|---|
| 147808 | AGCAATGGGAGCTCTTCAGT | GGG | 17 |
| 148065 | ATGCCAGTGCCTCTCTGTAG | TGG | 17 |
| 149010 | GTGGAAGAGAATTCAGGTAT | TGG | 17 |
| 149631 | GATGCCATGAAACATTCCTG | GGG | 17 |
| 150153 | ATGGCTTAATGCCCTTCCTG | GGG | 17 |
| 150155 | ACTCAACCTGCCCCCAGGAA | GGG | 17 |
| 150594 | GAAAAAAGTAAGAGAGTGAG | AGG | 17 |
| 150638 | AGAGGAAGTATGTAAAGAAA | TGG | 17 |
| 150669 | AGACTCTGATCCCCAGCTCA | AGG | 17 |
| 150672 | AGAGAAGGAACCCTTGAGCT | GGG | 17 |
| 150697 | CCTCATTCATTCCCAGGTAA | TGG | 17 |
| 150699 | TCATTGAATCCCCATTACCT | GGG | 17 |
| 150930 | TAGCCATGATAGCAGCTGGG | AGG | 17 |
| 151589 | TTAGTGGTGGATGTCCAGCA | GGG | 17 |
| 151604 | GACCCCCAAGATTTTGTTAC | TGG | 17 |
| 151652 | ATTTTTCTTATTGTTGTCTT | TGG | 17 |
| 151713 | CAGAGAATTCCCCTTGCCCC | CGG | 17 |
| 151715 | CACTATTCCTTCCGGGGGCA | AGG | 17 |
| 151726 | GTGGTTAAAAATATATCCAT | GGG | 17 |
| 151740 | GCTCACTCACTAAAACTTCA | AGG | 17 |
| 151769 | GGGAGCCATTCCCTTGACAT | GGG | 17 |
| 151771 | GCTGACAGCATCCCATGTCA | AGG | 17 |
| 151782 | GGCAAGTCTGAACTCACACA | GGG | 17 |

FIGURE 19I

| | | | |
|---|---|---|---|
| 151786 | CACTGCAGTTGCAGCTGCAG | TGG | 17 |
| 152068 | GGTTTATCAAGCCAAATGCC | TGG | 17 |
| 152070 | GAATAGAACACCCAGGCATT | TGG | 17 |
| 152071 | AGAACGCGAATAGAACACCC | AGG | 17 |
| 152082 | TTTATGTCCAATCAGTTACC | AGG | 17 |
| 152095 | TAAAGAAGTAATAAAGGGAA | TGG | 17 |
| 152125 | GGGTTTTAGAGGGATTACTC | TGG | 17 |
| 152256 | ATCCCTAGAATCTAACACAC | AGG | 17 |
| 152285 | ATGGCTTCTTATCCCCCTGA | TGG | 17 |
| 152521 | TACTGTAGTTAGAAGAAAAA | TGG | 17 |
| 152620 | TGGGACACTGGCTAGAGGAA | AGG | 17 |
| 153253 | AATTAAACTCAGGAGATGTG | GGG | 17 |
| 153496 | CCCCAAAGCACAACCCTAAC | TGG | 17 |
| 153548 | GAAGGACCTGGCCTGGGACC | AGG | 17 |
| 153550 | AGTAGGGGGTCCCTGGTCCC | AGG | 17 |
| 153632 | TCCTCAAAGTCTAATACGTC | AGG | 17 |
| 153961 | CTTATTAGCATGCCTCGTAT | AGG | 17 |
| 154101 | GCTGGGGAGGAGATTATCTC | TGG | 17 |
| 154107 | GCAGAGCAGGCTGGAAGCTG | GGG | 17 |
| 154132 | TACAGGCAGAGAAAGGACTC | AGG | 17 |
| 154177 | ACAGCCATGTCCCTTTATTT | AGG | 17 |
| 154179 | CACAGACAATACCTAAATAA | AGG | 17 |
| 154388 | AGGACTTTGCATGGGTCTGA | AGG | 17 |

FIGURE 19J

| | | | | |
|---|---|---|---|---|
| 154437 | TTCTAAGCTATAACATCCTC | GGG | | 17 |
| 154493 | GGCCAGCATCAGCATAACCT | AGG | | 17 |
| 154630 | TCTATACTTTGCGAAGAACT | GGG | | 17 |
| 154727 | CTAGCCTACAGGATGATGAG | TGG | | 17 |
| 155368 | TAAAAGAAGCCCTACAATCT | GGG | | 17 |
| 155456 | GGAGGACCACAAGCTGACTT | GGG | | 17 |
| 155498 | AGGAACAATGCACACATCCC | TGG | | 17 |
| 155545 | CTGGCTGGATCAGGAATACA | AGG | | 17 |
| 155554 | AGGCCCACTGCCTGCAATTC | AGG | | 17 |
| 155563 | CAGGAGCCCTACATCTGGGC | TGG | | 17 |
| 136516 | AACTCTGGTCATCTGTGACA | TGG | | 12 |
| 136766 | TGGTAGGGGTAGCAGATTGG | GGG | | 12 |
| 136837 | AGGAATCAATGCTATTTCTA | AGG | | 12 |
| 136867 | CACTAGCTGAGCAAAGATGG | AGG | | 12 |
| 136889 | AAATAGCAACCCTATGAAAT | AGG | | 12 |
| 137176 | ACAACCTGAGGTATTATGGT | AGG | | 12 |
| 137266 | AGAGCCTTCCTTGGGAGACA | TGG | | 12 |
| 137343 | CAAAAGTGAGTGTATTAGTC | AGG | | 12 |
| 137558 | GGCCTCAGGAAAAGCTGAAC | AGG | | 12 |
| 137584 | TAGGGAAACGACAAAGAAAG | TGG | | 12 |
| 137619 | TCCAAGGCTAGGATAGACTT | GGG | | 12 |
| 137729 | AGTGGCAGAACTTCTAACAT | AGG | | 12 |
| 137827 | GGAGCTGGGGCTGTGAGTAA | AGG | | 12 |

FIGURE 19K

| | | | |
|---|---|---|---|
| 137860 | GCCCAATGCTACTGCCATAT | TGG | 12 |
| 137992 | ACTACAATGAAGGGAAACAG | TGG | 12 |
| 138013 | TTACCTCACTCCCGTTAAAA | TGG | 12 |
| 138271 | GGGGCTTAAAACCTGGATGT | TGG | 12 |
| 138273 | TACTCATCAACCCAACATCC | AGG | 12 |
| 138437 | TACAGGCTCTTGCCTCAGTG | AGG | 12 |
| 138506 | ATCTCAAGGTAAAACTTCAG | CGG | 12 |
| 138604 | ACATATTCCTCAGGGCTCTT | GGG | 12 |
| 138609 | TCAGGGCTCTTGGGTGACCA | GGG | 12 |
| 138648 | AGCATAACCTGAAGGGCCCT | AGG | 12 |
| 138700 | ACTAACATCTAAGTTAATAA | AGG | 12 |
| 138819 | CAATGTCCTCTAAGTGTTCA | TGG | 12 |
| 138913 | CCACTCTGGACATCAGACTT | GGG | 12 |
| 139106 | TATTACATGATGCCGAGGTT | TGG | 12 |
| 139256 | AATTAATACTGAAAAAATTG | AGG | 12 |
| 139275 | TGTATAGATTCCTCTGAATA | GGG | 12 |
| 139290 | AGTGAAATGTAACTATTTGA | GGG | 12 |
| 139461 | GGACATCATGTTGAAGGCCA | TGG | 12 |
| 139635 | AAGACAGCAGAAGAGGGTTA | GGG | 12 |
| 139733 | CCCCTTATATGTACGTCCAA | AGG | 12 |
| 139846 | TACAGTATGACAGCTTTTAA | AGG | 12 |
| 139860 | GACATACTTGTCTATTCCCT | AGG | 12 |
| 139868 | TAATTCTTATCATATAAAAA | TGG | 12 |

FIGURE 19L

| | | | |
|---|---|---|---|
| 139879 | CACTTGCACTGCGGCATGAA | AGG | 12 |
| 139928 | ATAATGTAAACAGCTCGGTT | AGG | 12 |
| 140011 | AGACAGAATAGGTGTTACTG | AGG | 12 |
| 140741 | CAAGGAAGTGTTGATGGATT | TGG | 12 |
| 140764 | AATGAAGTTAGAGAAAGATG | AGG | 12 |
| 140839 | ACAAGCTAGAAACAATGTGT | TGG | 12 |
| 140844 | CAGAGCTTGCATTCCCTCTA | AGG | 12 |
| 140863 | TGCAGGCAGGCTCTAAAAGC | TGG | 12 |
| 140867 | GGCCAAGAGCCAAGAAATGC | AGG | 12 |
| 140883 | ATTGGAAGATGCTACACTAC | TGG | 12 |
| 140909 | TGATTACATTGGGCGCACTG | GGG | 12 |
| 140942 | GATATGGACATCTTTGGCGG | GGG | 12 |
| 140965 | CATACTTCTTCGGGTGGGTT | CGG | 12 |
| 140987 | ACCAGGCTCCTGTGTCCTTG | TGG | 12 |
| 140991 | CTGTGTCCTTGTGGCAGACA | TGG | 12 |
| 141158 | TACTGATTCATTCACATCCC | TGG | 12 |
| 141448 | CTGGCTTGTATGGGGGTAAT | AGG | 12 |
| 141451 | CATCTCCCTGGCTTGTATGG | GGG | 12 |
| 141452 | ACATCTCCCTGGCTTGTATG | GGG | 12 |
| 141510 | TCAGAAAGGCCAGTCTCCTG | GGG | 12 |
| 141553 | GTTATGGAACCTGTATTCTT | TGG | 12 |
| 141552 | GGCACCATTCCAAAGAATAC | AGG | 12 |
| 141580 | GAGAATATTCCAGAATCTAG | AGG | 12 |

FIGURE 19M

| | | | |
|---|---|---|---|
| 141599 | ATGACAACACCTGAGAGTGA | GGG | 12 |
| 141602 | ACACCTGAGAGTGAGGGTAT | GGG | 12 |
| 141719 | GATCATTGCCTCCCACCCTC | TGG | 12 |
| 141721 | CAGATGAGCCCCCAGAGGGT | GGG | 12 |
| 141733 | TGTCAGAGAGGAGAATATTT | TGG | 12 |
| 141753 | TTCTCTATTATTTCTTCCCT | GGG | 12 |
| 141937 | CAGCAGCACTCCTAGCAGCT | GGG | 12 |
| 141998 | ATCTTCGGTGTGTCCTTACA | TGG | 12 |
| 142058 | CCACGGGAATTTCCATAAGG | GGG | 12 |
| 142077 | CACTGGATGTGGGCTACTCC | AGG | 12 |
| 142092 | AAGTGCTAGGAAACGAAGAA | AGG | 12 |
| 142105 | CGTTCAGGGAGTTCTTAAGC | TGG | 12 |
| 142111 | AGGGCCTCAGCTGACCGTTC | AGG | 12 |
| 142127 | GGTCAACGTGTAGGGGCAGA | GGG | 12 |
| 142165 | GAAATCAGTCCCAAATGCCT | AGG | 12 |
| 142208 | AGACTTCCTGCATATCTCTC | AGG | 12 |
| 142225 | CAGACGACAGAGTGTGCCCA | AGG | 12 |
| 142461 | TCTCTAGAGCAACTGTCTGA | GGG | 12 |
| 142477 | TCACCATGATGTACCTACCA | GGG | 12 |
| 142519 | CTCTACACAAATGGTTTCCA | TGG | 12 |
| 142663 | TTTGCATGTACGATAATAAC | AGG | 12 |
| 142802 | CGAATGGCCATGTAAATATT | GGG | 12 |
| 142932 | TCCTAACTTCTAAGGATCTT | GGG | 12 |

FIGURE 19N

| 143098 | CTGGGGTTGGAGGAAAAAGT | TGG | 12 |
| --- | --- | --- | --- |
| 143100 | GAGGAAAAAGTTGGGACATA | CGG | 12 |
| 143105 | TGGAGGTGCTGCACTGACCC | TGG | 12 |
| 143397 | CCAGAAGTTCAAGAGCAACC | TGG | 12 |
| 143441 | ACTAGAAGAGGACATTTACT | GGG | 12 |
| 143485 | AGAAGTAGATTGTAGTGAGA | GGG | 12 |
| 143486 | AAGAAGTAGATTGTAGTGAG | AGG | 12 |
| 143963 | CCAACAAATGTACATGTCTC | TGG | 12 |
| 144017 | GTGTAAGAAGTTGAGGGGGG | TGG | 12 |
| 144076 | ATTGTCCCATCAATTCTTCC | AGG | 12 |
| 144074 | TATAGCCCTGGAAGAATTGA | TGG | 12 |
| 144117 | CCACACATTGCACTGTTACC | TGG | 12 |
| 144152 | ATCCTGAACACCTGGCCAAA | CGG | 12 |
| 144185 | GACAGGAGGGAGAAAGGTGG | AGG | 12 |
| 144235 | GGAAGGAAAGCAGGAAAAAG | GGG | 12 |
| 144269 | AAGGAAGGAGAGAACAAAGA | AGG | 12 |
| 144495 | GAACATGTAGAATAAGTTGG | AGG | 12 |
| 144548 | AGAGTCCAGTTCACCTTGTT | TGG | 12 |
| 144667 | TAAAACGAGAAGGGCAATCC | AGG | 12 |
| 144718 | CAGAGAAGTTGAAAACTATG | AGG | 12 |
| 144782 | TGAGCTGCCACTAAGTACCT | GGG | 12 |
| 144999 | GAGACTACTGAGCACATCAA | TGG | 12 |
| 145008 | GGACTCACAAACCCGTCACA | AGG | 12 |

FIGURE 19O

| | | | |
|---|---|---|---|
| 145009 | AGTCCACACTTCCTTGTGAC | GGG | 12 |
| 145022 | TATTATCTGGTAACTTCTGC | AGG | 12 |
| 145030 | AGCTATGTCAATGGTAGACT | AGG | 12 |
| 145086 | AGATAAACTTGGGCTCAGGT | AGG | 12 |
| 145106 | ACAATGTAACTTCAAAACCT | GGG | 12 |
| 145200 | AGGAAACGAAGATCCAGAGA | TGG | 12 |
| 145356 | AGAAACAGTTGCCTAAGAAC | TGG | 12 |
| 145357 | ACCATTTCCCACCAGTTCTT | AGG | 12 |
| 145408 | CTGCTCTGGCAGATTTCAAC | CGG | 12 |
| 145421 | ACCTCCAACATCAAGGAAGA | TGG | 12 |
| 145432 | GCAGTTTCCTTAGTAACCAC | AGG | 12 |
| 145444 | GAGTAGGAGCTAAAATATTT | TGG | 12 |
| 145583 | GTTCTCTGCCCTAGGAACTC | TGG | 12 |
| 145622 | TAACAGGGTAAATGTCATAA | GGG | 12 |
| 145658 | GTGGTGAGAAACTGGAGATA | AGG | 12 |
| 145697 | TTATCAGAGGTGAGTGGTGA | GGG | 12 |
| 145726 | GCTGCAAAAGACATCTCAAC | AGG | 12 |
| 145831 | AAGGAGCTAAATATCCAGAG | AGG | 12 |
| 145846 | GGAACTAACTGCAGAACACC | AGG | 12 |
| 145897 | ATGATCATTTCCACCTCATT | AGG | 12 |
| 145929 | AAGAAGGAAAGAAGAAAGTC | AGG | 12 |
| 145986 | GTCAGGAAGCCAGGCAGTAA | GGG | 12 |
| 146024 | GAAGCATATTCAGAGGATGA | TGG | 12 |

FIGURE 19P

| | | | | |
|---|---|---|---|---|
| 146033 | ATCTGCCCATGACTGGCGCA | GGG | | 12 |
| 146038 | TGAGATTATCTGCCCATGAC | TGG | | 12 |
| 146049 | GAAGAGAAGACCAGAAATAC | TGG | | 12 |
| 146073 | TACACTGCTGGGAAAGGGAG | GGG | | 12 |
| 146089 | TTGAGCACCTCCTATACTCC | AGG | | 12 |
| 146116 | TTAACAGCCACCCATTAGAA | TGG | | 12 |
| 146117 | CTCCATTCTTCCATTCTAAT | GGG | | 12 |
| 146118 | CCTCCATTCTTCCATTCTAA | TGG | | 12 |
| 146139 | TTTTCACGAGAAGATAATGG | AGG | | 12 |
| 146233 | ATTGGAGGCATCTTGAGGTA | AGG | | 12 |
| 146304 | AGAGAATGCACAATAGACAT | GGG | | 12 |
| 146312 | GAAAGGACACAGGTTTGAAA | TGG | | 12 |
| 146604 | GTTGTCATCCCTAAGGAGCA | TGG | | 12 |
| 146628 | GCCCAGGCATGAACAGACTT | GGG | | 12 |
| 146637 | CAAGATAGGGGCATAAGAAA | CGG | | 12 |
| 146883 | CTCCAATGTTGCTTACATGG | AGG | | 12 |
| 147001 | CCTTTACCAAACCATCTTCA | GGG | | 12 |
| 147002 | GATAACATCTACCCTGAAGA | TGG | | 12 |
| 147232 | TCCACTCCTTGAATATGGAT | TGG | | 12 |
| 147270 | GGTTATAAGTTGAGACGGTG | TGG | | 12 |
| 147320 | TTTGCGTACAAGTGTTTAAC | AGG | | 12 |
| 147407 | ACCACGCTATTGATGAAGGG | TGG | | 12 |
| 147489 | TAGCTTATCATCTCCTCTGG | TGG | | 12 |

FIGURE 19Q

| | | | | |
|---|---|---|---|---|
| 147575 | CATACCACTCTGGTGTGGAT | AGG | | 12 |
| 147648 | GTGAAAAGGTGTAGCCACTA | TGG | | 12 |
| 147762 | CCCATGTTGTAGCATAGGAA | AGG | | 12 |
| 147807 | GAGCAATGGGAGCTCTTCAG | TGG | | 12 |
| 148058 | TCCTCATTGCAATATTTGTG | GGG | | 12 |
| 148072 | GCTTCATCAAGATCCTCTTC | TGG | | 12 |
| 148097 | CTAGCCAAGAGCAGGCACCA | GGG | | 12 |
| 148101 | TCTTTGCACTAGCCAAGAGC | AGG | | 12 |
| 148167 | GTGTCAGAGATGAGATTCCT | TGG | | 12 |
| 148357 | ACAAAAGAGATCAAAATCAA | GGG | | 12 |
| 148568 | CATTCAAAGTAAATATTGAT | AGG | | 12 |
| 148759 | AGTAGGGTTAGTTTACTACT | GGG | | 12 |
| 148826 | ACTTGTGAAGATCTTCAGGA | AGG | | 12 |
| 148837 | ACATCTGGTAATATTAAGTT | GGG | | 12 |
| 148852 | GGCTATGGTTTGGGGGTTTT | GGG | | 12 |
| 148900 | AAATGTCTACTACATGTTTG | TGG | | 12 |
| 148978 | CAGGGGCTACAGATATGTAA | AGG | | 12 |
| 148996 | ACATCTGTGATGATACTGGT | AGG | | 12 |
| 148998 | TGTGATGATACTGGTAGGAT | AGG | | 12 |
| 149131 | ATTGATCCTATTGGGTAATT | GGG | | 12 |
| 149228 | TGCTCTCAACTCCTCACTGG | AGG | | 12 |
| 149230 | CTTGCACACTCCCTCCAGTG | AGG | | 12 |
| 149238 | AGTGTGCAAGCAAACGAGGT | GGG | | 12 |

FIGURE 19R

| | | | |
|---|---|---|---|
| 149424 | TAAGTTCCCACTTTGAGCTG | CGG | 12 |
| 149529 | GAAATAAAGAAATATACAGA | GGG | 12 |
| 149584 | AGACTACAGCACAGTTGGAC | TGG | 12 |
| 149648 | AAGTGGATGTGACCAGGGAA | TGG | 12 |
| 149702 | CCAAATGCTGAATAGCTGCA | TGG | 12 |
| 149772 | TCACTCCATTGGGGTGACAC | TGG | 12 |
| 149866 | GCAGTCATCTTGGAACCTGG | AGG | 12 |
| 150053 | AAGGATTGGTAATTTATCGT | GGG | 12 |
| 150104 | CCTGAACTAGAGATAATCAT | TGG | 12 |
| 150159 | TTAATGCCCTTCCTGGGGGC | AGG | 12 |
| 150160 | CAGTCACTCAACCTGCCCCC | AGG | 12 |
| 150290 | TGGTTTTTCAGTGATCTCTG | TGG | 12 |
| 150311 | CCTTTAAATAGTCTTACCCA | AGG | 12 |
| 150363 | TACTGAAGAGTACATGTGAC | AGG | 12 |
| 150696 | TGCCTTCCTCATTCATTCCC | AGG | 12 |
| 150693 | CCATTACCTGGGAATGAATG | AGG | 12 |
| 150856 | CTGTACCCCCCATTGTATCC | TGG | 12 |
| 150993 | TCTGCACTGTCCCAGCAGAG | AGG | 12 |
| 150995 | CTCATGGAAAACCTCTCTGC | TGG | 12 |
| 151042 | AGGCCTTAGTGGCTTACATG | TGG | 12 |
| 151439 | CGCTCCTTACCTCCCAAACT | AGG | 12 |
| 151520 | TTCACACAGCTAAGATGCAT | AGG | 12 |
| 151539 | TGCATAGTGTTACAAGTGAA | AGG | 12 |

FIGURE 19S

| | | | | |
|---|---|---|---|---|
| 151668 | CAGGGCCTGGATGAGGACTT | GGG | | 12 |
| 151725 | AGTGGTTAAAAATATATCCA | TGG | | 12 |
| 151767 | AGCATCCCATGTCAAGGGAA | TGG | | 12 |
| 151781 | AGGCAAGTCTGAACTCACAC | AGG | | 12 |
| 152083 | TTATGTCCAATCAGTTACCA | GGG | | 12 |
| 152080 | AACAGGCCCTGGTAACTGAT | TGG | | 12 |
| 152118 | CTGAAGAATAGGTAACTGAT | TGG | | 12 |
| 152166 | ATGGCTGAAGCACTGAGTTG | GGG | | 12 |
| 152167 | TATGGCTGAAGCACTGAGTT | GGG | | 12 |
| 152168 | GTATGGCTGAAGCACTGAGT | TGG | | 12 |
| 152286 | CAGGAGATGTCACCATCAGG | GGG | | 12 |
| 152572 | TGAGTGTGCATCCCTTGGTA | TGG | | 12 |
| 152573 | TCAGCAATAAGCCATACCAA | GGG | | 12 |
| 152583 | ATGAGTGGATAGACCTGCGT | GGG | | 12 |
| 152593 | AGTAAAACCCAGTGTGAGCA | AGG | | 12 |
| 152684 | TACCCTTTTGACGGCCGAAG | GGG | | 12 |
| 152841 | AGAATTGGTCCTAGAGTATA | TGG | | 12 |
| 152986 | CACATTCAAAGAGGTTGGAA | GGG | | 12 |
| 153008 | CATACAGCTTGAGGAATCTC | TGG | | 12 |
| 153023 | AGTTTTTCTTGTCTTTCAGC | TGG | | 12 |
| 153055 | TGTGCAGGTTCAAAGGAAAA | GGG | | 12 |
| 153173 | GCATGGGCTGGCAAGCACTT | TGG | | 12 |
| 153201 | CAAGACACAGTCAAGAATGA | GGG | | 12 |

FIGURE 19T

| | | | |
|---|---|---|---|
| 153427 | ACCCTACCGCTCAAAATGGA | AGG | 12 |
| 153533 | TGCTCACTGGTTAACAGGAA | AGG | 12 |
| 153581 | GGAGTGACAACAGAAAGCCC | TGG | 12 |
| 153608 | GAGTCTCTCCAGCTGCTCCA | AGG | 12 |
| 153682 | ACCACAACAGGAAAGGGTGT | GGG | 12 |
| 153901 | TAAATACAAATAATTCAATT | GGG | 12 |
| 153960 | ATCGGAAGGAAGCCTATACG | AGG | 12 |
| 153977 | TAGTGTGGAACATGCATTGG | AGG | 12 |
| 153991 | ACCCAAGGGGAGAAGAAGGT | GGG | 12 |
| 154109 | TTGCAGAGCAGGCTGGAAGC | TGG | 12 |
| 154113 | AGCTCTCCCACTTGCAGAGC | AGG | 12 |
| 154154 | GGCTGAGTGCTAAGGGGAAA | TGG | 12 |
| 154238 | TCAACTAGAAAACTCTGGGC | CGG | 12 |
| 154474 | CCTTGCTGCACACAGCAGAA | GGG | 12 |
| 154703 | GCAGTTTTCCAAGAGAGGGC | GGG | 12 |
| 154719 | ATCATCCTGTAGGCTAGATT | AGG | 12 |
| 154736 | GATATCTGACAGCTGGCTGT | TGG | 12 |
| 154973 | GCTAGAAAGCAAGCAAGCAA | GGG | 12 |
| 155109 | GACATAGGAGAAGACAAGAG | TGG | 12 |
| 155133 | TGAAAGATGAGTATCTCTCA | TGG | 12 |
| 155144 | ATCAGTGAGACTAGAGGAGT | GGG | 12 |
| 155190 | TATTGTCTATAGTGTGGTCA | GGG | 12 |
| 155200 | AGAACAACTAAGCAGGGAGA | TGG | 12 |

FIGURE 19U

| | | | |
|---|---|---|---|
| 155213 | TCTCAAATGTCAGTGTGCAC | AGG | 12 |
| 155215 | AGTGTGCACAGGATTCACCT | GGG | 12 |
| 155367 | ATGCACTGTCCCCAGATTGT | AGG | 12 |
| 155370 | TTAAAAGAAGCCCTACAATC | TGG | 12 |
| 155457 | GGGAGGACCACAAGCTGACT | TGG | 12 |
| 155532 | TCCAGCCAGCCATTGGCCAG | GGG | 12 |
| 155606 | GTTGCATGACAACGGGATAT | GGG | 12 |
| 136261 | TACTCAAGGCATTCAGACAG | TGG | 8 |
| 136286 | TTGACAGGTGAGAAATCTCA | GGG | 8 |
| 136406 | ATATGATGTTCTACCACATG | AGG | 8 |
| 136414 | TGAAGATGAAGAGATGAAAG | TGG | 8 |
| 136512 | AGAGTTTCACATTCTAACAC | TGG | 8 |
| 136534 | TGACTTCATCTGAGGTTTCT | GGG | 8 |
| 136536 | TTGACTTCATCTGAGGTTTC | TGG | 8 |
| 136558 | TCAGCACTAGGCACTATTCT | AGG | 8 |
| 136607 | AAAAGCTGTTCATTGTGGTC | AGG | 8 |
| 136633 | TGTGAAACCTGTTCTCTAGT | TGG | 8 |
| 136787 | AAAGGACCAGAGGTCATATG | AGG | 8 |
| 136800 | TGTTTGTTATGACTAAAGCT | AGG | 8 |
| 136827 | CATGGATTCTATCATTCTAG | AGG | 8 |
| 136865 | TTCCACTAGCTGAGCAAAGA | TGG | 8 |
| 136938 | TCAGAAGGTAAAAGAGTTTA | CGG | 8 |
| 136955 | TAGCCTTTCTAGTTACCGAA | AGG | 8 |

FIGURE 19V

| | | | |
|---|---|---|---|
| 136971 | TCTCACTGAGCATCTTCTTC | TGG | 8 |
| 136968 | GAAGAAGATGCTCAGTGAGA | TGG | 8 |
| 136981 | TTTGGCCACTCTATTTGGAG | AGG | 8 |
| 136988 | TAAGTGGAAGACAATGAGGA | TGG | 8 |
| 136992 | ATGAGAAGTGAGGAAGTAAG | TGG | 8 |
| 137018 | TGTTCTACTAGCACCTCCAT | CGG | 8 |
| 137089 | CAAAGTCAGGAAATTTAGCG | TGG | 8 |
| 137122 | GTGTTATAAAGTTCAAAGAA | AGG | 8 |
| 137148 | GTTGTGTCACTCATTGAGCT | AGG | 8 |
| 137168 | AACAAACGAGTAGTGATGAC | AGG | 8 |
| 137205 | CACTTGGGTATGAGGAGCAG | TGG | 8 |
| 137218 | TGGCCACCATGAGAATATGC | AGG | 8 |
| 137215 | AGGCCTGCATATTCTCATGG | TGG | 8 |
| 137246 | ACTTCTCCTCACCCAATGAT | TGG | 8 |
| 137248 | TCCCACCACACCCAATCATT | GGG | 8 |
| 137267 | GAGCCTTCCTTGGGAGACAT | GGG | 8 |
| 137264 | AAGAAGTCCCATGTCTCCCA | AGG | 8 |
| 137286 | CATCCCAGTGTGCGGTCTAG | TGG | 8 |
| 137316 | AACATCTCTTGCACCTTCCT | TGG | 8 |
| 137381 | CATCTTAAGAGGCCAGCCCA | TGG | 8 |
| 137407 | GGAGCGCAGAATTTAACTGG | AGG | 8 |
| 137444 | GAGATGGCAAAAGGAACTTT | GGG | 8 |
| 137445 | AGATGGCAAAAGGAACTTTG | GGG | 8 |

FIGURE 19W

| | | | |
|---|---|---|---|
| 137596 | ATCATTGTTGCTGAAGCCAC | AGG | 8 |
| 137629 | ATGTGTACTAGCTGAGTGCT | TGG | 8 |
| 137652 | TATGCTGTGATAGACTCTTT | TGG | 8 |
| 137774 | ATTATATTCTGAATCAGTCA | TGG | 8 |
| 137796 | CCTCAAGGCCTGAAAGGCTA | AGG | 8 |
| 137800 | AGGCCTGAAAGGCTAAGGGG | AGG | 8 |
| 137821 | CAAGACCTCTTGACAGGAGC | TGG | 8 |
| 137834 | GATGAGAGGAGAGTGAGTCG | AGG | 8 |
| 137855 | CATTGGGCTTGCTTGTCTAT | TGG | 8 |
| 137864 | GCCATATTGGTCAACCTCCT | AGG | 8 |
| 137862 | CCCTAGGAGGTTGACCAATA | TGG | 8 |
| 137881 | TATAAAAAAATAATAATAA | TGG | 8 |
| 137888 | TTGCTGAGAATTCCCATATG | TGG | 8 |
| 137894 | CAAAGACTTCATATCAAGTA | TGG | 8 |
| 137901 | CAGCTGAACTTTGGCAGATT | TGG | 8 |
| 137909 | AGAATGAGAAGAGCATTATA | AGG | 8 |
| 138252 | CGGGGCCTGTCAAGGGGTGA | GGG | 8 |
| 138257 | GTCAAGGGGTGAGGGGCAAG | GGG | 8 |
| 138272 | GGGCTTAAAACCTGGATGTT | GGG | 8 |
| 138392 | ACCAAACACACAATATTCCA | AGG | 8 |
| 138496 | TTATGGATGAGCAAAGATTG | TGG | 8 |
| 138518 | ATGAGAACCAGAATGAGAAG | TGG | 8 |
| 138569 | GGTGAGTCCACTGATGGATC | TGG | 8 |

FIGURE 19X

| | | | |
|---|---|---|---|
| 138574 | AAGGTATAGCTGCTATATTG | TGG | 8 |
| 138577 | TTAAATCATACATTTCATAA | AGG | 8 |
| 138735 | GGAAGCTGCAGCAGAAAAGT | TGG | 8 |
| 138741 | TGTGAATGCCGAGAGAGGTG | AGG | 8 |
| 138765 | TGTCTTAGTGGTCTGGATAG | AGG | 8 |
| 138851 | AAGGAGAGGAAGAGAGATGA | GGG | 8 |
| 138844 | TCATCTCTCTTCCTCTCCTT | GGG | 8 |
| 138854 | ATGAGGGAATGGCTGATCAG | TGG | 8 |
| 138907 | AAGCCTAGGAAACACCACTC | TGG | 8 |
| 138973 | CCAGTATGAATGGTGTGAGA | CGG | 8 |
| 139065 | TAGCTCCACATGAGAACACG | TGG | 8 |
| 139079 | GAAACGGAGGACTACTAGAG | TGG | 8 |
| 139104 | ATCATTTGTACTCCAAACCT | CGG | 8 |
| 139154 | GCTGCATGGGAGGCTGACAC | AGG | 8 |
| 139163 | CAGCCTCCCATGCAGCTGGC | AGG | 8 |
| 139164 | AGCCTCCCATGCAGCTGGCA | GGG | 8 |
| 139285 | TTGTAATTTATCTTCTGCTT | TGG | 8 |
| 139294 | AATTAGGAGGAGTATGTACC | AGG | 8 |
| 139330 | ACAGTAGGGAATGTGCCTCA | TGG | 8 |
| 139346 | AACTTTCAATGCAGTTGGGG | AGG | 8 |
| 139353 | CTGCGTGTGCGAGCATGCAT | GGG | 8 |
| 139383 | TTTATATGGGACCAGGTTCA | GGG | 8 |
| 139384 | TATGGCACCTTCCCTGAACC | TGG | 8 |

FIGURE 19Y

| | | | |
|---|---|---|---|
| 139389 | GTTCAGGGAAGGTGCCATAG | AGG | 8 |
| 139395 | CAACATGAACTGTAACTTAG | AGG | 8 |
| 139425 | CAGAGTGGTTGAGAAAGAGT | GGG | 8 |
| 139440 | GGCTGTGATCAAGTTGAGAA | GGG | 8 |
| 139450 | AAGCTGGGGCCAGAATGTGA | GGG | 8 |
| 139449 | TGTTCTGAGCCCTCACATTC | TGG | 8 |
| 139456 | GAACACTAGATGCCCAAATA | AGG | 8 |
| 139473 | GAAGAATGCCACAATAAAAG | TGG | 8 |
| 139482 | TTTTCCATTTCTTTCTTGGA | AGG | 8 |
| 139490 | GAGATACAAGAGGCTTTTCT | TGG | 8 |
| 139511 | GACAGTTTTTACAAGCAATG | GGG | 8 |
| 139538 | TTCTTACATTCCTACTCTAA | AGG | 8 |
| 139613 | CTACAGGTAGTATCAGCGAA | TGG | 8 |
| 139633 | GACAGCAGAAGAGGGTTAGG | GGG | 8 |
| 139644 | CCTCTTCTGCTGTCTTCACA | TGG | 8 |
| 139639 | CCATGTGAAGACAGCAGAAG | AGG | 8 |
| 139672 | TATAAGAATTCAAATACCTT | AGG | 8 |
| 139732 | AATGGTGTAATGGTTACCTT | TGG | 8 |
| 139752 | CATTTTCTCAGCAGTTGTCT | GGG | 8 |
| 139778 | CATTTGTGAAGATCATTTCT | TGG | 8 |
| 139792 | CTTGCAGTGAAGTGTTGCTG | GGG | 8 |
| 139832 | AAAGGCCACTGTGCTCCTAT | AGG | 8 |
| 139872 | AATGGGTCTACATTAGCACA | TGG | 8 |

FIGURE 19Z

| | | | |
|---|---|---|---|
| 139888 | GAAAGGAGCCCAGCTTGAGG | GGG | 8 |
| 139907 | AACTTTATGTACTGTTTGAT | AGG | 8 |
| 139994 | AATATAGCAGAAAGAGACAA | AGG | 8 |
| 140064 | GATATTTATTAAGGCCAAAC | TGG | 8 |
| 140071 | CATAAATGGATAGATATTAG | GGG | 8 |
| 140113 | GCTAGATATTGCACATGGGA | TGG | 8 |
| 140128 | GTAAGTACAGAACCATTGAG | GGG | 8 |
| 140129 | TGTAAGTACAGAACCATTGA | GGG | 8 |
| 140157 | ACACTGGAAAAGGAGGATAT | GGG | 8 |
| 140158 | AACACTGGAAAAGGAGGATA | TGG | 8 |
| 140724 | TAAGGAATAAGTGTTAGAAT | AGG | 8 |
| 140796 | CAAGGAATAAAAGTGGGGTC | TGG | 8 |
| 140859 | CAGGCTCTAAAAGCTGGAAA | AGG | 8 |
| 140870 | TGCCTGCATTTCTTGGCTCT | TGG | 8 |
| 140874 | GGCATTGAAGATGAAGGACA | GGG | 8 |
| 140899 | TCACCTCCTTCTCTCTTAGG | AGG | 8 |
| 140914 | CTTGACACGGAGAGATAGCC | TGG | 8 |
| 140961 | TACTGACATACTTCTTCGGG | TGG | 8 |
| 140993 | GGCAGACATGGTTTAACCAA | AGG | 8 |
| 141003 | AAGGCCTCCGGAAGTGGGAA | AGG | 8 |
| 141005 | AGTGGGAAAGGTGTATTGTT | GGG | 8 |
| 141015 | CCAAAAGACCATTTGAATTG | AGG | 8 |
| 141118 | CTTCTATTGTTACCATGGAG | AGG | 8 |

FIGURE 19AA

| | | | |
|---|---|---|---|
| 141131 | AGTAAAGGAGGTGGTGCAGA | GGG | 8 |
| 141134 | AGGAGGTGGTGCAGAGGGAG | AGG | 8 |
| 141135 | GGAGGTGGTGCAGAGGGAGA | GGG | 8 |
| 141150 | AAAACAACAGGAACACACAG | TGG | 8 |
| 141177 | TTTTCTGTTTTAGGATTGAG | GGG | 8 |
| 141178 | CTTTTCTGTTTTAGGATTGA | GGG | 8 |
| 141196 | CAGGTAAATGACCTTCAGAA | TGG | 8 |
| 141197 | TCCATCTACTGCCATTCTGA | AGG | 8 |
| 141317 | TACAAGTGAAGTCTATGGCA | TGG | 8 |
| 141453 | TACATCTCCCTGGCTTGTAT | GGG | 8 |
| 141465 | TCTTTGTATATATTGCAAAG | AGG | 8 |
| 141470 | TACAAAGAAATTTTTAGTTG | TGG | 8 |
| 141508 | ATCAGAAAGGCCAGTCTCCT | GGG | 8 |
| 141545 | TTCCTCATCTCTAGCTTGCT | AGG | 8 |
| 141571 | GTTGTCTGATGCCTTCTCTA | AGG | 8 |
| 141572 | GATGCAGTTAACCTTAGAGA | AGG | 8 |
| 141588 | CCGTATAAAAGGTTCAATCA | AGG | 8 |
| 141601 | AACACCTGAGAGTGAGGGTA | TGG | 8 |
| 141632 | TTAAAATAACCTCCACTATA | AGG | 8 |
| 141711 | CAGTCTCGTATCTGAACCCC | AGG | 8 |
| 141724 | CATTGCCTCCCACCCTCTGG | GGG | 8 |
| 141725 | AGCTCAGATGAGCCCCCAGA | GGG | 8 |
| 141726 | CAGCTCAGATGAGCCCCCAG | AGG | 8 |

FIGURE 19BB

| 141755 | TCTGTGAAAATAGATACCCA | GGG | | 8 |
| --- | --- | --- | --- | --- |
| 141789 | TAGAATCTGGCACTTATCAA | TGG | | 8 |
| 141798 | TGAAAGGGAGAAACTCAGAG | AGG | | 8 |
| 141804 | GGCGTTTTTCTTGTTTTGAA | AGG | | 8 |
| 141825 | GGTAAGCATCATGAATTTTA | TGG | | 8 |
| 141922 | TCATTTCCAAAGGGGAATCT | AGG | | 8 |
| 141935 | AGCAGCACTCCTAGCAGCTG | GGG | | 8 |
| 141953 | AGCGGCCCAGACTAAGACAA | GGG | | 8 |
| 141996 | CTCCTGTTAAATGGCATCTT | CGG | | 8 |
| 142009 | GGGAGGGCAAGGAAGCTTTC | TGG | | 8 |
| 142015 | TTTCTGGAGCCGCTTTTATA | AGG | | 8 |
| 142026 | GGGGGGTGATTAGGTCATGC | GGG | | 8 |
| 142072 | GCTAAAGTTCGTTGCCTTCC | TGG | | 8 |
| 142080 | TCAAGTCATGCACTGGATGT | GGG | | 8 |
| 142083 | ATCCAGTGCATGACTTGACA | CGG | | 8 |
| 142089 | AGGAAACGAAGAAAGGGGAC | TGG | | 8 |
| 142091 | AGTGCTAGGAAACGAAGAAA | GGG | | 8 |
| 142096 | AATGACCCTTCAGAAGTGCT | AGG | | 8 |
| 142132 | GTTCTTGGGGTCAACGTGTA | GGG | | 8 |
| 142146 | TGCATGCTCACCTCAATCTC | AGG | | 8 |
| 142162 | TCTTTAAGTAAGTAAACCCT | AGG | | 8 |
| 142192 | TGCTCCTTTATCAAGTACTT | GGG | | 8 |
| 142213 | GGGTCAAACACACCTGTTTG | TGG | | 8 |

FIGURE 19CC

| | | | |
|---|---|---|---|
| 142214 | GAAAGTCAGTGGCCACAAAC | AGG | 8 |
| 142231 | GGAGGGCACCTTCTGTTGAG | AGG | 8 |
| 142249 | ATAGATTCAAATTTTTCAGT | TGG | 8 |
| 142271 | ATTTGTACCATCAATTGGAA | AGG | 8 |
| 142322 | GAGGTTGGCATAACCATCAA | AGG | 8 |
| 142374 | TTAAAGCTTCTCTATATTTC | AGG | 8 |
| 142424 | TAAAATCTGGAAAGAGAATG | TGG | 8 |
| 142467 | TCAGACAGTTGCTCTAGAGA | AGG | 8 |
| 142462 | TTCTCTAGAGCAACTGTCTG | AGG | 8 |
| 142473 | AGGAATGGCTGCTTGGACCC | TGG | 8 |
| 142480 | GGACCCTGGTAGGTACATCA | TGG | 8 |
| 142483 | GGTAGGTACATCATGGTGAG | AGG | 8 |
| 142485 | TAATTTGTGAAGTTGTTACC | AGG | 8 |
| 142642 | TTCTGGACATGATTTCACAG | GGG | 8 |
| 142643 | ATTCTGGACATGATTTCACA | GGG | 8 |
| 142788 | AGGGCAATATCTACAAGTTT | GGG | 8 |
| 142792 | ATCTACAAGTTTGGGCCATG | GGG | 8 |
| 142820 | CAAGAAAGGCAACATTGGTA | AGG | 8 |
| 142830 | TTGATTATCATTGCTAGAAC | TGG | 8 |
| 142893 | GTGCATTATTAAGAGTATCT | TGG | 8 |
| 142904 | TTAGCTAAGAAGGAAAGAAA | GGG | 8 |
| 142926 | ATTGAGTGTTTTAACTGAAT | AGG | 8 |
| 142956 | TGGGGCTGCCAGAAAAGCAC | TGG | 8 |

FIGURE 19DD

| | | | | |
|---|---|---|---|---|
| 142964 | CAAACAGGAGCTGACACAGC | TGG | | 8 |
| 142982 | AGTACAGACATAGTGCCTGG | AGG | | 8 |
| 143124 | TGACAGCATTCTCACTACAG | TGG | | 8 |
| 143364 | CTGAGGTGACATGATCTCTT | GGG | | 8 |
| 143406 | CCAGGATGGAGGATCCCTTG | AGG | | 8 |
| 143455 | AAATCAAACTTGAGTAAGTG | TGG | | 8 |
| 143465 | TTTATGTAGAATTTCTCAGA | GGG | | 8 |
| 143531 | CATAGATTAACTTGATATGG | GGG | | 8 |
| 143626 | AACAAAAATTAAAAAGGGAT | AGG | | 8 |
| 143692 | GAGACACTAGAGTAATAATT | TGG | | 8 |
| 143724 | TAACATTACCCTAACATTAA | AGG | | 8 |
| 143947 | GTTGAAGATAATAGTGGATT | TGG | | 8 |
| 143964 | CCAGAGACATGTACATTTGT | TGG | | 8 |
| 144002 | GCAAACATGGTTTATTTCCA | TGG | | 8 |
| 144016 | GATGTGTAAGAAGTTGAGGG | GGG | | 8 |
| 144035 | TCCCAAGAGGTCTGGGGGTC | TGG | | 8 |
| 144057 | TGTAATAGCCACTTTCTGCT | GGG | | 8 |
| 144068 | ATGTGTGGGTAAAGTGGCAT | TGG | | 8 |
| 144069 | GGGACAATGTGTGGGTAAAG | TGG | | 8 |
| 144116 | CACACATTGCACTGTTACCT | GGG | | 8 |
| 144134 | CCAATCTGGAAAGGTCTTAC | TGG | | 8 |
| 144131 | CCAGTAAGACCTTTCCAGAT | TGG | | 8 |
| 144136 | ATCTGGAAAGGTCTTACTGG | AGG | | 8 |

FIGURE 19EE

| | | | |
|---|---|---|---|
| 144141 | TATTGAATAAAGAATTGAGT | TGG | 8 |
| 144183 | CAGGAGGGAGAAAGGTGGAG | GGG | 8 |
| 144199 | AGGAGGAAATGGAAGAGGGA | TGG | 8 |
| 144209 | AAGAGGACAAAAGAGGAGTG | AGG | 8 |
| 144212 | AATATTAAAGAGGACAAAAG | AGG | 8 |
| 144215 | ACAAGAAAGGAATATTAAAG | AGG | 8 |
| 144239 | AGGAAGAGAGGAAGGAAAGC | AGG | 8 |
| 144268 | AGGAAGGAGAGAACAAAGAA | GGG | 8 |
| 144278 | TAAATCTGACCCTTAAGGAA | AGG | 8 |
| 144357 | AATCAAGCAATACATACTAA | AGG | 8 |
| 144372 | CAAAGTCTAAAGCTAGTGAA | AGG | 8 |
| 144379 | ATGTCCTTATACCCCTTCTG | TGG | 8 |
| 144380 | TGAAATATTTGCCACAGAAG | GGG | 8 |
| 144414 | AATAAATGTGGATAGCTTGA | TGG | 8 |
| 144478 | CTGGGACGCATGTGGCTCAC | AGG | 8 |
| 144591 | AATCATTCTCTGATTAAATC | AGG | 8 |
| 144603 | TCCAGAGAGCTCTAATTGAT | AGG | 8 |
| 144632 | GAGGTTGAATAGAGAGGACT | GGG | 8 |
| 144638 | TGATGAGGAAGAAATTGATG | AGG | 8 |
| 144678 | CCAGGCATTAAAGAATGAGT | TGG | 8 |
| 144709 | TTGTGTGGGTGATGCTGTTG | GGG | 8 |
| 144711 | TATTGTGTGGGTGATGCTGT | TGG | 8 |
| 144712 | CAACTTCTCTGATATTGTGT | GGG | 8 |

FIGURE 19FF

| | | | | |
|---|---|---|---|---|
| 144713 | TCAACTTCTCTGATATTGTG | TGG | | 8 |
| 144721 | GTTGAAAACTATGAGGTTTA | AGG | | 8 |
| 144729 | AGATGTGAACTCAGGCAGTT | TGG | | 8 |
| 144732 | CAATGATGAGATGTGAACTC | AGG | | 8 |
| 144747 | TTACTGTGAGGTAGATAGAG | AGG | | 8 |
| 144790 | AGTGGCAGCTCAATAGAAGT | TGG | | 8 |
| 144814 | TAAGAAGGATAAGTAAGTAT | GGG | | 8 |
| 144860 | CCTATTCAGCAAGCAAGAGA | AGG | | 8 |
| 144853 | CTTCTCTTGCTTGCTGAATA | GGG | | 8 |
| 144979 | TTAAAGACGATCTCTGTGAG | GGG | | 8 |
| 145002 | GTTTGTGAGTCCAGCATTTA | GGG | | 8 |
| 145010 | AAGTCCACACTTCCTTGTGA | CGG | | 8 |
| 145063 | GTCATCAGGATTAAGTTGGT | TGG | | 8 |
| 145064 | GTTTGTCATCAGGATTAAGT | TGG | | 8 |
| 145083 | AGCTAGATAAACTTGGGCTC | AGG | | 8 |
| 145095 | TACTCAAGGTCACACAGCTT | GGG | | 8 |
| 145157 | GCAAGTAATAACACAAGCTT | AGG | | 8 |
| 145227 | AAGTGAGGCAGACAGAGTAA | GGG | | 8 |
| 145362 | GCCTAAGAACTGGTGGGAAA | TGG | | 8 |
| 145423 | GGAAGATGGCATTTCTAGTT | TGG | | 8 |
| 145495 | AAAGTTTTCAGACCTTGCCA | GGG | | 8 |
| 145585 | TTCTCTGCCCTAGGAACTCT | GGG | | 8 |
| 145587 | CCCTAGGAACTCTGGGACCT | TGG | | 8 |

FIGURE 19GG

| | | | | |
|---|---|---|---|---|
| 145581 | CCAAGGTCCCAGAGTTCCTA | GGG | | 8 |
| 145671 | GTCAGTCAAAAGTCCGTGTG | TGG | | 8 |
| 145700 | AGAGGTGAGTGGTGAGGGGA | AGG | | 8 |
| 145716 | AATTATTGGACTATGTAGTT | TGG | | 8 |
| 145729 | TCTCAACAGGAGACTCACAC | TGG | | 8 |
| 145786 | ATTGAAAGGCAGTAACAGTG | AGG | | 8 |
| 145808 | AGCATTTTGTGTCACAGTCC | AGG | | 8 |
| 145812 | CAGTCCAGGAGAAGAAATCA | TGG | | 8 |
| 145850 | ACCAGGCTGACTGGCAAATG | TGG | | 8 |
| 145860 | TAGATACACAAGGTATACTG | AGG | | 8 |
| 145930 | AGAAGGAAAGAAGAAAGTCA | GGG | | 8 |
| 145969 | CAAGGCAAGACAAGGCAGGA | AGG | | 8 |
| 145978 | AGGCAGGAAGGAAGGAAGTC | AGG | | 8 |
| 146006 | TCTTTTTGAGTCTCAGGCCC | TGG | | 8 |
| 146016 | TGATGACTAAATATGCCATT | GGG | | 8 |
| 146027 | ATATTCAGAGGATGATGGAG | AGG | | 8 |
| 146047 | GACCAGAAATACTGGCCTGA | CGG | | 8 |
| 146085 | CTTGCATCTTGCACATGTCC | TGG | | 8 |
| 146126 | CTAGAACACAAAACATGCCT | AGG | | 8 |
| 146155 | ATGTATGTGTGTGGGGTTGG | GGG | | 8 |
| 146156 | AATGTATGTGTGTGGGGTTG | GGG | | 8 |
| 146157 | AAATGTATGTGTGTGGGGTT | GGG | | 8 |
| 146178 | TAGCTCTGAATCAGAAAGCA | GGG | | 8 |

FIGURE 19HH

| | | | |
|---|---|---|---|
| 146226 | AAAGTAATGTTCACTGACAT | TGG | 8 |
| 146248 | TGAAAACAGTACCAATCTAA | TGG | 8 |
| 146249 | GTAACACAATTCCATTAGAT | TGG | 8 |
| 146262 | CTGACTGTAAGTACACTATG | TGG | 8 |
| 146274 | CCATACGAATGTAGAACATG | AGG | 8 |
| 146327 | GAGAAAATGAGATTTTTGTC | TGG | 8 |
| 146371 | CAAAATCTTGCACCACTATT | AGG | 8 |
| 146380 | AGGATTTTGAAAGTGTCTAG | AGG | 8 |
| 146584 | ATCCATAATCTAGAACGAAC | GGG | 8 |
| 146590 | TAGAATTTTCAATGATGTTC | TGG | 8 |
| 146607 | TCCCTAAGGAGCATGGGAAA | TGG | 8 |
| 146611 | AGGATTTCCGCCAGCTGGAG | GGG | 8 |
| 146621 | TTAAGATTAAATAGGGTACA | CGG | 8 |
| 146669 | TCTAACCACCTCAGAGACTA | AGG | 8 |
| 146670 | CTAACCACCTCAGAGACTAA | GGG | 8 |
| 146701 | GGTTCCTCCAGTAACAGATT | TGG | 8 |
| 146779 | TTTTGTTAATTAAAAGGTGT | TGG | 8 |
| 146798 | GAAAATTTAATTGGTTTCAG | GGG | 8 |
| 146859 | CCTGTTGACATGGAATGATA | AGG | 8 |
| 146885 | ATTCTCCAATGTTGCTTACA | TGG | 8 |
| 146982 | AAGAATCACTGAGTAAATGA | TGG | 8 |
| 146998 | CATCTACCCTGAAGATGGTT | TGG | 8 |
| 147019 | AGTGGTTAAGCACATTGTCT | TGG | 8 |

FIGURE 19II

| | | | |
|---|---|---|---|
| 147085 | CATATAATGTTAGTTATAGA | AGG | 8 |
| 147106 | ATTCTGATCCTACAATGCAC | AGG | 8 |
| 147121 | TTTTGGTTGTACATCTAGGA | GGG | 8 |
| 147126 | GTAATGTCAGGAGACATTTT | TGG | 8 |
| 147150 | GCAGCTATTTGAGAGGTGGG | TGG | 8 |
| 147151 | TAAGCAGCTATTTGAGAGGT | GGG | 8 |
| 147209 | GACAAAAGTGTAGATGCAAG | AGG | 8 |
| 147229 | GTTTCTCCACTCCTTGAATA | TGG | 8 |
| 147230 | ACTTGACCAATCCATATTCA | AGG | 8 |
| 147234 | ATTGGTCAAGTCACTTGTTT | CGG | 8 |
| 147262 | CTTGCCTGTAATTATTCATC | AGG | 8 |
| 147275 | ATATGTCTGGTATAACTTTT | TGG | 8 |
| 147299 | ATGATTCTTGATTCTGCTTG | GGG | 8 |
| 147338 | TCCAGCTGTGTTCTCTCTGC | TGG | 8 |
| 147402 | ACCACCCTTCATCAATAGCG | TGG | 8 |
| 147412 | TCTAGCTGGTTATACTCAAA | TGG | 8 |
| 147460 | GTCTAAATCTCTTATTTGTT | TGG | 8 |
| 147477 | AAGATCCTCTACCATGTGTC | AGG | 8 |
| 147478 | GCTTGTGAGGGCCTGACACA | TGG | 8 |
| 147480 | CTGGTGGATGAGGCTTGTGA | GGG | 8 |
| 147484 | ATCATCTCCTCTGGTGGATG | AGG | 8 |
| 147620 | TACTCAACATCGTCAATCAT | CGG | 8 |
| 147621 | ACTCAACATCGTCAATCATC | GGG | 8 |

FIGURE 19JJ

| | | | |
|---|---|---|---|
| 147622 | CTCAACATCGTCAATCATCG | GGG | 8 |
| 147668 | CAATCCCATTTCTGGGTGTA | CGG | 8 |
| 147666 | CTAACCGTACACCCAGAAAT | GGG | 8 |
| 147675 | GGTTAGTCCCCAACTTACTA | AGG | 8 |
| 147699 | ATACTCTCTTCTGACATATT | GGG | 8 |
| 147723 | GCAATGATGTTTGGTAGCTT | AGG | 8 |
| 147732 | GATGCTCATTGATTTACACT | GGG | 8 |
| 147744 | TTGCACACTCATATTAACTG | CGG | 8 |
| 147766 | TCCTTTCCTATGCTACAACA | TGG | 8 |
| 147767 | CCTTTCCTATGCTACAACAT | GGG | 8 |
| 147800 | ATTGCCAGTGCTGGGGTACA | GGG | 8 |
| 147803 | TGCTGGGGTACAGGGAGCAA | TGG | 8 |
| 148020 | TAAAAGGGAATTCATAGACC | AGG | 8 |
| 148051 | ATTGCAATGAGGATGCAAGT | AGG | 8 |
| 148074 | GGGTGCATCGACTCCAGAAG | AGG | 8 |
| 148123 | TGTGACAGGGACACTGGAGC | TGG | 8 |
| 148127 | AGGCTTCAGCCCATGTGACA | GGG | 8 |
| 148138 | CCTCAGTAGCAACTGCAGTG | TGG | 8 |
| 148146 | GGAAGTGAAGGAGGCAGTAT | TGG | 8 |
| 148150 | TGCTATTTATAAGGAAGTGA | AGG | 8 |
| 148171 | CATCTCTGACACCGTATCTC | TGG | 8 |
| 148172 | ACGTAAATAGACCAGAGATA | CGG | 8 |
| 148213 | ATCAGGCTGGCCTTGAACTC | CGG | 8 |

FIGURE 19KK

| | | | | |
|---|---|---|---|---|
| 148313 | TTCCAAGGTCATTATGAAGA | CGG | | 8 |
| 148356 | TACAAAAGAGATCAAAATCA | AGG | | 8 |
| 148372 | AGAATTTGAGATGGTTTGGC | AGG | | 8 |
| 148374 | AAAAAGAATTTGAGATGGTT | TGG | | 8 |
| 148382 | TAAATAAAACATGGTTTCAG | TGG | | 8 |
| 148411 | CTTCAGAAACCATTTACTGT | GGG | | 8 |
| 148413 | ACTTCAGAAACCATTTACTG | TGG | | 8 |
| 148417 | TCTTTCTGAATAAACAGAGT | TGG | | 8 |
| 148437 | AGGGGAAATCCCATCAGATC | AGG | | 8 |
| 148548 | AAGATGACGTGAGTCTCTTA | TGG | | 8 |
| 148558 | TCACCAGTCTAAAGATAGAG | TGG | | 8 |
| 148734 | CCACAGAAAATATATACATT | AGG | | 8 |
| 148773 | GACGTAAAAGTGGAATTGAA | GGG | | 8 |
| 148774 | AAGTGGAATTGAAGGGCATA | TGG | | 8 |
| 148789 | AATCTTCCCCTATTGACAAT | GGG | | 8 |
| 148792 | CTATTGACAATGGGGGCCTG | TGG | | 8 |
| 148867 | TCAAATGAGGACTAGATCCC | AGG | | 8 |
| 148922 | TTTAGCTATATCCAGCACAC | AGG | | 8 |
| 148923 | GAAGTTCTCAACCTGTGTGC | TGG | | 8 |
| 148984 | TGAAGATAGATATTCATGTC | AGG | | 8 |
| 149000 | GTGATGATACTGGTAGGATA | GGG | | 8 |
| 149001 | TGATACTGGTAGGATAGGGA | TGG | | 8 |
| 149006 | TAGGGATGGGGGCAAAACAA | AGG | | 8 |

FIGURE 19LL

| | | | | |
|---|---|---|---|---|
| 149011 | AGTAAAGTGGAAGAGAATTC | AGG | | 8 |
| 149058 | GTTTGGAAAGAAGACTGTAT | GGG | | 8 |
| 149064 | TGTAAGACTGAAATCAACAT | AGG | | 8 |
| 149113 | GTACTGGGAAACTACTGGGC | AGG | | 8 |
| 149121 | CCAGTACATGAAATTAGTAC | TGG | | 8 |
| 149123 | GTACATGAAATTAGTACTGG | AGG | | 8 |
| 149128 | TTGGGTGGTTCTAACATGTA | AGG | | 8 |
| 149221 | CAGTGAGGAGTTGAGAGCAG | TGG | | 8 |
| 149248 | TGAGCACTGGAGCAGCATCT | AGG | | 8 |
| 149310 | TAGATGCTGGACAAGAGCTC | AGG | | 8 |
| 149409 | GGGTGGGGTGGGGCCATGGG | TGG | | 8 |
| 149440 | TGAGGGTGGGGTTTTCGCTG | GGG | | 8 |
| 149470 | AGGTGCTCCTCAACGTACAA | TGG | | 8 |
| 149487 | GACCATGTTGAAGGTAGGCT | AGG | | 8 |
| 149522 | GATTTACAATGGTTCGGCTT | AGG | | 8 |
| 149538 | CAATTATCTCCTTTTGTCAA | GGG | | 8 |
| 149574 | TTTTCAAGATATAGAATTGT | CGG | | 8 |
| 149588 | GACTGGTTTAGACTAAAACT | AGG | | 8 |
| 149600 | TAGTATACGTCTAAAATCTT | GGG | | 8 |
| 149624 | CAATAATAGTATATTACTAT | TGG | | 8 |
| 149632 | ATCATCCCGATCACAGCCCC | AGG | | 8 |
| 149649 | CAAACAGCTAAGCCATTCCC | TGG | | 8 |
| 149706 | ATCATAATACAATATTGTCA | AGG | | 8 |

FIGURE 19MM

| | | | | |
|---|---|---|---|---|
| 149742 | AAGGATCAGAAACGAAATTT | AGG | | 8 |
| 149745 | ATTTAGTCATTCACATTGGG | AGG | | 8 |
| 149787 | AGAAAGCAGAATTTCAGAGT | GGG | | 8 |
| 149823 | TAATCTCATCCTCTTGGTTC | AGG | | 8 |
| 149857 | GATGACTGCCAGCAACAAAT | GGG | | 8 |
| 149858 | AGATGACTGCCAGCAACAAA | TGG | | 8 |
| 149863 | CTGGCAGTCATCTTGGAACC | TGG | | 8 |
| 149868 | CTCCTCACTAGTTGCCCTCC | AGG | | 8 |
| 149893 | AGCTCTGCTTGTACTTCATC | TGG | | 8 |
| 149900 | TCACATAACTGGAAGTTCAG | AGG | | 8 |
| 149950 | GGAGGACTAAGTAGGAAAAA | AGG | | 8 |
| 149992 | TGGTACCTACTAGTCTATCT | AGG | | 8 |
| 150154 | TGGCTTAATGCCCTTCCTGG | GGG | | 8 |
| 150156 | CACTCAACCTGCCCCCAGGA | AGG | | 8 |
| 150400 | AAGAATTGGAAGTGACCAAC | TGG | | 8 |
| 150415 | AGCTGAAGACAGGCGTGATG | TGG | | 8 |
| 150444 | GTACCATAGAAATTTTAAAA | GGG | | 8 |
| 150486 | GCTTGAGTGACAACTCCATG | TGG | | 8 |
| 150523 | CAGATATTCAGCAAACACAG | GGG | | 8 |
| 150598 | GAGTGAGAGGGTTGCAAGTT | GGG | | 8 |
| 150611 | TAGCCCTTAGCTCATTATGA | AGG | | 8 |
| 150607 | AAACCTTCATAATGAGCTAA | GGG | | 8 |
| 150608 | CAAACCTTCATAATGAGCTA | AGG | | 8 |

FIGURE 19NN

| | | | |
|---|---|---|---|
| 150616 | GGGAGCTAAGGAAATTTAGA | GGG | 8 |
| 150655 | GGAAACAAGGAGTACCAAAG | GGG | 8 |
| 150657 | CTGGAAACAAGGAGTACCAA | AGG | 8 |
| 150670 | GAGAAGGAACCCTTGAGCTG | GGG | 8 |
| 150691 | TACCTGGGAATGAATGAGGA | AGG | 8 |
| 150700 | TCATTCATTCCCAGGTAATG | GGG | 8 |
| 150725 | ATTCACCATTCTGCATGGCT | GGG | 8 |
| 150928 | GCCATGATAGCAGCTGGGAG | GGG | 8 |
| 151347 | CTTTGACCAATGATATGGTT | TGG | 8 |
| 151361 | TGGGGATCTAATGTACATTA | TGG | 8 |
| 151459 | CTGAAAAGTGAGTAGGTATG | AGG | 8 |
| 151490 | AGTAAGTAGTTCACAGTATC | TGG | 8 |
| 151492 | AGTTCACAGTATCTGGTATA | AGG | 8 |
| 151525 | TAGGAGAGAAGAAATGAATG | AGG | 8 |
| 151569 | AGAGATGATGAGATTGTACA | GGG | 8 |
| 151570 | GAGATGATGAGATTGTACAG | GGG | 8 |
| 151597 | CCAGCAGGGGTGAGGTGGGA | AGG | 8 |
| 151602 | CTATCCAGTAACAAAATCTT | GGG | 8 |
| 151608 | TTTGTTACTGGATAGCTAAG | TGG | 8 |
| 151618 | CTGAAGAAAGGAATATATCA | GGG | 8 |
| 151621 | GAAAGGAATATATCAGGGGA | AGG | 8 |
| 151639 | ATATGCAGTATGGAATACAG | AGG | 8 |
| 151659 | CTTTGGGTCCCCTGAAAACA | GGG | 8 |

FIGURE 19OO

| | | | |
|---|---|---|---|
| 151662 | GGTCCCCTGAAAACAGGGCC | TGG | 8 |
| 151672 | TTGGGTACAGATAGCTCATT | TGG | 8 |
| 151676 | TCATTTGGAAGCTGATCCCT | AGG | 8 |
| 151702 | GGTAATGCTTATGGACCATG | GGG | 8 |
| 151703 | CTGTCAAAATACAGTCCCCA | TGG | 8 |
| 151708 | GGGAATTCTCTGTGATTCTC | AGG | 8 |
| 151718 | GAATTCCCCTTGCCCCGGA | AGG | 8 |
| 151723 | TTTTTAACCACTATTCCTTC | CGG | 8 |
| 151730 | CCATGGGCTCCCATCTCCAT | TGG | 8 |
| 151727 | CCAATGGAGATGGGAGCCCA | TGG | 8 |
| 151746 | GAGAAAGCTCACAAAATCTG | TGG | 8 |
| 151764 | TTAGATAGAAAGTAGAAAAA | TGG | 8 |
| 151768 | TGGGAGCCATTCCCTTGACA | TGG | 8 |
| 151770 | CTGACAGCATCCCATGTCAA | GGG | 8 |
| 151776 | CATGGGATGCTGTCAGCTAA | AGG | 8 |
| 151791 | TGCAGCTGCAACTGCAGTGC | AGG | 8 |
| 151793 | GCAACTGCAGTGCAGGAAAA | TGG | 8 |
| 151799 | GCGTGTGACTCCAGGCACCA | GGG | 8 |
| 151802 | ACAATTGTAACAGATTCCCC | TGG | 8 |
| 151836 | GATGGAGGCGATTGTGCTGT | GGG | 8 |
| 151837 | AGATGGAGGCGATTGTGCTG | TGG | 8 |
| 152012 | CTTCTCCAGCCTAGATGTTT | AGG | 8 |
| 152060 | TGGTAGAAATTACTAAACTA | TGG | 8 |

FIGURE 19PP

| | | | |
|---|---|---|---|
| 152069 | GTTTATCAAGCCAAATGCCT | GGG | 8 |
| 152106 | GGAGGCTATTCCAGTGGTTC | AGG | 8 |
| 152131 | ACTAGTGACATGAGCATATT | TGG | 8 |
| 152150 | GAGGACATTCCAGATGATGC | TGG | 8 |
| 152181 | CAAGAGAAACAAGTAACAGT | TGG | 8 |
| 152184 | TGTTACTTGTTTCTCTTGCC | TGG | 8 |
| 152197 | TCTCCCTACTTGTTTGCCT | AGG | 8 |
| 152192 | TGTACCTAGGCAAACAAGTA | GGG | 8 |
| 152193 | GTGTACCTAGGCAAACAAGT | AGG | 8 |
| 152280 | AGTTAAGTCAAATAGTGTAC | TGG | 8 |
| 152281 | TCAAATAGTGTACTGGAAAA | TGG | 8 |
| 152287 | GCAGGAGATGTCACCATCAG | GGG | 8 |
| 152387 | ACACTCTTAAGAGTTGTACC | AGG | 8 |
| 152396 | ACCACTTACTTAGCATAGAA | TGG | 8 |
| 152414 | TCTTCTTAAGGCTTCCTCCA | GGG | 8 |
| 152422 | GAGGAAGCCTTAAGAAGATT | AGG | 8 |
| 152492 | ACTGTTTCAGCGGGAGGTAT | AGG | 8 |
| 152565 | ACACTCAAGGAATAAATTGG | AGG | 8 |
| 152590 | TCTCAATCCACTTGCATCCA | TGG | 8 |
| 152595 | ATCCATGGCCTTGCTCACAC | TGG | 8 |
| 152596 | TCCATGGCCTTGCTCACACT | GGG | 8 |
| 152611 | AGCCAAGAAGCATGCTTAAG | TGG | 8 |
| 152665 | GACTGGTTGAAATTGCAGAT | GGG | 8 |

FIGURE 19QQ

| 152677 | AGGAAACTCTACCCTTTTGA | CGG | | 8 |
| --- | --- | --- | --- | --- |
| 152683 | CTACCCTTTTGACGGCCGAA | GGG | | 8 |
| 152678 | GTCCCCTTCGGCCGTCAAAA | GGG | | 8 |
| 152731 | CAGCACTTCATTTAATCTTA | AGG | | 8 |
| 152827 | CATGCAAAACGGAAAAGAAA | GGG | | 8 |
| 152872 | ACTTAGTAGCTGGGTGTTTT | TGG | | 8 |
| 152867 | AAAAACACCCAGCTACTAAG | TGG | | 8 |
| 152896 | AGAATACTTGGCAAAATGCC | TGG | | 8 |
| 152906 | ACATACCTAATATTTATCTT | AGG | | 8 |
| 152943 | TTCATGTTTAACTCTCCTGG | AGG | | 8 |
| 152945 | CACTTCATGTTTAACTCTCC | TGG | | 8 |
| 152962 | CCATGCATTCAAATGTTCCT | TGG | | 8 |
| 152971 | CGCAAATCTCTATGATTCTG | GGG | | 8 |
| 152973 | ACGCAAATCTCTATGATTCT | GGG | | 8 |
| 152974 | GACGCAAATCTCTATGATTC | TGG | | 8 |
| 153076 | CTTGTCATACTGAAGTGAAT | GGG | | 8 |
| 153098 | AATGAAGGGACATTGGAGAT | TGG | | 8 |
| 153182 | AAAATACTGAAGATGAGAGA | AGG | | 8 |
| 153206 | GAATGAGGGTTTAAGGAGAT | AGG | | 8 |
| 153251 | GAAATTAAACTCAGGAGATG | TGG | | 8 |
| 153285 | GAATTAAAGCTAGACACACC | TGG | | 8 |
| 153298 | TTTATGATGTGACAGAGTCA | TGG | | 8 |
| 153333 | CTGTTTTGTTGCCAGACCAT | GGG | | 8 |

FIGURE 19RR

| | | | |
|---|---|---|---|
| 153335 | TCAGATGAGTCCCCATGGTC | TGG | 8 |
| 153434 | GCCTTCCATTTTGAGCGGTA | GGG | 8 |
| 153518 | AAGGGAACTTCATCACAAAA | TGG | 8 |
| 153541 | TAACCAGTGAGCATTGTTGA | AGG | 8 |
| 153539 | GGTCCTTCAACAATGCTCAC | TGG | 8 |
| 153552 | TGAAGGCAGTAGGGGGTCCC | TGG | 8 |
| 153553 | CTTTCCATGAAGGCAGTAGG | GGG | 8 |
| 153565 | CACTTCTCACACTCATCAGA | AGG | 8 |
| 153572 | GATGAGTGTGAGAAGTGCTG | GGG | 8 |
| 153577 | GTGCTGGGGCCTCACCAGCC | AGG | 8 |
| 153579 | TGCTGGGGCCTCACCAGCCA | GGG | 8 |
| 153576 | ACAGAAAGCCCTGGCTGGTG | AGG | 8 |
| 153580 | TGACAACAGAAAGCCCTGGC | TGG | 8 |
| 153588 | AGATGTGTCACACTGTAGAA | AGG | 8 |
| 153615 | TCCAAGGCCTTGCAGTATCT | TGG | 8 |
| 153683 | ATAGAAACATGGCAGGGGAG | GGG | 8 |
| 153741 | TATTTAAAGTATTATTGAAA | TGG | 8 |
| 153855 | GAGCTAGTCAGTGACAGAGT | GGG | 8 |
| 153856 | AGAGCTAGTCAGTGACAGAG | TGG | 8 |
| 153882 | TTACTCAAAAGGTATAACTG | TGG | 8 |
| 153908 | GAGCTGATCCCAGAAAGCCA | TGG | 8 |
| 153926 | CTGTCAGTTGTATCTCAGCA | GGG | 8 |
| 153933 | GATATATGAGAATACTGAAG | AGG | 8 |

FIGURE 19SS

| | | | | |
|---|---|---|---|---|
| 153946 | CTTCCCATTTTGGCAGAATC | TGG | | 8 |
| 153953 | TGGGAAGAAAGCCTACACAT | CGG | | 8 |
| 153954 | TAGGCTTCCTTCCGATGTGT | AGG | | 8 |
| 153990 | TACCCAAGGGGAGAAGAAGG | TGG | | 8 |
| 153985 | TCCCACCTTCTTCTCCCCTT | GGG | | 8 |
| 154090 | AACCAATGGACAAAAGCTGG | GGG | | 8 |
| 154092 | TTAACCAATGGACAAAAGCT | GGG | | 8 |
| 154093 | CTTAACCAATGGACAAAAGC | TGG | | 8 |
| 154115 | CTTCCAGCCTGCTCTGCAAG | TGG | | 8 |
| 154136 | AAGGACTCAGGAAGACTCAC | AGG | | 8 |
| 154149 | TATAGGAAGGCTGAGTGCTA | AGG | | 8 |
| 154152 | TAGGAAGGCTGAGTGCTAAG | GGG | | 8 |
| 154159 | GGAAATGGGTAGCCCACTAA | GGG | | 8 |
| 154160 | AGATAGATTTGACCCTTAGT | GGG | | 8 |
| 154193 | AAGCAGAAAATATCTAGTAT | CGG | | 8 |
| 154370 | TTCTCAGGCCCAGCAGCTTG | TGG | | 8 |
| 154415 | GCAGAGCTGTTCAGTGTTCC | TGG | | 8 |
| 154423 | TCTGCAGGGCAAATACTGCC | TGG | | 8 |
| 154439 | AAGCTATAACATCCTCGGGG | TGG | | 8 |
| 154441 | GCTATAACATCCTCGGGGTG | GGG | | 8 |
| 154456 | CCAGTGCTGTGAATGCTAAA | GGG | | 8 |
| 154467 | CCCTTCTGCTGTGTGCAGCA | AGG | | 8 |
| 154487 | GGTAGTAGTTCTCAAAGCAT | AGG | | 8 |

FIGURE 19TT

| | | | |
|---|---|---|---|
| 154491 | TTCCTAGGTTATGCTGATGC | TGG | 8 |
| 154494 | TGCATCTCTGAAAAGTTCCT | AGG | 8 |
| 154502 | CAGAGATGCAAGTCTTGGCT | GGG | 8 |
| 154613 | GTTTCTGATTTACTAGCTCT | GGG | 8 |
| 154647 | AAATCACTACATTGGGGAAA | AGG | 8 |
| 154661 | ATGCCACATCGCATATCAAA | GGG | 8 |
| 154695 | TACAAGACCTTCTGATGCCT | AGG | 8 |
| 154722 | TGAAGCCTAATCTAGCCTAC | AGG | 8 |
| 154966 | ACAGCCACAAAACAAAACAC | AGG | 8 |
| 154996 | TTTAAAGATTAAGGAGCCTG | AGG | 8 |
| 155084 | GCCCTCAGCTCAAAGCTGTT | TGG | 8 |
| 155094 | CATTCCCAGACTCTCCATAC | TGG | 8 |
| 155102 | CCATACTGGCAGCAATGTGG | AGG | 8 |
| 155153 | AACAAGATGACGGAATATTA | AGG | 8 |
| 155155 | CTGAAGTAGGAACAAGATGA | CGG | 8 |
| 155170 | ATTTCTGGGAAAATTATTCC | AGG | 8 |
| 155176 | AATTTTCCCAGAAATACACC | AGG | 8 |
| 155173 | AGTGAGCCTGGTGTATTTCT | GGG | 8 |
| 155174 | AAGTGAGCCTGGTGTATTTC | TGG | 8 |
| 155203 | TTACAGAGAACAACTAAGCA | GGG | 8 |
| 155216 | GTGTGCACAGGATTCACCTG | GGG | 8 |
| 155225 | GATTGTGATTCAGTGGGTCT | AGG | 8 |
| 155232 | TGTTAGACACACAGAATCTG | AGG | 8 |

FIGURE 19UU

| 155274 | TGTTTATAAGAAAAATACAT | TGG | | 8 |
|---|---|---|---|---|
| 155282 | GGATTTCGGCGCCCTGGTTT | TGG | | 8 |
| 155283 | GTAGGAAGGCTCCAAAACCA | GGG | | 8 |
| 155285 | GGTAGGAAGGCTCCAAAACC | AGG | | 8 |
| 155314 | GTTTTCTGGCTGTCTCTGGT | AGG | | 8 |
| 155323 | ACACCAATAAATGATAACAT | AGG | | 8 |
| 155326 | CAAACTATGCATATGCGCTG | AGG | | 8 |
| 155397 | ATGATTGAAGCATTAAAGCA | TGG | | 8 |
| 155430 | TCTCATGGCAATGTTAATGC | TGG | | 8 |
| 155438 | CCTTCTATCAACAACTGAAG | AGG | | 8 |
| 155458 | TCCTCCCCCAAGTCAGCTTG | TGG | | 8 |
| 155463 | CAAGAAAAGAAAAATGGAT | TGG | | 8 |
| 155494 | GTGTGCATTGTTCCTGAAGA | GGG | | 8 |
| 155515 | CAACTTGGACAAGTTTTCTG | AGG | | 8 |
| 155524 | GGCTGGCTGCTGCCTGAGAG | TGG | | 8 |
| 155530 | CTCAGGCAGCAGCCAGCCCC | TGG | | 8 |
| 155533 | AGCAGCCAGCCCCTGGCCAA | TGG | | 8 |
| 155535 | GATCCAGCCAGCCATTGGCC | AGG | | 8 |
| 155549 | TGAATTGCAGGCAGTGGGCC | TGG | | 8 |
| 155550 | TGTCCTGAATTGCAGGCAGT | GGG | | 8 |
| 155551 | CTGTCCTGAATTGCAGGCAG | TGG | | 8 |
| 155555 | GCAGAGCTGTCCTGAATTGC | AGG | | 8 |
| 155603 | GGGATATGGGGAGTGTTCTC | TGG | | 8 |

FIGURE 19VV

| 155608 | TCAAAGTGTTGCATGACAAC | GGG | 8 |

MATERIALS AND METHODS FOR TREATMENT OF DUCHENNE MUSCULAR DYSTROPHY

TECHNICAL FIELD

The present application provides materials and methods for treating a patient with Duchenne Muscular Dystrophy (DMD), both ex vivo and in vivo. In addition, the present application provides materials and methods for editing a dystrophin gene in a cell by genome editing.

RELATED APPLICATIONS

This application claims the benefit of U.S. Provisional Application No. 62/247,484 filed Oct. 28, 2015 and U.S. Provisional Application No. 62/324,064 filed Apr. 18, 2016, both of which are incorporated herein in their entirety by reference.

INCORPORATION BY REFERENCE OF SEQUENCE LISTING

This application contains a Sequence Listing in computer readable form (filename: 160101PCT sequence listing_ST25: 286,928,896 bytes—ASCII text file; created Oct. 28, 2016), which is incorporated herein by reference in its entirety and forms part of the disclosure.

BACKGROUND

Duchenne Muscular Dystrophy (DMD) is a severe X-linked recessive neuromuscular disorder effecting approximately 1 in 4,000 live male births. Patients are generally diagnosed by the age of 4, and wheel chair bound by the age of 10. Most patients do not live past the age of 25 due to cardiac and/or respiratory failure. Existing treatments are palliative at best. The most common treatment for DMD is steroids, which are used to slow the loss of muscle strength. However, because most DMD patients start receiving steroids early in life, the treatment delays puberty and further contributes to the patient's diminished quality of life.

DMD is caused by mutations in the dystrophin gene (Chromosome X: 31,117,228-33,344,609 (Genome Reference Consortium—GRCh38/hg38)). With a genomic region of over 2.2 megabases in length, dystrophin is the second largest human gene. The dystrophin gene contains 79 exons that are processed into an 11,000 base pair mRNA that is translated into a 427 kDa protein. Functionally, dystrophin acts as a linker between the actin filaments and the extracellular matrix within muscle fibers. The N-terminus of dystrophin is an actin-binding domain, while the C-terminus interacts with a transmembrane scaffold that anchors the muscle fiber to the extracellular matrix. Upon muscle contraction, dystrophin provides structural support that allows the muscle tissue to withstand mechanical force. DMD is caused by a wide variety of mutations within the dystrophin gene that result in premature stop codons and therefore a truncated dystrophin protein. Truncated dystrophin proteins do not contain the C-terminus, and therefore cannot provide the structural support necessary to withstand the stress of muscle contraction. As a result, the muscle fibers pull themselves apart, which leads to muscle wasting.

Becker Muscular Dystrophy (BMD) is a less severe form of muscular dystrophy compared to DMD. While BMD is also caused by mutations within the dystrophin gene, BMD mutations maintain the dystrophin reading frame. BMD dystrophin proteins contain internal deletions, but also retain portions of both the N and C termini. Therefore, the BMD dystrophin protein is shorter than the wild type protein, but can still function as a linker between the actin filaments and the extracellular matrix. In fact, depending on the size of the internal deletion, BMD patients may have only minor symptoms. As a result, most research efforts have been focused on converting the severe DMD phenotype to a less severe BMD phenotype.

Genome engineering refers to the strategies and techniques for the targeted, specific modification of the genetic information (genome) of living organisms. Genome engineering is a very active field of research because of the wide range of possible applications, particularly in the areas of human health; the correction of a gene carrying a harmful mutation, for example, to explore the function of a gene. Early technologies developed to insert a gene into a living cell, such as transgenesis, were often limited by the random nature of the insertion of the new sequence into the genome. The new gene was usually positioned blindly, and may have inactivated or disturbed the functioning of other genes, or even caused severe unwanted effects. Furthermore, these technologies generally offered no degree of reproducibility, as there was no guarantee that the new sequence would be inserted at the same place in two different cells. More recent genome engineering strategies, such as ZFNs, TALENs, HEs and MegaTALs, enable a specific area of the DNA to be modified, thereby increasing the precision of the correction or insertion compared to early technologies, and offering some degree of reproducibility. Despite this, such recent genome engineering strategies have limitations.

Multiple studies suggest that genome engineering would be an attractive strategy for treating DMD. One of the earliest approaches involved engineering a mini-dystrophin gene that is less than 4 kb and can be packaged into an adeno-associated virus (AAV) vector. This is a replacement gene therapy that has been tested experimentally in mouse (Wang, B., J. Li, and X. Xiao, Proc Natl Acad Sci USA, 2000. 97(25): p. 13714-9) (Watchko, J., et al., Hum Gene Ther, 2002. 13(12): p. 1451-60) and dog models (Wang, Z., et al., Mol Ther, 2012. 20(8): p. 1501-7), and a phase I clinical trial suggested that there are problems associated with an immune response to the non-self synthetic epitopes (Mendell, J. R., et al., N Engl J Med, 2010. 363(15): p. 1429-37).

More recently, oligo-mediated exon skipping was used to restore the reading frame in the cells of DMD patients. In this strategy, short oligos block splicing signals found in pre-mRNA and facilitate skipping of a single exon. Skipping of a single exon allows the transcriptional machinery to bypass the premature stop codon and produce a protein with intact N and C termini. Phase I/II clinical trials have shown that weekly injections of anti-sense oligos induce exon skipping and dystrophin positive fibers (Cirak, S., et al., Lancet, 2011. 378(9791): p. 595-605). However, the major limitation of this type of treatment is that it requires repeat dosing over the lifetime of the patient because the drug targets the pre-mRNA rather than the genomic locus. Ongoing Phase II/III clinical trials are evaluating delivery of exon skipping oligos via AAV for sustained expression, as well as delivery of multiple anti-sense oligos for facilitating multi-exon skipping strategies.

Despite efforts from researchers and medical professionals worldwide who have been trying to address DMD, and despite the promise of genome engineering approaches, there still remains a critical need for developing safe and effective treatments for DMD, which is among the most prevalent and debilitating genetic disorders.

SUMMARY

The present disclosure presents an approach to address the genetic basis of DMD. By using genome engineering tools to create permanent changes to the genome that can restore the dystrophin reading frame and restore the dystrophin protein activity with as few as a single treatment, the resulting therapy can correct the underlying genetic defect causing the disease.

Provided herein are cellular, ex vivo and in vivo methods for creating permanent changes to the genome by deleting, inserting, or replacing (deleting and inserting) one or more exons or aberrant intronic splice acceptor or donor sites in the dystrophin gene by genome editing and restoring the dystrophin reading frame and restoring the dystrophin protein activity, which can be used to treat Duchenne Muscular Dystrophy (DMD). Also provided herein are components, kits and compositions for performing such methods. Also, provided are cells produced by such methods.

Provided herein is a method for editing a dystrophin gene in a human cell by genome editing, the method comprising the step of introducing into the human cell one or more deoxyribonucleic acid (DNA) endonucleases to effect one or more single-strand breaks (SSBs) or double-strand breaks (DSBs) within or near the dystrophin gene that results in a permanent deletion, insertion, or replacement of one or more exons or aberrant intronic splice acceptor or donor sites within or near the dystrophin gene and results in restoration of the dystrophin reading frame and restoration of the dystrophin protein activity. The human cell can be a muscle cell or muscle precursor cell.

Also provided herein is an ex vivo method for treating a patient (e.g., a human) with Duchenne Muscular Dystrophy (DMD), the method comprising the steps of: i) creating a DMD patient specific induced pluripotent stem cell (iPSC); ii) editing within or near a dystrophin gene of the iPSC; iii) differentiating the genome-edited iPSC into a Pax7+ muscle progenitor cell; and iv) implanting the Pax7+ muscle progenitor cell into the patient.

The step of creating a patient specific induced pluripotent stem cell (iPSC) can comprise: a) isolating a somatic cell from the patient; and b) introducing a set of pluripotency-associated genes into the somatic cell to induce the somatic cell to become a pluripotent stem cell. The somatic cell can be a fibroblast. The set of pluripotency-associated genes is one or more of the genes selected from the group consisting of OCT4, SOX2, KLF4, Lin28, NANOG and cMYC.

The step of editing within or near a dystrophin gene of the iPSC can comprise introducing into the iPSC one or more deoxyribonucleic acid (DNA) endonucleases to effect one or more single-strand breaks (SSBs) or double-strand breaks (DSBs) within or near the dystrophin gene that results in a permanent deletion, insertion, or replacement of one or more exons or aberrant intronic splice acceptor or donor sites within or near the dystrophin gene and results in restoration of the dystrophin reading frame and restoration of the dystrophin protein activity.

The step of differentiating the genome-edited iPSC into a Pax7+ muscle progenitor cell can comprise contacting the genome-edited iPSC with specific media formulations, including small molecule drugs; transgene overexpression; or serum withdrawal.

The step of implanting the Pax7+ muscle progenitor cell into the patient can comprise implanting the Pax7+ muscle progenitor cell into the patient by local injection into the desired muscle.

Also provided herein is an in vivo method for treating a patient (e.g., a human) with Duchenne Muscular Dystrophy (DMD), the method comprising the step of editing a dystrophin gene in a cell of the patient. The cell can be a muscle cell or muscle precursor cell.

The step of editing a dystrophin in a cell of the patient can comprise introducing into the cell of the patient one or more deoxyribonucleic acid (DNA) endonucleases to effect one or more single-strand breaks (SSBs) or double-strand breaks (DSBs) within or near the dystrophin gene that results in a permanent deletion, insertion, or replacement of one or more exons or aberrant intronic splice acceptor or donor sites within or near the dystrophin gene and results in restoration of the dystrophin reading frame and restoration of the dystrophin protein activity.

The one or more DNA endonucleases can be a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombinant of the naturally occurring molecule thereof, a codon-optimized thereof, modified version thereof, and combinations of any of the foregoing.

The method can comprise introducing into the cell one or more polynucleotides encoding the one or more DNA endonucleases. The method can comprise introducing into the cell one or more ribonucleic acids (RNAs) encoding the one or more DNA endonucleases. The one or more polynucleotides or one or more RNAs can be one or more modified polynucleotides or one or more modified RNAs. The one or more DNA endonuclease can be one or more proteins or polypeptides.

The method can further comprise introducing into the cell one or more guide ribonucleic acids (gRNAs). The one or more gRNAs are single-molecule guide RNA (sgRNAs). The one or more gRNAs or one or more sgRNAs is one or more modified gRNAs or one or more modified sgRNAs. The one or more DNA endonucleases can be pre-complexed with one or more gRNAs or one or more sgRNAs.

The method can further comprise introducing into the cell a polynucleotide donor template comprising at least a portion of the wild-type dystrophin gene or cDNA. The at least a portion of the wild-type dystrophin gene or cDNA can include at least a part of exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA. The at least a portion of the wild-type dystrophin gene or cDNA can include exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA. The donor template can be a single or double stranded polynucleotide.

The method can further comprise introducing into the cell one or more guide ribonucleic acid (gRNAs). The one or more DNA endonucleases can be one or more Cas9 or Cpf1 endonucleases that effect a pair of single-strand breaks (SSBs) or double-strand breaks (DSBs), the first SSB or DSB break at a 5' locus and the second SSB or DSB break at a 3' locus, that results in a permanent deletion or replacement of one or more exons or aberrant intronic splice acceptor or donor sites between the 5' locus and the 3' locus within or near the dystrophin gene and results in restoration of the dystrophin reading frame and restoration of the dystrophin protein activity. One gRNA can create a pair of SSBs or DSBs. One gRNA can comprise a spacer sequence that is complementary to either the 5' locus, the 3' locus, or a segment between the 5' locus and 3' locus. A first gRNA can comprise a spacer sequence that is complementary to a segment of the 5' locus and the second gRNA can comprise a spacer sequence that is complementary to a segment of the 3' locus.

The one or more gRNAs can be one or more single-molecule guide RNAs (sgRNAs). The one or more gRNAs or one or more sgRNAs can be one or more modified gRNAs or one or more modified sgRNAs. The one or more DNA endonucleases can be pre-complexed with the one or more gRNAs or one or more sgRNAs.

There can be a deletion of the chromosomal DNA between the 5' locus and the 3' locus.

The deletion can be a single exon deletion. The single exon deletion can be a deletion of exon 2, exon 8, exon 43, exon 44, exon 45, exon 46, exon 50, exon 51, exon 52, or exon 53. The 5' locus can be proximal to a 5' boundary of a single exon selected from the group consisting of exon 2, exon 8, exon 43, exon 44, exon 45, exon 46, exon 50, exon 51, exon 52, and exon 53. The 3' locus can be proximal to a 3' boundary of a single exon selected from the group consisting of exon 2, exon 8, exon 43, exon 44, exon 45, exon 46, exon 50, exon 51, exon 52, and exon 53. The 5' locus can be proximal to a 5' boundary and the 3' locus can be proximal to the 3' boundary of a single exon selected from the group consisting of exon 2, exon 8, exon 43, exon 44, exon 45, exon 46, exon 50, exon 51, exon 52, and exon 53. Proximal to the boundary of the exon can include the surrounding splice donors and acceptors of the neighboring intron.

The deletion can be a multi-exon deletion. The multi-exon deletion can be a deletion of exons 45-53 or exons 45-55. The 5' locus can be proximal to a 5' boundary of multiple exons selected from the group consisting of exons 45-53 and exons 45-55. The 3' locus can be proximal to a 3' boundary of multiple exons selected from the group consisting of exons 45-53 and exons 45-55. The 5' locus can be proximal to a 5' boundary and a 3' locus can be proximal to the 3' boundary of multiple exons selected from the group consisting of exons 45-53 and exons 45-55. Proximal to the boundary of the exon can include the surrounding splice donors and acceptors of the neighboring intron.

There can be a replacement of the chromosomal DNA between the 5' locus and the 3' locus. The replacement can be a single exon replacement. The single exon replacement can be a replacement of exon 2, exon 8, exon 43, exon 44, exon 45, exon 46, exon 50, exon 51, exon 52, exon 53, or exon 70. The 5' locus can be proximal to a 5' boundary of a single exon selected from the group consisting of exon 2, exon 8, exon 43, exon 44, exon 45, exon 46, exon 50, exon 51, exon 52, exon 53, or exon 70. The 3' locus can be proximal to a 3' boundary of a single exon selected from the group consisting of exon 2, exon 8, exon 43, exon 44, exon 45, exon 46, exon 50, exon 51, exon 52, exon 53, or exon 70. The 5' locus can proximal to a 5' boundary and a 3' locus can be proximal to the 3' boundary of a single exon selected from the group consisting of exon 2, exon 8, exon 43, exon 44, exon 45, exon 46, exon 50, exon 51, exon 52, exon 53, or exon 70. Proximal to the boundary of the exon can include the surrounding splice donors and acceptors of the neighboring intron or neighboring exon.

The replacement can be a multi-exon replacement. The multi-exon replacement can be a replacement of exons 45-53 or exons 45-55. The 5' locus can be proximal to a 5' boundary of multiple exons selected from the group consisting of exons 45-53 or exons 45-55. The 3' locus can be proximal to a 3' boundary of multiple exons selected from the group consisting of exons 45-53 or exons 45-55. The 5' locus can proximal to a 5' boundary and a 3' locus can be proximal to the 3' boundary of multiple exons selected from the group consisting of exons 45-53 or exons 45-55. Proximal to the boundary of the exon can include the surrounding splice donors and acceptors of the neighboring intron or neighboring exon.

The method can further comprise introducing into the cell a polynucleotide donor template comprising at least a portion of the wild type dystrophin gene or cDNA and the replacement is by homology directed repair (HDR).

The at least a portion of the wild-type dystrophin gene or cDNA can include at least a part of exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA. The at least a portion of the wild-type dystrophin gene or cDNA can include exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

The method can further comprise introducing into the cell one guide ribonucleic acid (gRNA) and a polynucleotide donor template comprising at least a portion of the wild-type dystrophin gene. The one or more DNA endonucleases can be one or more Cas9 or Cpf1 endonucleases that effect one single-strand break (SSB) or double-strand break (DSB) at a locus within or near the dystrophin gene that facilitates insertion of a new sequence from the polynucleotide donor template into the chromosomal DNA at the locus that results in permanent insertion or correction of one or more exons or aberrant intronic splice acceptor or donor sites within or near the dystrophin gene and results in restoration of the dystrophin reading frame and restoration of the dystrophin protein activity. The gRNA can comprise a spacer sequence that is complementary to a segment of the locus.

The method can further comprise introducing into the cell one or more guide ribonucleic acid (gRNAs) and a polynucleotide donor template comprising at least a portion of the wild-type dystrophin gene. The one or more DNA endonucleases can be one or more Cas9 or Cpf1 endonucleases that effect a pair of single-strand breaks (SSBs) or double-strand breaks (DSBs), the first at a 5' locus and the second at a 3' locus, within or near the dystrophin gene that facilitates insertion of a new sequence from the polynucleotide donor template into the chromosomal DNA between the 5' locus and the 3' locus that results in a permanent insertion or correction of one or more exons or aberrant intronic splice acceptor or donor sites between the 5' locus and the 3' locus within or near the dystrophin gene and results in restoration of the dystrophin reading frame and restoration of the dystrophin protein activity.

One gRNA can create a pair of SSBs or DSBs. One gRNA can comprise a spacer sequence that is complementary to either the 5' locus, the 3' locus, or a segment between the 5' locus and the 3' locus. A first gRNA can comprise a spacer sequence that is complementary to a segment of the 5' locus and the second gRNA can comprise a spacer sequence that is complementary to a segment of the 3' locus.

The one or more gRNAs can be one or more single-molecule guide RNAs (sgRNAs). The one or more gRNAs or one or more sgRNAs can be one or more modified gRNAs or one or more modified sgRNAs. The one or more DNA endonucleases can be pre-complexed with the one or more gRNAs or one or more sgRNAs.

There can be an insertion between the 5' locus and the 3' locus.

The insertion can be a single exon insertion. The single exon insertion can be an insertion of exon 2, exon 8, exon 43, exon 44, exon 45, exon 46, exon 50, exon 51, exon 52, exon 53, or exon 70. The 5' locus or 3' locus can be proximal to a boundary of a single exon selected from the group consisting of exon 2, exon 8, exon 43, exon 44, exon 45, exon 46, exon 50, exon 51, exon 52, exon 53, and exon 70. Proximal to the boundary of the exon can include the surrounding splice donors and acceptors of the neighboring intron or neighboring exon.

The insertion can be a multi-exon insertion. The multi-exon insertion can be an insertion of exons 45-53 or exons 45-55. The 5' locus or 3' locus can be proximal to a boundary of multiple exons selected from the group consisting of exons 45-53 or exons 45-55. Proximal to the boundary of the exon can include the surrounding splice donors and acceptors of the neighboring intro.

The at least a portion of the wild-type dystrophin gene or cDNA can include at least a part of exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA. The at least a portion of the wild-type dystrophin gene or cDNA can include exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

The insertion or correction can be by homology directed repair (HDR).

The donor template can be a single or double stranded polynucleotide.

The Cas9 or Cpf1 mRNA, gRNA, and donor template can be each formulated into separate lipid nanoparticles or all co-formulated into a lipid nanoparticle.

The Cas9 or Cpf1 mRNA can be formulated into a lipid nanoparticle, and both the gRNA and donor template can be delivered to the cell by an adeno-associated virus (AAV) vector.

The Cas9 or Cpf1 mRNA can be formulated into a lipid nanoparticle, and the gRNA can be delivered to the cell by electroporation and donor template can be delivered to the cell by an adeno-associated virus (AAV) vector.

The dystrophin gene can be located on Chromosome X: 31,117,228-33,344,609 (Genome Reference Consortium—GRCh38/hg38).

Also provided herein is one or more guide ribonucleic acids (gRNAs) for editing a dystrophin gene in a cell from a patient with DMD. The one or more gRNAs and/or sgRNAs can comprise a spacer sequence selected from the group consisting of the nucleic acid sequences in SEQ ID Nos: 1-1,410,472 of the Sequence Listing. The one or more gRNAs can be one or more single-molecule guide RNAs (sgRNAs). The one or more gRNAs or one or more sgRNAs can be one or more modified gRNAs or one or more modified sgRNAs.

Provided herein are cells that have been modified by the preceding methods to permanently delete or correct one or more exons or aberrant intronic splice acceptor or donor sites within the dystrophin gene and restore the dystrophin reading frame and restore the dystrophin protein activity. Further provided herein are methods for ameliorating DMD by the administration of cells that have been modified by the preceding methods to a DMD patient.

It is understood that the inventions described in this specification are not limited to the examples summarized in this Summary. Various other aspects are described and exemplified herein.

BRIEF DESCRIPTION OF THE DRAWINGS

Various aspects of materials and methods for treatment of DMD disclosed and described in this specification can be better understood by reference to the accompanying figures, in which:

FIG. 4A describes the cutting efficiency of *S. pyogenes* gRNAs in HEK293 Ts targeting the splice acceptor of Exons 43, 44, 45, 46, 50, 51, 52, 53 and 55 of the dystrophin gene.

FIG. 4C describes the cutting efficiency of Cpf1 gRNAs in HEK293 Ts targeting the splice acceptors of Exons 43, 44, 45, 46, 50, 51, 52, 53 and 55 of the dystrophin gene.

FIGS. 5A-B describe cutting efficiencies and splice acceptor knock-out efficiencies of *S. pyogenes* gRNAs in HEK293 Ts targeting Exons 51, 45, 53, 44, 46, 52, 50, 43, and 55 of the dystrophin gene.

FIG. 6 describes cutting efficiencies and splice acceptor knock-out efficiencies of *N. meningitides* (NM), *S. thermophiles* (ST), and *S. aureus* (SA) gRNAs in HEK293 Ts targeting Exons 51, 45, 53, 44, 46, 52, 50, 43, and 55 of the dystrophin gene.

FIG. 10A, FIG. 10B, and FIG. 10C describe clonal analysis of clonal deletion events.

FIG. 11A and FIG. 11B describe sanger sequencing of Δ52 clones. SEQ ID NO: 1420000 corresponds to FIG. 11A. SEQ ID NO: 1420001 corresponds to FIG. 11B.

FIGS. 12A-E describe the cutting efficiencies of gRNAs selected via an in-vitro transcribed (IVT) gRNA screen.

FIG. 14A depicts a three primer PCR assay.

FIG. 14B depicts results from the three primer PCR assay.

FIG. 14C describes data generated from the three primer PCR assay.

FIGS. 19A-19VV describe the results of a large scale lentiviral screen.

BRIEF DESCRIPTION OF THE SEQUENCE LISTING

Figure 1A:
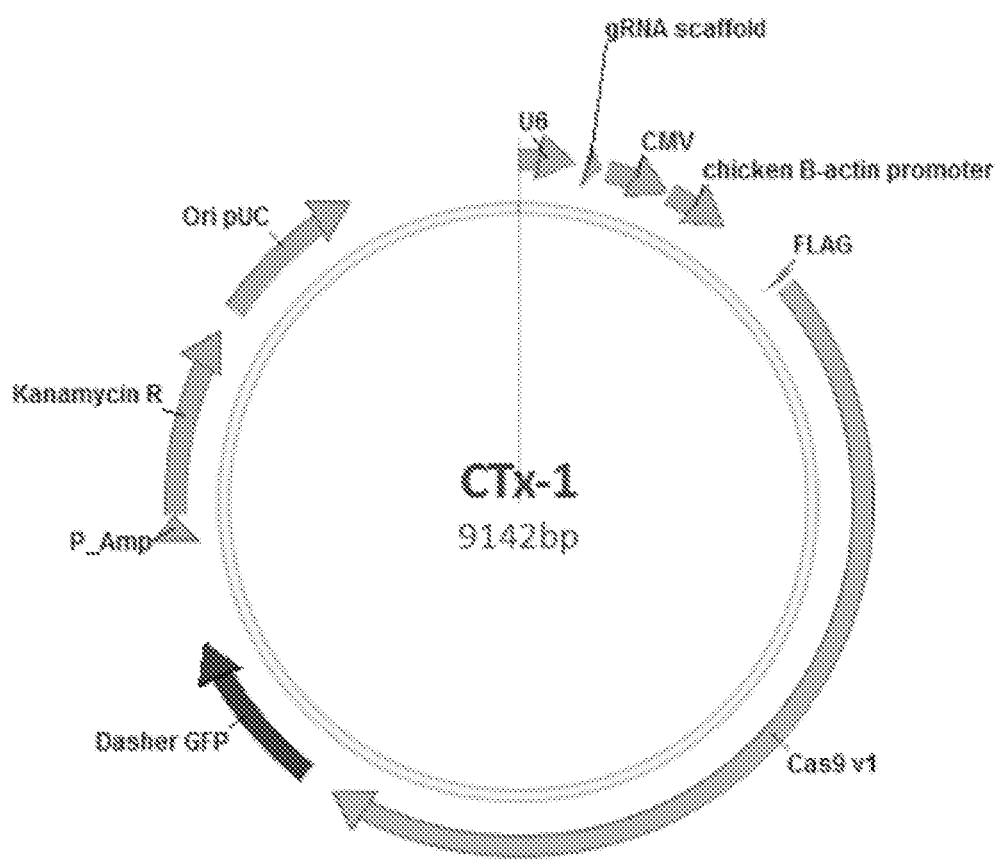
FIG. 1A is a plasmid (CTx-1) comprising a codon optimized gene for *S. pyogenes* Cas9 endonuclease. The CTx-1 plasmid also comprises a gRNA scaffold sequence, which includes a 20 bp spacer sequence from the sequences listed in SEQ ID NOs: 1-467,030 of the Sequence Listing or a 19 bp spacer sequence from the sequences listed in SEQ ID NOs: 1,410,430-1,410,472 of the Sequence Listing.

SEQ ID NOs: 1-467,030 is a list of gRNA 20 bp spacer sequences for targeting the dystrophin gene with a *S. pyogenes* Cas9 endonuclease.

SEQ ID NOs: 467,031-528,196 is a list of gRNA 20 bp spacer sequences for targeting the dystrophin gene with a *S. aureus* Cas9 endonuclease.

SEQ ID NOs: 528,197-553,198 is a list of gRNA 24 bp spacer sequences for targeting the dystrophin gene with a *S. thermophilus* Cas9 endonuclease.

SEQ ID NOs: 553,199-563,911 is a list of gRNA 24 bp spacer sequences for targeting the dystrophin gene with a *T. denticola* Cas9 endonuclease.

SEQ ID NOs: 563,912-627,854 is a list of gRNA 24 bp spacer sequences for targeting the dystrophin gene with a *N. meningitides* Cas9 endonuclease.

SEQ ID NOs: 627,855-1,410,399 is a list of gRNA 20-24 bp spacer sequences for targeting the dystrophin gene with an *Acidominoccocus*, a Lachnospiraceae, and a *Franciscella Novicida* Cpf1 endonuclease.

SEQ ID NOs: 1,410,400-1,410,402 is a list of gRNA 24 bp spacer sequences for targeting the dystrophin gene with a *N. meningitides* Cas9 endonuclease.

SEQ ID NOs: 1,410,403-1,410,429 is a list of gRNA 23 bp spacer sequences for targeting the dystrophin gene with an *Acidominoccocus*, a Lachnospiraceae, and a *Franciscella Novicida* Cpf1 endonuclease.

SEQ ID NOs: 1,410,430-1,410,472 is a list of gRNA 19 bp spacer sequences for targeting the dystrophin gene with a *S. pyogenes* Cas9 endonuclease.

DETAILED DESCRIPTION

Duchenne Muscular Dystrophy (DMD)

DMD is caused by mutations in the dystrophin gene (Chromosome X: 31,117,228-33,344,609 (Genome Reference Consortium—GRCh38/hg38)). With a genomic region of over 2.2 megabases in length, dystrophin is the second largest human gene. The dystrophin gene contains 79 exons that are processed into an 11,000 base pair mRNA that is translated into a 427 kDa protein. Functionally, dystrophin acts as a linker between the actin filaments and the extracellular matrix within muscle fibers. The N terminus of dystrophin is an actin-binding domain, while the C terminus interacts with a transmembrane scaffold that anchors the muscle fiber to the extracellular matrix. Upon muscle contraction, dystrophin provides structural support that allows the muscle tissue to withstand mechanical force. DMD is caused by a wide variety of mutations within the dystrophin gene that result in premature stop codons and therefore a truncated dystrophin protein. Truncated dystrophin proteins do not contain the C terminus, and therefore cannot provide the structural support necessary to withstand the stress of muscle contraction. As a result, the muscle fibers pull themselves apart, which leads to muscle wasting.

Therapeutic Approach

Provided herein are cellular, ex vivo and in vivo methods for using genome engineering tools to create permanent changes to the genome that can restore the dystrophin reading frame and restore dystrophin protein activity. Such methods use endonucleases, such as CRISPR/Cas9 nucleases, to permanently delete (excise), insert, or replace (delete and insert) exons (i.e., mutations in the coding and/or splicing sequences) in the genomic locus of the dystrophin gene. In this way, the present invention mimics the product produced by exon skipping, and/or restores the reading frame with as few as a single treatment (rather than deliver exon skipping oligos for the lifetime of the patient). Preclinical studies have been performed regarding expression of the C terminus of dystrophin by making targeted changes to the genome using Zinc-Finger-, TALE-, and CRISPR/Cas9-based nucleases. In one example, a large genomic region was deleted that is projected to treat over 60% of the patients with DMD.

Provided herein are methods for treating a patient with DMD. An example of such method is an ex vivo cell based therapy. For example, a DMD patient specific iPS cell line is created. Then, the chromosomal DNA of these iPS cells is corrected using the materials and methods described herein. Next, the corrected iPSCs are differentiated into Pax7+ muscle progenitor cells. Finally, the progenitor cells are implanted into the patient. There are many advantages to this ex vivo approach.

One advantage of an ex vivo cell therapy approach is the ability to conduct a comprehensive analysis of the therapeutic prior to administration. All nuclease based therapeutics have some level of off-target effects. Performing gene correction ex vivo allows one to fully characterize the corrected cell population prior to implantation. Aspects of the present disclosure include sequencing the entire genome of the corrected cells to ensure that the off-target cuts, if any, are in genomic locations associated with minimal risk to the patient. Furthermore, clonal populations of cells can be isolated prior to implantation.

Another advantage of ex vivo cell therapy relates to genetic correction in iPSCs compared to other primary cell sources. iPSCs are prolific, making it easy to obtain the large number of cells that will be required for a cell based therapy. Furthermore, iPSCs are an ideal cell type for performing clonal isolations. This allows screening for the correct genomic correction, without risking a decrease in viability. In contrast, other potential cell types, such as primary myoblasts, are viable for only a few passages and difficult to clonally expand. Also, patient specific DMD myoblasts will be unhealthy due to the lack of dystrophin protein. On the other hand, patient derived DMD iPSCs will not display a diseased phenotype, as they do not express dystrophin in this differentiation state. Therefore, manipulation of DMD iPSCs will be much easier, and will shorten the amount of time needed to make the desired genetic correction.

A further advantage of ex vivo cell therapy relates to implantation of myogenic Pax7+ progenitors versus myoblasts. Pax7+ cells are accepted as myogenic satellite cells. Pax7+ progenitors are mono-nuclear cells that sit on the periphery of the multi-nucleated muscle fibers. In response to injury, the progenitors divide and fuse to the existing fibers. In contrast, myoblasts fuse directly to the muscle fiber upon implantation and have minimal proliferative capacity in vivo. Therefore, myoblasts cannot aid in healing following repeated injury, while Pax7+ progenitors can function as a reservoir and help heal the muscle for the lifetime of the patient.

Another example of such method is an in vivo based therapy. In this method, the chromosomal DNA of the cells in the patient is corrected using the materials and methods described herein.

The advantage of in vivo gene therapy is the ease of therapeutic production and administration. The same therapeutic cocktail will have the potential to reach a subset of the DMD patient population (n>1). In contrast, the ex vivo cell therapy proposed requires a custom therapeutic to be developed for each patient (n=1). Ex vivo cell therapy development requires time, which certain advanced DMD patients may not have.

Also provided herein is a cellular method for editing the dystrophin gene in a human cell by genome editing. For example, a cell is isolated from a patient or animal. Then, the chromosomal DNA of the cell is corrected using the materials and methods described herein.

A number of types of genomic target sites can be present in addition to mutations in the coding and splicing sequences.

The regulation of transcription and translation implicates a number of different classes of sites that interact with cellular proteins or nucleotides. Often the DNA binding sites of transcription factors or other proteins can be targeted for mutation or deletion to study the role of the site, though they can also be targeted to change gene expression. Sites can be added through non-homologous end joining (NHEJ) or direct genome editing by homology directed repair (HDR). Increased use of genome sequencing, RNA expression and genome-wide studies of transcription factor binding have increased our ability to identify how the sites lead to developmental or temporal gene regulation. These control systems can be direct or can involve extensive cooperative regulation that can require the integration of activities from multiple enhancers. Transcription factors typically bind 6-12 bp-long degenerate DNA sequences. The low level of specificity provided by individual sites suggests that complex interactions and rules are involved in binding and the functional outcome. Binding sites with less degeneracy can provide simpler means of regulation. Artificial transcription factors can be designed to specify longer sequences that have less similar sequences in the genome and have lower potential for off-target cleavage. Any of these types of binding sites can be mutated, deleted or even created to enable changes in gene regulation or expression (Canver, M. C. et al., Nature (2015)).

Another class of gene regulatory regions having these features is microRNA (miRNA) binding sites. miRNAs are non-coding RNAs that play key roles in posttranscriptional gene regulation. miRNA can regulate the expression of 30% of all mammalian protein-encoding genes. Specific and potent gene silencing by double stranded RNA (RNAi) was discovered, plus additional small noncoding RNA (Canver, M. C. et al., Nature (2015)). The largest class of noncoding RNAs important for gene silencing are miRNAs. In mammals, miRNAs are first transcribed as long RNA transcripts, which can be separate transcriptional units, part of protein introns, or other transcripts. The long transcripts are called primary miRNA (pri-miRNA) that include imperfectly base-paired hairpin structures. These pri-miRNAs can be cleaved into one or more shorter precursor miRNAs (pre-miRNAs) by Microprocessor, a protein complex in the nucleus, involving Drosha.

Pre-miRNAs are short stem loops ~70 nucleotides in length with a 2-nucleotide 3'-overhang that are exported, into the mature 19-25 nucleotide miRNA:miRNA* duplexes. The miRNA strand with lower base pairing stability (the guide strand) can be loaded onto the RNA-induced silencing complex (RISC). The passenger guide strand (marked with *), can be functional, but is usually degraded. The mature miRNA tethers RISC to partly complementary sequence motifs in target mRNAs predominantly found within the 3' untranslated regions (UTRs) and induces posttranscriptional gene silencing (Bartel, D. P. Cell 136, 215-233 (2009); Saj, A. & Lai, E. C. Curr Opin Genet Dev 21, 504-510 (2011)).

miRNAs can be important in development, differentiation, cell cycle and growth control, and in virtually all biological pathways in mammals and other multicellular organisms. miRNAs can also be involved in cell cycle control, apoptosis and stem cell differentiation, hematopoiesis, hypoxia, muscle development, neurogenesis, insulin secretion, cholesterol metabolism, aging, viral replication and immune responses.

A single miRNA can target hundreds of different mRNA transcripts, while an individual transcript can be targeted by many different miRNAs. More than 28645 microRNAs have been annotated in the latest release of miRBase (v.21). Some miRNAs can be encoded by multiple loci, some of which can be expressed from tandemly co-transcribed clusters. The features allow for complex regulatory networks with multiple pathways and feedback controls. miRNAs can be integral parts of these feedback and regulatory circuits and can help regulate gene expression by keeping protein production within limits (Herranz, H. & Cohen, S. M. Genes Dev 24, 1339-1344 (2010); Posadas, D. M. & Carthew, R. W. Curr Opin Genet Dev 27, 1-6 (2014)).

miRNA can also be important in a large number of human diseases that are associated with abnormal miRNA expression. This association underscores the importance of the miRNA regulatory pathway. Recent miRNA deletion studies have linked miRNA with regulation of the immune responses (Stern-Ginossar, N. et al., Science 317, 376-381 (2007)).

miRNA also have a strong link to cancer and can play a role in different types of cancer. miRNAs have been found to be downregulated in a number of tumors. miRNA can be important in the regulation of key cancer-related pathways, such as cell cycle control and the DNA damage response, and can therefore be used in diagnosis and can be targeted clinically. MicroRNAs can delicately regulate the balance of angiogenesis, such that experiments depleting all microRNAs suppress tumor angiogenesis (Chen, S. et al., Genes Dev 28, 1054-1067 (2014)).

As has been shown for protein coding genes, miRNA genes can also be subject to epigenetic changes occurring with cancer. Many miRNA loci can be associated with CpG islands increasing their opportunity for regulation by DNA methylation (Weber, B., Stresemann, C., Brueckner, B. & Lyko, F. Cell Cycle 6, 1001-1005 (2007)). The majority of studies have used treatment with chromatin remodeling drugs to reveal epigenetically silenced miRNAs.

In addition to their role in RNA silencing, miRNA can also activate translation (Posadas, D. M. & Carthew, R. W. Curr Opin Genet Dev 27, 1-6 (2014)). Knocking out these sites can lead to decreased expression of the targeted gene, while introducing these sites can increase expression.

Individual miRNA can be knocked out most effectively by mutating the seed sequence (bases 2-8 of the microRNA), which can be important for binding specificity. Cleavage in this region, followed by mis-repair by NHEJ can effectively abolish miRNA function by blocking binding to target sites. miRNA could also be inhibited by specific targeting of the special loop region adjacent to the palindromic sequence. Catalytically inactive Cas9 can also be used to inhibit shRNA expression (Zhao, Y. et al., Sci Rep 4, 3943 (2014)). In addition to targeting the miRNA, the binding sites can also be targeted and mutated to prevent the silencing by miRNA.

Human Cells

For ameliorating DMD, as described and illustrated herein, the principal targets for gene editing are human cells. For example, in the ex vivo methods, the human cells can be somatic cells, which after being modified using the techniques as described, can give rise to Pax7+ muscle progenitor cells. For example, in the in vivo methods, the human cells can be muscle cells or muscle precursor cells.

By performing gene editing in autologous cells that are derived from and therefore already completely matched with the patient in need, it is possible to generate cells that can be safely re-introduced into the patient, and effectively give rise to a population of cells that can be effective in ameliorating one or more clinical conditions associated with the patient's disease.

Progenitor cells (also referred to as stem cells herein) are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one aspect, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell can derive from a multipotent cell that itself is derived from a multipotent cell, and so on. While each of these multipotent cells can be considered stem cells, the range of cell types that each can give rise to can vary considerably. Some differentiated cells also have the capacity to give rise to cells of greater developmental potential. Such capacity can be natural or may be induced artificially upon treatment with various factors. In many biological instances, stem cells can be also "multipotent" because they can produce progeny of more than one distinct cell type, but this is not required for "stem-ness."

Self-renewal can be another important aspect of the stem cell. In theory, self-renewal can occur by either of two major mechanisms. Stem cells can divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a myocyte progenitor cell), which in turn can differentiate into other types of precursor cells further down the pathway (such as a myocyte precursor), and then to an end-stage differentiated cell, such as a myocyte, which plays a characteristic role in a certain tissue type, and may or may not retain the capacity to proliferate further.

Induced Pluripotent Stem Cells

In some examples, the genetically engineered human cells described herein can be induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a progenitor cell to be administered to the subject (e.g., autologous cells). Because the progenitors are essentially derived from an autologous source, the risk of engraftment rejection or allergic response can be reduced compared to the use of cells from another subject or group of subjects. In addition, the use of iPSCs negates the need for cells obtained from an embryonic source. Thus, in one aspect, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

The term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. Reprogramming encompasses complete reversion of the differentiation state of a differentiated cell (e.g., a somatic cell) to a pluripotent state or a multipotent state. Reprogramming can encompass complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain examples described herein, reprogramming of a differentiated cell (e.g., a somatic cell) can cause the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a myogenic stem cell). Reprogramming is also distinct from promoting the self-renewal or proliferation of cells that are already pluripotent or multipotent, although the compositions and methods described herein can also be of use for such purposes, in some examples.

Many methods are known in the art that can be used to generate pluripotent stem cells from somatic cells. Any such method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, Cell 126(4): 663-76 (2006). iPSCs resemble ES cells, as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germ line transmission [see, e.g., Maherali and Hochedlinger, Cell Stem Cell. 3(6):595-605 (2008)], and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, Stem Cells Transl Med. 3(4):448-57 (2014); Barrett et al., Stem Cells Trans Med 3:1-6 sctm. 2014-0121 (2014); Focosi et al., Blood Cancer Journal 4: e211 (2014); and references cited therein. The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it may not be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., Cell Stem Cell, 7(5):618-30 (2010). Reprogramming can be achieved by introducing a combination of nucleic acids encoding stem cell-associated genes, including, for example, Oct-4 (also known as Oct-3/4 or Pouf51), Soxl, Sox2, Sox3, Sox 15, Sox 18, NANOG, Klfl, Klf2, Klf4, Klf5, NR5A2, c-Myc, 1-Myc, n-Myc, Rem2, Tert, and LIN28. Reprogramming using the methods and compositions described herein can further comprise introducing one or more of Oct-3/4, a member of the Sox family, a member of the Klf family, and a member of the Myc family to a somatic cell. The methods and compositions described herein can further comprise introducing one or more of each of Oct-4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one aspect the reprogramming is not effected by a method that alters the genome. Thus, in such examples, reprogramming can be achieved, e.g., without the use of viral or plasmid vectors.

The efficiency of reprogramming (i.e., the number of reprogrammed cells) derived from a population of starting cells can be enhanced by the addition of various agents, e.g., small molecules, as shown by Shi et al., Cell-Stem Cell 2:525-528 (2008); Huangfu et al., Nature Biotechnology 26(7):795-797 (2008) and Marson et al., Cell-Stem Cell 3: 132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(1,3-Dioxo-IH,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzam ides (e.g., CI-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-CI-UCHA (e.g., 6-(3-chlorophenylureido) caproic hydroxamic acid), AOE (2-amino-8-oxo-9, 10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers can be selected from the non-limiting group including SSEA3, SSEA4, CD9, Nanog, Fbxl5, Ecatl, Esgl, Eras, Gdf3, Fgf4, Cripto, Daxl, Zpf296, Slc2a3, Rexl, Utfl, and Natl. In one case, for example, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. Detection can involve, not only RT-PCR, but can also include detection of protein markers. Intracellular markers can be best identified via RT-PCR, or protein detection methods such as immunocytochemistry, while cell surface markers are readily identified, e.g., by immunocytochemistry.

The pluripotent stem cell character of isolated cells can be confirmed by tests evaluating the ability of the iPSCs to differentiate into cells of each of the three germ layers. As one example, teratoma formation in nude mice can be used to evaluate the pluripotent character of the isolated clones. The cells can be introduced into nude mice and histology and/or immunohistochemistry can be performed on a tumor arising from the cells. The growth of a tumor comprising cells from all three germ layers, for example, further indicates that the cells are pluripotent stem cells.

Creating DMD Patient Specific iPSCs

One step of the ex vivo methods of the present disclosure can involve creating a DMD patient specific iPS cell, DMD patient specific iPS cells, or a DMD patient specific iPS cell line. There are many established methods in the art for creating patient specific iPS cells, as described in Takahashi and Yamanaka 2006; Takahashi, Tanabe et al. 2007. In addition, differentiation of pluripotent cells toward the muscle lineage can be accomplished by technology developed by Anagenesis Biotechnologies, as described in International patent application publication numbers WO2013/030243 and WO2012/101114. For example, the creating step can comprise: a) isolating a somatic cell, such as a skin cell or fibroblast from the patient; and b) introducing a set of pluripotency-associated genes into the somatic cell in order to induce the cell to become a pluripotent stem cell. The set of pluripotency-associated genes can be one or more of the genes selected from the group consisting of OCT4, SOX2, KLF4, Lin28, NANOG, and cMYC.

Genome Editing

Genome editing generally refers to the process of modifying the nucleotide sequence of a genome, preferably in a precise or pre-determined manner. Examples of methods of genome editing described herein include methods of using site-directed nucleases to cut deoxyribonucleic acid (DNA) at precise target locations in the genome, thereby creating single-strand or double-strand DNA breaks at particular locations within the genome. Such breaks can be and regularly are repaired by natural, endogenous cellular processes, such as homology-directed repair (HDR) and non-homologous end-joining (NHEJ), as recently reviewed in Cox et al., Nature Medicine 21(2), 121-31 (2015). NHEJ directly joins the DNA ends resulting from a double-strand break, sometimes with the loss or addition of nucleotide sequence, which can disrupt or enhance gene expression. HDR utilizes a homologous sequence, or donor sequence, as a template for inserting a defined DNA sequence at the break point. The homologous sequence can be in the endogenous genome, such as a sister chromatid. Alternatively, the donor can be an exogenous nucleic acid, such as a plasmid, a single-strand oligonucleotide, a double-strand oligonucleotide, a duplex oligonucleotide or a virus, that has regions of high homology with the nuclease-cleaved locus, but which can also contain additional sequence or sequence changes including deletions that can be incorporated into the cleaved target locus. A third repair mechanism can be microhomology-mediated end joining (MMEJ), also referred to as "Alternative NHEJ", in which the genetic outcome is similar to NHEJ in that small deletions and insertions can occur at the cleavage site. MMEJ can make use of homologous sequences of a few basepairs flanking the DNA break site to drive a more favored DNA end joining repair outcome, and recent reports have further elucidated the molecular mechanism of this process; see, e.g., Cho and Greenberg, Nature 518, 174-76 (2015); Kent et al., Nature Structural and Molecular Biology, Adv. Online doi:10.1038/nsmb.2961 (2015); Mateos-Gomez et al., Nature 518, 254-57 (2015); Ceccaldi et al., Nature 528, 258-62 (2015). In some instances it may be possible to predict likely repair outcomes based on analysis of potential microhomologies at the site of the DNA break.

Each of these genome editing mechanisms can be used to create desired genomic alterations. A step in the genome editing process can be to create one or two DNA breaks, the latter as double-strand breaks or as two single-stranded breaks, in the target locus as close as near to the site of intended mutation. This can be achieved via the use of site-directed polypeptides, as described and illustrated herein.

Site-directed polypeptides, such as a DNA endonuclease, can introduce double-strand breaks or single-strand breaks in nucleic acids, e.g., genomic DNA. The double-strand break can stimulate a cell's endogenous DNA-repair pathways (e.g., homology-dependent repair or non-homologous end joining or alternative non-homologous end joining (A-NHEJ) or microhomology-mediated end joining). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template can comprise sequences that can be homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligonucleotide, single-strand oligonucleotide, double-stranded oligonucleotide, or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ in that small deletions and insertions can occur at the cleavage site. MMEJ can make use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination can be used to insert an exogenous polynucleotide sequence into the target nucleic acid cleavage site. An exogenous polynucleotide sequence is termed a donor polynucleotide (or donor or donor sequence or polynucleotide donor template) herein. The donor polynucleotide, a portion of the donor polynucleotide, a copy of the donor polynucleotide, or a portion of a copy of the donor polynucleotide can be inserted into the target nucleic acid cleavage site. The donor polynucleotide can be an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats." When expressed, the repeats can form secondary structures (e.g., hairpins) and/or comprise unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Type II CRISPR Systems crRNA biogenesis in a Type II CRISPR system in nature requires a trans-activating CRISPR RNA (tracrRNA). The tracrRNA can be modified by endogenous RNaseIII, and then hybridizes to a crRNA repeat in the pre-crRNA array. Endogenous RNaseIII can be recruited to cleave the pre-crRNA. Cleaved crRNAs can be subjected to exoribonuclease trimming to produce the mature crRNA form (e.g., 5' trimming). The tracrRNA can remain hybridized to the crRNA, and the tracrRNA and the crRNA associate with a site-directed polypeptide (e.g., Cas9). The crRNA of the crRNA-tracrRNA-Cas9 complex can guide the complex to a target nucleic acid to which the crRNA can hybridize. Hybridization of the crRNA to the target nucleic acid can activate Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., *Science*, 337(6096):816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays can be processed into mature crRNAs without the requirement of an additional trans-activating tracrRNA. The Type V CRISPR array can be processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems can start with 20-24 nucleotides of spacer sequence followed by about 22 nucleotides of direct repeat. Also, Cpf1 can utilize a T-rich protospacer-adjacent motif such that Cpf1-crRNA complexes efficiently cleave target DNA preceded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Figure 1B:
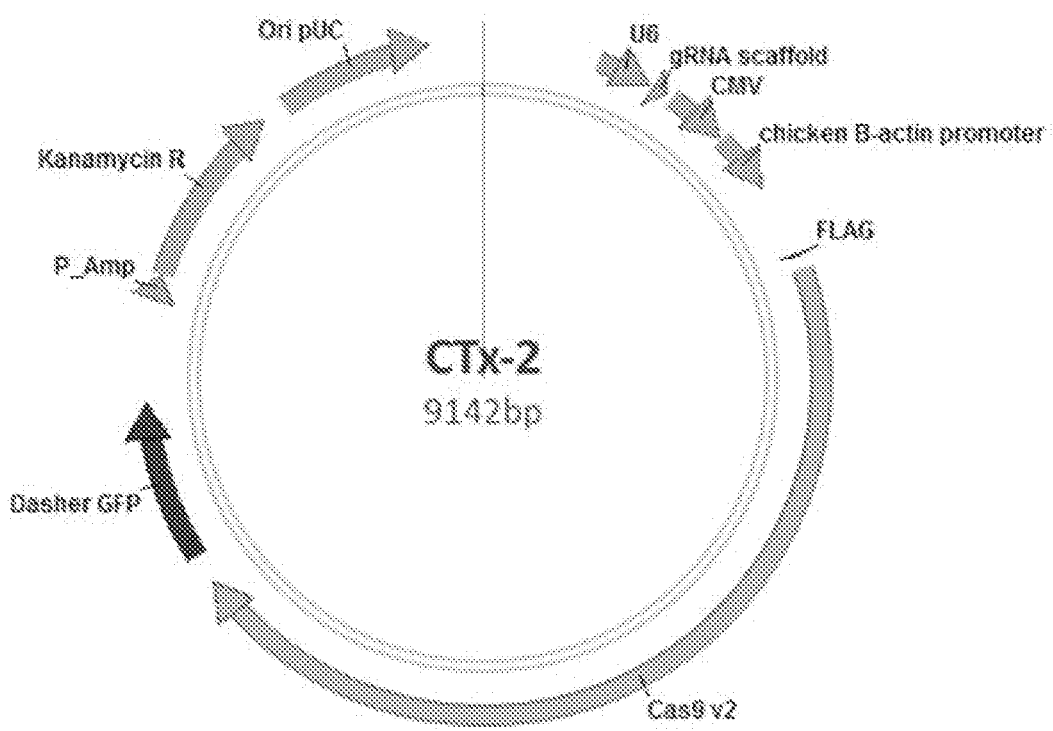
FIG. 1B is a plasmid (CTx-2) comprising a different codon optimized gene for *S. pyogenes* Cas9 endonuclease. The CTx-2 plasmid also comprises a gRNA scaffold sequence, which includes a 20 bp spacer sequence from the sequences listed in SEQ ID NOs: 1-467,030 of the Sequence Listing or a 19 bp spacer sequence from the sequences listed in SEQ ID NOs: 1,410,430-1,410,472 of the Sequence Listing.
Figure 1C:
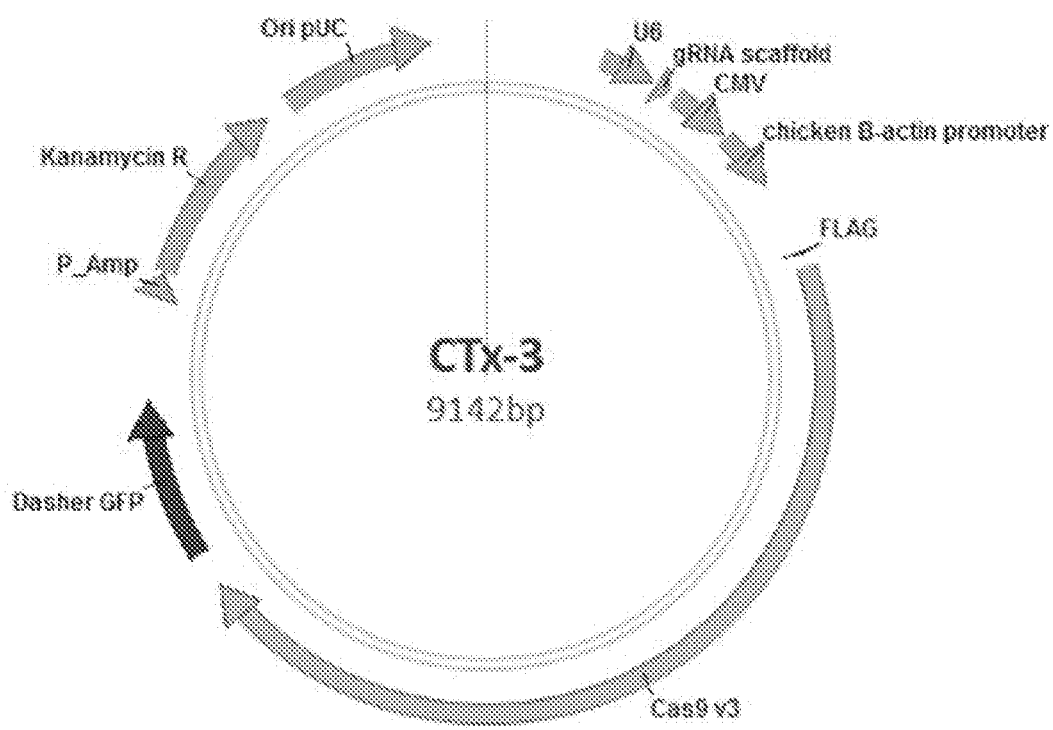
FIG. 1C is a plasmid (CTx-3) comprising yet another different codon optimized gene for *S. pyogenes* Cas9 endonuclease. The CTx-3 plasmid also comprises a gRNA scaffold sequence, which includes a 20 bp spacer sequence from the sequences listed in SEQ ID NOs: 1-467,030 of the Sequence Listing or a 19 bp spacer sequence from the sequences listed in SEQ ID NOs: 1,410,430-1,410,472 of the Sequence Listing.
Figure 2A:
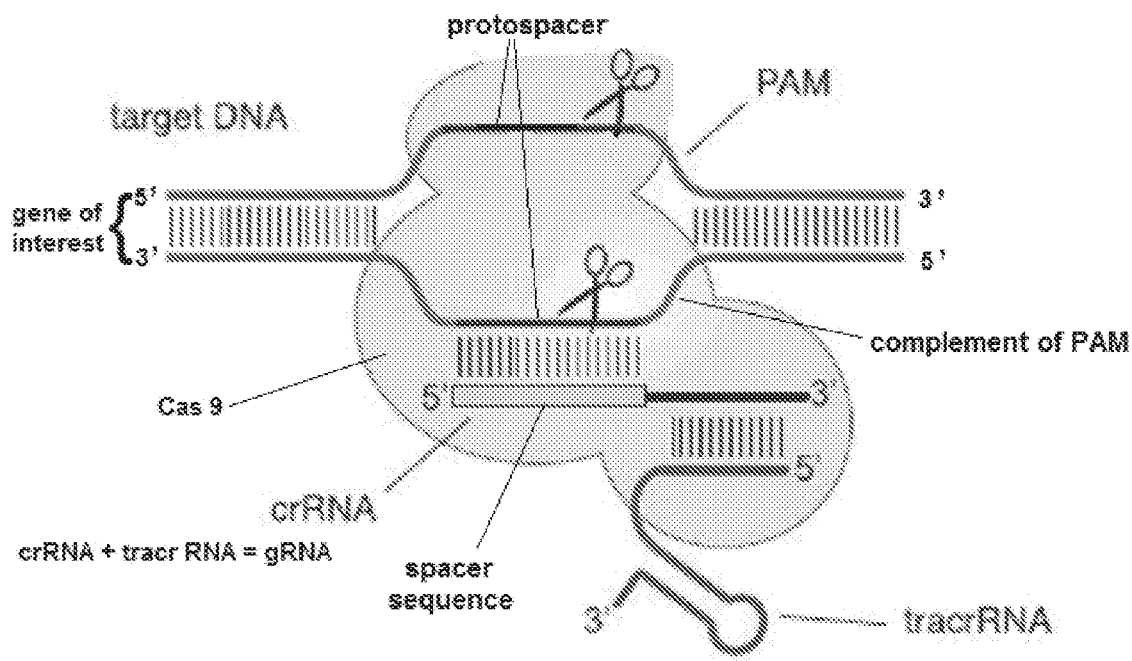
FIG. 2A is a depiction of the type II CRISPR/Cas system.
Figure 2B:
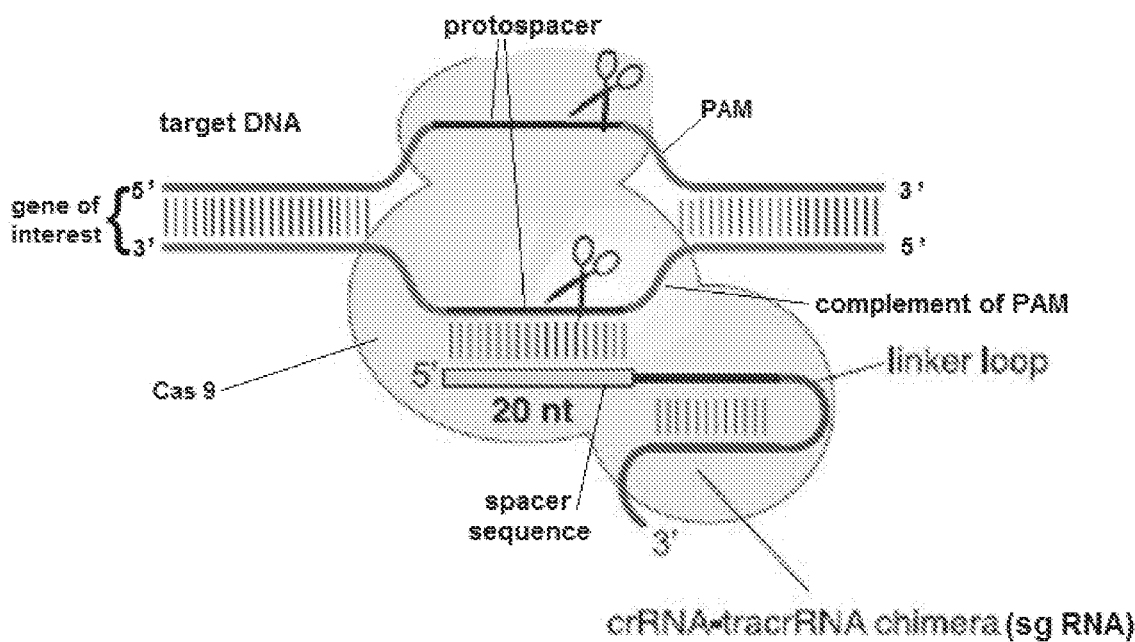
FIG. 2B is a depiction of the type II CRISPR/Cas system.

Exemplary CRISP R/Cas polypeptides include the Cas9 polypeptides in FIG. 1 of Fonfara et al., *Nucleic Acids Research*, 42: 2577-2590 (2014). The CRISPR/Cas gene naming system has undergone extensive rewriting since the Cas genes were discovered. FIG. 5 of Fonfara, supra, provides PAM sequences for the Cas9 polypeptides from various species.

Site-Directed Polypeptides

A site-directed polypeptide is a nuclease used in genome editing to cleave DNA. The site-directed can be administered to a cell or a patient as either: one or more polypeptides, or one or more mRNAs encoding the polypeptide.

In the context of a CRISP R/Cas or CRISPR/Cpf1 system, the site-directed polypeptide can bind to a guide RNA that, in turn, specifies the site in the target DNA to which the polypeptide is directed. In the CRISPR/Cas or CRISPR/Cpf1 systems disclosed herein, the site-directed polypeptide can be an endonuclease, such as a DNA endonuclease.

A site-directed polypeptide can comprise a plurality of nucleic acid-cleaving (i.e., nuclease) domains. Two or more nucleic acid-cleaving domains can be linked together via a linker. For example, the linker can comprise a flexible linker. Linkers can comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the "Cas9" refers to both naturally-occurring and recombinant Cas9s. Cas9 enzymes contemplated herein can comprise a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., a divalent cation binding site). RuvC/RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, e.g., genomic DNA. The double-strand break can stimulate a cell's endogenous DNA-repair pathways (e.g., homology-dependent repair (HDR) or non-homologous end joining (NHEJ) or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template can comprise sequences that are homologous to sequences flanking the target nucleic acid cleavage site. The sister chromatid can be used by the cell as the repair template. However, for the purposes of genome editing, the repair template can be supplied as an exogenous nucleic acid, such as a plasmid, duplex oligonucleotide, single-strand oligonucleotide or viral nucleic acid. With exogenous donor templates, an additional nucleic acid sequence (such as a transgene) or modification (such as a single or multiple base change or a deletion) can be introduced between the flanking regions of homology so that the additional or altered nucleic acid sequence also becomes incorporated into the target locus. MMEJ can result in a genetic outcome that is similar to NHEJ in that small deletions and insertions can occur at the cleavage site. MMEJ can make use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination is used to insert an exogenous polynucleotide sequence into the target nucleic acid cleavage site. An exogenous polynucleotide sequence is termed a donor polynucleotide (or donor or donor sequence) herein. The donor polynucleotide, a portion of the donor polynucleotide, a copy of the donor polynucleotide, or a portion of a copy of the donor polynucleotide can be inserted into the target nucleic acid cleavage site. The donor polynucleotide can be an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

The site-directed polypeptide can comprise an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to a wild-type exemplary site-directed polypeptide [e.g., Cas9 from S. pyogenes, US2014/0068797 Sequence ID No. 8 or Sapranauskas et al., Nucleic Acids Res, 39(21): 9275-9282 (2011)], and various other site-directed polypeptides).

The site-directed polypeptide comprises at least 70, 75, 80, 85, 90, 95, 97, 99, or 100% identity to a wild-type site-directed polypeptide (e.g., Cas9 from S. pyogenes, supra) over 10 contiguous amino acids. The site-directed polypeptide can comprise at most: 70, 75, 80, 85, 90, 95, 97, 99, or 100% identity to a wild-type site-directed polypeptide (e.g., Cas9 from S. pyogenes, supra) over 10 contiguous amino acids. The site-directed polypeptide can comprise at least: 70, 75, 80, 85, 90, 95, 97, 99, or 100% identity to a wild-type site-directed polypeptide (e.g., Cas9 from S. pyogenes, supra) over 10 contiguous amino acids in a HNH nuclease domain of the site-directed polypeptide. The site-directed polypeptide can comprise at most: 70, 75, 80, 85, 90, 95, 97, 99, or 100% identity to a wild-type site-directed polypeptide (e.g., Cas9 from S. pyogenes, supra) over 10 contiguous amino acids in a HNH nuclease domain of the site-directed polypeptide. The site-directed polypeptide can comprise at least: 70, 75, 80, 85, 90, 95, 97, 99, or 100% identity to a wild-type site-directed polypeptide (e.g., Cas9 from S. pyogenes, supra) over 10 contiguous amino acids in a RuvC nuclease domain of the site-directed polypeptide. The site-directed polypeptide comprises at most: 70, 75, 80, 85, 90, 95, 97, 99, or 100% identity to a wild-type site-directed polypeptide (e.g., Cas9 from S. pyogenes, supra) over 10 contiguous amino acids in a RuvC nuclease domain of the site-directed polypeptide.

The site-directed polypeptide can comprise a modified form of a wild-type exemplary site-directed polypeptide. The modified form of the wild-type exemplary site-directed polypeptide can comprise a mutation that reduces the nucleic acid-cleaving activity of the site-directed polypeptide. The modified form of the wild-type exemplary site-directed polypeptide can have less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from S. pyogenes, supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive."

The modified form of the site-directed polypeptide can comprise a mutation such that it can induce a single-strand break (SSB) on a target nucleic acid (e.g., by cutting only one of the sugar-phosphate backbones of a double-strand target nucleic acid). The mutation can result in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from S. pyogenes, supra). The mutation can result in one or more of the plurality of nucleic acid-cleaving domains retaining the ability to cleave the complementary strand of the target nucleic acid, but reducing its ability to cleave the non-complementary strand of the target nucleic acid. The mutation can result in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary S. pyogenes Cas9 polypeptide, such as Asp10, His840, Asn854 and Asn856, are mutated to inactivate one or more of the plurality of nucleic acid-cleaving domains (e.g., nuclease domains). The residues to be mutated can correspond to residues Asp10, His840, Asn854 and Asn856 in the wild-type exemplary S. pyogenes Cas9 polypeptide (e.g., as determined by sequence and/or structural alignment). Non-limiting examples of mutations include D10A, H840A, N854A or N856A. One skilled in the art will recognize that mutations other than alanine substitutions can be suitable.

A D10A mutation can be combined with one or more of H840A, N854A, or N856A mutations to produce a site-directed polypeptide substantially lacking DNA cleavage activity. A H840A mutation can be combined with one or more of D10A, N854A, or N856A mutations to produce a site-directed polypeptide substantially lacking DNA cleavage activity. A N854A mutation can be combined with one or more of H840A, D10A, or N856A mutations to produce a site-directed polypeptide substantially lacking DNA cleavage activity. A N856A mutation can be combined with one or more of H840A, N854A, or D10A mutations to produce a site-directed polypeptide substantially lacking DNA cleavage activity. Site-directed polypeptides that comprise one substantially inactive nuclease domain are referred to as "nickases".

Nickase variants of RNA guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13 nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes. Descriptions of various CRISPR/Cas systems for use in gene editing can be found, e.g., in international patent application publication number WO2013/176772, and in *Nature Biotechnology* 32, 347-355 (2014), and references cited therein.

Mutations contemplated can include substitutions, additions, and deletions, or any combination thereof. The mutation converts the mutated amino acid to alanine. The mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). The mutation converts the mutated amino acid to a natural amino acid (e.g., selenomethionine). The mutation converts the mutated amino acid to amino acid mimics (e.g., phosphomimics). The mutation can be a conservative mutation. For example, the mutation can convert the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). The mutation can cause a shift in reading frame and/or the creation of a premature stop codon. Mutations can cause changes to regulatory regions of genes or loci that affect expression of one or more genes.

The site-directed polypeptide (e.g., variant, mutated, enzymatically inactive and/or conditionally enzymatically inactive site-directed polypeptide) can target nucleic acid. The site-directed polypeptide (e.g., variant, mutated, enzymatically inactive and/or conditionally enzymatically inactive endoribonuclease) can target DNA. The site directed polypeptide (e.g., variant, mutated, enzymatically inactive and/or conditionally enzymatically inactive endoribonuclease) can target RNA.

The site-directed polypeptide can comprise one or more non-native sequences (e.g., the site-directed polypeptide is a fusion protein).

The site-directed polypeptide can comprise an amino acid sequence comprising at least 15% amino acid identity to a Cas9 from a bacterium (e.g., *S. pyogenes*), a nucleic acid binding domain, and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain).

The site-directed polypeptide can comprise an amino acid sequence comprising at least 15% amino acid identity to a Cas9 from a bacterium (e.g., *S. pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), and non-native sequence (for example, a nuclear localization signal) or a linker linking the site-directed polypeptide to a non-native sequence.

The site-directed polypeptide can comprise an amino acid sequence comprising at least 15% amino acid identity to a Cas9 from a bacterium (e.g., *S. pyogenes*), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

The site-directed polypeptide can comprise an amino acid sequence comprising at least 15% amino acid identity to a Cas9 from a bacterium (e.g., *S. pyogenes*), and two nucleic acid cleaving domains (i.e., a HNH domain and a RuvC domain), wherein one of the nuclease domains comprises a mutation of aspartic acid 10, and/or wherein one of the nuclease domains can comprise a mutation of histidine 840, and wherein the mutation reduces the cleaving activity of the nuclease domain(s) by at least 50%.

The one or more site-directed polypeptides, e.g. DNA endonucleases, can comprise two nickases that together effect one double-strand break at a specific locus in the genome, or four nickases that together effect or cause two double-strand breaks at specific loci in the genome. Alternatively, one site-directed polypeptide, e.g. DNA endonuclease, can effect or cause one double-strand break at a specific locus in the genome.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. The genome-targeting nucleic acid can be an RNA. A genome-targeting RNA is referred to as a "guide RNA" or "gRNA" herein. A guide RNA can comprise at least a spacer sequence that hybridizes to a target nucleic acid sequence of interest, and a CRISPR repeat sequence. In Type II systems, the gRNA also comprises a second RNA called the tracrRNA sequence. In the Type II guide RNA (gRNA), the CRISPR repeat sequence and tracrRNA sequence hybridize to each other to form a duplex. In the Type V guide RNA (gRNA), the crRNA forms a duplex. In both systems, the duplex can bind a site-directed polypeptide, such that the guide RNA and site-direct polypeptide form a complex. The genome-targeting nucleic acid can provide target specificity to the complex by virtue of its association with the site-directed polypeptide. The genome-targeting nucleic acid thus can direct the activity of the site-directed polypeptide.

Exemplary guide RNAs include the spacer sequences in the Sequence Listing, shown with the genome location of their target sequence, which is within or near the dystrophin gene, and the associated Cas9 cut site, wherein the genome location is based on the GRCh38/hg38 human genome assembly.

Each guide RNA can be designed to include a spacer sequence complementary to its genomic target sequence, which is within or near the dystrophin gene. For example, each of the spacer sequences in the Sequence Listing can be put into a single strand guide RNA (sgRNA) (e.g., an RNA chimera) or a crRNA (along with a corresponding tracrRNA). See Jinek et al., Science, 337, 816-821 (2012) and Deltcheva et al., Nature, 471, 602-607 (2011).

The genome-targeting nucleic acid can be a double-molecule guide RNA. The genome-targeting nucleic acid can be a single-molecule guide RNA.

A double-molecule guide RNA can comprise two strands of RNA. The first strand comprises in the 5' to 3' direction, an optional spacer extension sequence, a spacer sequence and a minimum CRISPR repeat sequence. The second strand can comprise a minimum tracrRNA sequence (complementary to the minimum CRISPR repeat sequence), a 3' tracrRNA sequence and an optional tracrRNA extension sequence.

A single-molecule guide RNA (sgRNA) in a Type II system can comprise, in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension can comprise elements that contribute additional functionality (e.g., stability) to the guide RNA. The single-molecule guide linker can link the minimum CRISPR repeat and the minimum tracrRNA sequence to form a hairpin structure. The optional tracrRNA extension can comprise one or more hairpins.

A single-molecule guide RNA (sgRNA) in a Type V system can comprise, in the 5' to 3' direction, a minimum CRISPR repeat sequence and a spacer sequence.

By way of illustration, guide RNAs used in the CRISPR/Cas/Cpf1 system, or other smaller RNAs can be readily synthesized by chemical means, as illustrated below and described in the art. While chemical synthetic procedures are continually expanding, purifications of such RNAs by procedures such as high performance liquid chromatography (HPLC), which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 of Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

Spacer Extension Sequence

In some examples of genome-targeting nucleic acids, a spacer extension sequence can modify activity, provide stability and/or provide a location for modifications of a genome-targeting nucleic acid. A spacer extension sequence can modify on or off target activity or specificity. In some examples, a spacer extension sequence can be provided. The spacer extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. The spacer extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. The spacer extension sequence can be less than 10 nucleotides in length. The spacer extension sequence can be between 10-30 nucleotides in length. The spacer extension sequence can be between 30-70 nucleotides in length.

The spacer extension sequence can comprise another moiety (e.g., a stability control sequence, an endoribonuclease binding sequence, a ribozyme). The moiety can decrease or increase the stability of a nucleic acid targeting nucleic acid. The moiety can be a transcriptional terminator segment (i.e., a transcription termination sequence). The moiety can function in a eukaryotic cell. The moiety can function in a prokaryotic cell. The moiety can function in both eukaryotic and prokaryotic cells. Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a genome-targeting nucleic acid can interact with a target nucleic acid in a sequence-specific manner via hybridization (i.e., base pairing). The nucleotide sequence of the spacer can vary depending on the sequence of the target nucleic acid of interest.

In a CRISPR/Cas system herein, the spacer sequence can be designed to hybridize to a target nucleic acid that is located 5' of a PAM of the Cas9 enzyme used in the system. The spacer can perfectly match the target sequence or can have mismatches. Each Cas9 enzyme has a particular PAM sequence that it recognizes in a target DNA. For example, S. pyogenes recognizes in a target nucleic acid a PAM that comprises the sequence 5'-NRG-3', where R comprises either A or G, where N is any nucleotide and N is immediately 3' of the target nucleic acid sequence targeted by the spacer sequence.

The target nucleic acid sequence can comprise 20 nucleotides. The target nucleic acid can comprise less than 20 nucleotides. The target nucleic acid can comprise more than 20 nucleotides. The target nucleic acid can comprise at least: 5, 10, 15, 16, 17, 18, 19, 20, 21, 22, 23, 24, 25, 30 or more nucleotides. In some examples, the target nucleic acid comprises at most: 5, 10, 15, 16, 17, 18, 19, 20, 21, 22, 23, 24, 25, 30 or more nucleotides. The target nucleic acid sequence can comprise 20 bases immediately 5' of the first nucleotide of the PAM. For example, in a sequence comprising 5'-NNNNNNNNNNNNNNNNNNNNNRG-3' (SEQ ID NO. 1,410,473) the target nucleic acid can comprise the sequence that corresponds to the Ns, wherein N is any nucleotide, and the underlined NRG sequence is the S. pyogenes PAM.

The spacer sequence that hybridizes to the target nucleic acid can have a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some examples, the spacer sequence can comprise 20 nucleotides. The spacer sequence can comprise 19 nucleotides.

In some examples, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some examples, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some examples, the percent complementarity between the spacer sequence and the target nucleic acid is 100% over the six contiguous 5'-most nucleotides of the target sequence of the complementary strand of the target nucleic acid. The percent complementarity between the spacer sequence and the target nucleic acid can be at least 60% over about 20 contiguous nucleotides. The length of the spacer sequence and the target nucleic acid can differ by 1 to 6 nucleotides, which can be thought of as a bulge or bulges.

The spacer sequence can be designed or chosen using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

A minimum CRISPR repeat sequence is a sequence with at least about 30%, about 40%, about 50%, about 60%, about 65%, about 70%, about 75%, about 80%, about 85%, about 90%, about 95%, or 100% sequence identity to a reference CRISPR repeat sequence (e.g., crRNA from S. pyogenes).

A minimum CRISPR repeat sequence can comprise nucleotides that can hybridize to a minimum tracrRNA sequence in a cell. The minimum CRISPR repeat sequence and a minimum tracrRNA sequence can form a duplex, i.e. a base-paired double-stranded structure. Together, the minimum CRISPR repeat sequence and the minimum tracrRNA sequence can bind to the site-directed polypeptide. At least a part of the minimum CRISPR repeat sequence can hybridize to the minimum tracrRNA sequence. At least a part of the minimum CRISPR repeat sequence can comprise at least about 30%, about 40%, about 50%, about 60%, about 65%, about 70%, about 75%, about 80%, about 85%, about 90%, about 95%, or 100% complementary to the minimum tracrRNA sequence. At least a part of the minimum CRISPR repeat sequence can comprise at most about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some examples, the minimum CRISPR repeat sequence is approximately 9 nucleotides in length. The minimum CRISPR repeat sequence can be approximately 12 nucleotides in length.

The minimum CRISPR repeat sequence can be at least about 60% identical to a reference minimum CRISPR repeat sequence (e.g., wild-type crRNA from S. pyogenes) over a stretch of at least 6, 7, or 8 contiguous nucleotides. For example, the minimum CRISPR repeat sequence is at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

A minimum tracrRNA sequence can be a sequence with at least about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from S. pyogenes).

A minimum tracrRNA sequence can comprise nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat bind to a site-directed polypeptide. At least a part of the minimum tracrRNA sequence can hybridize to the minimum CRISPR repeat sequence. The minimum tracrRNA sequence can be at least about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. The minimum tracrRNA sequence can be approximately 9 nucleotides in length. The minimum tracrRNA sequence can be approximately 12 nucleotides. The minimum tracrRNA can consist of tracrRNA nt 23-48 described in Jinek et al., supra.

The minimum tracrRNA sequence can be at least about 60% identical to a reference minimum tracrRNA (e.g., wild type, tracrRNA from *S. pyogenes*) sequence over a stretch of at least 6, 7, or 8 contiguous nucleotides. For example, the minimum tracrRNA sequence can be at least about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least 6, 7, or 8 contiguous nucleotides.

The duplex between the minimum CRISPR RNA and the minimum tracrRNA can comprise a double helix. The duplex between the minimum CRISPR RNA and the minimum tracrRNA can comprise at least about 1, 2, 3, 4, 5, 6, 7, 8, 9, or 10 or more nucleotides. The duplex between the minimum CRISPR RNA and the minimum tracrRNA can comprise at most about 1, 2, 3, 4, 5, 6, 7, 8, 9, or 10 or more nucleotides.

The duplex can comprise a mismatch (i.e., the two strands of the duplex are not 100% complementary). The duplex can comprise at least about 1, 2, 3, 4, or 5 or mismatches. The duplex can comprise at most about 1, 2, 3, 4, or 5 or mismatches. The duplex can comprise no more than 2 mismatches.

Bulges

In some cases, there can be a "bulge" in the duplex between the minimum CRISPR RNA and the minimum tracrRNA. A bulge is an unpaired region of nucleotides within the duplex. A bulge can contribute to the binding of the duplex to the site-directed polypeptide. The bulge can comprise, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge can comprise an unpaired purine (e.g., adenine) on the minimum CRISPR repeat strand of the bulge. In some examples, the bulge can comprise an unpaired 5'-AAGY-3' of the minimum tracrRNA sequence strand of the bulge, where Y comprises a nucleotide that can form a wobble pairing with a nucleotide on the minimum CRISPR repeat strand.

A bulge on the minimum CRISPR repeat side of the duplex can comprise at least 1, 2, 3, 4, or 5 or more unpaired nucleotides. A bulge on the minimum CRISPR repeat side of the duplex can comprise at most 1, 2, 3, 4, or 5 or more unpaired nucleotides. A bulge on the minimum CRISPR repeat side of the duplex can comprise 1 unpaired nucleotide.

A bulge on the minimum tracrRNA sequence side of the duplex can comprise at least 1, 2, 3, 4, 5, 6, 7, 8, 9, or 10 or more unpaired nucleotides. A bulge on the minimum tracrRNA sequence side of the duplex can comprise at most 1, 2, 3, 4, 5, 6, 7, 8, 9, or 10 or more unpaired nucleotides. A bulge on a second side of the duplex (e.g., the minimum tracrRNA sequence side of the duplex) can comprise 4 unpaired nucleotides.

A bulge can comprise at least one wobble pairing. In some examples, a bulge comprises at most one wobble pairing. In some examples, a bulge can comprise at least one purine nucleotide. A bulge can comprise at least 3 purine nucleotides. A bulge sequence can comprise at least 5 purine nucleotides. A bulge sequence can comprise at least one guanine nucleotide. A bulge sequence can comprise at least one adenine nucleotide.

Hairpins

In various examples, one or more hairpins can be located 3' to the minimum tracrRNA in the 3' tracrRNA sequence.

The hairpin can start at least about 1, 2, 3, 4, 5, 6, 7, 8, 9, 10, 15, or 20 or more nucleotides 3' from the last paired nucleotide in the minimum CRISPR repeat and minimum tracrRNA sequence duplex. The hairpin can start at most about 1, 2, 3, 4, 5, 6, 7, 8, 9 or 10 or more nucleotides 3' of the last paired nucleotide in the minimum CRISPR repeat and minimum tracrRNA sequence duplex.

The hairpin can comprise at least about 1, 2, 3, 4, 5, 6, 7, 8, 9, 10, 15, or 20 or more consecutive nucleotides. The hairpin can comprise at most about 1, 2, 3, 4, 5, 6, 7, 8, 9, 10, 15, or more consecutive nucleotides.

The hairpin can comprise a CC dinucleotide (i.e., two consecutive cytosine nucleotides).

The hairpin can comprise duplexed nucleotides (e.g., nucleotides in a hairpin, hybridized together). For example, a hairpin can comprise a CC dinucleotide that is hybridized to a GG dinucleotide in a hairpin duplex of the 3' tracrRNA sequence.

One or more of the hairpins can interact with guide RNA-interacting regions of a site-directed polypeptide.

In some examples, there are two or more hairpins, and in other examples there are three or more hairpins.

3' tracrRNA Sequence

A 3' tracrRNA sequence can comprise a sequence with at least about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from *S. pyogenes*).

The 3' tracrRNA sequence can have a length from about 6 nucleotides to about 100 nucleotides. For example, the 3' tracrRNA sequence can have a length from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. The 3' tracrRNA sequence can have a length of approximately 14 nucleotides.

The 3' tracrRNA sequence can be at least about 60% identical to a reference 3' tracrRNA sequence (e.g., wild type 3' tracrRNA sequence from *S. pyogenes*) over a stretch of at least 6, 7, or 8 contiguous nucleotides. For example, the 3' tracrRNA sequence can be at least about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from *S. pyogenes*) over a stretch of at least 6, 7, or 8 contiguous nucleotides.

The 3' tracrRNA sequence can comprise more than one duplexed region (e.g., hairpin, hybridized region). The 3' tracrRNA sequence can comprise two duplexed regions.

The 3' tracrRNA sequence can comprise a stem loop structure. The stem loop structure in the 3' tracrRNA can comprise at least 1, 2, 3, 4, 5, 6, 7, 8, 9, 10, 15 or 20 or more nucleotides. The stem loop structure in the 3' tracrRNA can comprise at most 1, 2, 3, 4, 5, 6, 7, 8, 9 or 10 or more nucleotides. The stem loop structure can comprise a functional moiety. For example, the stem loop structure can comprise an aptamer, a ribozyme, a protein-interacting hairpin, a CRISPR array, an intron, or an exon. The stem loop structure can comprise at least about 1, 2, 3, 4, or 5 or more functional moieties. The stem loop structure can comprise at most about 1, 2, 3, 4, or 5 or more functional moieties.

The hairpin in the 3' tracrRNA sequence can comprise a P-domain. In some examples, the P-domain can comprise a double-stranded region in the hairpin.

tracrRNA Extension Sequence

A tracrRNA extension sequence can be provided whether the tracrRNA is in the context of single-molecule guides or double-molecule guides. The tracrRNA extension sequence can have a length from about 1 nucleotide to about 400 nucleotides. The tracrRNA extension sequence can have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. The tracrRNA extension sequence can have a length from about 20 to about 5000 or more nucleotides. The tracrRNA extension sequence can have a length of more than 1000 nucleotides. The tracrRNA extension sequence can have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. The tracrRNA extension sequence can have a length of less than 1000 nucleotides. The tracrRNA extension sequence can comprise less than 10 nucleotides in length. The tracrRNA extension sequence can be 10-30 nucleotides in length. The tracrRNA extension sequence can be 30-70 nucleotides in length.

The tracrRNA extension sequence can comprise a functional moiety (e.g., a stability control sequence, ribozyme, endoribonuclease binding sequence). The functional moiety can comprise a transcriptional terminator segment (i.e., a transcription termination sequence). The functional moiety can have a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 15 nt to about 50 nt, from about 15 nt to about 40 nt, from about 15 nt to about 30 nt, or from about 15 nt to about 25 nt. The functional moiety can function in a eukaryotic cell. The functional moiety can function in a prokaryotic cell. The functional moiety can function in both eukaryotic and prokaryotic cells.

Non-limiting examples of suitable tracrRNA extension functional moieties include a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, or a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). The tracrRNA extension sequence can comprise a primer binding site or a molecular index (e.g., barcode sequence). The tracrRNA extension sequence can comprise one or more affinity tags.

Single-Molecule Guide Linker Sequence

The linker sequence of a single-molecule guide nucleic acid can have a length from about 3 nucleotides to about 100 nucleotides. In Jinek et al., supra, for example, a simple 4 nucleotide "tetraloop" (-GAAA-) was used, Science, 337 (6096):816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. The linker of a single-molecule guide nucleic acid can be between 4 and 40 nucleotides. The linker can be at least about 100, 500, 1000, 1500, 2000, 2500, 3000, 3500, 4000, 4500, 5000, 5500, 6000, 6500, or 7000 or more nucleotides. The linker can be at most about 100, 500, 1000, 1500, 2000, 2500, 3000, 3500, 4000, 4500, 5000, 5500, 6000, 6500, or 7000 or more nucleotides.

Linkers can comprise any of a variety of sequences, although in some examples the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337 (6096):816-821 (2012), but numerous other sequences, including longer sequences can likewise be used.

The linker sequence can comprise a functional moiety. For example, the linker sequence can one or more features, including an aptamer, a ribozyme, a protein-interacting hairpin, a protein binding site, a CRISPR array, an intron, or an exon. The linker sequence can comprise at least about 1, 2, 3, 4, or 5 or more functional moieties. In some examples, the linker sequence can comprise at most about 1, 2, 3, 4, or 5 or more functional moieties.

Genome Engineering Strategies to Correct Cells by Deletion (Excision), Insertion, or Replacement (Deletion and Insertion) of One or More Exons or Aberrant Intronic Splice Acceptor or Donor Sites A step of the ex vivo methods of the present disclosure involves editing/correcting the DMD patient specific iPS cells using genome engineering. Likewise, a step of the in vivo methods of the present disclosure involves editing/correcting the muscle cells in a DMD patient using genome engineering. Similarly, a step in the cellular methods of the present disclosure involves editing/correcting the dystrophin gene in a human cell by genome engineering.

DMD patients exhibit a wide range of mutations in the dystrophin gene. Therefore, different patients will generally require different correction strategies. Any CRISPR endonuclease can be used in the methods of the present disclosure, each CRISPR endonuclease having its own associated PAM, which may or may not be disease specific. For example, gRNA spacer sequences for targeting the dystrophin gene with a CRISPR/Cas9 endonuclease from *S. pyogenes* have been identified in SEQ ID NOs: 1-467,030 and 1,410,430-1,410,472 of the Sequence Listing. gRNA spacer sequences for targeting the dystrophin gene with a CRISPR/Cas9 endonuclease from *S. aureus* have been identified in SEQ ID NOs: 467,031-528,196 of the Sequence Listing. gRNA spacer sequences for targeting the dystrophin gene with a CRISPR/Cas9 endonuclease from *S. thermophilus* have been identified in SEQ ID NOs: 528,197-553,198 of the Sequence Listing. gRNA spacer sequences for targeting the dystrophin gene with a CRISPR/Cas9 endonuclease from *T. denticola* have been identified in SEQ ID NOs: 553,199-563,911 of the Sequence Listing. gRNA spacer sequences for targeting the dystrophin gene with a CRISPR/Cas9 endonuclease from *N. meningitides* have been identified in SEQ ID NOs: 563,912-627,854 and 1,410,400-1,410,402 of the Sequence Listing. gRNA spacer sequences for targeting the dystrophin gene with a CRISPR/Cpf1 endonuclease from *Acidominoccoccus*, Lachnospiraceae and *Franciscella Novicida* have been identified in SEQ ID NOs: 627,855-1,410,399 and 1,410,403-1,410,429 of the Sequence Listing.

One genome engineering strategy involves exon deletion. Targeted deletion of specific exons can be an attractive strategy for treating a large subset of patients with a single therapeutic cocktail. It is predicted that single exon deletions can treat up to 13% of patients, while a multi-exon deletion can treat up to 62% of patients by restoring the dystrophin reading frame. While multi-exon deletions can reach a larger number of patients, for larger deletions the efficiency of deletion greatly decreases with increased size. Therefore, preferred deletions can range from 400 to 350,000 base pairs (bp) in size. For example, deletions can range from 400-1,000; 1,000-5,000; 5,000-10,000, 10,000-25,000; 25,000-50,000, 50,000-100,000; 100,000-200,000; or 200,000-350,000 base pairs in size.

As stated previously, the DMD gene contains 79 exons. Any one or more of the 79 exons, or aberrant intronic splice acceptor or donor sites, can be deleted in order to restore the dystrophin reading frame. The methods provide gRNA pairs that can be used to delete exons 2, 8, 43, 44, 45, 46, 50, 51, 52, 53, 70, 45-53, or 45-55, as these are the regions that are predicted to reach the largest subset of patients (see Tables 1 and 2; Table 2 percentages given are the average reported from the literature).

Different regions of the DMD gene can be repaired by either deletion and/or HDR. Certain combinations of gRNAs that cut within the genomic region of interest can be used to correct mutations in the targeted exon. Coordinates are based on the GRch38/hg38 genomic assembly (Table 1).

TABLE 1

| Targeted Exon(s) | Repair strategy | Genomic Coordinates |
| --- | --- | --- |
| 45-55 | Deletion and/or HDR | Chrx: 31512453-32216916 |
| 45-53 | Deletion and/or HDR | Chrx: 31679586-32216916 |
| 2 | Deletion and/or HDR | Chrx: 32849820-33211282 |
| 8 | Deletion and/or HDR | Chrx: 32697998-32809493 |
| 43 | Deletion and/or HDR | Chrx: 32217063-32310082 |

TABLE 1-continued

| Targeted Exon(s) | Repair strategy | Genomic Coordinates |
| --- | --- | --- |
| 44 | Deletion and/or HDR | Chrx: 31968514-32287529 |
| 45 | Deletion and/or HDR | Chrx: 31932227-32216916 |
| 46 | Deletion and/or HDR | Chrx: 31929745-31968339 |
| 50 | Deletion and/or HDR | Chrx: 31774192-31836718 |
| 51 | Deletion and/or HDR | Chrx: 31729748-31819975 |
| 52 | Deletion and/or HDR | Chrx: 31679586-31773960 |
| 53 | Deletion and/or HDR | Chrx: 31658144-31729631 |
| 70 | HDR | Chrx: 31177970-31180370 |

TABLE 2

| Deleted Exon(s) | % of Mutations | Citation |
| --- | --- | --- |
| 45-55 | 62.1 | Beroud, C., et al., Hum Mutat, 2007. 28(2): p. 196-202. |
| 45-53 | 53.3 | Tuffery-Giraud, S., et al., Hum Mutat, 2009. 30(6): p. 934-45. |
| 2 | 1.9 | Aartsma-Rus, A., et al., Hum Mutat, 2009. 30(3): p. 293-9. |
| 8 | 2.2 | Aartsma-Rus, A., et al., Id. Bladen, C. L., et al., Hum Mutat, 2015. 36(4): p. 395-402. |
| 43 | 5.7 | Aartsma-Rus, A., et al., Id. Bladen, C. L., et al., Id. |
| 44 | 6.7 | Aartsma-Rus, A., et al., Id. Bladen, C. L., et al., Id. |
| 45 | 8.6 | Aartsma-Rus, A., et al., Id. Bladen, C. L., et al., Id. |
| 46 | 4.5 | Aartsma-Rus, A., et al., Id. Bladen, C. L., et al., Id. |
| 50 | 3.9 | Aartsma-Rus, A., et al., Id. Bladen, C. L., et al., Id. |
| 51 | 13.5 | Aartsma-Rus, A., et al., Id. Bladen, C. L., et al., Id. |
| 52 | 3.9 | Aartsma-Rus, A., et al., Id. Bladen, C. L., et al., Id. |
| 53 | 8.9 | Aartsma-Rus, A., et al., Id. Bladen, C. L., et al., Id. |

The methods provide gRNA pairs that delete exon 2 by cutting the gene twice, one gRNA cutting at the 5' end of exon 2 and the other gRNA cutting at the 3' end of exon 2.

The methods provide gRNA pairs that delete exon 8 by cutting the gene twice, one gRNA cutting at the 5' end of exon 8 and the other gRNA cutting at the 3' end of exon 8.

The methods provide gRNA pairs that delete exon 43 by cutting the gene twice, one gRNA cutting at the 5' end of exon 43 and the other gRNA cutting at the 3' end of exon 43.

The methods provide gRNA pairs that delete exon 44 by cutting the gene twice, one gRNA cutting at the 5' end of exon 44 and the other gRNA cutting at the 3' end of exon 44.

The methods provide gRNA pairs that delete exon 45 by cutting the gene twice, one gRNA cutting at the 5' end of exon 45 and the other gRNA cutting at the 3' end of exon 45.

The methods provide gRNA pairs that delete exon 46 by cutting the gene twice, one gRNA cutting at the 5' end of exon 46 and the other gRNA cutting at the 3' end of exon 46.

The methods provide gRNA pairs that delete exon 50 by cutting the gene twice, one gRNA cutting at the 5' end of exon 50 and the other gRNA cutting at the 3' end of exon 50.

The methods provide gRNA pairs that delete exon 51 by cutting the gene twice, one gRNA cutting at the 5' end of exon 51 and the other gRNA cutting at the 3' end of exon 51.

The methods provide gRNA pairs that delete exon 52 by cutting the gene twice, one gRNA cutting at the 5' end of exon 52 and the other gRNA cutting at the 3' end of exon 52.

The methods provide gRNA pairs that delete exon 53 by cutting the gene twice, one gRNA cutting at the 5' end of exon 53 and the other gRNA cutting at the 3' end of exon 53.

The methods provide gRNA pairs that delete exon 70 by cutting the gene twice, one gRNA cutting at the 5' end of exon 70 and the other gRNA cutting at the 3' end of exon 70.

The methods provide gRNA pairs that delete exons 45-53 by cutting the gene twice, one gRNA cutting at the 5' end of exon 45 and the other gRNA cutting at the 3' end of exon 53.

The methods provide gRNA pairs that delete exons 45-55 by cutting the gene twice, one gRNA cutting at the 5' end of exon 45 and the other gRNA cutting at the 3' end of exon 55.

Another genome engineering strategy involves insertion or replacement of one or more exons or aberrant intronic splice acceptor or donor sites by homology directed repair (HDR), which is also known as homologous recombination (HR). Homology directed repair is one strategy for treating patients that have premature stop codons due to small insertions/deletions or point mutations. Rather than making a large genomic deletion that will convert a DMD phenotype to a BMD phenotype, this strategy will restore the entire reading frame and completely reverse the diseased state. This strategy will require a more custom approach based on the location of the patient's premature stop. Most of the dystrophin exons are small (<300 bp). This is advantageous, as HDR efficiencies are inversely related to the size of the donor molecule. Also, it is expected that the donor templates can fit into size constrained adeno-associated virus (AAV) molecules, which have been shown to be an effective means of donor template delivery.

Homology direct repair is a cellular mechanism for repairing double-stranded breaks (DSBs). The most common form is homologous recombination. There are additional pathways for HDR, including single-strand annealing and alternative-HDR. Genome engineering tools allow researchers to manipulate the cellular homologous recombination pathways to create site-specific modifications to the genome. It has been found that cells can repair a double-stranded break using a synthetic donor molecule provided in trans. Therefore, by introducing a double-stranded break near a specific mutation and providing a suitable donor, targeted changes can be made in the genome. Specific cleavage increases the rate of HDR more than 1,000 fold above the rate of 1 in $10^6$ cells receiving a homologous donor alone. The rate of homology directed repair (HDR) at a particular nucleotide is a function of the distance to the cut site, so choosing overlapping or nearest target sites is important. Gene editing offers the advantage over gene addition, as correcting in situ leaves the rest of the genome unperturbed.

Supplied donors for editing by HDR vary markedly but can contain the intended sequence with small or large flanking homology arms to allow annealing to the genomic DNA. The homology regions flanking the introduced genetic changes can be 30 bp or smaller, or as large as a multi-kilobase cassette that can contain promoters, cDNAs, etc. Both single-stranded and double-stranded oligonucleotide donors have been used. These oligonucleotides can range in size from less than 100 nt to over 200 nt, though longer ssDNA can also be generated and used. Double-stranded donors can be used, including PCR amplicons, plasmids, and mini-circles. In general, it has been found that an AAV vector can be a very effective means of delivery of a donor template, though the packaging limits for individual donors is <5 kb. Active transcription of the donor increased HDR three-fold, indicating the inclusion of promoter can increase conversion. Conversely, CpG methylation of the donor decreased gene expression and HDR.

In addition to wildtype endonucleases, such as Cas9, nickase variants exist that can have one or the other nuclease domain inactivated resulting in cutting of only one DNA strand. HDR can be directed from individual Cas nickases or using pairs of nickases that flank the target area. Donors can be single-stranded, nicked, or dsDNA.

The donor DNA can be supplied with the nuclease or independently by a variety of different methods, for example by transfection, nano-particle, micro-injection, or viral transduction. A range of tethering options has been proposed to increase the availability of the donors for HDR. Examples include attaching the donor to the nuclease, attaching to DNA binding proteins that bind nearby, or attaching to proteins that are involved in DNA end binding or repair.

The repair pathway choice can be guided by a number of culture conditions, such as those that influence cell cycling, or by targeting of DNA repair and associated proteins. For example, to increase HDR, key NHEJ molecules can be suppressed, such as KU70, KU80 or DNA ligase IV.

Without a donor present, the ends from a DNA break or ends from different breaks can be joined using the several nonhomologous repair pathways in which the DNA ends are joined with little or no base-pairing at the junction. In addition to canonical NHEJ, there are similar repair mechanisms, such as alt-NHEJ. If there are two breaks, the intervening segment can be deleted or inverted. NHEJ repair pathways can lead to insertions, deletions, or mutations at the joints.

NHEJ was used to insert a 15-kb inducible gene expression cassette into a defined locus in human cell lines after nuclease cleavage. Maresca, M., Lin, V. G., Guo, N. & Yang, Y. Obligate ligation-gated recombination (ObLiGaRe): custom-designed nuclease-mediated targeted integration through nonhomologous end joining. *Genome Res* 23, 539-546 (2013).

In addition to genome editing by NHEJ or HDR, site-specific gene insertions have been conducted that use both the NHEJ pathway and HR. A combination approach can be applicable in certain settings, possibly including intron/exon borders. NHEJ can prove effective for ligation in the intron, while the error-free HDR can be better suited in the coding region.

As stated previously, the DMD gene contains 79 exons. Any one or more of the 79 exons can be repaired in order to correct a mutation and restore the dystrophin reading frame. Some methods provide one gRNA or a pair of gRNAs that can be used to facilitate incorporation of a new sequence from a polynucleotide donor template to insert or replace a sequence in exon 70, as data shows that exon 70 can be prone to the most premature stop codons in the dystrophin gene (Tuffery-Giraud, S., et al., Hum Mutat, 2009. 30(6): p. 934-45) (Flanigan, K. M., et al., Hum Mutat, 2009. 30(12): p. 1657-66). In order to make the method applicable to the largest number of patients, the method involves a donor template that can insert or replace the whole exon 70. Alternatively, the methods provide one gRNA or a pair of gRNAs that can be used to facilitate incorporation of a new sequence from a polynucleotide donor template to insert or replace a sequence in exon 2, exon 8, exon 43, exon 44, exon 45, exon 46, exon 50, exon 51, exon 52, exon 53, or exon 70. See Table 1.

In order to ensure that the pre-mRNA is properly processed following HDR, it is important to keep the surrounding splicing signals intact. Splicing donor and acceptors can be generally within 100 base pairs of the neighboring intron. Therefore, in some examples, methods can provide all gRNAs that cut approximately +/−0-3100 bp with respect to the exon's intron junctions.

Some methods provide gRNA pairs that make a deletion by cutting the gene twice, one gRNA cutting at the 5' end of exon 2 and the other gRNA cutting at the 3' end of exon 2 that facilitates incorporation of a new sequence from a polynucleotide donor template to replace a sequence in exon 2.

Alternatively, some methods provide one gRNA from the preceding paragraph to make one double-strand cut that facilitates insertion of a new sequence from a polynucleotide donor template to replace a sequence in exon 2.

Some examples of the methods provide gRNA pairs that make a deletion by cutting the gene twice, one gRNA cutting at the 5' end of exon 8 and the other gRNA cutting at the 3' end of exon 8 that facilitates incorporation of a new sequence from a polynucleotide donor template to replace a sequence in exon 8.

Alternatively, some methods provide one gRNA from the preceding paragraph to make one double-strand cut that facilitates insertion of a new sequence from a polynucleotide donor template to replace a sequence in exon 8.

Some methods provide gRNA pairs that make a deletion by cutting the gene twice, one gRNA cutting at the 5' end of exon 43 and the other gRNA cutting at the 3' end of exon 43 that facilitates incorporation of a new sequence from a polynucleotide donor template to replace a sequence in exon 43.

Alternatively, some methods provide one gRNA from the preceding paragraph to make one double-strand cut that facilitates insertion of a new sequence from a polynucleotide donor template to replace a sequence in exon 43.

Some methods provide gRNA pairs that make a deletion by cutting the gene twice, one gRNA cutting at the 5' end of exon 44 and the other gRNA cutting at the 3' end of exon 44 that facilitates incorporation of a new sequence from a polynucleotide donor template to replace a sequence in exon 44.

Alternatively, some methods provide one gRNA from the preceding paragraph to make one double-strand cut that facilitates insertion of a new sequence from a polynucleotide donor template to replace a sequence in exon 44.

Some methods provide gRNA pairs that make a deletion by cutting the gene twice, one gRNA cutting at the 5' end of exon 45 and the other gRNA cutting at the 3' end of exon 45 that facilitates incorporation of a new sequence from a polynucleotide donor template to replace a sequence in exon 45.

Alternatively, some methods provide one gRNA from the preceding paragraph to make one double-strand cut that facilitates insertion of a new sequence from a polynucleotide donor template to replace a sequence in exon 45.

Some methods provide gRNA pairs that make a deletion by cutting the gene twice, one gRNA cutting at the 5' end of exon 46 and the other gRNA cutting at the 3' end of exon 46 that facilitates incorporation of a new sequence from a polynucleotide donor template to replace a sequence in exon 46.

Alternatively, some methods provide one gRNA from the preceding paragraph to make one double-strand cut that facilitates insertion of a new sequence from a polynucleotide donor template to replace a sequence in exon 46.

Some methods provide gRNA pairs that make a deletion by cutting the gene twice, one gRNA cutting at the 5' end of exon 50 and the other gRNA cutting at the 3' end of exon 50 that facilitates incorporation of a new sequence from a polynucleotide donor template to replace a sequence in exon 50.

Alternatively, some methods provide one gRNA from the preceding paragraph to make one double-strand cut that facilitates insertion of a new sequence from a polynucleotide donor template to replace a sequence in exon 50.

Some methods provide gRNA pairs that make a deletion by cutting the gene twice, one gRNA cutting at the 5' end of exon 51 and the other gRNA cutting at the 3' end of exon 51 that facilitates incorporation of a new sequence from a polynucleotide donor template to replace a sequence in exon 51.

Alternatively, some methods provide one gRNA from the preceding paragraph to make one double-strand cut that facilitates insertion of a new sequence from a polynucleotide donor template to replace a sequence in exon 51.

Some methods provide gRNA pairs that make a deletion by cutting the gene twice, one gRNA cutting at the 5' end of exon 52 and the other gRNA cutting at the 3' end of exon 52 that facilitates incorporation of a new sequence from a polynucleotide donor template to replace a sequence in exon 52.

Alternatively, some methods provide one gRNA from the preceding paragraph to make one double-strand cut that facilitates insertion of a new sequence from a polynucleotide donor template to replace a sequence in exon 52.

Some methods provide gRNA pairs that make a deletion by cutting the gene twice, one gRNA cutting at the 5' end of exon 53 and the other gRNA cutting at the 3' end of exon 53 that facilitates incorporation of a new sequence from a polynucleotide donor template to replace a sequence in exon 53.

Alternatively, some methods provide one gRNA from the preceding paragraph to make one double-strand cut that facilitates insertion of a new sequence from a polynucleotide donor template to replace a sequence in exon 53.

Some methods provide gRNA pairs that make a deletion by cutting the gene twice, one gRNA cutting at the 5' end of exon 70 and the other gRNA cutting at the 3' end of exon 70 that facilitates incorporation of a new sequence from a polynucleotide donor template to replace a sequence in exon 70.

Alternatively, some methods provide one gRNA from the preceding paragraph to make one double-strand cut that facilitates insertion of a new sequence from a polynucleotide donor template to replace a sequence in exon 70.

In addition to single exon replacements by homology directed repair, we also describe methods for conducting a partial cDNA knock-in of mutational hotspots found in the DMD gene. For example, a treatment that repairs exons 45-55 can treat up to 62% of patients. Rather than deleting or replacing exons 45-55 as described herein, another treatment option replaces entire genomic region for exons 45-55—which, including introns, spans >350,000 bp—with a cDNA containing only the coding region of exons 45-55, which spans approximate 1800 bp. The replacement could be effected using a homology directed repair approach. By excluding the intergenic regions, the cDNA for exons 45-55 can more easily be accommodated (than the entire genomic region) along with homology arms into any donor vector described in the section of this application titled Nucleic Acids Encoding System Components. In this approach, two gRNAs and Cas9 or Cpf1 that remove the genomic region from exon 45-55 can be delivered along with a donor construct to replace the deleted region with the desired cDNA knock-in.

The cDNA knock-in approach can be used to replace any series of exons.

The cDNA knock-in sequence can be optimized to contain synthetic intron sequences. Synthetic introns which are smaller than naturally occurring introns can be added between the exons in the donor construct to ensure proper expression and processing of the DMD locus.

Illustrative modifications within the dystrophin gene include deletions, insertions, or replacements within or proximal to the dystrophin loci referred to above, such as within the region of less than 3 kb, less than 2 kb, less than 1 kb, less than 0.5 kb upstream or downstream of the specific exon. Given the relatively wide variations of mutations in the dystrophin gene, it will be appreciated that numerous variations of the deletions, insertions, or replacements referenced above (including without limitation larger as well as smaller deletions), would be expected to result in restoration of the dystrophin reading frame and restoration of the dystrophin protein activity.

Such variants can include deletions, insertions, or replacements that are larger in the 5' and/or 3' direction than the specific exon in question, or smaller in either direction. Accordingly, by "near" or "proximal" with respect to specific exon deletions, insertions or replacements, it is intended that the SSB or DSB locus associated with a desired deletion, insertion, or replacement boundary (also referred to herein as an endpoint) can be within a region that is less than about 3 kb from the reference locus noted. The SSB or DSB locus can be more proximal and within 2 kb, within 1 kb, within 0.5 kb, or within 0.1 kb. In the case of small deletions, the desired endpoint can be at or "adjacent to" the reference locus, by which it is intended that the endpoint can be within 100 bp, within 50 bp, within 25 bp, or less than about 10 bp to 5 bp from the reference locus.

One advantage for patients with DMD of replicating or mimicking the product produced by exon skipping and/or restoring the reading frame is that it is already known to be both safe and associated with the amelioration of DMD. Other examples comprising larger or smaller deletions/insertions/replacements can be expected to provide the same benefit, as long as the dystrophin reading frame is restored. Thus, it can be expected that many variations of the deletions, insertions, and replacements described and illustrated herein can be effective for ameliorating DMD.

Target Sequence Selection

Shifts in the location of the 5' boundary and/or the 3' boundary relative to particular reference loci can be used to facilitate or enhance particular applications of gene editing, which depend in part on the endonuclease system selected for the editing, as further described and illustrated herein.

In a first nonlimiting example of such target sequence selection, many endonuclease systems have rules or criteria that can guide the initial selection of potential target sites for cleavage, such as the requirement of a PAM sequence motif in a particular position adjacent to the DNA cleavage sites in the case of CRISPR Type II or Type V endonucleases.

In another nonlimiting example of target sequence selection or optimization, the frequency of "off-target" activity for a particular combination of target sequence and gene editing endonuclease (i.e. the frequency of DSBs occurring at sites other than the selected target sequence) can be assessed relative to the frequency of on-target activity. In some cases, cells that have been correctly edited at the desired locus can have a selective advantage relative to other cells. Illustrative, but nonlimiting, examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus can be positively selected for by one or more screening methods used to identify, sort or otherwise select for cells that have been correctly edited. Both selective advantage and directed selection methods can take advantage of the phenotype associated with the correction. In some cases, cells can be edited two or more times in order to create a second modification that creates a new phenotype that is used to select or purify the intended population of cells. Such a second modification could be created by adding a second gRNA for a selectable or screenable marker. In some cases, cells can be correctly edited at the desired locus using a DNA fragment that contains the cDNA and also a selectable marker.

Whether any selective advantage is applicable or any directed selection is to be applied in a particular case, target sequence selection can also be guided by consideration of off-target frequencies in order to enhance the effectiveness of the application and/or reduce the potential for undesired alterations at sites other than the desired target. As described further and illustrated herein and in the art, the occurrence of off-target activity can be influenced by a number of factors including similarities and dissimilarities between the target site and various off target sites, as well as the particular endonuclease used. Bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

Another aspect of target sequence selection relates to homologous recombination events. Sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs), which occur on a regular basis during the normal cell replication cycle but can also be enhanced by the occurrence of various events (such as UV light and other inducers of DNA breakage) or the presence of certain agents (such as various chemical inducers). Many such inducers cause DSBs to occur indiscriminately in the genome, and DSBs can be regularly induced and repaired in normal cells. During repair, the original sequence can be reconstructed with complete fidelity, however, in some cases, small insertions or deletions (referred to as "indels") are introduced at the DSB site.

DSBs can also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that can comprise as few as ten basepairs or less, can also be used to bring about desired deletions. For example, a single DSB can be introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

The examples provided herein further illustrate the selection of various target regions for the creation of DSBs designed to induce disruptions, deletions, or replacements that result in restoration of the dystrophin reading frame, as well as the selection of specific target sequences within such regions that are designed to minimize off-target events relative to on-target events.

Nucleic Acid Modifications

In some cases, polynucleotides introduced into cells can comprise one or more modifications that can be used, individually or in combination, for example, to enhance activity, stability or specificity, alter delivery, reduce innate immune responses in host cells, or for other enhancements, as further described herein and known in the art.

In certain examples, modified polynucleotides can be used in the CRISPR/Cas9/Cpf1 system, in which case the guide RNAs (either single-molecule guides or double-molecule guides) and/or a DNA or an RNA encoding a Cas or Cpf1 endonuclease introduced into a cell can be modified, as described and illustrated below. Such modified polynucleotides can be used in the CRISPR/Cas9/Cpf1 system to edit any one or more genomic loci.

Using the CRISPR/Cas9/Cpf1 system for purposes of nonlimiting illustrations of such uses, modifications of guide RNAs can be used to enhance the formation or stability of the CRISPR/Cas9/Cpf1 genome editing complex comprising guide RNAs, which can be single-molecule guides or double-molecule, and a Cas or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in aspects in which a Cas or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNAses present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9/Cpf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9/Cpf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high performance liquid chromatography (HPLC), which avoids the use of gels such as PAGE) tends to become more challenging as polynucleotide lengths increase significantly beyond a hundred or so nucleotides. One approach that can be used for generating chemically-modified RNAs of greater length is to produce two or more molecules that are ligated together. Much longer RNAs, such as those encoding a Cas9 endonuclease, are more readily generated enzymatically. While fewer types of modifications are available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some aspects a 2'-O-alkyl, 2'-O-alkyl-O-alkyl, or 2'-fluoro-modified nucleotide. In some aspects, RNA modifications can comprise 2'-fluoro, 2'-amino or 2' O-methyl modifications on the ribose of pyrimidines, abasic residues, or an inverted base at the 3' end of the RNA. Such modifications can be routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly CH2-NH—O—CH2, CH, ~N(CH3)~O~CH2 (known as a methylene(methylimino) or MMI backbone), CH2-O—N(CH3)-CH2, CH2-N(CH3)-N(CH3)-CH2 and O—N(CH3)-CH2-CH2 backbones, wherein the native phosphodiester backbone is represented as O—P—O—

CH,); amide backbones [see De Mesmaeker et al., Acc. Chem. Res., 28:366-374 (1995)]; morpholino backbone structures (see Summerton and Weller, U.S. Pat. No. 5,034, 506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Braasch and David Corey, Biochemistry, 41(14): 4503-4510 (2002); Genesis, Volume 30, Issue 3, (2001); Heasman, Dev. Biol., 243: 209-214 (2002); Nasevicius et al., Nat. Genet., 26:216-220 (2000); Lacerra et al., Proc. Natl. Acad. Sci., 97: 9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122: 8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and CH2 component parts; see U.S. Pat. Nos. 5,034,506; 5,166,315; 5,185, 444; 5,214,134; 5,216,141; 5,235,033; 5,264,562; 5,264, 564; 5,405,938; 5,434,257; 5,466,677; 5,470,967; 5,489, 677; 5,541,307; 5,561,225; 5,596,086; 5,602,240; 5,610, 289; 5,602,240; 5,608,046; 5,610,289; 5,618,704; 5,623, 070; 5,663,312; 5,633,360; 5,677,437; and 5,677,439, each of which is herein incorporated by reference.

One or more substituted sugar moieties can also be included, e.g., one of the following at the 2' position: OH, SH, SCH3, F, OCN, OCH3 OCH3, OCH3O(CH2)n CH3, O(CH2)n NH2, or O(CH2)n CH3, where n is from 1 to about 10; C1 to C10 lower alkyl, alkoxyalkoxy, substituted lower alkyl, alkaryl or aralkyl; Cl; Br; CN; CF3; OCF3; O-, S-, or N-alkyl; O-, S-, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some aspects, a modification includes 2'-methoxyethoxy (2'-O-CH2CH2OCH3, also known as 2'-O-(2-methoxyethyl)) (Martin et al, Helv. Chim. Acta, 1995, 78, 486). Other modifications include 2'-methoxy (2'-O-CH3), 2'-propoxy (2'-OCH2 CH2CH3) and 2'-fluoro (2'-F). Similar modifications can also be made at other positions on the oligonucleotide, particularly the 3' position of the sugar on the 3' terminal nucleotide and the 5' position of 5' terminal nucleotide. Oligonucleotides can also have sugar mimetics, such as cyclobutyls in place of the pentofuranosyl group.

In some examples, both a sugar and an internucleoside linkage, i.e., the backbone, of the nucleotide units can be replaced with novel groups. The base units can be maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide can be replaced with an amide containing backbone, for example, an aminoethylglycine backbone. The nucleobases can be retained and bound directly or indirectly to aza nitrogen atoms of the amide portion of the backbone. Representative United States patents that teach the preparation of PNA compounds comprise, but are not limited to, U.S. Pat. Nos. 5,539,082; 5,714,331; and 5,719, 262. Further teaching of PNA compounds can be found in Nielsen et al, Science, 254: 1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, as well as synthetic nucleobases, e.g., 2-aminoadenine, 2-(methylamino)adenine, 2-(imidazolylalkyl)adenine, 2-(aminoalklyamino)adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl)adenine, and 2,6-diaminopurine. Kornberg, A., DNA Replication, W. H. Freeman & Co., San Francisco, pp 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are aspects of base substitutions.

Modified nucleobases can comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine, and 3-deazaguanine and 3-deazaadenine.

Further, nucleobases can comprise those disclosed in U.S. Pat. No. 3,687,808, those disclosed in 'The Concise Encyclopedia of Polymer Science And Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., eds, 'Antisense Research and Applications', CRC Press, Boca Raton, 1993, pp. 276-278) and are aspects of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and US Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications can be incorporated in a single oligonucleotide, or even in a single nucleoside within an oligonucleotide.

The guide RNAs and/or mRNA (or DNA) encoding an endonuclease can be chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86: 6553-6556 (1989)]; cholic acid [Manoharan et al., Bioorg. Med. Chem. Let., 4: 1053-1060 (1994)]; a thioether, e.g., hexyl-S-tritylthiol [Manoharan et al, Ann. N. Y. Acad. Sci., 660: 306-309 (1992) and Manoharan et al., Bioorg. Med. Chem. Let., 3: 2765-2770 (1993)]; a thiocholesterol [Oberhauser et al., Nucl. Acids Res., 20: 533-538 (1992)]; an aliphatic chain, e.g., dodecandiol or undecyl residues [Kabanov et al., FEBS Lett., 259: 327-330 (1990) and Svinarchuk et al., Biochimie, 75: 49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36: 3651-3654 (1995) and Shea et al., Nucl. Acids Res., 18: 3777-3783 (1990)]; a polyamine or a polyethylene glycol chain [Mancharan et al., Nucleosides & Nucleotides, 14: 969-973 (1995)]; adamantane acetic acid [Manoharan et al., Tetrahedron Lett., 36: 3651-3654 (1995)]; a palmityl moiety [(Mishra et al., Biochim. Biophys. Acta, 1264: 229-237 (1995)]; or an octadecylamine or hexylamino-carbonyl-t oxycholesterol moiety [Crooke et al., J. Pharmacol. Exp. Ther., 277: 923-937 (1996)]. See also U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599, 928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21(10):1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this disclosure, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine-5'-Triphosphate (5-Methyl-CTP) or N6-Methyl-ATP), or treatment with phosphatase to remove 5' terminal phosphates. These and other modifications are known in the art, and new modifications of RNAs are regularly being developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7(5):618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs (such as m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6(4): 440-468 (2013); Kanasty et al., Molecular Therapy 20(3): 513-524 (2012); Burnett et al., Biotechnol J. 6(9):1130-46 (2011); Judge and MacLachlan, Hum Gene Ther 19(2):111-24 (2008); and references cited therein.

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2: 77-96 (2011); Gaglione and Messere, Mini Rev Med Chem, 10(7):578-95 (2010); Chernolovskaya et al, Curr Opin Mol Ther., 12(2):158-67 (2010); Deleavey et al., Curr Protoc Nucleic Acid Chem Chapter 16:Unit 16.3 (2009); Behlke, Oligonucleotides 18(4):305-19 (2008); Fucini et al., Nucleic Acid Ther 22(3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (Tm), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013), and references cited therein.

Codon-Optimization

A polynucleotide encoding a site-directed polypeptide can be codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

RNPs

The site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP).

Nucleic Acids Encoding System Components

The present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the aspects of the methods of the disclosure.

The nucleic acid encoding a genome-targeting nucleic acid of the disclosure, a site-directed polypeptide of the disclosure, and/or any nucleic acid or proteinaceous molecule necessary to carry out the aspects of the methods of the disclosure can comprise a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some examples, vectors can be capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, Calif. (1990). Regulatory sequences include those that direct constitutive expression of a nucleotide sequence in many types of host cells, and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Additional vectors contemplated for eukaryotic target cells include, but are not limited to, the vectors pCTx-1, pCTx-2, and pCTx-3, which are described in FIGS. 1A to 1C. Other vectors can be used so long as they are compatible with the host cell.

In some examples, a vector can comprise one or more transcription and/or translation control elements. Depending on the host/vector system utilized, any of a number of suitable transcription and translation control elements, including constitutive and inducible promoters, transcription enhancer elements, transcription terminators, etc. can be used in the expression vector. The vector can be a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art, and additional information and approaches are regularly being described; see, e.g., Ma, H. et al., *Molecular Therapy—Nucleic Acids* 3, e161 (2014) doi:10.1038/mtna.2014.12.

The expression vector can also contain a ribosome binding site for translation initiation and a transcription terminator. The expression vector can also comprise appropriate sequences for amplifying expression. The expression vector can also include nucleotide sequences encoding non-native tags (e.g., histidine tag, hemagglutinin tag, green fluorescent protein, etc.) that are fused to the site-directed polypeptide, thus resulting in a fusion protein.

A promoter can be an inducible promoter (e.g., a heat shock promoter, tetracycline-regulated promoter, steroid-regulated promoter, metal-regulated promoter, estrogen receptor-regulated promoter, etc.). The promoter can be a constitutive promoter (e.g., CMV promoter, UBC promoter). In some cases, the promoter can be a spatially restricted and/or temporally restricted promoter (e.g., a tissue specific promoter, a cell type specific promoter, etc.).

The nucleic acid encoding a genome-targeting nucleic acid of the disclosure and/or a site-directed polypeptide can be packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. A variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Delivery

Guide RNA polynucleotides (RNA or DNA) and/or endonuclease polynucleotide(s) (RNA or DNA) can be delivered by viral or non-viral delivery vehicles known in the art. Alternatively, endonuclease polypeptide(s) can be delivered by non-viral delivery vehicles known in the art, such as electroporation or lipid nanoparticles. In further alternative aspects, the DNA endonuclease can be delivered as one or more polypeptides, either alone or pre-complexed with one or more guide RNAs, or one or more crRNA together with a tracrRNA.

Polynucleotides can be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18: 1127-1133 (2011) (which focuses on non-viral delivery vehicles for siRNA that are also useful for delivery of other polynucleotides).

Polynucleotides, such as guide RNA, sgRNA, and mRNA encoding an endonuclease, can be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle can range in size from 1-1000 nm, 1-500 nm, 1-250 nm, 25-200 nm, 25-100 nm, 35-75 nm, or 25-60 nm.

LNPs can be made from cationic, anionic, or neutral lipids. Neutral lipids, such as the fusogenic phospholipid DOPE or the membrane component cholesterol, can be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs can also be comprised of hydrophobic lipids, hydrophilic lipids, or both hydrophobic and hydrophilic lipids.

Any lipid or combination of lipids that are known in the art can be used to produce a LNP. Examples of lipids used to produce LNPs are: DOTMA, DOSPA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids can be combined in any number of molar ratios to produce a LNP. In addition, the polynucleotide(s) can be combined with lipid(s) in a wide range of molar ratios to produce a LNP.

As stated previously, the site-directed polypeptide and genome-targeting nucleic acid can each be administered separately to a cell or a patient. On the other hand, the site-directed polypeptide can be pre-complexed with one or more guide RNAs, or one or more crRNA together with a tracrRNA. The pre-complexed material can then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP can be modified or unmodified. Likewise, the gRNA, crRNA, tracrRNA, or sgRNA can be modified or unmodified. Numerous modifications are known in the art and can be used.

The endonuclease and sgRNA can be combined in a 1:1 molar ratio. Alternatively, the endonuclease, crRNA and tracrRNA can be generally combined in a 1:1:1 molar ratio. However, a wide range of molar ratios can be used to produce a RNP.

A recombinant adeno-associated virus (AAV) vector can be used for delivery. Techniques to produce rAAV particles, in which an AAV genome to be packaged that includes the polynucleotide to be delivered, rep and cap genes, and helper virus functions are provided to a cell are standard in the art. Production of rAAV typically requires that the following components are present within a single cell (denoted herein as a packaging cell): a rAAV genome, AAV rep and cap genes separate from (i.e., not in) the rAAV genome, and helper virus functions. The AAV rep and cap genes can be from any AAV serotype for which recombinant virus can be derived, and can be from a different AAV serotype than the rAAV genome ITRs, including, but not limited to, AAV serotypes AAV-1, AAV-2, AAV-3, AAV-4, AAV-5, AAV-6, AAV-7, AAV-8, AAV-9, AAV-10, AAV-11, AAV-12, AAV-13 and AAV rh.74. Production of pseudotyped rAAV is disclosed in, for example, international patent application publication number WO 01/83692. See Table 3.

TABLE 3

| AAV Serotype | Genbank Accession No. |
| --- | --- |
| AAV-1 | NC_002077.1 |
| AAV-2 | NC_001401.2 |
| AAV-3 | NC_001729.1 |
| AAV-3B | AF028705.1 |
| AAV-4 | NC_001829.1 |
| AAV-5 | NC_006152.1 |
| AAV-6 | AF028704.1 |
| AAV-7 | NC_006260.1 |

TABLE 3-continued

| AAV Serotype | Genbank Accession No. |
| --- | --- |
| AAV-8 | NC_006261.1 |
| AAV-9 | AX753250.1 |
| AAV-10 | AY631965.1 |
| AAV-11 | AY631966.1 |
| AAV-12 | DQ813647.1 |
| AAV-13 | EU285562.1 |

A method of generating a packaging cell involves creating a cell line that stably expresses all of the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line can then be infected with a helper virus, such as adenovirus. The advantages of this method are that the cells are selectable and are suitable for large-scale production of rAAV. Other examples of suitable methods employ adenovirus or baculovirus, rather than plasmids, to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658,776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types can be transduced by the indicated AAV serotypes among others. See Table 4.

TABLE 4

| Tissue/Cell Type | Serotype |
| --- | --- |
| Liver | AAV8, AAV3, AAV5, AAV9 |
| Skeletal muscle | AAV1, AAV7, AAV6, AAV8, AAV9 |
| Central nervous system | AAV5, AAV1, AAV4 |
| RPE | AAV5, AAV4 |
| Photoreceptor cells | AAV5 |
| Lung | AAV9 |
| Heart | AAV8 |
| Pancreas | AAV8 |
| Kidney | AAV2 |

Genetically Modified Cells

The term "genetically modified cell" refers to a cell that comprises at least one genetic modification introduced by genome editing (e.g., using the CRISPR/Cas system). In some ex vivo examples herein, the genetically modified cell can be a genetically modified progenitor cell. In some in vivo examples herein, the genetically modified cell can be a genetically modified muscle cell or genetically modified muscle pre-cursor cell. A genetically modified cell comprising an exogenous genome-targeting nucleic acid and/or an exogenous nucleic acid encoding a genome-targeting nucleic acid is contemplated herein.

The term "control treated population" describes a population of cells that has been treated with identical media, viral induction, nucleic acid sequences, temperature, confluency, flask size, pH, etc., with the exception of the addition of the genome editing components. Any method known in the art can be used to measure restoration of the dystrophin reading frame, for example, Western Blot analysis of the dystrophin protein or quantifying dystrophin mRNA.

The term "isolated cell" refers to a cell that has been removed from an organism in which it was originally found, or a descendant of such a cell. Optionally, the cell can be cultured in vitro, e.g., under defined conditions or in the presence of other cells. Optionally, the cell can be later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some cases, the isolated population can be a substantially pure population of cells, as compared to the heterogeneous population from which the cells were isolated or enriched. In some cases, the isolated population can be an isolated population of human progenitor cells, e.g., a substantially pure population of human progenitor cells, as compared to a heterogeneous population of cells comprising human progenitor cells and cells from which the human progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating DMD.

The term "substantially enriched" with respect to a particular cell population, refers to a population of cells that is at least about 10%, about 20%, about 30%, about 40%, about 50%, about 60%, about 70% or more with respect to the cells making up a total cell population.

The term "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of progenitor cells, refers to a population of cells that contain fewer than about 20%, about 15%, about 10%, about 9%, about 8%, about 7%, about 6%, about 5%, about 4%, about 3%, about 2%, about 1%, or less than 1%, of cells that are not progenitor cells as defined by the terms herein.

Differentiation of Corrected iPSCs into Pax7+ Muscle Progenitor Cells

Another step of the ex vivo methods of the present disclosure involves differentiating the corrected iPSCs into Pax7+ muscle progenitor cells. The differentiating step can be performed according to any method known in the art. For example, the differentiating step can comprise contacting the genome-edited iPSC with specific media formulations, including small molecule drugs, to differentiate it into a Pax7+ muscle progenitor cell, as shown in Chal, Oginuma et al. 2015. Alternatively, iPSCs, myogenic progenitors, and cells of other lineages can be differentiated into muscle using any one of a number of established methods that involve transgene over expression, serum withdrawal, and/or small molecule drugs, as shown in the methods of Tapscott, Davis et al. 1988, Langen, Schols et al. 2003, Fujita, Endo et al. 2010, Xu, Tabebordbar et al. 2013, Shoji, Woltjen et al. 2015.

Implanting Pax7+ Muscle Progenitor Cells into Patients

Another step of the ex vivo methods of the invention involves implanting the Pax7+ muscle progenitor cells into patients. This implanting step can be accomplished using any method of implantation known in the art. For example, the genetically modified cells can be injected directly in the patient's muscle.

Pharmaceutically Acceptable Carriers

The ex vivo methods of administering progenitor cells to a subject contemplated herein involve the use of therapeutic compositions comprising progenitor cells.

Therapeutic compositions can contain a physiologically tolerable carrier together with the cell composition, and optionally at least one additional bioactive agent as described herein, dissolved or dispersed therein as an active ingredient. In some cases, the therapeutic composition is not substantially immunogenic when administered to a mammal or human patient for therapeutic purposes, unless so desired.

In general, the progenitor cells described herein can be administered as a suspension with a pharmaceutically acceptable carrier. One of skill in the art can recognize that a pharmaceutically acceptable carrier to be used in a cell composition can not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition can depend on the nature of the disorder or condition, and can be determined by standard clinical techniques.

Administration & Efficacy

The terms "administering," "introducing" and "transplanting" are used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny, can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some aspects described herein, an effective amount of myogenic progenitor cells is administered via a systemic route of administration, such as an intraperitoneal or intravenous route.

The terms "individual", "subject," "host" and "patient" are used interchangeably herein and refer to any subject for whom diagnosis, treatment or therapy is desired. In some aspects, the subject is a mammal. In some aspects, the subject is a human being.

When provided prophylactically, progenitor cells described herein can be administered to a subject in advance of any symptom of DMD, e.g., prior to the development of muscle wasting. Accordingly, the prophylactic administration of a muscle progenitor cell population can serve to prevent DMD.

When provided therapeutically, muscle progenitor cells can be provided at (or after) the onset of a symptom or indication of DMD, e.g., upon the onset of muscle wasting.

The muscle progenitor cell population being administered according to the methods described herein can comprise allogeneic muscle progenitor cells obtained from one or more donors. "Allogeneic" refers to a muscle progenitor cell or biological samples comprising muscle progenitor cells obtained from one or more different donors of the same species, where the genes at one or more loci are not identical. For example, a muscle progenitor cell population being administered to a subject can be derived from one more unrelated donor subjects, or from one or more non-identical siblings. In some cases, syngeneic muscle progenitor cell populations can be used, such as those obtained from genetically identical animals, or from identical twins. The muscle progenitor cells can be autologous cells; that is, the muscle progenitor cells are obtained or isolated from a subject and administered to the same subject, i.e., the donor and recipient are the same.

The term "effective amount" refers to the amount of a population of progenitor cells or their progeny needed to prevent or alleviate at least one or more signs or symptoms of DMD, and relates to a sufficient amount of a composition to provide the desired effect, e.g., to treat a subject having DMD. The term "therapeutically effective amount" therefore refers to an amount of progenitor cells or a composition comprising progenitor cells that is sufficient to promote a particular effect when administered to a typical subject, such as one who has or is at risk for DMD. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various aspects described herein, an effective amount of progenitor cells comprises at least $10^2$ progenitor cells, at least $5 \times 10^2$ progenitor cells, at least $10^3$ progenitor cells, at least $5 \times 10^3$ progenitor cells, at least $10^4$ progenitor cells, at least $5 \times 10^4$ progenitor cells, at least $10^5$ progenitor cells, at least $2 \times 10^5$ progenitor cells, at least $3 \times 10^5$ progenitor cells, at least $4 \times 10^5$ progenitor cells, at least $5 \times 10^5$ progenitor cells, at least $6 \times 10^5$ progenitor cells, at least $7 \times 10^5$ progenitor cells, at least $8 \times 10^5$ progenitor cells, at least $9 \times 10^5$ progenitor cells, at least $1 \times 10^6$ progenitor cells, at least $2 \times 10^6$ progenitor cells, at least $3 \times 10^6$ progenitor cells, at least $4 \times 10^6$ progenitor cells, at least $5 \times 10^6$ progenitor cells, at least $6 \times 10^6$ progenitor cells, at least $7 \times 10^6$ progenitor cells, at least $8 \times 10^6$ progenitor cells, at least $9 \times 10^6$ progenitor cells, or multiples thereof. The progenitor cells can be derived from one or more donors, or can be obtained from an autologous source. In some examples described herein, the progenitor cells can be expanded in culture prior to administration to a subject in need thereof.

Modest and incremental increases in the levels of functional dystrophin expressed in cells of patients having DMD can be beneficial for ameliorating one or more symptoms of the disease, for increasing long-term survival, and/or for reducing side effects associated with other treatments. Upon administration of such cells to human patients, the presence of muscle progenitors that are producing increased levels of functional dystrophin is beneficial. In some cases, effective treatment of a subject gives rise to at least about 3%, 5%, or 7% functional dystrophin relative to total dystrophin in the treated subject. In some examples, functional dystrophin will be at least about 10% of total dystrophin. In some examples, functional dystrophin will be at least about 20% to 30% of total dystrophin. Similarly, the introduction of even relatively limited subpopulations of cells having significantly elevated levels of functional dystrophin can be beneficial in various patients because in some situations normalized cells will have a selective advantage relative to diseased cells. However, even modest levels of muscle progenitors with elevated levels of functional dystrophin can be beneficial for ameliorating one or more aspects of DMD in patients. In some examples, about 10%, about 20%, about 30%, about 40%, about 50%, about 60%, about 70%, about 80%, about 90% or more of the muscle progenitors in patients to whom such cells are administered are producing increased levels of functional dystrophin.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1 \times 10^4$ cells are delivered to the desired site for a period of time. Modes of administration include injection, infusion, instillation, or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some examples, the route is intravenous. For the delivery of cells, administration by injection or infusion can be made.

The cells are administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of DMD can be determined by the skilled clinician. However, a treatment is considered "effective treatment," if any one or all of the signs or symptoms of, as but one example, levels of functional dystrophin are altered in a beneficial manner (e.g., increased by at least 10%), or other clinically accepted symptoms or markers of disease are improved or ameliorated. Efficacy can also be measured by failure of an individual to worsen as assessed by hospitalization or need for medical interventions (e.g., reduced muscle wasting, or progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present disclosure can ameliorate one or more symptoms associated with DMD by increasing the amount of functional dystrophin in the individual. Early signs typically associated with DMD, include for example, delayed walking, enlarged calf muscle (due to scar tissue), and falling frequently. As the disease progresses, children become wheel chair bound due to muscle wasting and pain. The disease becomes life threatening due to heart and/or respiratory complications.

Kits

The present disclosure provides kits for carrying out the methods described herein. A kit can include one or more of a genome-targeting nucleic acid, a polynucleotide encoding a genome-targeting nucleic acid, a site-directed polypeptide, a polynucleotide encoding a site-directed polypeptide, and/or any nucleic acid or proteinaceous molecule necessary to carry out the aspects of the methods described herein, or any combination thereof.

A kit can comprise: (1) a vector comprising a nucleotide sequence encoding a genome-targeting nucleic acid, and (2) the site directed polypeptide or a vector comprising a nucleotide sequence encoding the site-directed polypeptide, and (3) a reagent for reconstitution and/or dilution of the vector(s) and or polypeptide.

A kit can comprise: (1) a vector comprising (i) a nucleotide sequence encoding a genome-targeting nucleic acid, and (ii) a nucleotide sequence encoding the site-directed polypeptide and (2) a reagent for reconstitution and/or dilution of the vector.

In some of the kits, the kit can comprise a single-molecule guide genome-targeting nucleic acid. In any of the above kits, the kit can comprise a double-molecule genome-targeting nucleic acid. In any of the kits, the kit can comprise two or more double-molecule guides or single-molecule guides. The kits can comprise a vector that encodes the nucleic acid targeting nucleic acid.

In any of the kits, the kit can further comprise a polynucleotide to be inserted to effect the desired genetic modification.

Components of a kit can be in separate containers, or combined in a single container.

Any kit can further comprise one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. A kit can also comprise one or more components that can be used to facilitate or enhance the on-target binding or the cleavage of DNA by the endonuclease, or improve the specificity of targeting.

In addition to the above-mentioned components, a kit can further comprise instructions for using the components of the kit to practice the methods. The instructions for practicing the methods can be recorded on a suitable recording medium. For example, the instructions can be printed on a substrate, such as paper or plastic, etc. The instructions can be present in the kits as a package insert, in the labeling of the container of the kit or components thereof (i.e., associated with the packaging or subpackaging), etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this case is a kit that comprises a web address where the instructions can be viewed and/or from which the instructions can be downloaded. As with the instructions, this means for obtaining the instructions can be recorded on a suitable substrate.

Guide RNA Formulation

Guide RNAs of the present disclosure can be formulated with pharmaceutically acceptable excipients such as carriers, solvents, stabilizers, adjuvants, diluents, etc., depending upon the particular mode of administration and dosage form. Guide RNA compositions can be formulated to achieve a physiologically compatible pH, and range from a pH of about 3 to a pH of about 11, about pH 3 to about pH 7, depending on the formulation and route of administration. In some cases, the pH can be adjusted to a range from about pH 5.0 to about pH 8. In some cases, the compositions can comprise a therapeutically effective amount of at least one compound as described herein, together with one or more pharmaceutically acceptable excipients. Optionally, the compositions can comprise a combination of the compounds described herein, or can include a second active ingredient useful in the treatment or prevention of bacterial growth (for example and without limitation, anti-bacterial or anti-microbial agents), or can include a combination of reagents of the present disclosure.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients can include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

Other Possible Therapeutic Approaches

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR-Cas9 nuclease systems. The nuclease platforms vary in difficulty of design, targeting density and mode of action, particularly as the specificity of ZFNs and TALENs is through protein-DNA interactions, while RNA-DNA interactions primarily guide Cas9. Cas9 cleavage also requires an adjacent motif, the PAM, which differs between different CRISPR systems. Cas9 from *Streptococcus pyogenes* cleaves using a NGG PAM, CRISPR from *Neisseria meningitidis* can cleave at sites with PAMs including NNNNGATT, NNNNNGTTT and NNNNGCTT. A number of other Cas9 orthologs target protospacer adjacent to alternative PAMs.

CRISPR endonucleases, such as Cas9, can be used in the methods of the present disclosure. However, the teachings described herein, such as therapeutic target sites, could be applied to other forms of endonucleases, such as ZFNs, TALENs, HEs, or MegaTALs, or using combinations of nucleases. However, in order to apply the teachings of the present disclosure to such endonucleases, one would need to, among other things, engineer proteins directed to the specific target sites.

Additional binding domains can be fused to the Cas9 protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site Zinc Finger Nucleases Zinc finger nucleases (ZFNs) are modular proteins comprised of an engineered zinc finger DNA binding domain linked to the catalytic domain of the type II endonuclease FokI. Because FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect of ZFNs is that they can be readily re-targeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the typical 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other, and not with themselves. Forcing the obligate heterodimer prevents formation of the homodimer. This has greatly enhanced specificity of ZFNs, as well as any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., *Proc Natl Acad Sci USA* 96(6):2758-63 (1999); Dreier B et al., *J Mol Biol.* 303(4):489-502 (2000); Liu Q et al., *J Biol Chem.* 277(6):3850-6 (2002); Dreier et al., *J Biol Chem* 280(42): 35588-97 (2005); and Dreier et al., *J Biol Chem.* 276(31): 29466-78 (2001).

Transcription Activator-Like Effector Nucleases (TALENs)

TALENs represent another format of modular nucleases whereby, as with ZFNs, an engineered DNA binding domain is linked to the FokI nuclease domain, and a pair of TALENs operate in tandem to achieve targeted DNA cleavage. The major difference from ZFNs is the nature of the DNA binding domain and the associated target DNA sequence recognition properties. The TALEN DNA binding domain derives from TALE proteins, which were originally described in the plant bacterial pathogen *Xanthomonas* sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ile, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefited from the use of obligate heterodimer variants of the FokI domain to reduce off-target activity.

Additional variants of the FokI domain have been created that are deactivated in their catalytic function. If one half of either a TALEN or a ZFN pair contains an inactive FokI domain, then only single-strand DNA cleavage (nicking) will occur at the target site, rather than a DSB. The outcome is comparable to the use of CRISPR/Cas9/Cpf1 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB, which is prone to NHEJ-mediated mis-repair.

A variety of TALEN-based systems have been described in the art, and modifications thereof are regularly reported; see, e.g., Boch, *Science* 326(5959):1509-12 (2009); Mak et al., *Science* 335(6069):716-9 (2012); and Moscou et al., *Science* 326(5959):1501 (2009). The use of TALENs based on the "Golden Gate" platform, or cloning scheme, has been described by multiple groups; see, e.g., Cermak et al., *Nucleic Acids Res.* 39(12):e82 (2011); Li et al., *Nucleic Acids Res.* 39(14):6315-25 (2011); Weber et al., *PLoS One.* 6(2):e16765 (2011); Wang et al., *J Genet Genomics* 41(6): 339-47, Epub 2014 May 17 (2014); and Cermak T et al., *Methods Mol Biol.* 1239:133-59 (2015).

Homing Endonucleases

Homing endonucleases (HEs) are sequence-specific endonucleases that have long recognition sequences (14-44 base pairs) and cleave DNA with high specificity—often at sites unique in the genome. There are at least six known families of HEs as classified by their structure, including LAGLIDADG (SEQ ID NO. 1,410,474), GIY-YIG, His-Cis box, H—N—H, PD-(D/E)xK, and Vsr-like that are derived from a broad range of hosts, including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., Glycobiology 24(8): 663-80 (2014); Belfort and Bonocora, *Methods Mol* Biol. 1123:1-26 (2014); Hafez and Hausner, Genome 55(8):553-69 (2012); and references cited therein.

MegaTAL/Tev-mTALEN/MegaTev

As further examples of hybrid nucleases, the MegaTAL platform and Tev-mTALEN platform use a fusion of TALE DNA binding domains and catalytically active HEs, taking advantage of both the tunable DNA binding and specificity of the TALE, as well as the cleavage sequence specificity of the HE; see, e.g., Boissel et al., *NAR* 42: 2591-2601 (2014); Kleinstiver et al., G3 4:1155-65 (2014); and Boissel and Scharenberg, *Methods Mol. Biol.* 1239: 171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on a DNA substrate and generate two DSBs with non-compatible cohesive ends; see, e.g., Wolfs et al., *NAR* 42, 8816-29 (2014). It is anticipated that other combinations of existing nuclease-based approaches will evolve and be useful in achieving the targeted genome modifications described herein.

dCas9-FokI or dCpf1-Fok1 and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create a DSB. The specificity of targeting is driven by a 20 or 24 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated, particularly in the 5' half of the target sequence, effectively reducing the number of bases that drive specificity. One solution to this has been to completely deactivate the Cas9 or Cpf1 catalytic function—retaining only the RNA-guided DNA binding function—and instead fusing a FokI domain to the deactivated Cas9; see, e.g., Tsai et al., *Nature Biotech* 32: 569-76 (2014); and Guilinger et al., *Nature Biotech.* 32: 577-82 (2014). Because FokI must dimerize to become catalytically active, two guide RNAs are required to tether two FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-TevI, takes advantage of both the tunable DNA binding and specificity of the TALE, as well as the cleavage sequence specificity of I-TevI, with the expectation that off-target cleavage can be further reduced.

Methods and Compositions of the Invention

Accordingly, the present disclosure relates in particular to the following non-limiting inventions: In a first method, Method 1, the present disclosure provides a method for editing a dystrophin gene in a human cell by genome editing, the method comprising the step of: introducing into the human cell one or more deoxyribonucleic acid (DNA) endonucleases to effect one or more single-strand breaks (SSBs) or double-strand breaks (DSBs) within or near the dystrophin gene that results in a permanent deletion, insertion, or replacement of one or more exons or aberrant intronic splice acceptor or donor sites within or near the dystrophin gene and results in restoration of the dystrophin reading frame and restoration of the dystrophin protein activity.

In another method, Method 2, the present disclosure provides a method for editing a dystrophin gene in a human cell by genome editing, as provided in Method 1, wherein the human cell is a muscle cell or muscle precursor cell.

In another method, Method 3, the present disclosure provides an ex vivo method for treating a patient with Duchenne Muscular Dystrophy (DMD), the method comprising the steps of: i) creating a DMD patient specific induced pluripotent stem cell (iPSC); ii) editing within or near a dystrophin gene of the iPSC; iii) differentiating the genome-edited iPSC into a Pax7+ muscle progenitor cell; and iv) implanting the Pax7+ muscle progenitor cell into the patient.

In another method, Method 4, the present disclosure provides an ex vivo method for treating a patient with DMD, as provided in Method 3, wherein the creating step comprises: a) isolating a somatic cell from the patient; and b) introducing a set of pluripotency-associated genes into the somatic cell to induce the somatic cell to become a pluripotent stem cell.

In another method, Method 5, the present disclosure provides an ex vivo method for treating a patient with DMD, as provided in Method 4, wherein the somatic cell is a fibroblast.

In another method, Method 6, the present disclosure provides an ex vivo method for treating a patient with DMD, as provided in Methods 4 and 5, wherein the set of pluripotency-associated genes is one or more of the genes selected from the group consisting of OCT4, SOX2, KLF4, Lin28, NANOG and cMYC.

In another method, Method 7, the present disclosure provides an ex vivo method for treating a patient with DMD, as provided in any one of Methods 3-6, wherein the editing step comprises introducing into the iPSC one or more deoxyribonucleic acid (DNA) endonucleases to effect one or more single-strand breaks (SSBs) or double-strand breaks (DSBs) within or near the dystrophin gene that results in a permanent deletion, insertion, or replacement of one or more exons or aberrant intronic splice acceptor or donor sites within or near the dystrophin gene and results in restoration of the dystrophin reading frame and restoration of the dystrophin protein activity.

In another method, Method 8, the present disclosure provides an ex vivo method for treating a patient with DMD, as provided in any one of Methods 3-7, wherein the differentiating step comprises one or more of the following to differentiate the genome-edited iPSC into a Pax7+ muscle progenitor cell: contacting the genome-edited iPSC with specific media formulations, including small molecule drugs; transgene overexpression; or serum withdrawal.

In another method, Method 9, the present disclosure provides an ex vivo method for treating a patient with DMD, as provided in any one of Methods 3-8, wherein the implanting step comprises implanting the Pax7+ muscle progenitor cell into the patient by local injection into the desired muscle.

In another method, Method 10, the present disclosure provides an in vivo method for treating a patient with DMD, the method comprising the step of editing a dystrophin gene in a cell of the patient.

In another method, Method 11, the present disclosure provides an in vivo method for treating a patient with DMD, as provided in Method 10, wherein the editing step comprises introducing into the cell of the patient one or more deoxyribonucleic acid (DNA) endonucleases to effect one or more single-strand breaks (SSBs) or double-strand breaks (DSBs) within or near the dystrophin gene that results in a permanent deletion, insertion, or replacement of one or more exons or aberrant intronic splice acceptor or donor sites within or near the dystrophin gene and results in restoration of the dystrophin reading frame and restoration of the dystrophin protein activity.

In another method, Method 12, the present disclosure provides an in vivo method for treating a patient with DMD, as provided in Method 11, wherein the cell is a muscle cell or muscle precursor cell.

In another method, Method 13, the present disclosure provides an in vivo method for treating a patient with DMD, as provided in any one of Methods 1, 7, and 11, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, a codon-optimized thereof, modified version thereof, and combinations thereof.

In another method, Method 14, the present disclosure provides a method as provided in Method 13, wherein the method comprises introducing into the cell one or more polynucleotides encoding the one or more DNA endonucleases.

In another method, Method 15, the present disclosure provides a method as provided in Method 13, wherein the method comprises introducing into the cell one or more ribonucleic acids (RNAs) encoding the one or more DNA endonucleases.

In another method, Method 16, the present disclosure provides a method as provided in Methods 14 and 15, wherein the one or more polynucleotides or one or more RNAs is one or more modified polynucleotides or one or more modified RNAs.

In another method, Method 17, the present disclosure provides a method as provided in Method 13, wherein the one or more DNA endonuclease is one or more proteins or polypeptides.

In another method, Method 18, the present disclosure provides a method as provided in any one of Methods 1-17, wherein the method further comprises introducing into the cell one or more guide ribonucleic acids (gRNAs).

In another method, Method 19, the present disclosure provides a method as provided in Method 18, wherein the one or more gRNAs are single-molecule guide RNA (sgRNAs).

In another method, Method 20, the present disclosure provides a method as provided in Methods 18 and 19, wherein the one or more gRNAs or one or more sgRNAs is one or more modified gRNAs or one or more modified sgRNAs.

In another method, Method 21, the present disclosure provides a method as provided in any one of Methods 18-20, wherein the one or more DNA endonucleases is pre-complexed with one or more gRNAs or one or more sgRNAs.

In another method, Method 22, the present disclosure provides a method as provided in any one of Methods 1-21, wherein the method further comprises introducing into the cell a polynucleotide donor template comprising at least a portion of the wild-type dystrophin gene or cDNA.

In another method, Method 23, the present disclosure provides a method as provided in Method 22, wherein the at least a portion of the wild-type dystrophin gene or cDNA includes at least a part of exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

In another method, Method 24, the present disclosure provides a method as provided in Method 22, wherein the at least a portion of the wild-type dystrophin gene or cDNA includes exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

In another method, Method 25, the present disclosure provides a method as provided in any one of Methods 22-24, wherein the donor template is a single or double stranded polynucleotide.

In another method, Method 26, the present disclosure provides a method as provided in any one of Methods 1, 7, and 11, wherein the method further comprises introducing into the cell one or more guide ribonucleic acid (gRNAs), and wherein the one or more DNA endonucleases is one or more Cas9 or Cpf1 endonucleases that effect a pair of single-strand breaks (SSBs) or double-strand breaks (DSBs), the first SSB or DSB break at a 5' locus and the second SSB or DSB break at a 3' locus, that results in a permanent deletion or replacement of one or more exons or aberrant intronic splice acceptor or donor sites between the 5' locus and the 3' locus within or near the dystrophin gene and results in restoration of the dystrophin reading frame and restoration of the dystrophin protein activity.

In another method, Method 27, the present disclosure provides a method as provided in Method 26, wherein one gRNA creates a pair of SSBs or DSBs.

In another method, Method 28, the present disclosure provides a method as provided in Method 26, wherein one gRNA comprises a spacer sequence that is complementary to either the 5' locus, the 3' locus, or a segment between the 5' locus and 3' locus.

In another method, Method 29, the present disclosure provides a method as provided in Method 26, wherein the method comprises a first gRNA and a second gRNA, wherein the first gRNA comprises a spacer sequence that is complementary to a segment of the 5' locus and the second gRNA comprises a spacer sequence that is complementary to a segment of the 3' locus.

In another method, Method 30, the present disclosure provides a method as provided in Methods 26-29, wherein the one or more gRNAs are one or more single-molecule guide RNAs (sgRNAs).

In another method, Method 31, the present disclosure provides a method as provided in Methods 26-30, wherein the one or more gRNAs or one or more sgRNAs are one or more modified gRNAs or one or more modified sgRNAs.

In another method, Method 32, the present disclosure provides a method as provided in any one of Methods 26-31, wherein the one or more DNA endonucleases is pre-complexed with one or more gRNAs or one or more sgRNAs.

In another method, Method 33, the present disclosure provides a method as provided in any one of Methods 26-32, wherein there is a deletion of the chromosomal DNA between the 5' locus and the 3' locus.

In another method, Method 34, the present disclosure provides a method as provided in any one of Methods 26-33, wherein the deletion is a single exon deletion.

In another method, Method 35, the present disclosure provides a method as provided in Method 34, wherein the single exon deletion is a deletion of exon 2, exon 8, exon 43, exon 44, exon 45, exon 46, exon 50, exon 51, exon 52, or exon 53.

In another method, Method 36, the present disclosure provides a method as provided in Methods 34 or 35, wherein the 5' locus is proximal to a 5' boundary of a single exon selected from the group consisting of exon 2, exon 8, exon 43, exon 44, exon 45, exon 46, exon 50, exon 51, exon 52, and exon 53.

In another method, Method 37, the present disclosure provides a method as provided in any one of Methods 34-36, wherein the 3' locus is proximal to a 3' boundary of a single exon selected from the group consisting of exon 2, exon 8, exon 43, exon 44, exon 45, exon 46, exon 50, exon 51, exon 52, and exon 53.

In another method, Method 38, the present disclosure provides a method as provided in any one of Methods 34-37, wherein the 5' locus is proximal to a 5' boundary and the 3' locus is proximal to the 3' boundary of a single exon selected from the group consisting of exon 2, exon 8, exon 43, exon 44, exon 45, exon 46, exon 50, exon 51, exon 52, and exon 53.

In another method, Method 39, the present disclosure provides a method as provided in any one of Methods 36-38, wherein proximal to the boundary of the exon includes the surrounding splice donors and acceptors of the neighboring intron.

In another method, Method 40, the present disclosure provides a method as provided in any one of Methods 26-33, wherein the deletion is a multi-exon deletion.

In another method, Method 41, the present disclosure provides a method as provided in Method 40, wherein the multi-exon deletion is a deletion of exons 45-53 or exons 45-55.

In another method, Method 42, the present disclosure provides a method as provided in any one of Methods 40-41, wherein the 5' locus is proximal to a 5' boundary of multiple exons selected from the group consisting of exons 45-53 and exons 45-55.

In another method, Method 43, the present disclosure provides a method as provided in any one of Methods 40-42, wherein the 3' locus is proximal to a 3' boundary of multiple exons selected from the group consisting of exons 45-53 and exons 45-55.

In another method, Method 44, the present disclosure provides a method as provided in any one of Methods 40-43, wherein the 5' locus is proximal to a 5' boundary and a 3' locus is proximal to the 3' boundary of multiple exons selected from the group consisting of exons 45-53 and exons 45-55.

In another method, Method 45, the present disclosure provides a method as provided in any one of Methods 42-44, wherein proximal to the boundary of the exon includes the surrounding splice donors and acceptors of the neighboring intron.

In another method, Method 46, the present disclosure provides a method as provided in any one of Methods 26-32, wherein there is a replacement of the chromosomal DNA between the 5' locus and the 3' locus.

In another method, Method 47, the present disclosure provides a method as provided in any one of Methods 26-32 and 46, wherein the replacement is a single exon replacement.

In another method, Method 48, the present disclosure provides a method as provided in any one of Methods 26-32 and 46-47, wherein the single exon replacement is a replacement of exon 2, exon 8, exon 43, exon 44, exon 45, exon 46, exon 50, exon 51, exon 52, exon 53, or exon 70.

In another method, Method 49, the present disclosure provides a method as provided in any one of Methods 47-48, wherein the 5' locus is proximal to a 5' boundary of a single exon selected from the group consisting of exon 2, exon 8, exon 43, exon 44, exon 45, exon 46, exon 50, exon 51, exon 52, exon 53, or exon 70.

In another method, Method 50, the present disclosure provides a method as provided in any one of Methods 47-49, wherein the 3' locus is proximal to a 3' boundary of a single exon selected from the group consisting of exon 2, exon 8, exon 43, exon 44, exon 45, exon 46, exon 50, exon 51, exon 52, exon 53, or exon 70.

In another method, Method 51, the present disclosure provides a method as provided in any one of Methods 47-50, wherein the 5' locus is proximal to a 5' boundary and a 3' locus is proximal to the 3' boundary of a single exon selected from the group consisting of exon 2, exon 8, exon 43, exon 44, exon 45, exon 46, exon 50, exon 51, exon 52, exon 53, or exon 70.

In another method, Method 52, the present disclosure provides a method as provided in any one of Methods 49-51, wherein proximal to the boundary of the exon includes the surrounding splice donors and acceptors of the neighboring intron or neighboring exon.

In another method, Method 53, the present disclosure provides a method as provided in any one of Methods 26-32 or 46, wherein the replacement is a multi-exon replacement.

In another method, Method 54, the present disclosure provides a method as provided in any one of Method 53, wherein the multi-exon replacement is a replacement of exons 45-53 or exons 45-55.

In another method, Method 55, the present disclosure provides a method as provided in any one of Methods 53-54, wherein the 5' locus is proximal to a 5' boundary of multiple exons selected from the group consisting of exons 45-53 and exons 45-55.

In another method, Method 56, the present disclosure provides a method as provided in any one of Methods 53-55, wherein the 3' locus is proximal to a 3' boundary of multiple exons selected from the group consisting of exons 45-53 and exons 45-55.

In another method, Method 57, the present disclosure provides a method as provided in any one of Methods 53-56, wherein the 5' locus is proximal to a 5' boundary and a 3' locus is proximal to the 3' boundary of multiple exons selected from the group consisting of exons 45-53 and exons 45-55.

In another method, Method 58, the present disclosure provides a method as provided in any one of Methods 55-57, wherein proximal to the boundary of the exon includes the surrounding splice donors and acceptors of the neighboring intron.

In another method, Method 59, the present disclosure provides a method as provided in any one of Methods 46-58, wherein the method further comprises introducing into the cell a polynucleotide donor template comprising at least a portion of the wild-type dystrophin gene or cDNA, and the replacement is by homology directed repair (HDR).

In another method, Method 60, the present disclosure provides a method as provided in any one of Method 59, wherein the at least a portion of the wild-type dystrophin gene or cDNA includes at least a part of exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

In another method, Method 61, the present disclosure provides a method as provided in any one of Method 59, wherein the at least a portion of the wild-type dystrophin gene or cDNA includes exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

In another method, Method 62, the present disclosure provides a method as provided in any one of Methods 1, 7, or 11, wherein the method further comprises introducing into the cell one guide ribonucleic acid (gRNA) and a polynucleotide donor template comprising at least a portion of the wild-type dystrophin gene, and wherein the one or more DNA endonucleases is one or more Cas9 or Cpf1 endonucleases that effect one single-strand break (SSB) or double-strand break (DSB) at a locus within or near the dystrophin gene that facilitates insertion of a new sequence from the polynucleotide donor template into the chromosomal DNA at the locus that results in permanent insertion or correction of one or more exons or aberrant intronic splice acceptor or donor sites within or near the dystrophin gene and results in restoration of the dystrophin reading frame and restoration of the dystrophin protein activity, and wherein the gRNA comprises a spacer sequence that is complementary to a segment of the locus.

In another method, Method 63, the present disclosure provides a method as provided in any one of Methods 1, 7, or 11, wherein the method further comprises introducing into the cell one or more guide ribonucleic acid (gRNAs) and a polynucleotide donor template comprising at least a portion of the wild-type dystrophin gene, and wherein the one or more DNA endonucleases is one or more Cas9 or Cpf1 endonucleases that effect a pair of single-strand breaks (SSBs) or double-strand breaks (DSBs), the first at a 5' locus and the second at a 3' locus, within or near the dystrophin gene that facilitates insertion of a new sequence from the polynucleotide donor template into the chromosomal DNA between the 5' locus and the 3' locus that results in a permanent insertion or correction of one or more exons or aberrant intronic splice acceptor or donor sites between the 5' locus and the 3' locus within or near the dystrophin gene and results in restoration of the dystrophin reading frame and restoration of the dystrophin protein activity.

In another method, Method 64, the present disclosure provides a method as provided in Method 63, wherein one gRNA creates a pair of SSBs or DSBs.

In another method, Method 65, the present disclosure provides a method as provided in Method 63, wherein one gRNA comprises a spacer sequence that is complementary to either the 5' locus, the 3' locus, or a segment between the 5' locus and the 3' locus.

In another method, Method 66, the present disclosure provides a method as provided in Method 63, wherein the method comprises a first gRNA and a second gRNA, wherein the first gRNA comprises a spacer sequence that is complementary to a segment of the 5' locus and the second gRNA comprises a spacer sequence that is complementary to a segment of the 3' locus.

In another method, Method 67, the present disclosure provides a method as provided in Methods 62 or 63, wherein the one or more gRNAs are one or more single-molecule guide RNAs (sgRNAs).

In another method, Method 68, the present disclosure provides a method as provided in Methods 62-63 or 67, wherein the one or more gRNAs or one or more sgRNAs are one or more modified gRNAs or one or more modified sgRNAs.

In another method, Method 69, the present disclosure provides a method as provided in any one of Methods 62-63 or 67-68, wherein the one or more DNA endonucleases is pre-complexed with one or more gRNAs or one or more sgRNAs.

In another method, Method 70, the present disclosure provides a method as provided in any one of Methods 62-69, wherein the insertion is a single exon insertion In another method, Method 71, the present disclosure provides a method as provided in Method 70, wherein the single exon insertion is an insertion of exon 2, exon 8, exon 43, exon 44, exon 45, exon 46, exon 50, exon 51, exon 52, exon 53 or exon 70.

In another method, Method 72, the present disclosure provides a method as provided in any one of Methods 70-71, wherein the locus, 5' locus, or 3' locus is proximal to a boundary of a single exon selected from the group consisting of exon 2, exon 8, exon 43, exon 44, exon 45, exon 46, exon 50, exon 51, exon 52, exon 53 and exon 70.

In another method, Method 73, the present disclosure provides a method as provided in Method 72, wherein proximal to the boundary of the exon includes the surrounding splice donors and acceptors of the neighboring intron or neighboring exon.

In another method, Method 74, the present disclosure provides a method as provided in any one of Methods 62-69, wherein the insertion is a multi-exon insertion.

In another method, Method 75, the present disclosure provides a method as provided in Method 74, wherein the multi-exon insertion is an insertion of exons 45-53 or exons 45-55.

In another method, Method 76, the present disclosure provides a method as provided in any one of Methods 74-75, wherein the locus, 5' locus, or 3' locus is proximal to a boundary of multiple-exons selected from the group consisting of exons 45-53 or exons 45-55.

In another method, Method 77, the present disclosure provides a method as provided in Method 76, wherein proximal to the boundary of the exon includes the surrounding splice donors and acceptors of the neighboring intron.

In another method, Method 78, the present disclosure provides a method as provided in any one of Methods 62 or 63, wherein the at least a portion of the wild-type dystrophin gene or cDNA includes at least a part of exon 1, exon 2, exon 3, exon 4, exon 5, exon 6, exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

In another method, Method 79, the present disclosure provides a method as provided in any one of Methods 62 or 63, wherein the at least a portion of the wild-type dystrophin gene or cDNA includes exon 1, exon 2, exon 3, exon 4, exon 5, exon 6,
exon 7, exon 8, exon 9, exon 10, exon 11, exon 12, exon 13, exon 14, exon 15, exon 16, exon 17, exon 18, exon 19, exon 20, exon 21, exon 22, exon 23, exon 24, exon 25, exon 26, exon 27, exon 28, exon 29, exon 30, exon 31, exon 32, exon 33, exon 34, exon 35, exon 36, exon 37, exon 38, exon 39, exon 40, exon 41, exon 42, exon 43, exon 44, exon 45, exon 46, exon 47, exon 48, exon 49, exon 50, exon 51, exon 52, exon 53, exon 54, exon 55, exon 56, exon 57, exon 58, exon 59, exon 60, exon 61, exon 62, exon 63, exon 64, exon 65, exon 66, exon 67, exon 68, exon 69, exon 70, exon 71, exon 72, exon 73, exon 74, exon 75, exon 76, exon 77, exon 78, exon 79, intronic regions, synthetic intronic regions, fragments, combinations thereof, or the entire dystrophin gene or cDNA.

In another method, Method 80, the present disclosure provides a method as provided in any one of Methods 62-79, wherein the insertion is by homology directed repair (HDR).

In another method, Method 81, the present disclosure provides a method as provided in any one of Methods 62-80, wherein the donor template is a single or double stranded polynucleotide.

In another method, Method 82, the present disclosure provides a method as provided in any one of Methods 26-81, wherein the Cas9 or Cpf1 mRNA, gRNA, and donor template are each formulated into separate lipid nanoparticles or all co-formulated into a lipid nanoparticle.

In another method, Method 83, the present disclosure provides a method as provided in any one of Methods 26-81, wherein the Cas9 or Cpf1 mRNA is formulated into a lipid nanoparticle, and both the gRNA and donor template are delivered to the cell by an adeno-associated virus (AAV) vector.

In another method, Method 84, the present disclosure provides a method as provided in any one of Methods 26-81, wherein the Cas9 or Cpf1 mRNA is formulated into a lipid nanoparticle, and the gRNA is delivered to the cell by electroporation and donor template is delivered to the cell by an adeno-associated virus (AAV) vector.

In another method, Method 85, the present disclosure provides a method as provided in any one of Methods 1-84, wherein the dystrophin gene is located on Chromosome X: 31,117,228-33,344,609 (Genome Reference Consortium—GRCh38/hg38).

In a first composition, Composition 1, the present disclosure provides one or more guide ribonucleic acids (gRNAs) for editing a dystrophin gene in a cell from a patient with Duchenne Muscular Dystrophy (DMD), the one or more gRNAs comprising a spacer sequence selected from the group consisting of the nucleic acid sequences in SEQ ID Nos: 1-1,410,472 of the Sequence Listing.

In another composition, Composition 2, the present disclosure provides the one or more gRNAs of Composition 1, wherein the one or more gRNAs are one or more single-molecule guide RNAs (sgRNAs).

In another composition, Composition 3, the present disclosure provides the one or more gRNAs or sgRNAs of Compositions 1 or 2, wherein the one or more gRNAs or one or more sgRNAs is one or more modified gRNAs or one or more modified sgRNAs.

Definitions

The term "comprising" or "comprises" is used in reference to compositions, methods, and respective component(s) thereof, that are essential to the invention, yet open to the inclusion of unspecified elements, whether essential or not.

The term "consisting essentially of" refers to those elements required for a given aspect. The term permits the presence of additional elements that do not materially affect the basic and novel or functional characteristic(s) of that aspect of the invention.

The term "consisting of" refers to compositions, methods, and respective components thereof as described herein, which are exclusive of any element not recited in that description of the aspect.

The singular forms "a," "an," and "the" include plural references, unless the context clearly dictates otherwise.

Any numerical range recited in this specification describes all sub-ranges of the same numerical precision (i.e., having the same number of specified digits) subsumed within the recited range. For example, a recited range of "1.0 to 10.0" describes all sub-ranges between (and including) the recited minimum value of 1.0 and the recited maximum value of 10.0, such as, for example, "2.4 to 7.6," even if the range of "2.4 to 7.6" is not expressly recited in the text of the specification. Accordingly, the Applicant reserves the right to amend this specification, including the claims, to expressly recite any sub-range of the same numerical precision subsumed within the ranges expressly recited in this specification. All such ranges are inherently described in this specification such that amending to expressly recite any such sub-ranges will comply with written description, sufficiency of description, and added matter requirements, including the requirements under 35 U.S.C. § 112(a) and Article 123(2) EPC. Also, unless expressly specified or otherwise required by context, all numerical parameters described in this specification (such as those expressing values, ranges, amounts, percentages, and the like) may be read as if prefaced by the word "about," even if the word "about" does not expressly appear before a number. Additionally, numerical parameters described in this specification should be construed in light of the number of reported significant digits, numerical precision, and by applying ordinary rounding techniques. It is also understood that numerical parameters described in this specification will necessarily possess the inherent variability

EXAMPLES

The invention will be more fully understood by reference to the following examples, which provide illustrative non-limiting aspects of the invention.

The examples describe the use of the CRISPR system as an illustrative genome editing technique to create defined therapeutic genomic deletions, insertions, or replacements, collectively termed "genomic modifications" herein, in the dystrophin gene (DMD gene) that lead to permanent deletion or correction of problematic exons from the genomic locus that restore the dystrophin reading frame and restore the dystrophin protein activity.

Single gRNAs spanning different regions of the DMD gene were selected and tested for cutting efficiencies (Table 5). gRNAs were targeted to exons, introns, and the splice acceptors of multiple areas of interest in the DMD gene. The naming convention for all gRNAs discussed in the Examples is: # (corresponding to the gRNA)—NN (Cas protein: SP—*S. pyogenes*, SA—*S. aureus*, NM—*N. meningitides*, ST—*S. thermophiles*, TD—*T. denticola*, Cpf1)—NN## (SA—Splice acceptor, E—Exon, I—Intron).

TABLE 5

| gRNA Name | gRNA sequence | SEQ ID NO: |
|---|---|---|
| 1-NM-SA51 | AGTCTGAGTAGGAGCTAAAATATT | 1410400 |
| 2-NM-SA44 | CTTGATCCATATGCTTTTACCTGC | 1410401 |
| 3-NM-SA52 | ATATTTGTTCTTACAGGCAACAAT | 1410402 |
| 1-ST-SA53 | CTGATTCTGAATTCTTTCAA | 534494 |
| 2-ST-SA53 | TTTTCCTTTTATTCTAGTTG | 534495 |
| 3-ST-SA46 | TTCTTTTGTTCTTCTAGCCT | 537307 |
| 4-ST-SA46 | GTTCTTCTAGCCTGGAGAAA | 537308 |
| 5-ST-SA50 | ATCTTCTAACTTCCTCTTTA | 536097 |
| 6-ST-SA43 | TGTTTTAAAATTTTTATATT | 541322 |
| 1-SA-SA51 | TGAGTAGGAGCTAAAATATT | 485512 |
| 2-SA-SA45 | TTGGTATCTTACAGGAACTC | 490807 |
| 3-SA-SA53 | TGATTCTGAATTCTTTCAAC | 482860 |
| 4-SA-SA53 | TTTCCTTTTATTCTAGTTGA | 482861 |
| 5-SA-SA46 | TTCTTCTAGCCTGGAGAAAG | 489814 |
| 6-SA-SA43 | GTTTTAAAATTTTTATATTA | 499467 |
| 7-SA-SA55 | TCTGAACATTTGGTCCTTTG | 481421 |
| 8-SA-SA55 | AACATTTGGTCCTTTGCAGG | 481420 |
| 1-Cpf1-SA51 | TGCAAAAACCCAAAATATTTTAG | 1410403 |
| 2-Cpf1-SA51 | GCAAAAACCCAAAATATTTTAGC | 1410404 |
| 3-Cpf1-SA51 | CAAAAACCCAAAATATTTTAGCT | 1410405 |
| 4-Cpf1-SA45 | CCGCTGCCCAATGCCATCCTGGA | 1410406 |
| 5-Cpf1-SA45 | TGTTTTGCCTTTTTGGTATCTTA | 1410407 |
| 6-Cpf1-SA45 | GTTTTGCCTTTTTGGTATCTTAC | 1410408 |
| 7-Cpf1-SA45 | TTTTGCCTTTTTGGTATCTTACA | 1410409 |
| 8-Cpf1-SA45 | GCCTTTTTGGTATCTTACAGGAA | 1410410 |
| 9-Cpf1-SA45 | CCTTTTTGGTATCTTACAGGAAC | 1410411 |
| 10-Cpf1-SA45 | TGGTATCTTACAGGAACTCCAGG | 1410412 |
| 11-Cpf1-SA53 | TTTTTCCTTTTATTCTAGTTGAA | 1410413 |
| 12-Cpf1-SA53 | TCCTTTTATTCTAGTTGAAAGAA | 1410414 |
| 13-Cpf1-SA53 | CCTTTTATTCTAGTTGAAAGAAT | 1410415 |
| 14-Cpf1-SA44 | TCAACAGATCTGTCAAATCGCCT | 1410416 |
| 15-Cpf1-SA44 | TCTTGATCCATATGCTTTTACCT | 1410417 |
| 16-Cpf1-SA44 | CTTGATCCATATGCTTTTACCTG | 1410418 |
| 17-Cpf1-SA44 | TTGATCCATATGCTTTTACCTGC | 1410419 |
| 18-Cpf1-SA46 | GTTCTTCTAGCCTGGAGAAAGAA | 1410420 |
| 19-Cpf1-SA46 | TTCTTCTAGCCTGGAGAAAGAAG | 1410421 |
| 20-Cpf1-SA46 | ATTCTTCTTTCTCCAGGCTAGAA | 1410422 |
| 21-Cpf1-SA46 | TTCTTCTTTCTCCAGGCTAGAAG | 1410423 |
| 22-Cpf1-SA43 | TTGTAGACTATCTTTTATATTCT | 1410424 |
| 23-Cpf1-SA43 | TACTGTTTTAAAATTTTTATATT | 1410425 |
| 24-Cpf1-SA43 | ACTGTTTTAAAATTTTTATATTA | 1410426 |
| 25-Cpf1-SA43 | CTGTTTTAAAATTTTTATATTAC | 1410427 |
| 26-Cpf1-SA43 | AAAATTTTTATATTACAGAATAT | 1410428 |
| 27-Cpf1-SA43 | AAATTTTTATATTACAGAATATA | 1410429 |
| 1-SP-SA51 | AAAATATTTTAGCTCCTACT | 145442 |
| 2-SP-SA51 | TGCAAAAACCCAAAATATTT | 145443 |
| 3-SP-SA45 | TGGTATCTTACAGGAACTCC | 186216 |
| 4-SP-SA45 | TTGGTATCTTACAGGAACTC | 186217 |
| 5-SP-SA45 | TGCCATCCTGGAGTTCCTGT | 186218 |
| 6-SP-SA45 | TTGCCTTTTTGGTATCTTAC | 186219 |
| 7-SP-SA45 | TTTGCCTTTTTGGTATCTTA | 186220 |
| 8-SP-SA53 | TGATTCTGAATTCTTTCAAC | 125451 |
| 9-SP-SA53 | TTTCCTTTTATTCTAGTTGA | 125452 |
| 10-SP-SA53 | AATTCTTTCAACTAGAATAA | 125453 |
| 11-SP-SA53 | ATTTATTTTCCTTTTATTC | 125455 |
| 12-SP-SA53 | ATTCTTTCAACTAGAATAAA | 125454 |
| 13-SP-SA44 | AGATCTGTCAAATCGCCTGC | 237600 |
| 14-SP-SA44 | CAGATCTGTCAAATCGCCTG | 237599 |
| 15-SP-SA44 | GTCAAATCGCCTGCAGGTAA | 237602 |
| 16-SP-SA44 | GATCCATATGCTTTTACCTG | 237603 |
| 17-SP-SA44 | ATCCATATGCTTTTACCTGC | 237601 |

TABLE 5-continued

| gRNA Name | gRNA sequence | SEQ ID NO: |
|---|---|---|
| 18-SP-SA46 | TTGTTCTTCTAGCCTGGAGA | 178873 |
| 19-SP-SA46 | ATTCTTTTGTTCTTCTAGCC | 178869 |
| 20-SP-SA46 | TTCTTCTAGCCTGGAGAAAG | 178875 |
| 21-SP-SA46 | TTCTTCTTTCTCCAGGCTAG | 178870 |
| 22-SP-SA46 | TCTTTTGTTCTTCTAGCCTG | 178871 |
| 23-SP-SA46 | AAGATATTCTTTTGTTCTTC | 178868 |
| 24-SP-SA46 | TTATTCTTCTTTCTCCAGGC | 178872 |
| 25-SP-SA46 | AATTTTATTCTTCTTTCTCC | 178874 |
| 26-SP-SA46 | CAATTTTATTCTTCTTTCTC | 178876 |
| 27-SP-SA52 | AATCCTGCATTGTTGCCTGT | 136213 |
| 28-SP-SA52 | TAAGGGATATTTGTTCTTAC | 136214 |
| 29-SP-SA52 | CTAAGGGATATTTGTTCTTA | 136215 |
| 30-SP-SA50 | ATGCTTTTCTGTTAAAGAGG | 155685 |
| 31-SP-SA50 | TGTATGCTTTTCTGTTAAAG | 155687 |
| 32-SP-SA50 | TCTTCTAACTTCCTCTTTAA | 155686 |
| 33-SP-SA50 | ATGTGTATGCTTTTCTGTTA | 155689 |
| 34-SP-SA50 | TTTTCTGTTAAAGAGGAAGT | 155684 |
| 35-SP-SA50 | GTGTATGCTTTTCTGTTAAA | 155688 |
| 36-SP-SA43 | TTTTATATTACAGAATATAA | 252291 |
| 37-SP-SA43 | GTTTTAAAATTTTTATATTA | 252292 |
| 38-SP-SA55 | CTGAACATTTGGTCCTTTGC | 114755 |
| 39-SP-SA55 | CATTTGGTCCTTTGCAGGGT | 114751 |
| 40-SP-SA55 | CTCGCTCACTCACCCTGCAA | 114753 |
| 41-SP-SA55 | TCTGAACATTTGGTCCTTTG | 114756 |
| 42-SP-SA55 | TGGTCCTTTGCAGGGTGAGT | 114750 |
| 43-SP-SA55 | TCTCGCTCACTCACCCTGCA | 114752 |
| 44-SP-SA55 | TGAACATTTGGTCCTTTGCA | 114754 |
| 1-SP-E51 | CCTACTCAGACTGTTACTC | 1410430 |
| 2-SP-E51 | ACTCTGGTGACACAACCTG | 1410431 |
| 3-SP-E51 | ACACAACCTGTGGTTACTA | 1410432 |
| 4-SP-E51 | ATGTTGGAGGTACCTGCTC | 1410433 |
| 5-SP-E51 | TGCTCTGGCAGATTTCAAC | 1410434 |
| 6-SP-E51 | GCTCTGGCAGATTTCAACC | 1410435 |
| 7-SP-E51 | GGCAGATTTCAACCGGGCT | 1410436 |
| 8-SP-E51 | TTGGACAGAACTTACCGAC | 1410437 |
| 9-SP-E51 | CATCTCGTTGATATCCTCA | 1410438 |
| 10-SP-E51 | GGTAAGTTCTGTCCAAGCC | 1410439 |
| 11-SP-E51 | GGTTGAAATCTGCCAGAGC | 1410440 |
| 12-SP-E51 | GCAGGTACCTCCAACATCA | 1410441 |
| 13-SP-E51 | GGCATTTCTAGTTTGGAGA | 1410442 |
| 14-SP-E51 | CAGTTTCCTTAGTAACCAC | 1410443 |
| 15-SP-E51 | CCAGAGTAACAGTCTGAGT | 1410444 |
| 16-SP-E45 | GGTATCTTACAGGAACTCC | 1410445 |
| 17-SP-E45 | TCTTACAGGAACTCCAGGA | 1410446 |
| 18-SP-E45 | AGGAACTCCAGGATGGCAT | 1410447 |
| 19-SP-E45 | GGAACTCCAGGATGGCATT | 1410448 |
| 20-SP-E45 | CCAGGATGGCATTGGGCAG | 1410449 |
| 21-SP-E45 | TCAGAACATTGAATGCAAC | 1410450 |
| 22-SP-E45 | AGAACATTGAATGCAACTG | 1410451 |
| 23-SP-E45 | ACAGATGCCAGTATTCTAC | 1410452 |
| 24-SP-E45 | ATTGGGAAGCCTGAATCTG | 1410453 |
| 25-SP-E45 | GGGAAGCCTGAATCTGCGG | 1410454 |
| 26-SP-E45 | AGCCTGAATCTGCGGTGGC | 1410455 |
| 27-SP-E45 | CTCCTGCCACCGCAGATTC | 1410456 |
| 28-SP-E45 | CCGCTGCCCAATGCCATCC | 1410457 |
| 29-SP-E53 | ACAAGAACACCTTCAGAAC | 1410458 |
| 30-SP-E53 | AGAACACCTTCAGAACCGG | 1410459 |
| 31-SP-E53 | GTTAAAGGATTCAACACAA | 1410460 |
| 32-SP-E53 | ACACAATGGCTGGAAGCTA | 1410461 |
| 33-SP-E53 | GCTGAGCAGGTCTTAGGAC | 1410462 |
| 34-SP-E53 | CAGAGCCAAGCTTGAGTCA | 1410463 |
| 35-SP-E53 | GCCAAGCTTGAGTCATGGA | 1410464 |
| 36-SP-E53 | ACAAGAACACCTTCAGAAC | 1410465 |
| 37-SP-E53 | AGAACACCTTCAGAACCGG | 1410466 |
| 38-SP-E53 | GTTAAAGGATTCAACACAA | 1410467 |
| 39-SP-E53 | ACACAATGGCTGGAAGCTA | 1410468 |
| 40-SP-E53 | AAGAAGCTGAGCAGGTCTT | 1410469 |
| 41-SP-E53 | GCTGAGCAGGTCTTAGGAC | 1410470 |
| 42-SP-E53 | CAGAGCCAAGCTTGAGTCA | 1410471 |
| 43-SP-E53 | GCCAAGCTTGAGTCATGGA | 1410472 |
| 1-SP-I52 | ACAGTGGTTTAAGTAATCCG | 136258 |
| 2-SP-I52 | GGAGACATTCCGGAGTACCT | 136257 |
| 3-SP-I52 | TTTGGAGAGCATCAGATTAC | 136337 |
| 4-SP-I52 | GTTTGGTGATTCTTACGGAC | 136306 |
| 5-SP-I52 | TCTGTGTGACGTCAAAATTA | 136275 |
| 6-SP-I52 | ATATGATGTTCTACCACATG | 136406 |
| 1-SP-I53 | GCCCACCCTACTACGGCATA | 136093 |

TABLE 5-continued

| gRNA Name | gRNA sequence | SEQ ID NO: |
|---|---|---|
| 2-SP-I53 | CTGTACCTTATGCCGTAGTA | 136089 |
| 3-SP-I53 | ACTGTACCTTATGCCGTAGT | 136090 |
| 4-SP-I53 | TACCTTATGCCGTAGTAGGG | 136087 |
| 5-SP-I53 | ACCTTATGCCGTAGTAGGGT | 136086 |
| 6-SP-I53 | TGCACAGCGTCTAGTCAGAT | 136079 |
| 1-SP-I44 | CATCGCATAGTTTAGTATAT | 237710 |
| 2-SP-I44 | CTTAGGTAAACATACAGCCC | 237749 |
| 3-SP-I44 | ACTCCTTTCAGTTGATGAAC | 237661 |
| 4-SP-I44 | ATTTTAGATTGGAATACTGC | 237724 |
| 5-SP-I44 | GCCTCAGTCTCTTTTATGAC | 237740 |
| 6-SP-I44 | CTGCCTGTTCATCAACTGAA | 237664 |
| 1-SP-I45 | AATATTAGAGCACGGTGCTA | 237546 |
| 2-SP-I45 | CTCTATACAAATGCCAACGC | 237393 |
| 3-SP-I45 | CAGATAAACCAGCTCCGTCC | 237535 |
| 4-SP-I45 | AGGGAAGCATCGTAACAGCA | 237521 |
| 5-SP-I45 | ACTTGCATGCACACCAGCGT | 237394 |
| 6-SP-I45 | AGAGTTTGCCTGGACGGAGC | 237533 |
| 7-SP-I45 | TTAGTGATCGTGGATACGAG | 186301 |
| 8-SP-I45 | TTTGGGTTTCTTAGTGATCG | 186298 |
| 9-SP-I45 | AAAAACTGGAGCTAACCGAG | 186263 |
| 10-SP-I45 | CATTCAGATTTAAATACGGT | 186375 |
| 11-SP-I45 | AAAACTGGAGCTAACCGAGA | 186262 |
| 12-SP-I45 | TTTGTAAGCTTGTCAGCTAG | 186274 |
| 1-SP-I46 | CAACTGCAGCAGCACGCATT | 186065 |
| 2-SP-I46 | CCACCTATTATGTGGATGAT | 186030 |
| 3-SP-I46 | ATATACTTGTGGCTAGTTAG | 186135 |
| 4-SP-I46 | CCCATCATCCACATAATAGG | 186025 |
| 5-SP-I46 | CCATTAAACTTGTACCTCTT | 186083 |
| 6-SP-I46 | CCACCCATCATCCACATAAT | 186027 |
| 1-SP-I54 | GCTGGGGACCGTTATCTATT | 121156 |
| 2-SP-I54 | GCACATTCACGTATTACTGC | 121149 |
| 3-SP-I54 | TTTAGTTGAACGCCAGTAGA | 121051 |
| 4-SP-I54 | CACATTCACGTATTACTGCT | 121150 |
| 5-SP-I54 | ACATTCACGTATTACTGCTG | 121151 |
| 6-SP-I54 | CGTGAATGTGCTAGTTTTAC | 121147 |
| 1-SP-I55 | TAGCTCCCTATTATATCACG | 120796 |
| 2-SP-I55 | GCCAAGTCCGTGAGTTTAGT | 120916 |
| 3-SP-I55 | CCTATTATATCACGTGGTTC | 120798 |
| 4-SP-I55 | CCTGAACCACGTGATATAAT | 120794 |
| 5-SP-I55 | CTGAACCACGTGATATAATA | 120793 |
| 6-SP-I55 | TTCTCATTTGATACATCCCC | 120802 |
| 49-SP-I50 | CATTGGCTTTGATTTCCCTA | 145522 |
| 51-SP-I51 | ACAGTTGCCTAAGAACTGGT | 145360 |
| 53-SP-I55 | GCCTTCTTTATCCCCTATCG | 91033 |
| 44-SP-E70 | ACTGGCAGGTAGCCCATTCG | 13562 |
| 45-SP-E70 | TTTGCGAAGCATCCCCGAAT | 13563 |
| 46-SP-E70 | TTTTGCGAAGCATCCCCGAA | 13564 |
| 47-SP-E70 | CACTGGCAGGTAGCCCATTC | 13561 |
| 48-SP-E70 | GCACTGGCAGGTAGCCCATT | 13560 |
| 54-SP-E55 | AGGATGCTACCCGTAAGGAA | 114709 |
| 55-SP-E55 | CCTTACGGGTAGCATCCTGT | 114716 |
| 56-SP-E55 | AACAACTGCCAATGTCCTAC | 114717 |
| 57-SP-E55 | ATTACTGCAACAGTTCCCCC | 114738 |
| 58-SP-E55 | GCAACAGTTCCCCCTGGACC | 114736 |
| 59-SP-E55 | TTCTAGGAGCCTTTCCTTAC | 114710 |
| 60-SP-E55 | AGGCTCCTAGAAGACTCCAA | 114700 |
| 61-SP-E55 | GGTAGCATCCTGTAGGACAT | 114719 |
| 62-SP-E55 | ACCTGGAAAAGTTTCTTGCC | 114728 |
| 63-SP-E55 | GCCAGGCAAGAAACTTTTCC | 114730 |

All tested gRNAs can be used for an HDR/correction based editing approach. Single gRNAs targeting the splice acceptors can be used to induce exon skipping to restore the reading frame of the DMD gene. Selected pairs of gRNAs can be used to make deletions in the DMD gene that restore the reading frame. Selected pairs of gRNAs can be used to make deletions that simulate patient mutations and can be used to generate model DMD mutant lines.

Various Cas orthologs were evaluated for cutting. SP, NM, ST, SA, and Cpf1 gRNAs were delivered as RNA, expressed from the U6 promoter in plasmids, or expressed from the U6 promoter in lentivirus. The corresponding Cas protein was either knocked into the cell line of interest and constitutively expressed, delivered as mRNA, or delivered as protein. The activity of the gRNAs in all the above mentioned formats were evaluated using TIDE analysis or next generation sequencing in HEK293T cells, K562 cells, or induced pluripotent stem cells (iPSCs).

Overall, it was determined that most gRNAs tested induced cutting. However, the amount of cutting was highly dependent on the Cas protein tested. It was found that, generally, SP Cas9 gRNAs induce the highest levels of cutting with SA Cas9 gRNAs inducing the second highest level of cutting. Generally, it is beneficial to select gRNAs for therapeutic application that have the highest cutting efficiency possible. However, for an iPSC based therapy, the cutting efficiency is not as important. iPSCs are highly proliferative and make it simple to isolate a clonal population of cells with the desired edit, even when the editing efficiency is less than 10%.

Introduction of the defined therapeutic modifications described above represents a novel therapeutic strategy for the potential amelioration of DMD, as further described and illustrated herein.

Example 1—CRISPR/SPCas9 Target Sites for the Dystrophin Gene

Regions of the dystrophin gene were scanned for target sites. Each area was scanned for a protospacer adjacent motif (PAM) having the sequence NRG. gRNA 20 bp spacer sequences corresponding to the PAM were identified, as shown in SEQ ID NOs: 1-467,030. gRNA 19 bp spacer sequences corresponding to the PAM were identified, as shown in SEQ ID NOs: 1,410,430-1,410,472 of the Sequence Listing.

Example 2—CRISPR/SACas9 Target Sites for the Dystrophin Gene

Regions of the dystrophin gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 467,031-528,196 of the Sequence Listing.

Example 3—CRISPR/STCas9 Target Sites for the Dystrophin Gene

Regions of the dystrophin gene were scanned for target sites. Each area was scanned for a protospacer adjacent motif (PAM) having the sequence NNAGAAW. gRNA 24 bp spacer sequences corresponding to the PAM were identified, as shown in SEQ ID NOs: 528,197-553,198 of the Sequence Listing.

Example 4—CRISPR/TDCas9 Target Sites for the Dystrophin Gene

Regions of the dystrophin gene were scanned for target sites. Each area was scanned for a protospacer adjacent motif (PAM) having the sequence NAAAAC. gRNA 24 bp spacer sequences corresponding to the PAM were identified, as shown in SEQ ID NOs: 553,199-563,911 of the Sequence Listing.

Example 5—CRISPR/NMCas9 Target Sites for the Dystrophin Gene

Regions of the dystrophin gene were scanned for target sites. Each area was scanned for a protospacer adjacent motif (PAM) having the sequence NNNNGHTT. gRNA 24 bp spacer sequences corresponding to the PAM were identified, as shown in SEQ ID NOs: 563,912-627,854 and 1,410,400-1,410,402 of the Sequence Listing.

Example 6—CRISPR/Cpf1 Target Sites for the Dystrophin Gene

Regions of the dystrophin gene were scanned for target sites. Each area was scanned for a protospacer adjacent motif (PAM) having the sequence YTN. gRNA 20-24 bp spacer sequences corresponding to the PAM were identified, as shown in SEQ ID NOs: 627,855-1,410,399 and 1,410, 403-1,410,429 of the Sequence Listing.

Example 7—Illustrative Genome Editing Strategies Targeting Exon 2

Several methods provide gRNA pairs that delete exon 2 by cutting the gene twice, one gRNA cutting at the 5' end of exon 2 and the other gRNA cutting at the 3' end of exon 2.

Example 8—Illustrative Genome Editing Strategies Targeting Exon 8

Several methods provide gRNA pairs that delete exon 8 by cutting the gene twice, one gRNA cutting at the 5' end of exon 8 and the other gRNA cutting at the 3' end of exon 8.

Example 9—Illustrative Genome Editing Strategies Targeting Exon 43

Several methods provide gRNA pairs that delete exon 43 by cutting the gene twice, one gRNA cutting at the 5' end of exon 43 and the other gRNA cutting at the 3' end of exon 43.

Example 10—Illustrative Genome Editing Strategies Targeting Exon 44

Several methods provide gRNA pairs that delete exon 44 by cutting the gene twice, one gRNA cutting at the 5' end of exon 44 and the other gRNA cutting at the 3' end of exon 44.

Example 11—Illustrative Genome Editing Strategies Targeting Exon 45

Several methods provide gRNA pairs that delete exon 45 by cutting the gene twice, one gRNA cutting at the 5' end of exon 45 and the other gRNA cutting at the 3' end of exon 45.

Example 12—Illustrative Genome Editing Strategies Targeting Exon 46

Several methods provide gRNA pairs that delete exon 46 by cutting the gene twice, one gRNA cutting at the 5' end of exon 46 and the other gRNA cutting at the 3' end of exon 46.

Example 13—Illustrative Genome Editing Strategies Targeting Exon 50

Several methods provide gRNA pairs that delete exon 50 by cutting the gene twice, one gRNA cutting at the 5' end of exon 50 and the other gRNA cutting at the 3' end of exon 50.

Example 14—Illustrative Genome Editing Strategies Targeting Exon 51

Several methods provide gRNA pairs that delete exon 51 by cutting the gene twice, one gRNA cutting at the 5' end of exon 51 and the other gRNA cutting at the 3' end of exon 51.

Example 15—Illustrative Genome Editing Strategies Targeting Exon 52

Several methods provide gRNA pairs that delete exon 52 by cutting the gene twice, one gRNA cutting at the 5' end of exon 52 and the other gRNA cutting at the 3' end of exon 52.

Example 16—Illustrative Genome Editing Strategies Targeting Exon 53

Several methods provide gRNA pairs that delete exon 53 by cutting the gene twice, one gRNA cutting at the 5' end of exon 53 and the other gRNA cutting at the 3' end of exon 53.

Example 17—Illustrative Genome Editing Strategies Targeting Exon 70

Several methods provide gRNA pairs that delete exon 70 by cutting the gene twice, one gRNA cutting at the 5' end of exon 70 and the other gRNA cutting at the 3' end of exon 70.

Example 18—Illustrative Genome Editing Strategies Targeting Exons 45-53

Several methods provide gRNA pairs that delete exons 45-53 by cutting the gene twice, one gRNA cutting at the 5' end of exon 45 and the other gRNA cutting at the 3' end of exon 53.

Example 19—Illustrative Genome Editing Strategies Targeting Exons 45-55

Several methods provide gRNA pairs that delete exons 45-55 by cutting the gene twice, one gRNA cutting at the 5' end of exon 45 and the other gRNA cutting at the 3' end of exon 55.

Example 20—Bioinformatics Analysis of the Guide Strands

Candidate guides were screened and selected in a multi-step process that involved both theoretical binding and experimentally assessed activity. By way of illustration, candidate guides having sequences that match a particular on-target site, such as a site within or near the dystrophin gene, with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended. Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the CRISPR/Cas9 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr.bme.gatech.edu) compiles such similarities. Other bioinformatics tools include, but are not limited to, GUIDO, autoCOSMID, and CCtop.

Bioinformatics were used to minimize off-target cleavage in order to reduce the detrimental effects of mutations and chromosomal rearrangements. Studies on CRISPR/Cas9 systems suggested the possibility of high off-target activity due to nonspecific hybridization of the guide strand to DNA sequences with base pair mismatches and/or bulges, particularly at positions distal from the PAM region. Therefore, it is important to have a bioinformatics tool that can identify potential off-target sites that have insertions and/or deletions between the RNA guide strand and genomic sequences, in addition to base-pair mismatches. The bioinformatics-based tool, COSMID (CRISPR Off-target Sites with Mismatches, Insertions and Deletions) was therefore used to search genomes for potential CRISPR off-target sites (available on the web at crispr.bme.gatech.edu). COSMID output ranked lists of the potential off-target sites based on the number and location of mismatches, allowing more informed choice of target sites, and avoiding the use of sites with more likely off-target cleavage.

Additional bioinformatics pipelines were employed that weigh the estimated on- and/or off-target activity of gRNA targeting sites in a region. Other features that can be used to predict activity include information about the cell type in question, DNA accessibility, chromatin state, transcription factor binding sites, transcription factor binding data, and other CHIP-seq data. Additional factors are weighed that predict editing efficiency, such as relative positions and directions of pairs of gRNAs, local sequence features and micro-homologies.

Example 21—Testing of Preferred Guides in Cells for On-Target Activity

The gRNAs predicted to have the lowest off-target activity will then be tested for on-target activity in epithelial cells derived from a human embryonic kidney, HEK 293 Ts, by transient transfection and evaluated for indel frequency using TIDE or next generation sequencing. TIDE is a web tool to rapidly assess genome editing by CRISPR-Cas9 of a target locus determined by a guide RNA (gRNA or sgRNA). Based on the quantitative sequence trace data from two standard capillary sequencing reactions, the TIDE software quantifies the editing efficacy and identifies the predominant types of insertions and deletions (indels) in the DNA of a targeted cell pool. See Brinkman et al, Nucl. Acids Res. (2014) for a detailed explanation and examples. Next-generation sequencing (NGS), also known as high-throughput sequencing, is the catch-all term used to describe a number of different modern sequencing technologies including: Illumina (Solexa) sequencing, Roche 454 sequencing, Ion torrent: Proton/PGM sequencing, and SOLiD sequencing. These recent technologies allow one to sequence DNA and RNA much more quickly and cheaply than the previously used Sanger sequencing, and as such have revolutionized the study of genomics and molecular biology. HEK 293 Ts are a good model system for gene correction in iPSCs because both cell types are known to have loose chromatin structures.

Chromatin is organizing by coiling into discrete structures called nucleosomes. This coiling influences accessibility of the genomic material to transcriptional machinery. Regions of the genome that are open are termed euchromatin, while regions of tight coiling are called heterochromatin. It is a well accepted paradigm that stem cells have a generally loose chromatin conformation and as cells differentiate into more specialized cell types, certain regions of the genome become closed forming heterochromatin (Sims, R. J. and D. Reinberg (2009). "Stem cells: Escaping fates with open states." Nature 460(7257): 802-803).

Example 22—Testing in Relevant Model Cell Lines

Once all of the guide RNAs are evaluated individually and effective gRNAs are identified, all permutations of pairs of gRNAs will be tested in relevant model cell lines for their ability to modify the DNA sequence of the dystrophin gene that would be predicted to restore the dystrophin reading frame. Myoblast and iPSC cell lines with modifications similar or identical to those found in patient samples were generated. The cells are treated with the different individual and pairwise combinations of gRNAs and a donor DNA template, if and as applicable. Samples can then be evaluated for restoration of dystrophin expression using one or more biological methods known to those skilled in the art, for example, an enzyme-linked immunosorbent assay (ELISA) that specifically recognizes the C terminus of the dystrophin protein (note that truncated proteins do not contain an intact C terminus). The pairs of gRNAs that restore dystrophin expression can then be further evaluated by an additional biologic technique, such as Western blot to confirm expression of the appropriate size of dystrophin protein.

Example 23—Testing Different Approaches for HDR Gene Editing

After testing the gRNAs for both on-target activity and off-target activity, exon correction and knock-in strategies will be tested for HDR gene editing.

For the exon correction approach, donor DNA template will be provided as a short single-stranded oligonucleotide, a short double-stranded oligonucleotide (PAM sequence intact/PAM sequence mutated), a long single-stranded DNA molecule (PAM sequence intact/PAM sequence mutated) or a long double-stranded DNA molecule (PAM sequence intact/PAM sequence mutated). In addition, the donor DNA template will be delivered by AAV.

For the DNA knock-in approach, a single-stranded or double-stranded DNA having homologous arms to the Xp21.2 locus can include 40 nt or more of a first target exon (the first coding exon) of the dystrophin gene, the complete coding DNA sequence (CDS) of the dystrophin gene and 3'UTR of the dystrophin gene, and at least 40 nt of the following intron. The single-stranded or double-stranded DNA having homologous arms to the Xp21.2 locus can include 80 nt or more of a first target exon (the first coding exon) of the dystrophin gene, the complete coding DNA sequence (CDS) of the dystrophin gene and 3'UTR of the dystrophin gene, and at least 80 nt of the following intron. The single-stranded or double-stranded DNA having homologous arms to the Xp21.2 locus can include 100 nt or more of a first target exon (the first coding exon) of the dystrophin gene, the complete coding DNA sequence (CDS) of the dystrophin gene and 3'UTR of the dystrophin gene, and at least 100 nt of the following intron. The single-stranded or double-stranded DNA having homologous arms to the Xp21.2 locus can include 150 nt or more of the first target exon (the first coding exon) of the dystrophin gene, the complete coding DNA sequence (CDS) of the dystrophin gene and 3'UTR of the dystrophin gene, and at least 150 nt of the following intron. The single-stranded or double-stranded DNA having homologous arms to the Xp21.2 locus can include 300 nt or more of the first target exon (the first coding exon) of the dystrophin gene, the complete coding DNA sequence (CDS) of the dystrophin gene and 3'UTR of the dystrophin gene, and at least 300 nt of the following intron. The single-stranded or double-stranded DNA having homologous arms to the Xp21.2 locus can include 400 nt or more of the first target exon (the first coding exon) of the dystrophin gene, the complete CDS of the dystrophin gene and 3'UTR of the dystrophin gene, and at least 400 nt of the following intron. Alternatively, the DNA template will be delivered by AAV.

For the cDNA knock-in approach, a single-stranded or double-stranded cDNA can include 40 nt or more of a single exon target of the dystrophin gene. The single-stranded or double-stranded cDNA can include 80 nt or more of a single exon target of the dystrophin gene. The single-stranded or double-stranded cDNA can include 100 nt or more of a single exon target of the dystrophin gene. The single-stranded or double-stranded cDNA can include 150 nt or more of a single exon target of the dystrophin gene. The single-stranded or double-stranded cDNA can include 300 nt or more of a single exon target of the dystrophin gene. The single-stranded or double-stranded cDNA can include 400 nt or more of a single exon target of the dystrophin gene. Alternatively, the DNA template will be delivered by AAV.

For the cDNA knock-in approach, a single-stranded or double-stranded cDNA can include 40 nt or more of a multiple exon target of the dystrophin gene. The single-stranded or double-stranded cDNA can include 80 nt or more of a multiple exon target of the dystrophin gene. The single-stranded or double-stranded cDNA can include 100 nt or more of a multiple exon target of the dystrophin gene. The single-stranded or double-stranded cDNA can include 150 nt or more of a multiple exon target of the dystrophin gene. The single-stranded or double-stranded cDNA can include 300 nt or more of a multiple exon target of the dystrophin gene. The single-stranded or double-stranded cDNA can include 400 nt or more of a multiple exon target of the dystrophin gene. Alternatively, the DNA template will be delivered by AAV.

Example 24—Re-Assessment of Lead CRISPR-Cas9/DNA Donor Combinations

After testing the different strategies for HDR gene editing, the lead CRISPR-Cas9/DNA donor combinations will be re-assessed in therapeutically relevant cells for efficiency of deletion, recombination, and off-target specificity. Cas9 mRNA or RNP will be formulated into lipid nanoparticles for delivery, sgRNAs will be formulated into nanoparticles or delivered as AAV, and donor DNA will be formulated into nanoparticles or delivered as AAV.

Example 25—In Vivo Testing in Relevant Animal Model

After the CRISPR-Cas9/DNA donor combinations have been re-assessed, the lead formulations will be tested in vivo in a therapeutically relevant mouse model.

Culture in human cells allows direct testing on the human target and the background human genome, as described above.

Preclinical efficacy and safety evaluations can be observed through engraftment of modified mouse or human cells in a therapeutically relevant mouse model. The modified cells can be observed in the months after engraftment.

Figure 3A:
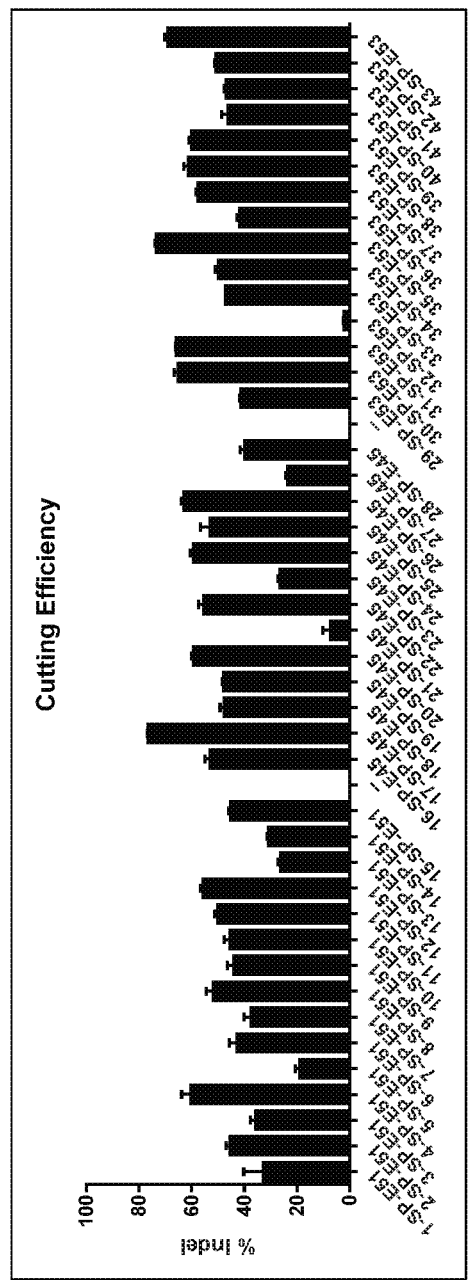
FIG. 3A describes the cutting efficiency of *S. pyogenes* gRNAs in HEK293 Ts targeting Exons 45, 51, and 53 of the dystrophin gene.
Figure 3B:
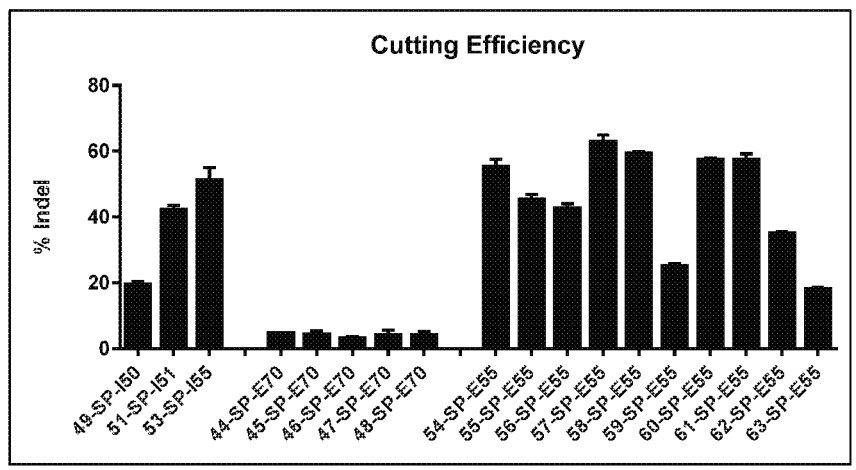
FIG. 3B describes the cutting efficiency of *S. pyogenes* gRNAs in HEK293 Ts targeting Exons 55 and 70 of the dystrophin gene.

Example 26—Cutting Efficiency of S. pyogenes gRNAs Targeting Exons 45, 51, 53, 55, and 70 in the DMD Gene S. pyogenes (SP) gRNAs were tested that target Exons 45, 51, 53, 55, and 70 in the DMD gene (FIGS. 3A-3B). Each of Exons 45, 51, 53, 55, and 70 may be edited using an HDR/correction based approach.

The SP gRNAs were cloned into plasmids that co-express the SP Cas protein. The plasmids were transfected into HEK293T cells using lipofectamine 2000. Cells were harvested 48 hours post transfection, the genomic DNA was isolated, and cutting efficiency was evaluated using TIDE analysis. Data was compiled from one experiment containing 3-4 replicates (N=3 to 4). Data was plotted as mean and SEM.

The data from FIGS. 3A-3B indicate that most gRNAs cut with efficiencies greater than 50% in HEK293T cells.

Example 27—Cutting Efficiency of gRNAs Targeting the Splice Acceptor of Exons 43, 44, 45, 46, 50, 51, 52, 53, and 55 in the DMD Gene A viable option for treating DMD is to induce exon skipping to restore the reading frame of the DMD gene. To induce exon skipping, the gene editing approach must remove the AG sequence just upstream of the exon that is recognized by endogenous splicing machinery. When a single gRNA induces a double stranded break, the cell will repair the break. Some fraction of the time, the endogenous repair machinery will make a mistake and either insert or delete bases adjacent to the cut site. The gRNAs that mutate the AG sequence are likely to induce exon skipping at this site as the splicing machinery will no longer be able to recognize this site as a splice acceptor site and will skip to the next splice acceptor of the neighboring exon.

Figure 4B:
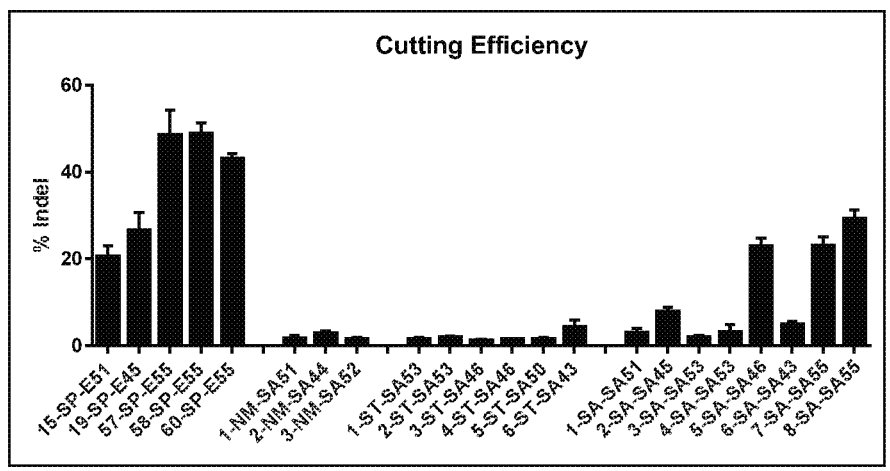
FIG. 4B describes the cutting efficiency of *N. meningitides, S. thermophiles*, and *S. aureus* gRNAs in HEK293 Ts targeting the splice acceptor of Exons 43, 44, 45, 46, 50, 51, 52, 53 and 55 of the dystrophin gene.

S. pyogenes (SP), S. aureus (SA), S. thermophiles (ST), N. Meningitidis (NM), and Cpf1 gRNAs were designed and tested that target the splice acceptor of Exons 43, 44, 45, 46, 50, 51, 52, 53, and 55 in the DMD gene (FIGS. 4A, 4B, and 4C).

SP gRNAs were designed to target the splice acceptor of nine exons in the DMD gene. The gRNAs were ordered as split RNA gRNAs from Integrated DNA Technologies (IDT). The split gRNAs were annealed to the tracRNA per manufacturer's instructions. The annealed split gRNAs were then transfected into HEK293T cells that stably express the SP Cas9 protein cells using RNAiMax. Cells were harvested 48 hours post transfection, the genomic DNA was isolated, and cutting efficiency was evaluated using TIDE analysis (FIG. 4A). Data was compiled between two independent experiments each containing 3 replicates (N=2 to 6). Data was plotted as mean and SEM.

NM, ST, and SA gRNAs were designed to target the splice acceptor of nine exons. The gRNAs were cloned into plasmids that co-express the Cas protein of interest along with the corresponding gRNA. The plasmids were transfected into HEK293T cells using lipofectamine 2000. Cells were harvested 48 hours post transfection, the genomic DNA was isolated, and cutting efficiency was evaluated using TIDE analysis (FIG. 4B). Data was compiled between 2-4 independent experiments each containing 3 replicates (N=6 to 12). Data was plotted as mean and SEM.

Cpf1 gRNAs were designed to target the splice acceptor of nine exons in the DMD gene. The gRNAs were cloned into plasmids that express the gRNA. HEK293T were co-transfected with the gRNA plasmid of interest and a second plasmid expressing Cpf1 using lipofectamine 2000. Cells were harvested 48 hours post transfection, the genomic DNA was isolated, and cutting efficiency was evaluated using TIDE analysis (FIG. 4C). Data was compiled between two independent experiments each containing 3 replicates (N=3 to 6). Data was plotted as mean and SEM.

Example 28—Cutting Efficiencies and Splice Acceptor Knock-Out Efficiencies of gRNAs Targeting Exons 43, 44, 45, 46, 50, 51, 52, 53, and 55 in the DMD Gene Many of the splice acceptor targeting gRNAs cut efficiently at the desired splice site. To evaluate if the gRNA effectively knocked out the desired AG sequence, PCR amplicons around the cut site were submitted for next generation sequencing. The indel percentage reads where the splice acceptor site was removed were quantified (FIGS. 5A-B and FIG. 6). A number of promising gRNAs were identified including, but not limited to: 8-SA-SA55, 3-SP-SA45, 31-SP-SA50, and 40-SP-SA55 that remove the splice acceptor site in a large proportion of the reads.

S. pyogenes gRNAs were designed to target the splice acceptor of nine exons in the DMD gene. The gRNAs were ordered as split RNA gRNAs from IDT. The split gRNAs were annealed to the tracRNA per manufacturer's instructions. The annealed split gRNAs were transfected into HEK293T cells that stably express the S. pyogenes Cas9 protein cells using RNAiMax. Cells were harvested 48 hours post transfection, the genomic DNA was isolated, and the desired 100-250 bp PCR amplicons surrounding the desired splice acceptors were submitted for next generation sequencing. Data was compiled between two independent experiments each containing 3 replicates (N=6). Averages were presented as population averages (FIGS. 5A-B).

N. meningitides (NM), S. thermophiles (ST), and S. aureus (SA) gRNAs were designed to target the splice acceptor of nine exons. The gRNAs were cloned into plasmids that co-expresses the Cas protein of interest along with the corresponding gRNA. The plasmids were transfected into HEK293T cells using lipofectamine 2000. Cells were harvested 48 hours post transfection, the genomic DNA was isolated, and the desired 100-250 bp PCR amplicons surrounding the desired splice acceptors were submitted for next generation sequencing. Data was compiled between two independent experiments each containing 3 replicates (N=6). Averages were presented as population averages (FIG. 6).

Example 29—Cutting Efficiency of gRNAs Targeting the Regions Surrounding Exons 44, 45, 52, and 54 of the DMD Gene To effectively evaluate editing approaches, it is important to access patient cell lines for in-vitro testing. However, patient material may be difficult to access and there can be large patient-to-patient variation between samples. Therefore, it was important to create DMD mutant cell lines that mimic common patient mutations. This allows the researcher to test the efficacy of a repair strategy in the same background to ensure that variations in editing efficiency are not patient specific. To address this, a variety of gRNAs were designed that can be paired to create common deletions found in DMD patients (Δ52, Δ44, Δ45, and Δ54). The resulting cell lines can be corrected using either an HDR or exon skipping approach. It is important to note, that these gRNAs can be used for either the creation of the model line or an HDR based correction of mutations of interest.

Figure 7A:
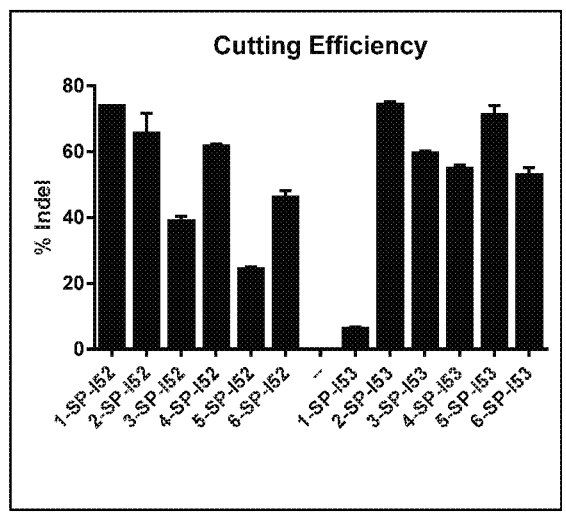
FIG. 7A describes the cutting efficiency of *S. pyogenes* gRNAs in HEK293T cells where the gRNAs target the regions surrounding Exon 52 of the dystrophin gene.
Figure 7B:
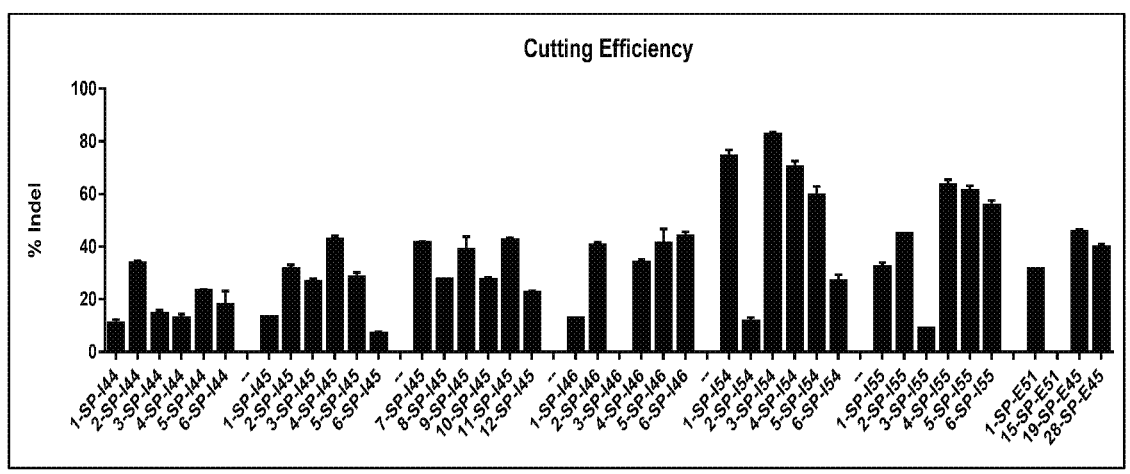
FIG. 7B describes the cutting efficiency of *S. pyogenes* gRNAs in HEK293T cells where the gRNAs target the regions surrounding Exons 44, 45, and 54 of the dystrophin gene.
Figure 8A:
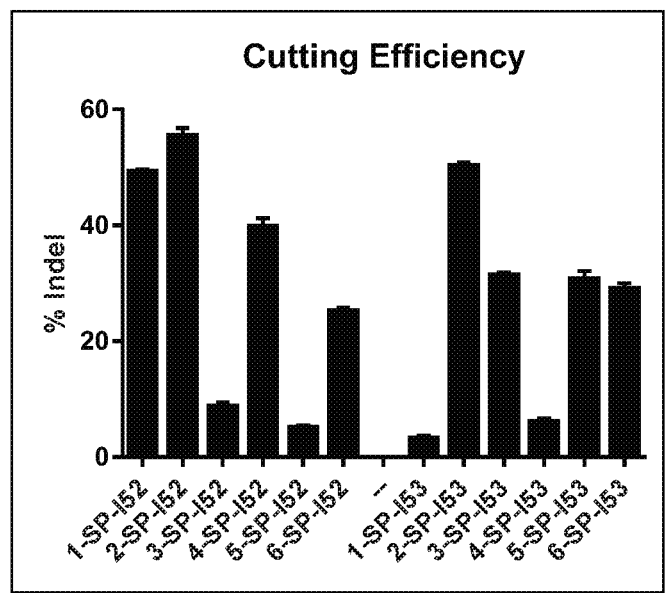
FIG. 8A describes the cutting efficiency of *S. pyogenes* gRNAs in iPSCs where the gRNAs target the regions surrounding Exon 52 of the dystrophin gene.
Figure 8B:
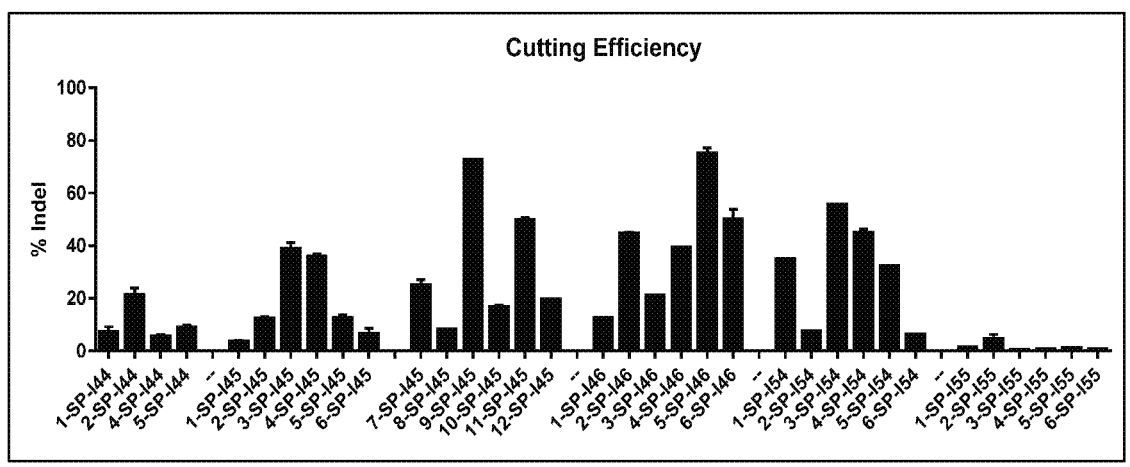
FIG. 8B describes the cutting efficiency of *S. pyogenes* gRNAs in iPSCs where the gRNAs target the regions surrounding Exons 44, 45, and 54 of the dystrophin gene.

The region (100 bp-1 kb upstream and downstream of the exon of interest) was screened using gRNA design software. The best 6 gRNAs based on fewest predicted off target effects were selected on each side of the exon of interest (such as Exons 44, 45, 52, and 54 of the DMD gene). The gRNAs were first evaluated in HEK293 Ts for cutting efficiency (FIGS. 7A-7B) and confirmed for cutting efficiency in iPSC (FIGS. 8A-8B).

Single S. pyogenes gRNAs around exons 44, 45, 52, and 54 were selected. The gRNAs were ordered as split gRNA from IDT. Split gRNAs were annealed to the tracer sequence using manufacturer's instructions.

The annealed gRNAs were transfected into HEK293T that stably express the SP Cas9 protein cells using RNAiMax. Cells were harvested 48 hours post transfection, the genomic DNA was isolated, and cutting efficiency was evaluated using TIDE analysis (FIGS. 7A-7B). Data was compiled from one experiment each containing 3 replicates (N=1 to 3). Data was plotted as mean and SEM.

The annealed gRNAs were also subsequently complexed with Cas9 protein to form a ribonucleoprotein complex (RNP). The RNPs were transfected into iPSCs (DiPS 1016SevA) using RNAiMax. Cells were harvested 48 hours post transfection, the genomic DNA was isolated, and cutting efficiency was evaluated using TIDE analysis (FIG. 8A-8B). Data was compiled from one experiment containing 3 replicates (N=1 to 3). Data was plotted as mean and SEM.

Single S. pyogenes gRNAs around exons 44, 45, 52, and 54 were selected. The gRNAs were ordered as split gRNA from IDT. Split gRNAs were annealed to the tracer sequence using manufacturer's instructions. The gRNAs were transfected into HEK293T that stably express the SP Cas9 protein cells using RNAiMax. The same gRNAs were also complexed with Cas9 protein to form a ribonucleoprotein complex (RNP). The RNPs were transfected into iPSCs (DiPS 1016SevA) using RNAiMax. Cells were harvested 48 hours post transfection, the genomic DNA was isolated, and cutting was evaluated using TIDE analysis. Data was compiled from multiple experiments. Only average values were plotted.

Figure 9:
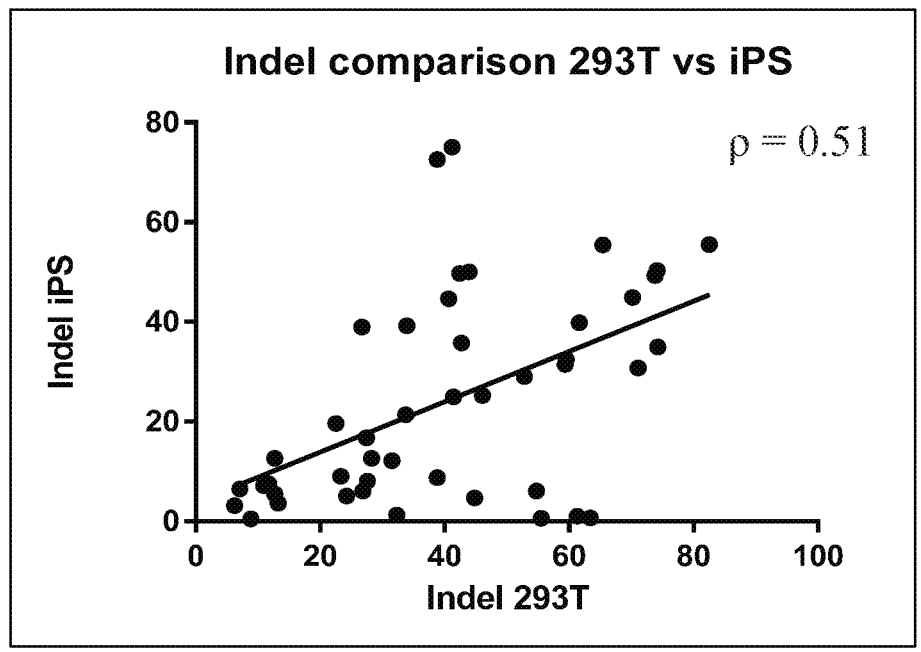
FIG. 9 describes the cutting efficiency comparison of *S. pyogenes* gRNAs in HEK293T cells and iPSCs where the gRNAs target the regions surrounding Exons 44, 45, 52, and 54 of the dystrophin gene.

There was a high correlation between editing efficiency in HEK293T cells and iPSCs with a Pearson correlation coefficient of 0.51 overall. As such, screening in HEK293T cells was considered to be a good surrogate for our therapeutic cell line of interest—iPSCs (FIG. 9).

Example 30—Clonal Analysis of Clonal Deletion Events gRNAs with cutting efficiencies over 20% in iPSCs were identified in each intron of interest except for intron 55. Single gRNAs were selected with the best cutting efficiencies to make the desired deletions.

Figure 10A:
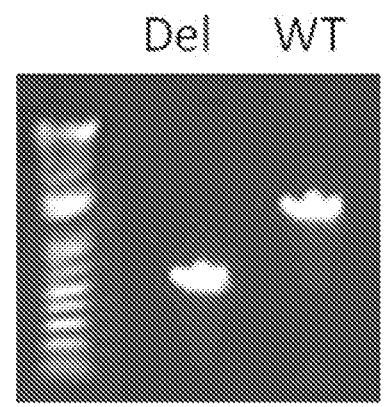

Two pairs of gRNAs were used to create clonal Δ52 cell lines (1-SP-I52+2-SP-I53 and 2-SP-I52+2-SP-I53). Out of 261 total clones screened, 57 had the desired deletion as accessed by PCR analysis (FIGS. 10A, 10C).

To confirm the presence of the expected Δ52 deletion, genomic DNA from each clone of interest was harvested. PCR primers flanking the deletion were designed. Since the deletion was small (<900 bp), a single pair of primers could be used to detect the deletion. This would result in a smaller deletion band (~500 bp) or a wild-type (WT) band (~1000 bp). A representative gel of the deletion (del) or wild type (WT) product is shown in FIG. 10A.

The deletion even was confirmed in seven clones by submitting the deletion PCR product for Sanger sequencing (7/7 clones had the predicted deletion event with small insertions and deletions (FIGS. 11A-B). The deletion bands from seven clones (PCRs generated in FIG. 8A) were gel prepped and submitted for Sanger sequencing. Two clones created using gRNA 1-SP-I52 and 2-SP-I53 were sequenced and aligned to the predicted deletion product (assuming that S. pyogenes Cas9 cuts 3BP from the 3' end of the gRNA (FIG. 11A). Five clones created using gRNA 2-SP-I52 and 2-SP-I53 were sequenced and aligned to the predicted deletion product (assuming that S. pyogenes Cas9 cuts 3BP from the 3' end of the gRNA (FIG. 11B).

Figure 10B:
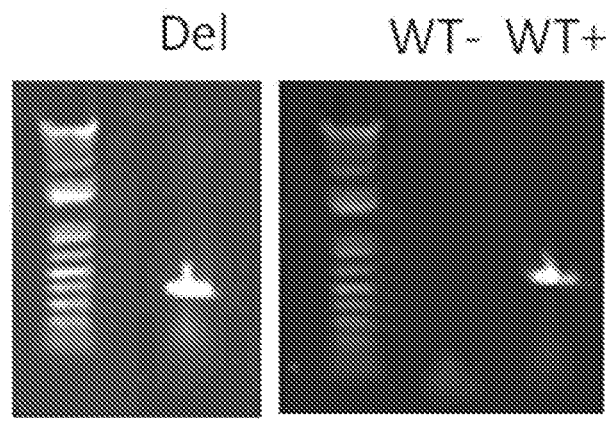

Similarly, two pairs of gRNAs were used to create clonal Δ44 cell lines (2-SP-I44+3-SP-I45 and 2-SP-I44+4-SP-I45). Out of 256 total clones screened, 16 had the desired deletion as accessed by PCR analysis (FIGS. 10B, 10C).

To confirm the presence of the expected Δ44 deletion, genomic DNA from each clone of interest was harvested. Since the Δ44 gRNAs produce a larger deletion compared to the Δ52 gRNAs, two pairs of PCR primers were designed to either detect a deletion band or WT band. The expected deletion band was ~400 bp and the expected WT band was ~500 bp. A representative gel of the deletion (del), wild type product (WT+), and a negative sample amplified with the wild type primers (WT−) is shown in FIG. 10B.

Example 31—Lentiviral Screen

To identify a large spectrum of pairs of gRNAs able to induce Exon51 skipping, we conducted a large scale lentiviral screen. Intron 51 and Intron 52 genomic sequence were submitted for analysis using a gRNA design software. The resulting list of gRNAs were narrowed to about 3000 left and 3000 right gRNAs adjacent to the Exon 51 splice acceptor. The list was narrowed based on uniqueness of sequence (only gRNAs without a perfect match somewhere else in the genome were screened) and minimal predicted off targets. A left gRNA paired with a right gRNA should induce Exon 51 skipping. The 6000 gRNAs were cloned into a lentiviral vector that expressed each gRNA of interest from the U6 promoter and confers puromycin resistance. K562 cells were transduced with the virus at an MOI 2 and selected with puromycin to obtain a population of cells that were expressing a gRNA of interest. These cells were then nucleofected with Cas9 mRNA to induce a transient period of cutting. After 7 days, the cells were pelleted and the genomic DNA was extracted. The genomic DNA was enriched for the region of interest around Exon 51 using hybrid capture. The enriched DNA was submitted for next generation sequencing (FIGS. 19A-19VV).

Example 32—In Vitro Transcribed (IVT) gRNA Screen

To identify a large spectrum of pairs of gRNAs able to induce Exon 45 skipping, an in vitro transcribed (IVT) gRNA screen was conducted. Intron 45 and Intron 46 genomic sequence was submitted for analysis using a gRNA design software. The resulting list of gRNAs were narrowed to a list of about 100 left and about 100 right gRNAs based on uniqueness of sequence (only gRNAs without a perfect match somewhere else in the genome were screened) and minimal predicted off targets. This set of gRNAs were in vitro transcribed, and transfected using messenger Max into HEK293T cells that stably express Cas9. Cells were harvested 48 hours post transfection, the genomic DNA was

Example 33—Partial cDNA Knockin Between Exons 45-55 of the DMD Gene

Figure 13A:
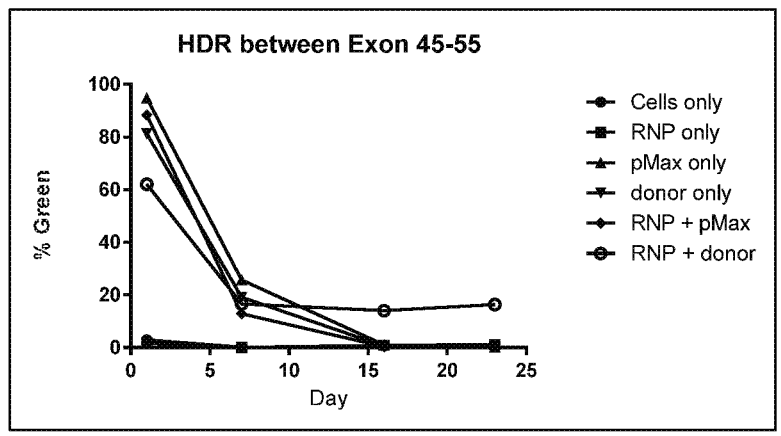
FIG. 13A describes the homology directed repair (HDR) between Exon 45-55 of the dystrophin gene.
Figure 13B:
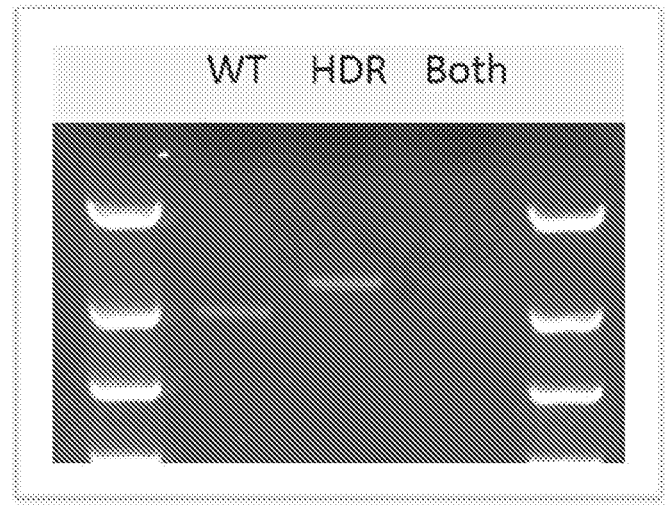
FIG. 13B depicts the PCR confirmation of HDR at the Exon 45-55 locus of the dystrophin gene.

Another approach for correcting the DMD gene is a partial cDNA knock-in. As proof of principle, a study was conducted to replace the region Exon 45-55 of the DMD gene (which could treat up to 62% of DMD patients). The cDNA for Exon 45-55 is 3.2 kb. Two solid phase synthesized gRNAs [one in Exon 45 (SEQ ID NO. 1410449) and a second in Exon 55 (SEQ ID NO 114738)] from Trilink were used for cutting. The two trilink gRNAs were complexed with Cas9 protein and nucleofected into iPSCs along with a plasmid donor. The plasmid donor was designed to have a 3.2 kb cassette (same size as the desired cDNA knock-in) that constitutively expressed GFP with 1 kb homology arms on each side to induce integration into the Exon 45 to 55 site. The cells were tracked over 23 days. All experimental conditions were nucleofected with high efficiency (over 60%); however, only GFP expression from cells that received the donor and gRNA stabilized over time, indicating that HDR occurred in about 16 percent of cells (FIG. 13A). The genomic DNA from these samples was isolated and tested for site specific integration of the donor construct. Samples were amplified with primers specific to the WT allele or the desired knock-in allele. As expected, both the WT and knock-in allele could be detected (FIG. 13B).

Example 34—Internally Deleted Yet Functional Dystrophin Protein

As proof of concept, it was demonstrated that we can edit in iPSC, isolate a clonal population of edited cells, and differentiate those cells down the myogenic lineage to produce an internally deleted yet functional dystrophin protein.

One attractive method for correcting the DMD gene is to create a 445-55 deletion. This deletion maintains the DMD reading frame and can restore expression of dystrophin in about 62% of DMD patients. To create the desired 445-55 deletion, two published SP gRNAs (CR6: SEQ ID NO: 1,410,475 and CR36: SEQ ID NO: 91033) were cloned into plasmids that also express SP Cas9 T2A orange florescent protein (OFP).

| gRNA | gRNA sequence | PAM |
|---|---|---|
| CR6 | GGGGCTCCACCCTCACGAGT | GGG |
| CR36 | GCCTTCTTTATCCCCTATCG | AGG |

These two plasmids were co transfected into iPSCs using Mirus LT1 transfection reagent. Two days later the cells expressing Cas9 as indicated by OFP expression were isolated using florescence activated cell sorting (FACS). The cells were seeded at a low density and allowed to grow for 7-10 days until single cell clones appeared in the dishes. The clones were picked manually under a microscope and transferred into 96 well plates. Once the cells reached confluence, the samples were passaged 1:2 and genomic DNA was isolated from the remaining cells.

To identify clones with the desired deletion, a three primer PCR assay was designed (FIGS. 14A and 14B). The assay allows for detection of a wild type (WT) and deletion band in the same PCR reaction. Using this assay, we identified 26/100 clones that had the editing event (FIG. 14C).

Figure 15:
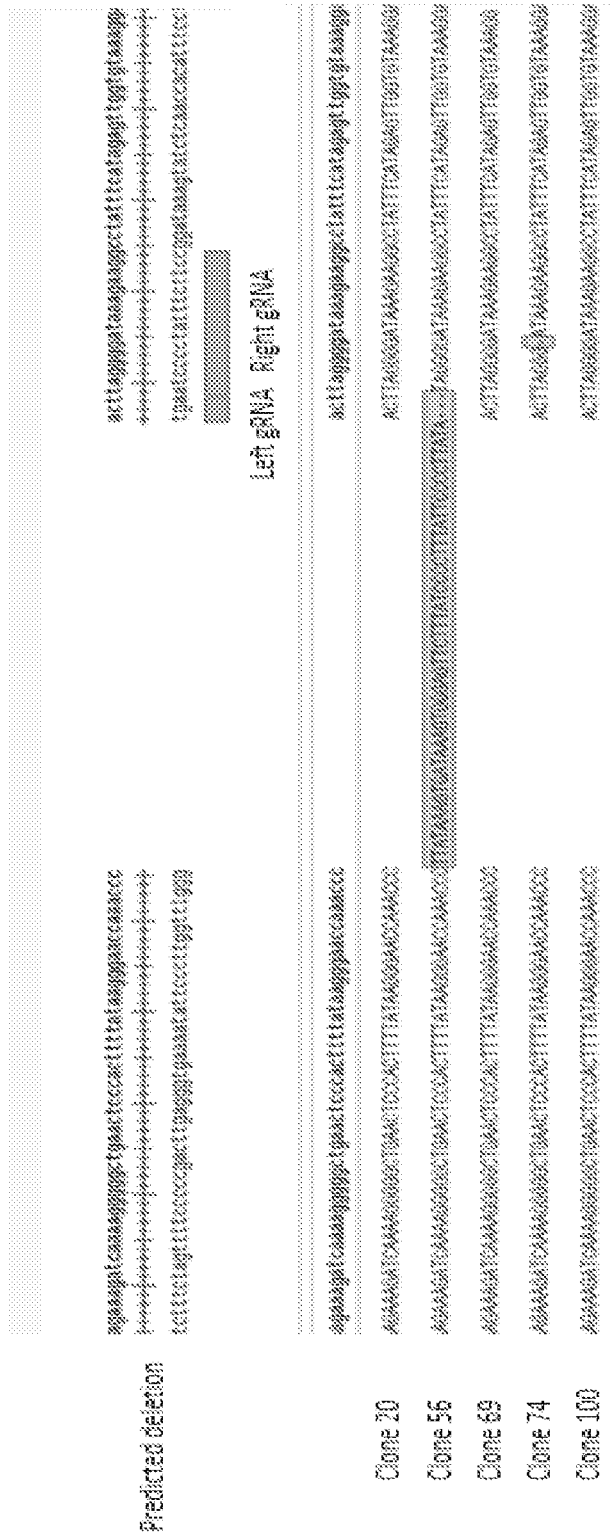
FIG. 15 describes 5 clones that have the desired 445-55 deletion. SEQ ID NO: 1420002 corresponds to clone 20. SEQ ID NO: 1420003 corresponds to clone 56. SEQ ID NO: 1420004 corresponds to clone 69. SEQ ID NO: 1420005 corresponds to clone 74. SEQ ID NO: 1420006 corresponds to clone 100.

To further validate that the clones had the desired 445-55 deletion, 5 clones were submitted for Sanger sequencing. All five were confirmed to have the desired deletion event. One clone had an insertion, and one a single base pair deletion. The other three clones contained perfect deletion events (FIG. 15).

Figure 16A:
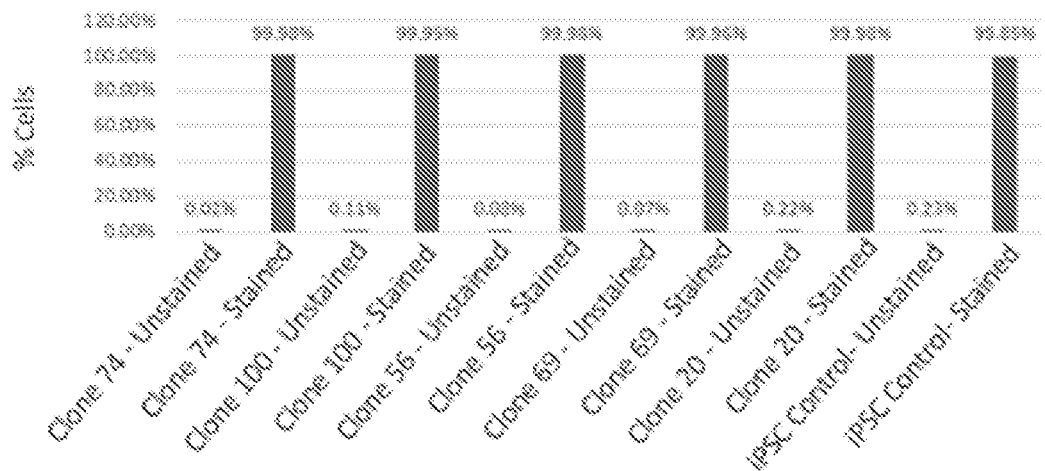
FIGS. 16A-B describes the SSEA-4 Staining and TRA-160 Staining results of the 5 clones that have the desired 445-55 deletion.
Figure 16B:
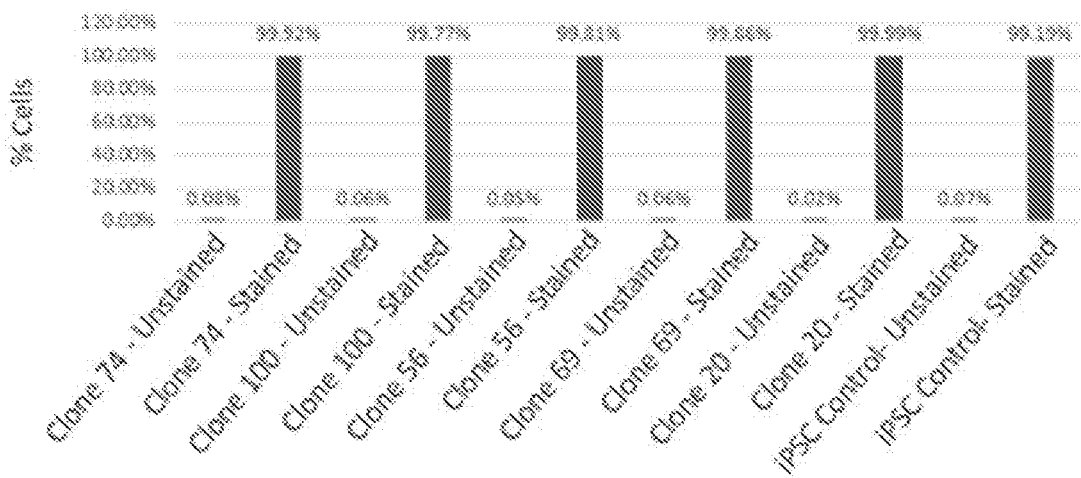

All five clones that were sequenced, were also submitted for karyotyping, and found karyotypically normal. Furthermore, all clones maintained pluripotency and stained over 99% positive for both SSEA-4 and TRA-160 (FIGS. 16A-B).

Figure 17:
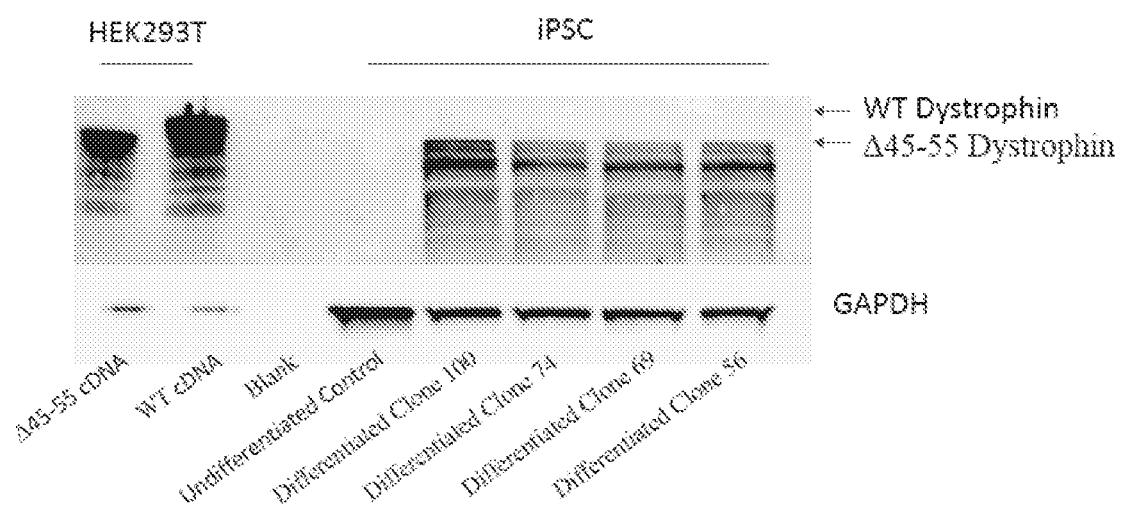
FIG. 17 depicts the expression of an internally deleted dystrophin protein for all 5 edited clones.
Figure 18:
FIG. 18 depicts myosin heavy chain staining of differentiated clone 56.

Four of the clones were then differentiated into mytotubes using the published Chal et. al protocol. [Chal et. al (2015) Differentiation of Pluripotent stem cells to muscle fiber to model Duchenne Muscular Dystrophy. Nature Biotechnology] to induce expression of dystrophin. Samples were harvested for Western blot and immuno-histo-chemistry. All five edited clones induced expression of an internally deleted dystrophin protein (FIG. 17). The sizes were compared to protein isolated from HEK293T cells transfected with control cDNA plasmids that express either the WT dystrophin protein or the 445-55 dystrophin protein. The differentiated cells phenotypically produced myotubes as demonstrated by myosin heavy chain staining. Representative image of differentiated Clone 56 is shown in FIG. 18.

Note Regarding Illustrative Aspects

While the present disclosure provides descriptions of various specific aspects for the purpose of illustrating various aspects of the present invention and/or its potential applications, it is understood that variations and modifications will occur to those skilled in the art. Accordingly, the invention or inventions described herein should be understood to be at least as broad as they are claimed, and not as more narrowly defined by particular illustrative aspects provided herein.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

SEQUENCE LISTING (1410475 sequences)

SEQ ID NO: 1 - DNA, 20 bp, Artificial Sequence
  chemically synthesized
aggttacctacagtaacttg

SEQ ID NO: 2 - DNA, 20 bp, Artificial Sequence
  chemically synthesized
aaggttacctacagtaactt

SEQ ID NO: 3 - DNA, 20 bp, Artificial Sequence
  chemically synthesized
tttaaacctcaagttactgt

SEQ ID NO: 4 - DNA, 20 bp, Artificial Sequence
  chemically synthesized
tgtacagaaaaggttaccta

SEQ ID NO: 5 - DNA, 20 bp, Artificial Sequence
  chemically synthesized
gtagcttttgtgtacagaaa

SEQ ID NO: 6 - DNA, 20 bp, Artificial Sequence
  chemically synthesized
agtagcttttgtgtacagaa

SEQ ID NO: 7 - DNA, 20 bp, Artificial Sequence
  chemically synthesized
gtaaccttttctgtacacaa

SEQ ID NO: 8 - DNA, 20 bp, Artificial Sequence
  chemically synthesized
ttgagagtagcttttgtgta

SEQ ID NO: 9 - DNA, 20 bp, Artificial Sequence
  chemically synthesized
tggggatgtttgtttgagag

SEQ ID NO: 10 - DNA, 20 bp, Artificial Sequence
  chemically synthesized
gtttggggatgtttgtttga

SEQ ID NO: 11 - DNA, 20 bp, Artificial Sequence
  chemically synthesized
aagtttggggatgtttgttt

SEQ ID NO: 12 - DNA, 20 bp, Artificial Sequence
  chemically synthesized
gtgtgaatgtgtaaagtttg

SEQ ID NO: 13 - DNA, 20 bp, Artificial Sequence
  chemically synthesized
tgtgtgaatgtgtaaagttt

SEQ ID NO: 14 - DNA, 20 bp, Artificial Sequence
  chemically synthesized
ttgtgtgaatgtgtaaagtt

SEQ ID NO: 15 - DNA, 20 bp, Artificial Sequence
  chemically synthesized
caatattgtgtgaatgtgta

SEQ ID NO: 16 - DNA, 20 bp, Artificial Sequence
  chemically synthesized
tcacacaatattgtttatta

SEQ ID NO: 17 - DNA, 20 bp, Artificial Sequence
  chemically synthesized
tattgtttattatggaatgt

SEQ ID NO: 18 - DNA, 20 bp, Artificial Sequence
  chemically synthesized
attgtttattatggaatgtt

SEQ ID NO: 19 - DNA, 20 bp, Artificial Sequence
  chemically synthesized
agctgacaacacaagagtgg

SEQ ID NO: 20 - DNA, 20 bp, Artificial Sequence
  chemically synthesized
cttagctgacaacacaagag

SEQ ID NO: 21 - DNA, 20 bp, Artificial Sequence
  chemically synthesized
ggacttagctgacaacacaa

SEQ ID NO: 22 - DNA, 20 bp, Artificial Sequence
  chemically synthesized
tgctgccactcttgtgttgt

SEQ ID NO: 23 - DNA, 20 bp, Artificial Sequence
  chemically synthesized
atggacttagctgacaacac

SEQ ID NO: 24 - DNA, 20 bp, Artificial Sequence
  chemically synthesized
ccactcttgtgttgtcagct

SEQ ID NO: 25 - DNA, 20 bp, Artificial Sequence
  chemically synthesized
gtgttgtcagctaagtccat

SEQ ID NO: 26 - DNA, 20 bp, Artificial Sequence
  chemically synthesized
gtactgtgatctcatggact

SEQ ID NO: 27 - DNA, 20 bp, Artificial Sequence
  chemically synthesized
gtcagtgtactgtgatctca

SEQ ID NO: 28 - DNA, 20 bp, Artificial Sequence
  chemically synthesized
cagctaagtccatgagatca

SEQ ID NO: 29 - DNA, 20 bp, Artificial Sequence
  chemically synthesized
atcacagtacactgacgtgc

SEQ ID NO: 30 - DNA, 20 bp, Artificial Sequence
  chemically synthesized
tcacagtacactgacgtgca

SEQ ID NO: 31 - DNA, 20 bp, Artificial Sequence
  chemically synthesized
cttcaatgccccttgcacgt

SEQ ID NO: 32 - DNA, 20 bp, Artificial Sequence
  chemically synthesized
cacagtacactgacgtgcaa

SEQ ID NO: 33 - DNA, 20 bp, Artificial Sequence
  chemically synthesized
acagtacactgacgtgcaag

SEQ ID NO: 34 - DNA, 20 bp, Artificial Sequence
  chemically synthesized
ctgacgtgcaaggggcattg

SEQ ID NO: 35 - DNA, 20 bp, Artificial Sequence
  chemically synthesized
ggcattgaagaacatattta

SEQ ID NO: 36 - DNA, 20 bp, Artificial Sequence
  chemically synthesized
atttatagttcctactccaa

SEQ ID NO: 37 - DNA, 20 bp, Artificial Sequence
  chemically synthesized
agtagcaaagccattggagt

SEQ ID NO: 38 - DNA, 20 bp, Artificial Sequence
  chemically synthesized
cagtagcaaagccattggag

SEQ ID NO: 39 - DNA, 20 bp, Artificial Sequence
  chemically synthesized
ccacagtagcaaagccattg

SEQ ID NO: 40 - DNA, 20 bp, Artificial Sequence
  chemically synthesized
tcccacagtagcaaagccat

SEQ ID NO: 41 - DNA, 20 bp, Artificial Sequence
  chemically synthesized
aattctttcccacagtagca

SEQ ID NO: 42 - DNA, 20 bp, Artificial Sequence
  chemically synthesized
ctccaatggctttgctactg

SEQ ID NO: 43 - DNA, 20 bp, Artificial Sequence
  chemically synthesized
tccaatggctttgctactgt

SEQ ID NO: 44 - DNA, 20 bp, Artificial Sequence
  chemically synthesized
aatcaaattctttcccacag

SEQ ID NO: 45 - DNA, 20 bp, Artificial Sequence
  chemically synthesized
atggctttgctactgtggga

SEQ ID NO: 46 - DNA, 20 bp, Artificial Sequence
  chemically synthesized
acaaatcaaattctttccca

SEQ ID NO: 47 - DNA, 20 bp, Artificial Sequence
  chemically synthesized
ccttcaaattaagtgtagga

SEQ ID NO: 48 - DNA, 20 bp, Artificial Sequence
  chemically synthesized
gccttcaaattaagtgtagg

SEQ ID NO: 49 - DNA, 20 bp, Artificial Sequence
  chemically synthesized
tttgccttcaaattaagtgt

SEQ ID NO: 50 - DNA, 20 bp, Artificial Sequence
  chemically synthesized
ctttgccttcaaattaagtg

SEQ ID NO: 51 - DNA, 20 bp, Artificial Sequence
  chemically synthesized
tccttcctacacttaatttg

SEQ ID NO: 52 - DNA, 20 bp, Artificial Sequence
  chemically synthesized
ccttcctacacttaatttga

SEQ ID NO: 53 - DNA, 20 bp, Artificial Sequence
  chemically synthesized
aaagactttgccttcaaatt

SEQ ID NO: 54 - DNA, 20 bp, Artificial Sequence
  chemically synthesized
ctacacttaatttgaaggca

SEQ ID NO: 55 - DNA, 20 bp, Artificial Sequence
  chemically synthesized
tttgaaggcaaagtctttgc

SEQ ID NO: 56 - DNA, 20 bp, Artificial Sequence
  chemically synthesized
caggcactggcgcacttgca

SEQ ID NO: 57 - DNA, 20 bp, Artificial Sequence
  chemically synthesized
caaagtctttgcaagtgcgc

SEQ ID NO: 58 - DNA, 20 bp, Artificial Sequence
  chemically synthesized
atgaatacaaaggcaggcac

SEQ ID NO: 59 - DNA, 20 bp, Artificial Sequence
  chemically synthesized
ggtggaatgaatacaaaggc

SEQ ID NO: 60 - DNA, 20 bp, Artificial Sequence
  chemically synthesized
tggtggaatgaatacaaagg

SEQ ID NO: 61 - DNA, 20 bp, Artificial Sequence
  chemically synthesized
taatggtggaatgaatacaa

SEQ ID NO: 62 - DNA, 20 bp, Artificial Sequence
  chemically synthesized
ctaatggtggaatgaataca

SEQ ID NO: 63 - DNA, 20 bp, Artificial Sequence
  chemically synthesized
ctttgtattcattccaccat

SEQ ID NO: 64 - DNA, 20 bp, Artificial Sequence
  chemically synthesized
ttgtattcattccaccatta

SEQ ID NO: 65 - DNA, 20 bp, Artificial Sequence
  chemically synthesized
aatttgtaatgctctaatgg

SEQ ID NO: 66 - DNA, 20 bp, Artificial Sequence
  chemically synthesized
ctgaatttgtaatgctctaa

SEQ ID NO: 67 - DNA, 20 bp, Artificial Sequence
  chemically synthesized
ccattagagcattacaaatt

SEQ ID NO: 68 - DNA, 20 bp, Artificial Sequence
  chemically synthesized
cattagagcattacaaattc

SEQ ID NO: 69 - DNA, 20 bp, Artificial Sequence
  chemically synthesized
attagagcattacaaattca

SEQ ID NO: 70 - DNA, 20 bp, Artificial Sequence
  chemically synthesized
aattcagggaaatcccatcg

SEQ ID NO: 71 - DNA, 20 bp, Artificial Sequence
  chemically synthesized
gtgttctgtagagctgcgat

SEQ ID NO: 72 - DNA, 20 bp, Artificial Sequence
  chemically synthesized
tgtgttctgtagagctgcga

SEQ ID NO: 73 - DNA, 20 bp, Artificial Sequence
  chemically synthesized
gaaatcccatcgcagctcta

SEQ ID NO: 74 - DNA, 20 bp, Artificial Sequence
  chemically synthesized
actaatggatgtgttctgta

SEQ ID NO: 75 - DNA, 20 bp, Artificial Sequence
  chemically synthesized
agactaatggatgtgttctg

SEQ ID NO: 76 - DNA, 20 bp, Artificial Sequence
  chemically synthesized
gctctacagaacacatccat

SEQ ID NO: 77 - DNA, 20 bp, Artificial Sequence
  chemically synthesized
cagaacacatccattagtct

SEQ ID NO: 78 - DNA, 20 bp, Artificial Sequence
  chemically synthesized
ggagaaagcaccaagactaa

SEQ ID NO: 79 - DNA, 20 bp, Artificial Sequence
  chemically synthesized
tttgtttgggagaaagcacc

SEQ ID NO: 80 - DNA, 20 bp, Artificial Sequence
  chemically synthesized
atgtgtgtttgtttgggaga

SEQ ID NO: 81 - DNA, 20 bp, Artificial Sequence
  chemically synthesized
caaaatgtgtgtttgtttgg

SEQ ID NO: 82 - DNA, 20 bp, Artificial Sequence
  chemically synthesized
agcaaaatgtgtgtttgttt

SEQ ID NO: 83 - DNA, 20 bp, Artificial Sequence
  chemically synthesized
aagcaaaatgtgtgtttgtt

SEQ ID NO: 84 - DNA, 20 bp, Artificial Sequence
  chemically synthesized
caaacacacattttgcttgc

SEQ ID NO: 85 - DNA, 20 bp, Artificial Sequence
  chemically synthesized
ggcacagattatgcaccggc

SEQ ID NO: 86 - DNA, 20 bp, Artificial Sequence
  chemically synthesized
agctggcacagattatgcac

SEQ ID NO: 87 - DNA, 20 bp, Artificial Sequence
  chemically synthesized
tgccggtgcataatctgtgc

SEQ ID NO: 88 - DNA, 20 bp, Artificial Sequence
  chemically synthesized
taaaatgaatcgagctggca

SEQ ID NO: 89 - DNA, 20 bp, Artificial Sequence
  chemically synthesized
aaaattaaaatgaatcgagc

SEQ ID NO: 90 - DNA, 20 bp, Artificial Sequence
  chemically synthesized
gttaaaaattaaaatgaatc

SEQ ID NO: 91 - DNA, 20 bp, Artificial Sequence
  chemically synthesized
tagaagagacagaattaatt

SEQ ID NO: 92 - DNA, 20 bp, Artificial Sequence
  chemically synthesized
tgaattaattctgtctcttc

SEQ ID NO: 93 - DNA, 20 bp, Artificial Sequence
  chemically synthesized
ttggcacacactagaagaga

SEQ ID NO: 94 - DNA, 20 bp, Artificial Sequence
  chemically synthesized
atacttggcacacactagaa

SEQ ID NO: 95 - DNA, 20 bp, Artificial Sequence
  chemically synthesized
ccatacttggcacacactag

SEQ ID NO: 96 - DNA, 20 bp, Artificial Sequence
  chemically synthesized
attccatacttggcacacac

SEQ ID NO: 97 - DNA, 20 bp, Artificial Sequence
  chemically synthesized
tgtctcttctagtgtgtgcc

SEQ ID NO: 98 - DNA, 20 bp, Artificial Sequence
  chemically synthesized
cttctagtgtgtgccaagta

SEQ ID NO: 99 - DNA, 20 bp, Artificial Sequence
  chemically synthesized
ttggttttccattccatact

SEQ ID NO: 100 - DNA, 20 bp, Artificial Sequence
  chemically synthesized
agtgtgtgccaagtatggaa

SEQ ID NO: 101 - DNA, 20 bp, Artificial Sequence
  chemically synthesized
atgactctgaggagggcatt

SEQ ID NO: 102 - DNA, 20 bp, Artificial Sequence
  chemically synthesized
ggaaaaccaaatgccctcct

SEQ ID NO: 103 - DNA, 20 bp, Artificial Sequence
  chemically synthesized
aaaaccaaatgccctcctca

SEQ ID NO: 104 - DNA, 20 bp, Artificial Sequence
  chemically synthesized
tgtgtggatgactctgagga

SEQ ID NO: 105 - DNA, 20 bp, Artificial Sequence
  chemically synthesized
gtgtgtggatgactctgagg

SEQ ID NO: 106 - DNA, 20 bp, Artificial Sequence
  chemically synthesized
tgtgtgtggatgactctgag

SEQ ID NO: 107 - DNA, 20 bp, Artificial Sequence
  chemically synthesized
actgtgtgtggatgactctg

SEQ ID NO: 108 - DNA, 20 bp, Artificial Sequence
  chemically synthesized
aactgtgtgtggatgactct

SEQ ID NO: 109 - DNA, 20 bp, Artificial Sequence
  chemically synthesized
tcctcagagtcatccacaca

SEQ ID NO: 110 - DNA, 20 bp, Artificial Sequence
  chemically synthesized
acgtctaagacaactgtgtg

SEQ ID NO: 111 - DNA, 20 bp, Artificial Sequence
  chemically synthesized
tcatccacacacagttgtct

SEQ ID NO: 112 - DNA, 20 bp, Artificial Sequence
  chemically synthesized
acacacagttgtcttagacg

SEQ ID NO: 113 - DNA, 20 bp, Artificial Sequence
  chemically synthesized
ttcaatacttcaccacgtct

SEQ ID NO: 114 - DNA, 20 bp, Artificial Sequence
  chemically synthesized
cagttgtcttagacgtggtg

SEQ ID NO: 115 - DNA, 20 bp, Artificial Sequence
  chemically synthesized
ttagacgtggtgaagtattg

SEQ ID NO: 116 - DNA, 20 bp, Artificial Sequence
  chemically synthesized
gtgaagtattgaagattcct

SEQ ID NO: 117 - DNA, 20 bp, Artificial Sequence
  chemically synthesized
gacacttaaggaggtaactg

SEQ ID NO: 118 - DNA, 20 bp, Artificial Sequence
  chemically synthesized
tgacacttaaggaggtaact

SEQ ID NO: 119 - DNA, 20 bp, Artificial Sequence
  chemically synthesized
gattcctcagttacctcctt

SEQ ID NO: 120 - DNA, 20 bp, Artificial Sequence
  chemically synthesized
tgttttggtgacacttaagg

SEQ ID NO: 121 - DNA, 20 bp, Artificial Sequence
  chemically synthesized
ctgttttggtgacacttaag

SEQ ID NO: 122 - DNA, 20 bp, Artificial Sequence
  chemically synthesized
ggctgttttggtgacactta

SEQ ID NO: 123 - DNA, 20 bp, Artificial Sequence
  chemically synthesized
tggctgttttggtgacactt

SEQ ID NO: 124 - DNA, 20 bp, Artificial Sequence
  chemically synthesized
ctccttaagtgtcaccaaaa

SEQ ID NO: 125 - DNA, 20 bp, Artificial Sequence
  chemically synthesized
ttaagtgtcaccaaaacagc

SEQ ID NO: 126 - DNA, 20 bp, Artificial Sequence
  chemically synthesized
aacacccagactggctgttt

SEQ ID NO: 127 - DNA, 20 bp, Artificial Sequence
  chemically synthesized
tgtcaccaaaacagccagtc

SEQ ID NO: 128 - DNA, 20 bp, Artificial Sequence
  chemically synthesized
gtcaccaaaacagccagtct

SEQ ID NO: 129 - DNA, 20 bp, Artificial Sequence
  chemically synthesized
tttgtttgaaacacccagac

SEQ ID NO: 130 - DNA, 20 bp, Artificial Sequence
  chemically synthesized
ctacctttgtttgaaacacc

SEQ ID NO: 131 - DNA, 20 bp, Artificial Sequence
  chemically synthesized
cagtctgggtgtttcaaaca

SEQ ID NO: 132 - DNA, 20 bp, Artificial Sequence
  chemically synthesized
agtctgggtgtttcaaacaa

SEQ ID NO: 133 - DNA, 20 bp, Artificial Sequence
  chemically synthesized
ctgggtgtttcaaacaaagg

SEQ ID NO: 134 - DNA, 20 bp, Artificial Sequence
  chemically synthesized
tgggtgtttcaaacaaaggt

SEQ ID NO: 135 - DNA, 20 bp, Artificial Sequence
  chemically synthesized
gtttcaaacaaaggtaggtt

SEQ ID NO: 136 - DNA, 20 bp, Artificial Sequence
  chemically synthesized
tttcaaacaaaggtaggttc

SEQ ID NO: 137 - DNA, 20 bp, Artificial Sequence
  chemically synthesized
acaaaggtaggttcgggtaa

SEQ ID NO: 138 - DNA, 20 bp, Artificial Sequence
  chemically synthesized
aaggtaggttcgggtaatgg

SEQ ID NO: 139 - DNA, 20 bp, Artificial Sequence
  chemically synthesized
aggtaggttcgggtaatggt

SEQ ID NO: 140 - DNA, 20 bp, Artificial Sequence
  chemically synthesized
taggttcgggtaatggtggg

SEQ ID NO: 141 - DNA, 20 bp, Artificial Sequence
  chemically synthesized
aggttcgggtaatggtggga

SEQ ID NO: 142 - DNA, 20 bp, Artificial Sequence
  chemically synthesized
aaatgatttgtttatttaaa

SEQ ID NO: 143 - DNA, 20 bp, Artificial Sequence
  chemically synthesized
aatgatttgtttatttaaat

SEQ ID NO: 144 - DNA, 20 bp, Artificial Sequence
  chemically synthesized
aataggatgaaaatttttct

SEQ ID NO: 145 - DNA, 20 bp, Artificial Sequence
  chemically synthesized
ccttgacatccacacatacc

SEQ ID NO: 146 - DNA, 20 bp, Artificial Sequence
  chemically synthesized
aaaatttttcttggtatgtg

SEQ ID NO: 147 - DNA, 20 bp, Artificial Sequence
  chemically synthesized
tcttggtatgtgtggatgtc

SEQ ID NO: 148 - DNA, 20 bp, Artificial Sequence
  chemically synthesized
cttggtatgtgtggatgtca

SEQ ID NO: 149 - DNA, 20 bp, Artificial Sequence
  chemically synthesized
ttggtatgtgtggatgtcaa

SEQ ID NO: 150 - DNA, 20 bp, Artificial Sequence
  chemically synthesized
gtatgtgtggatgtcaaggg

SEQ ID NO: 151 - DNA, 20 bp, Artificial Sequence
  chemically synthesized
tcaagggaagtgtttcaatg

SEQ ID NO: 152 - DNA, 20 bp, Artificial Sequence
  chemically synthesized
agggaagtgtttcaatgtgg

SEQ ID NO: 153 - DNA, 20 bp, Artificial Sequence
  chemically synthesized
gtttcaatgtggtagtcact

SEQ ID NO: 154 - DNA, 20 bp, Artificial Sequence
  chemically synthesized
tttcaatgtggtagtcactt

SEQ ID NO: 155 - DNA, 20 bp, Artificial Sequence
  chemically synthesized
aatgtggtagtcacttaggt

SEQ ID NO: 156 - DNA, 20 bp, Artificial Sequence
  chemically synthesized
tagggtgatgatgctgacct

SEQ ID NO: 157 - DNA, 20 bp, Artificial Sequence
  chemically synthesized
ttgctaattttttgaaagta

SEQ ID NO: 158 - DNA, 20 bp, Artificial Sequence
  chemically synthesized
cttgctaattttttgaaagt

SEQ ID NO: 159 - DNA, 20 bp, Artificial Sequence
  chemically synthesized
acttgctaattttttgaaag

SEQ ID NO: 160 - DNA, 20 bp, Artificial Sequence
  chemically synthesized
atcacttgctaattttttga

SEQ ID NO: 161 - DNA, 20 bp, Artificial Sequence
  chemically synthesized
tcaccctactttcaaaaaat

SEQ ID NO: 162 - DNA, 20 bp, Artificial Sequence
  chemically synthesized
cctactttcaaaaaattagc

SEQ ID NO: 163 - DNA, 20 bp, Artificial Sequence
  chemically synthesized
attagcaagtgattgattca

SEQ ID NO: 164 - DNA, 20 bp, Artificial Sequence
  chemically synthesized
agcaagtgattgattcacag

SEQ ID NO: 165 - DNA, 20 bp, Artificial Sequence
  chemically synthesized
caagtgattgattcacagca

SEQ ID NO: 166 - DNA, 20 bp, Artificial Sequence
  chemically synthesized
atgatgtttgttagtagatg

SEQ ID NO: 167 - DNA, 20 bp, Artificial Sequence
  chemically synthesized
ttagaaatgatgtttgttag

SEQ ID NO: 168 - DNA, 20 bp, Artificial Sequence
  chemically synthesized
tcattagaaatgatgtttgt

SEQ ID NO: 169 - DNA, 20 bp, Artificial Sequence
  chemically synthesized
taacaaacatcatttctaat

SEQ ID NO: 170 - DNA, 20 bp, Artificial Sequence
  chemically synthesized
aaacatcatttctaatgaga

SEQ ID NO: 171 - DNA, 20 bp, Artificial Sequence
  chemically synthesized
gatgagatgatccatctcat

SEQ ID NO: 172 - DNA, 20 bp, Artificial Sequence
  chemically synthesized
ttttggaaataataggagat

SEQ ID NO: 173 - DNA, 20 bp, Artificial Sequence
  chemically synthesized
agtgattttggaaataatag

SEQ ID NO: 174 - DNA, 20 bp, Artificial Sequence
  chemically synthesized
ctagtgattttggaaataat

SEQ ID NO: 175 - DNA, 20 bp, Artificial Sequence
  chemically synthesized
cctagtgattttggaaataa

SEQ ID NO: 176 - DNA, 20 bp, Artificial Sequence
  chemically synthesized
cctattatttccaaaatcac

SEQ ID NO: 177 - DNA, 20 bp, Artificial Sequence
  chemically synthesized
gcagcctatcctagtgattt

SEQ ID NO: 178 - DNA, 20 bp, Artificial Sequence
  chemically synthesized
ctattatttccaaaatcact

SEQ ID NO: 179 - DNA, 20 bp, Artificial Sequence
  chemically synthesized
tatttccaaaatcactagga

SEQ ID NO: 180 - DNA, 20 bp, Artificial Sequence
  chemically synthesized
atttccaaaatcactaggat

SEQ ID NO: 181 - DNA, 20 bp, Artificial Sequence
  chemically synthesized
ccaccaggtgcagcctatcc

SEQ ID NO: 182 - DNA, 20 bp, Artificial Sequence
  chemically synthesized
tcactaggataggctgcacc

SEQ ID NO: 183 - DNA, 20 bp, Artificial Sequence
  chemically synthesized
ctaggataggctgcacctgg

SEQ ID NO: 184 - DNA, 20 bp, Artificial Sequence
  chemically synthesized
taacataagtccaccaggtg

SEQ ID NO: 185 - DNA, 20 bp, Artificial Sequence
  chemically synthesized
aggaataacataagtccacc

SEQ ID NO: 186 - DNA, 20 bp, Artificial Sequence
  chemically synthesized
aaggaataacataagtccac

SEQ ID NO: 187 - DNA, 20 bp, Artificial Sequence
  chemically synthesized
gtgagccaaaggaataacat

SEQ ID NO: 188 - DNA, 20 bp, Artificial Sequence
  chemically synthesized
gtggacttatgttattcctt

SEQ ID NO: 189 - DNA, 20 bp, Artificial Sequence
  chemically synthesized
ttcagatactggtgagccaa

SEQ ID NO: 190 - DNA, 20 bp, Artificial Sequence
  chemically synthesized
gttcagatactggtgagcca

SEQ ID NO: 191 - DNA, 20 bp, Artificial Sequence
  chemically synthesized
atgttattcctttggctcac

SEQ ID NO: 192 - DNA, 20 bp, Artificial Sequence
  chemically synthesized
aacagtgttcagatactggt

SEQ ID NO: 193 - DNA, 20 bp, Artificial Sequence
  chemically synthesized
ccccaacagtgttcagatac

SEQ ID NO: 194 - DNA, 20 bp, Artificial Sequence
  chemically synthesized
cggggttccccaacagtgtt

SEQ ID NO: 195 - DNA, 20 bp, Artificial Sequence
  chemically synthesized
caccagtatctgaacactgt

SEQ ID NO: 196 - DNA, 20 bp, Artificial Sequence
  chemically synthesized
accagtatctgaacactgtt

SEQ ID NO: 197 - DNA, 20 bp, Artificial Sequence
  chemically synthesized
ccagtatctgaacactgttg

SEQ ID NO: 198 - DNA, 20 bp, Artificial Sequence
  chemically synthesized
gggtgggcggggttccccaa

SEQ ID NO: 199 - DNA, 20 bp, Artificial Sequence
  chemically synthesized
gttcatggatggggtgggcg

SEQ ID NO: 200 - DNA, 20 bp, Artificial Sequence
  chemically synthesized
ggttcatggatggggtgggc

SEQ ID NO: 201 - DNA, 20 bp, Artificial Sequence
  chemically synthesized
aggttcatggatggggtggg

SEQ ID NO: 202 - DNA, 20 bp, Artificial Sequence
  chemically synthesized
ccaaggttcatggatggggt

SEQ ID NO: 203 - DNA, 20 bp, Artificial Sequence
  chemically synthesized
cccaaggttcatggatgggg

SEQ ID NO: 204 - DNA, 20 bp, Artificial Sequence
  chemically synthesized
attcccaaggttcatggatg

SEQ ID NO: 205 - DNA, 20 bp, Artificial Sequence
  chemically synthesized
tattcccaaggttcatggat

SEQ ID NO: 206 - DNA, 20 bp, Artificial Sequence
  chemically synthesized
ctattcccaaggttcatgga

SEQ ID NO: 207 - DNA, 20 bp, Artificial Sequence
  chemically synthesized
cccaccccatccatgaacct

SEQ ID NO: 208 - DNA, 20 bp, Artificial Sequence
  chemically synthesized
ttacctattcccaaggttca

SEQ ID NO: 209 - DNA, 20 bp, Artificial Sequence
  chemically synthesized
ccaccccatccatgaacctt

SEQ ID NO: 210 - DNA, 20 bp, Artificial Sequence
  chemically synthesized
ccatccatgaaccttgggaa

SEQ ID NO: 211 - DNA, 20 bp, Artificial Sequence
  chemically synthesized
catccatgaaccttgggaat

SEQ ID NO: 212 - DNA, 20 bp, Artificial Sequence
  chemically synthesized
tctatctttacctattccca

SEQ ID NO: 213 - DNA, 20 bp, Artificial Sequence
  chemically synthesized
atctatctttacctattccc

SEQ ID NO: 214 - DNA, 20 bp, Artificial Sequence
  chemically synthesized
atgaaccttgggaataggta

SEQ ID NO: 215 - DNA, 20 bp, Artificial Sequence
  chemically synthesized
accttgggaataggtaaaga

SEQ ID NO: 216 - DNA, 20 bp, Artificial Sequence
  chemically synthesized
tgggaataggtaaagataga

SEQ ID NO: 217 - DNA, 20 bp, Artificial Sequence
  chemically synthesized
aagatagatagcctctccct

SEQ ID NO: 218 - DNA, 20 bp, Artificial Sequence
  chemically synthesized
tgtcagcacttcttagggag

SEQ ID NO: 219 - DNA, 20 bp, Artificial Sequence
  chemically synthesized
atgtcagcacttcttaggga

SEQ ID NO: 220 - DNA, 20 bp, Artificial Sequence
  chemically synthesized
atagatagcctctccctaag

SEQ ID NO: 221 - DNA, 20 bp, Artificial Sequence
  chemically synthesized
caatgtcagcacttcttagg

SEQ ID NO: 222 - DNA, 20 bp, Artificial Sequence
  chemically synthesized
agcaatgtcagcacttctta

SEQ ID NO: 223 - DNA, 20 bp, Artificial Sequence
  chemically synthesized
tagcaatgtcagcacttctt

SEQ ID NO: 224 - DNA, 20 bp, Artificial Sequence
  chemically synthesized
gtagcaatgtcagcacttct

SEQ ID NO: 225 - DNA, 20 bp, Artificial Sequence
  chemically synthesized
gagaaagtgggtagcaatgt

SEQ ID NO: 226 - DNA, 20 bp, Artificial Sequence
  chemically synthesized
aaggaagctgagaaagtggg

SEQ ID NO: 227 - DNA, 20 bp, Artificial Sequence
  chemically synthesized
gacattgctacccactttct

SEQ ID NO: 228 - DNA, 20 bp, Artificial Sequence
  chemically synthesized
gcaaaggaagctgagaaagt

SEQ ID NO: 229 - DNA, 20 bp, Artificial Sequence
  chemically synthesized
tgcaaaggaagctgagaaag

SEQ ID NO: 230 - DNA, 20 bp, Artificial Sequence
  chemically synthesized
agctgcaaaggaagctgaga

SEQ ID NO: 231 - DNA, 20 bp, Artificial Sequence
  chemically synthesized
ccctagctgcaaaggaagct

SEQ ID NO: 232 - DNA, 20 bp, Artificial Sequence
  chemically synthesized
cactttctcagcttcctttg

SEQ ID NO: 233 - DNA, 20 bp, Artificial Sequence
  chemically synthesized
tcttgccctagctgcaaagg

SEQ ID NO: 234 - DNA, 20 bp, Artificial Sequence
  chemically synthesized
ttctcagcttcctttgcagc

SEQ ID NO: 235 - DNA, 20 bp, Artificial Sequence
  chemically synthesized
gtttcttgccctagctgcaa

SEQ ID NO: 236 - DNA, 20 bp, Artificial Sequence
  chemically synthesized
tctcagcttcctttgcagct

SEQ ID NO: 237 - DNA, 20 bp, Artificial Sequence
  chemically synthesized
tgtttcttgccctagctgca

SEQ ID NO: 238 - DNA, 20 bp, Artificial Sequence
  chemically synthesized
ctcagcttcctttgcagcta

SEQ ID NO: 239 - DNA, 20 bp, Artificial Sequence
  chemically synthesized
gcttcctttgcagctagggc

SEQ ID NO: 240 - DNA, 20 bp, Artificial Sequence
  chemically synthesized
ccctgctctgtttcttgccc

SEQ ID NO: 241 - DNA, 20 bp, Artificial Sequence
  chemically synthesized
tttgcagctagggcaagaaa

SEQ ID NO: 242 - DNA, 20 bp, Artificial Sequence
  chemically synthesized
tgcagctagggcaagaaaca

SEQ ID NO: 243 - DNA, 20 bp, Artificial Sequence
  chemically synthesized
agctagggcaagaaacagag

SEQ ID NO: 244 - DNA, 20 bp, Artificial Sequence
  chemically synthesized
gctagggcaagaaacagagc

SEQ ID NO: 245 - DNA, 20 bp, Artificial Sequence
  chemically synthesized
ctagggcaagaaacagagca

SEQ ID NO: 246 - DNA, 20 bp, Artificial Sequence
  chemically synthesized
gggcaagaaacagagcaggg

SEQ ID NO: 247 - DNA, 20 bp, Artificial Sequence
  chemically synthesized
ggcaagaaacagagcagggc

SEQ ID NO: 248 - DNA, 20 bp, Artificial Sequence
  chemically synthesized
gcaagaaacagagcagggca

SEQ ID NO: 249 - DNA, 20 bp, Artificial Sequence
  chemically synthesized
caagaaacagagcagggcag

SEQ ID NO: 250 - DNA, 20 bp, Artificial Sequence
  chemically synthesized
aacagagcagggcaggggca

SEQ ID NO: 251 - DNA, 20 bp, Artificial Sequence
  chemically synthesized
acagagcagggcaggggcaa

SEQ ID NO: 252 - DNA, 20 bp, Artificial Sequence
  chemically synthesized
agagcagggcaggggcaaag

SEQ ID NO: 253 - DNA, 20 bp, Artificial Sequence
  chemically synthesized
agcagggcaggggcaaagga

SEQ ID NO: 254 - DNA, 20 bp, Artificial Sequence
  chemically synthesized
gcagggcaggggcaaaggag

SEQ ID NO: 255 - DNA, 20 bp, Artificial Sequence
  chemically synthesized
caaaggagaggttctcccca

SEQ ID NO: 256 - DNA, 20 bp, Artificial Sequence
  chemically synthesized
aggagaggttctccccatgg

SEQ ID NO: 257 - DNA, 20 bp, Artificial Sequence
  chemically synthesized
tagtcaaccaccaccatggg

SEQ ID NO: 258 - DNA, 20 bp, Artificial Sequence
  chemically synthesized
catagtcaaccaccaccatg

SEQ ID NO: 259 - DNA, 20 bp, Artificial Sequence
  chemically synthesized
agaggttctccccatggtgg

SEQ ID NO: 260 - DNA, 20 bp, Artificial Sequence
  chemically synthesized
ccatagtcaaccaccaccat

SEQ ID NO: 261 - DNA, 20 bp, Artificial Sequence
  chemically synthesized
accatagtcaaccaccacca

SEQ ID NO: 262 - DNA, 20 bp, Artificial Sequence
  chemically synthesized
cccatggtggtggttgacta

SEQ ID NO: 263 - DNA, 20 bp, Artificial Sequence
  chemically synthesized
tggtggtggttgactatggt

SEQ ID NO: 264 - DNA, 20 bp, Artificial Sequence
  chemically synthesized
ggtggtggttgactatggta

SEQ ID NO: 265 - DNA, 20 bp, Artificial Sequence
  chemically synthesized
gtggtggttgactatggtaa

SEQ ID NO: 266 - DNA, 20 bp, Artificial Sequence
  chemically synthesized
ggaagaagaatcccttacca

SEQ ID NO: 267 - DNA, 20 bp, Artificial Sequence
  chemically synthesized
ggtaagggattcttcttccc

SEQ ID NO: 268 - DNA, 20 bp, Artificial Sequence
  chemically synthesized
cacaactggttctggggaag

SEQ ID NO: 269 - DNA, 20 bp, Artificial Sequence
  chemically synthesized
tctcacaactggttctgggg

SEQ ID NO: 270 - DNA, 20 bp, Artificial Sequence
  chemically synthesized
ggattcttcttccccagaac

SEQ ID NO: 271 - DNA, 20 bp, Artificial Sequence
  chemically synthesized
atgtctcacaactggttctg

SEQ ID NO: 272 - DNA, 20 bp, Artificial Sequence
  chemically synthesized
gatgtctcacaactggttct

SEQ ID NO: 273 - DNA, 20 bp, Artificial Sequence
  chemically synthesized
tgatgtctcacaactggttc

SEQ ID NO: 274 - DNA, 20 bp, Artificial Sequence
  chemically synthesized
tcttccccagaaccagttgt

SEQ ID NO: 275 - DNA, 20 bp, Artificial Sequence
  chemically synthesized
ctaaaatgatgtctcacaac

SEQ ID NO: 276 - DNA, 20 bp, Artificial Sequence
  chemically synthesized
ccagttgtgagacatcattt

SEQ ID NO: 277 - DNA, 20 bp, Artificial Sequence
  chemically synthesized
cagttgtgagacatcatttt

SEQ ID NO: 278 - DNA, 20 bp, Artificial Sequence
  chemically synthesized
catgagtgagtagtaagaaa

SEQ ID NO: 279 - DNA, 20 bp, Artificial Sequence
  chemically synthesized
tgcatgagtgagtagtaaga

SEQ ID NO: 280 - DNA, 20 bp, Artificial Sequence
  chemically synthesized
aggatgcatgagtgagtagt

SEQ ID NO: 281 - DNA, 20 bp, Artificial Sequence
  chemically synthesized
taagaggatgcatgagtgag

SEQ ID NO: 282 - DNA, 20 bp, Artificial Sequence
  chemically synthesized
atctaagaggatgcatgagt

SEQ ID NO: 283 - DNA, 20 bp, Artificial Sequence
  chemically synthesized
caccatctaagaggatgcat

SEQ ID NO: 284 - DNA, 20 bp, Artificial Sequence
  chemically synthesized
tactcactcatgcatcctct

SEQ ID NO: 285 - DNA, 20 bp, Artificial Sequence
  chemically synthesized
cactcatgcatcctcttaga

SEQ ID NO: 286 - DNA, 20 bp, Artificial Sequence
  chemically synthesized
tcttaatgtcaccatctaag

SEQ ID NO: 287 - DNA, 20 bp, Artificial Sequence
  chemically synthesized
ttcttaatgtcaccatctaa

SEQ ID NO: 288 - DNA, 20 bp, Artificial Sequence
  chemically synthesized
tattcttaatgtcaccatct

SEQ ID NO: 289 - DNA, 20 bp, Artificial Sequence
  chemically synthesized
tcctcttagatggtgacatt

SEQ ID NO: 290 - DNA, 20 bp, Artificial Sequence
  chemically synthesized
ttagatggtgacattaagaa

SEQ ID NO: 291 - DNA, 20 bp, Artificial Sequence
  chemically synthesized
gatggtgacattaagaatag

SEQ ID NO: 292 - DNA, 20 bp, Artificial Sequence
  chemically synthesized
aagtgatatgaaattctctt

SEQ ID NO: 293 - DNA, 20 bp, Artificial Sequence
  chemically synthesized
tgatatgaaattctcttgag

SEQ ID NO: 294 - DNA, 20 bp, Artificial Sequence
  chemically synthesized
gttcatactttgcttctcaa

SEQ ID NO: 295 - DNA, 20 bp, Artificial Sequence
  chemically synthesized
cagttcatactttgcttctc

SEQ ID NO: 296 - DNA, 20 bp, Artificial Sequence
  chemically synthesized
tgaaattctcttgagaagca

SEQ ID NO: 297 - DNA, 20 bp, Artificial Sequence
  chemically synthesized
atattaattaagtcagtttg

SEQ ID NO: 298 - DNA, 20 bp, Artificial Sequence
  chemically synthesized
gacaagtatattaattaagt

SEQ ID NO: 299 - DNA, 20 bp, Artificial Sequence
  chemically synthesized
taatgacaagtatattaatt

SEQ ID NO: 300 - DNA, 20 bp, Artificial Sequence
  chemically synthesized
ttttttgttttaataatgac

SEQ ID NO: 301 - DNA, 20 bp, Artificial Sequence
  chemically synthesized
gattgattgattgatagtca

SEQ ID NO: 302 - DNA, 20 bp, Artificial Sequence
  chemically synthesized
tgcagtgattgattgattga

SEQ ID NO: 303 - DNA, 20 bp, Artificial Sequence
  chemically synthesized
gggagatgatacattttgtg

SEQ ID NO: 304 - DNA, 20 bp, Artificial Sequence
  chemically synthesized
gcacaaaatgtatcatctcc

SEQ ID NO: 305 - DNA, 20 bp, Artificial Sequence
  chemically synthesized
ggtaagcatttgtagactgg

SEQ ID NO: 306 - DNA, 20 bp, Artificial Sequence
  chemically synthesized
ggggtaagcatttgtagact

SEQ ID NO: 307 - DNA, 20 bp, Artificial Sequence
  chemically synthesized
gggggtaagcatttgtagac

SEQ ID NO: 308 - DNA, 20 bp, Artificial Sequence
  chemically synthesized
tcaaagggggtaagcatttg

SEQ ID NO: 309 - DNA, 20 bp, Artificial Sequence
  chemically synthesized
attgctggatcaaagggggt

SEQ ID NO: 310 - DNA, 20 bp, Artificial Sequence
  chemically synthesized
tgagattgctggatcaaagg

SEQ ID NO: 311 - DNA, 20 bp, Artificial Sequence
  chemically synthesized
gtgagattgctggatcaaag

SEQ ID NO: 312 - DNA, 20 bp, Artificial Sequence
  chemically synthesized
aatgcttaccccctttgatc

SEQ ID NO: 313 - DNA, 20 bp, Artificial Sequence
  chemically synthesized
agtgagattgctggatcaaa

SEQ ID NO: 314 - DNA, 20 bp, Artificial Sequence
  chemically synthesized
aagtgagattgctggatcaa

SEQ ID NO: 315 - DNA, 20 bp, Artificial Sequence
  chemically synthesized
gaagtgagattgctggatca

SEQ ID NO: 316 - DNA, 20 bp, Artificial Sequence
  chemically synthesized
cttcctagaagtgagattgc

SEQ ID NO: 317 - DNA, 20 bp, Artificial Sequence
  chemically synthesized
tgatccagcaatctcacttc

SEQ ID NO: 318 - DNA, 20 bp, Artificial Sequence
  chemically synthesized
gatccagcaatctcacttct

SEQ ID NO: 319 - DNA, 20 bp, Artificial Sequence
  chemically synthesized
gtgggatacttcctagaagt

SEQ ID NO: 320 - DNA, 20 bp, Artificial Sequence
  chemically synthesized
ccagcaatctcacttctagg

SEQ ID NO: 321 - DNA, 20 bp, Artificial Sequence
  chemically synthesized
atctgtgggatacttcctag

SEQ ID NO: 322 - DNA, 20 bp, Artificial Sequence
  chemically synthesized
caaatctgtgggatacttcc

SEQ ID NO: 323 - DNA, 20 bp, Artificial Sequence
  chemically synthesized
cacttctaggaagtatccca

SEQ ID NO: 324 - DNA, 20 bp, Artificial Sequence
  chemically synthesized
gcataaacaaacaaatctgt

SEQ ID NO: 325 - DNA, 20 bp, Artificial Sequence
  chemically synthesized
tgcataaacaaacaaatctg

SEQ ID NO: 326 - DNA, 20 bp, Artificial Sequence
  chemically synthesized
cacaaatgaaatgatgtaat

SEQ ID NO: 327 - DNA, 20 bp, Artificial Sequence
  chemically synthesized
atgtgcaatattgtttgtta

SEQ ID NO: 328 - DNA, 20 bp, Artificial Sequence
  chemically synthesized
aatattgtttgttatagcaa

SEQ ID NO: 329 - DNA, 20 bp, Artificial Sequence
  chemically synthesized
ttgtttgttatagcaaaaga

SEQ ID NO: 330 - DNA, 20 bp, Artificial Sequence
  chemically synthesized
agcaaaagaaagactgacaa

SEQ ID NO: 331 - DNA, 20 bp, Artificial Sequence
  chemically synthesized
tgggatatgtagtctgttgt

SEQ ID NO: 332 - DNA, 20 bp, Artificial Sequence
  chemically synthesized
gttccctttggtgggatatg

SEQ ID NO: 333 - DNA, 20 bp, Artificial Sequence
  chemically synthesized
acagactacatatcccacca

SEQ ID NO: 334 - DNA, 20 bp, Artificial Sequence
  chemically synthesized
cagactacatatcccaccaa

SEQ ID NO: 335 - DNA, 20 bp, Artificial Sequence
  chemically synthesized
agactacatatcccaccaaa

SEQ ID NO: 336 - DNA, 20 bp, Artificial Sequence
  chemically synthesized
tttaagcagttccctttggt

SEQ ID NO: 337 - DNA, 20 bp, Artificial Sequence
  chemically synthesized
atttaagcagttccctttgg

SEQ ID NO: 338 - DNA, 20 bp, Artificial Sequence
  chemically synthesized
tttatttaagcagttccctt

SEQ ID NO: 339 - DNA, 20 bp, Artificial Sequence
  chemically synthesized
cataggatattttatttaag

SEQ ID NO: 340 - DNA, 20 bp, Artificial Sequence
  chemically synthesized
gttcataggatattttattt

SEQ ID NO: 341 - DNA, 20 bp, Artificial Sequence
  chemically synthesized
atatttcattatatgttcat

SEQ ID NO: 342 - DNA, 20 bp, Artificial Sequence
  chemically synthesized
aatatttcattatatgttca

SEQ ID NO: 343 - DNA, 20 bp, Artificial Sequence
  chemically synthesized
acatataatgaaatattata

SEQ ID NO: 344 - DNA, 20 bp, Artificial Sequence
  chemically synthesized
aatattatacagctataaaa

SEQ ID NO: 345 - DNA, 20 bp, Artificial Sequence
  chemically synthesized
tgctttctcattctttttta

SEQ ID NO: 346 - DNA, 20 bp, Artificial Sequence
  chemically synthesized
atacagctataaaaaagaat

SEQ ID NO: 347 - DNA, 20 bp, Artificial Sequence
  chemically synthesized
agctataaaaaagaatgaga

SEQ ID NO: 348 - DNA, 20 bp, Artificial Sequence
  chemically synthesized
attttatatatttaaatgaa

SEQ ID NO: 349 - DNA, 20 bp, Artificial Sequence
  chemically synthesized
tttaaatgaaaagatttctt

SEQ ID NO: 350 - DNA, 20 bp, Artificial Sequence
  chemically synthesized
ttaaatttaaatatggactc

SEQ ID NO: 351 - DNA, 20 bp, Artificial Sequence
  chemically synthesized
tgtttgtttaaatttaaata

SEQ ID NO: 352 - DNA, 20 bp, Artificial Sequence
  chemically synthesized
ttaaatttaaacaaacaaac

SEQ ID NO: 353 - DNA, 20 bp, Artificial Sequence
  chemically synthesized
atttaaacaaacaaacaagt

SEQ ID NO: 354 - DNA, 20 bp, Artificial Sequence
  chemically synthesized
tttaaacaaacaaacaagta

SEQ ID NO: 355 - DNA, 20 bp, Artificial Sequence
  chemically synthesized
aaacaagtaaggtgcataac

SEQ ID NO: 356 - DNA, 20 bp, Artificial Sequence
  chemically synthesized
aacaagtaaggtgcataact

SEQ ID NO: 357 - DNA, 20 bp, Artificial Sequence
  chemically synthesized
gtaaggtgcataactgggtg

SEQ ID NO: 358 - DNA, 20 bp, Artificial Sequence
  chemically synthesized
aaggtgcataactgggtgca

SEQ ID NO: 359 - DNA, 20 bp, Artificial Sequence
  chemically synthesized
gatatagcattctctgcacc

SEQ ID NO: 360 - DNA, 20 bp, Artificial Sequence
  chemically synthesized
tattattatttcataggata

SEQ ID NO: 361 - DNA, 20 bp, Artificial Sequence
  chemically synthesized
ttttcctattattatttcat

SEQ ID NO: 362 - DNA, 20 bp, Artificial Sequence
  chemically synthesized
tttttcctattattatttca

SEQ ID NO: 363 - DNA, 20 bp, Artificial Sequence
  chemically synthesized
tatatcctatgaaataataa

SEQ ID NO: 364 - DNA, 20 bp, Artificial Sequence
  chemically synthesized
atatcctatgaaataataat

SEQ ID NO: 365 - DNA, 20 bp, Artificial Sequence
  chemically synthesized
aataataggaaaaaaataaa

SEQ ID NO: 366 - DNA, 20 bp, Artificial Sequence
  chemically synthesized
ataataggaaaaaaataaat

SEQ ID NO: 367 - DNA, 20 bp, Artificial Sequence
  chemically synthesized
tttattaattattatataag

SEQ ID NO: 368 - DNA, 20 bp, Artificial Sequence
  chemically synthesized
ttctttattaattattatat

SEQ ID NO: 369 - DNA, 20 bp, Artificial Sequence
  chemically synthesized
tgcttatataataattaata

SEQ ID NO: 370 - DNA, 20 bp, Artificial Sequence
  chemically synthesized
tatataataattaataaaga

SEQ ID NO: 371 - DNA, 20 bp, Artificial Sequence
  chemically synthesized
attaataaagaaagaccctc

SEQ ID NO: 372 - DNA, 20 bp, Artificial Sequence
  chemically synthesized
aataaagaaagaccctctgg

SEQ ID NO: 373 - DNA, 20 bp, Artificial Sequence
  chemically synthesized
ttcttatttagtcttccaga

SEQ ID NO: 374 - DNA, 20 bp, Artificial Sequence
  chemically synthesized
tttcttatttagtcttccag

SEQ ID NO: 375 - DNA, 20 bp, Artificial Sequence
  chemically synthesized
atttcttatttagtcttcca

SEQ ID NO: 376 - DNA, 20 bp, Artificial Sequence
  chemically synthesized
taatttcttatttagtcttc

SEQ ID NO: 377 - DNA, 20 bp, Artificial Sequence
  chemically synthesized
gaccctctggaagactaaat

SEQ ID NO: 378 - DNA, 20 bp, Artificial Sequence
  chemically synthesized
gacattattaatttcttatt

SEQ ID NO: 379 - DNA, 20 bp, Artificial Sequence
  chemically synthesized
aaattaataatgtctactca

SEQ ID NO: 380 - DNA, 20 bp, Artificial Sequence
  chemically synthesized
attaataatgtctactcata

SEQ ID NO: 381 - DNA, 20 bp, Artificial Sequence
  chemically synthesized
catcctcattgctctatgag

SEQ ID NO: 382 - DNA, 20 bp, Artificial Sequence
  chemically synthesized
aatcatcctcattgctctat

SEQ ID NO: 383 - DNA, 20 bp, Artificial Sequence
  chemically synthesized
atgtctactcatagagcaat

SEQ ID NO: 384 - DNA, 20 bp, Artificial Sequence
  chemically synthesized
tgtctactcatagagcaatg

SEQ ID NO: 385 - DNA, 20 bp, Artificial Sequence
  chemically synthesized
atgaggatgattgattgata

SEQ ID NO: 386 - DNA, 20 bp, Artificial Sequence
  chemically synthesized
tgaggatgattgattgatat

SEQ ID NO: 387 - DNA, 20 bp, Artificial Sequence
  chemically synthesized
gaggatgattgattgatatg

SEQ ID NO: 388 - DNA, 20 bp, Artificial Sequence
  chemically synthesized
aggatgattgattgatatgg

SEQ ID NO: 389 - DNA, 20 bp, Artificial Sequence
  chemically synthesized
atgattgattgatatggggg

SEQ ID NO: 390 - DNA, 20 bp, Artificial Sequence
  chemically synthesized
tgattgattgatatggggga

SEQ ID NO: 391 - DNA, 20 bp, Artificial Sequence
  chemically synthesized
gattgattgatatgggggaa

SEQ ID NO: 392 - DNA, 20 bp, Artificial Sequence
  chemically synthesized
attgattgatatgggggaag

SEQ ID NO: 393 - DNA, 20 bp, Artificial Sequence
  chemically synthesized
gattgatatgggggaagggg

SEQ ID NO: 394 - DNA, 20 bp, Artificial Sequence
  chemically synthesized
gatatgggggaaggggtagt

SEQ ID NO: 395 - DNA, 20 bp, Artificial Sequence
  chemically synthesized
atatgggggaaggggtagtt

SEQ ID NO: 396 - DNA, 20 bp, Artificial Sequence
  chemically synthesized
atgggggaaggggtagttag

SEQ ID NO: 397 - DNA, 20 bp, Artificial Sequence
  chemically synthesized
gagtgttttcactgtctttc

SEQ ID NO: 398 - DNA, 20 bp, Artificial Sequence
  chemically synthesized
aaaactataatccagaaaga

SEQ ID NO: 399 - DNA, 20 bp, Artificial Sequence
  chemically synthesized
gtaaaaaactataatccaga

SEQ ID NO: 400 - DNA, 20 bp, Artificial Sequence
  chemically synthesized
ttcactgtctttctggatta

SEQ ID NO: 401 - DNA, 20 bp, Artificial Sequence
  chemically synthesized
atgagtaaaaaactataatc

SEQ ID NO: 402 - DNA, 20 bp, Artificial Sequence
  chemically synthesized
aataggtaatacatgcatat

SEQ ID NO: 403 - DNA, 20 bp, Artificial Sequence
  chemically synthesized
gcatgtattacctatttaaa

SEQ ID NO: 404 - DNA, 20 bp, Artificial Sequence
  chemically synthesized
tacttacttactttttaaat

SEQ ID NO: 405 - DNA, 20 bp, Artificial Sequence
  chemically synthesized
ttacttacttactttttaaa

SEQ ID NO: 406 - DNA, 20 bp, Artificial Sequence
  chemically synthesized
gtattacctatttaaaaagt

SEQ ID NO: 407 - DNA, 20 bp, Artificial Sequence
  chemically synthesized
tacctatttaaaaagtaagt

SEQ ID NO: 408 - DNA, 20 bp, Artificial Sequence
  chemically synthesized
tatttaaaaagtaagtaagt

SEQ ID NO: 409 - DNA, 20 bp, Artificial Sequence
  chemically synthesized
actttgtttttattttaatt

SEQ ID NO: 410 - DNA, 20 bp, Artificial Sequence
  chemically synthesized
actaaattaaaataaaaaca

SEQ ID NO: 411 - DNA, 20 bp, Artificial Sequence
  chemically synthesized
aaaataaaaacaaagtactg

SEQ ID NO: 412 - DNA, 20 bp, Artificial Sequence
  chemically synthesized
aaaaacaaagtactgcagtc

SEQ ID NO: 413 - DNA, 20 bp, Artificial Sequence
  chemically synthesized
aaaaagtattgactggactg

SEQ ID NO: 414 - DNA, 20 bp, Artificial Sequence
  chemically synthesized
tgttacaaaaaagtattgac

SEQ ID NO: 415 - DNA, 20 bp, Artificial Sequence
  chemically synthesized
cacgcagttatgttacaaaa

SEQ ID NO: 416 - DNA, 20 bp, Artificial Sequence
  chemically synthesized
gtgtatctcaataaagcacg

SEQ ID NO: 417 - DNA, 20 bp, Artificial Sequence
  chemically synthesized
acataactgcgtgctttatt

SEQ ID NO: 418 - DNA, 20 bp, Artificial Sequence
  chemically synthesized
ctttactgtgtatctcaata

SEQ ID NO: 419 - DNA, 20 bp, Artificial Sequence
  chemically synthesized
gcgtgctttattgagataca

SEQ ID NO: 420 - DNA, 20 bp, Artificial Sequence
  chemically synthesized
ctttattgagatacacagta

SEQ ID NO: 421 - DNA, 20 bp, Artificial Sequence
  chemically synthesized
tattgagatacacagtaaag

SEQ ID NO: 422 - DNA, 20 bp, Artificial Sequence
  chemically synthesized
tatgccttactattgtatta

SEQ ID NO: 423 - DNA, 20 bp, Artificial Sequence
  chemically synthesized
aaagcagtactataatacaa

SEQ ID NO: 424 - DNA, 20 bp, Artificial Sequence
  chemically synthesized
cagtactataatacaatagt

SEQ ID NO: 425 - DNA, 20 bp, Artificial Sequence
  chemically synthesized
agtactataatacaatagta

SEQ ID NO: 426 - DNA, 20 bp, Artificial Sequence
  chemically synthesized
acaatagtaaggcatatatt

SEQ ID NO: 427 - DNA, 20 bp, Artificial Sequence
  chemically synthesized
agtaaggcatatatttggtg

SEQ ID NO: 428 - DNA, 20 bp, Artificial Sequence
  chemically synthesized
actgcattttcacaacatat

SEQ ID NO: 429 - DNA, 20 bp, Artificial Sequence
  chemically synthesized
tctgatatgttgtgaaaatg

SEQ ID NO: 430 - DNA, 20 bp, Artificial Sequence
  chemically synthesized
gtgaaaatgcagtaaaactg

SEQ ID NO: 431 - DNA, 20 bp, Artificial Sequence
  chemically synthesized
cgaattatttttttaaactt

SEQ ID NO: 432 - DNA, 20 bp, Artificial Sequence
  chemically synthesized
aaaataattcgtaaatgtta

SEQ ID NO: 433 - DNA, 20 bp, Artificial Sequence
  chemically synthesized
attcgtaaatgttacagtgt

SEQ ID NO: 434 - DNA, 20 bp, Artificial Sequence
  chemically synthesized
cacaatatattatgatactc

SEQ ID NO: 435 - DNA, 20 bp, Artificial Sequence
  chemically synthesized
atatattatgatactcaagt

SEQ ID NO: 436 - DNA, 20 bp, Artificial Sequence
  chemically synthesized
caggtactgagttcttactt

SEQ ID NO: 437 - DNA, 20 bp, Artificial Sequence
  chemically synthesized
atgatactcaagtaagaact

SEQ ID NO: 438 - DNA, 20 bp, Artificial Sequence
  chemically synthesized
tgtcattgttttcaggtact

SEQ ID NO: 439 - DNA, 20 bp, Artificial Sequence
  chemically synthesized
catgttttgtcattgttttc

SEQ ID NO: 440 - DNA, 20 bp, Artificial Sequence
  chemically synthesized
gcatgttttgtcattgtttt

SEQ ID NO: 441 - DNA, 20 bp, Artificial Sequence
  chemically synthesized
actgaagcataaacatcaca

SEQ ID NO: 442 - DNA, 20 bp, Artificial Sequence
  chemically synthesized
gccatgtgatgtttatgctt

SEQ ID NO: 443 - DNA, 20 bp, Artificial Sequence
  chemically synthesized
tgtaaatcataatgtaactg

SEQ ID NO: 444 - DNA, 20 bp, Artificial Sequence
  chemically synthesized
ttcagttacattatgattta

SEQ ID NO: 445 - DNA, 20 bp, Artificial Sequence
  chemically synthesized
atgatttacagtttaatact

SEQ ID NO: 446 - DNA, 20 bp, Artificial Sequence
  chemically synthesized
atttacagtttaatacttgg

SEQ ID NO: 447 - DNA, 20 bp, Artificial Sequence
  chemically synthesized
ttgtgttctttataaccacc

SEQ ID NO: 448 - DNA, 20 bp, Artificial Sequence
  chemically synthesized
tttaatacttggtggttata

SEQ ID NO: 449 - DNA, 20 bp, Artificial Sequence
  chemically synthesized
cattttaagcataattaatt

SEQ ID NO: 450 - DNA, 20 bp, Artificial Sequence
  chemically synthesized
aattaattatgcttaaaatg

SEQ ID NO: 451 - DNA, 20 bp, Artificial Sequence
  chemically synthesized
gagctttattgctgcatttt

SEQ ID NO: 452 - DNA, 20 bp, Artificial Sequence
  chemically synthesized
atgcttaaaatgcagcaata

SEQ ID NO: 453 - DNA, 20 bp, Artificial Sequence
  chemically synthesized
aatatttgaacaaaaattga

SEQ ID NO: 454 - DNA, 20 bp, Artificial Sequence
  chemically synthesized
ataatatttgaacaaaaatt

SEQ ID NO: 455 - DNA, 20 bp, Artificial Sequence
  chemically synthesized
tttttgttcaaatattatga

SEQ ID NO: 456 - DNA, 20 bp, Artificial Sequence
  chemically synthesized
atattatgacagactcactc

SEQ ID NO: 457 - DNA, 20 bp, Artificial Sequence
  chemically synthesized
attatgacagactcactcca

SEQ ID NO: 458 - DNA, 20 bp, Artificial Sequence
  chemically synthesized
agacacattagctctggagt

SEQ ID NO: 459 - DNA, 20 bp, Artificial Sequence
  chemically synthesized
ttttagacacattagctctg

SEQ ID NO: 460 - DNA, 20 bp, Artificial Sequence
  chemically synthesized
tcttttagacacattagctc

SEQ ID NO: 461 - DNA, 20 bp, Artificial Sequence
  chemically synthesized
tgtttttcttttagacacat

SEQ ID NO: 462 - DNA, 20 bp, Artificial Sequence
  chemically synthesized
tccagagctaatgtgtctaa

SEQ ID NO: 463 - DNA, 20 bp, Artificial Sequence
  chemically synthesized
taatctttttgtttttcttt

SEQ ID NO: 464 - DNA, 20 bp, Artificial Sequence
  chemically synthesized
gtgtctaaaagaaaaacaaa

SEQ ID NO: 465 - DNA, 20 bp, Artificial Sequence
  chemically synthesized
tctaaaatcagaggtaaata

SEQ ID NO: 466 - DNA, 20 bp, Artificial Sequence
  chemically synthesized
attctaaaatcagaggtaaa

SEQ ID NO: 467 - DNA, 20 bp, Artificial Sequence
  chemically synthesized
actctatttacctctgattt

SEQ ID NO: 468 - DNA, 20 bp, Artificial Sequence
  chemically synthesized
aagtttcattctaaaatcag

SEQ ID NO: 469 - DNA, 20 bp, Artificial Sequence
  chemically synthesized
taagtttcattctaaaatca

SEQ ID NO: 470 - DNA, 20 bp, Artificial Sequence
  chemically synthesized
agtaagtttcattctaaaat

SEQ ID NO: 471 - DNA, 20 bp, Artificial Sequence
  chemically synthesized
actaagaagtttaagtaagt

SEQ ID NO: 472 - DNA, 20 bp, Artificial Sequence
  chemically synthesized
tcctactaagaagtttaagt

SEQ ID NO: 473 - DNA, 20 bp, Artificial Sequence
  chemically synthesized
tacatcctactaagaagttt

SEQ ID NO: 474 - DNA, 20 bp, Artificial Sequence
  chemically synthesized
acttacttacttaaacttct

SEQ ID NO: 475 - DNA, 20 bp, Artificial Sequence
  chemically synthesized
tacttacttaaacttcttag

SEQ ID NO: 476 - DNA, 20 bp, Artificial Sequence
  chemically synthesized
acttacttaaacttcttagt

SEQ ID NO: 477 - DNA, 20 bp, Artificial Sequence
  chemically synthesized
ttactttacatcctactaag

SEQ ID NO: 478 - DNA, 20 bp, Artificial Sequence
  chemically synthesized
gggttactttacatcctact

SEQ ID NO: 479 - DNA, 20 bp, Artificial Sequence
  chemically synthesized
aaacttcttagtaggatgta

SEQ ID NO: 480 - DNA, 20 bp, Artificial Sequence
  chemically synthesized
aaactcagatttaaaacaag

SEQ ID NO: 481 - DNA, 20 bp, Artificial Sequence
  chemically synthesized
aaaactcagatttaaaacaa

SEQ ID NO: 482 - DNA, 20 bp, Artificial Sequence
  chemically synthesized
taaaactcagatttaaaaca

SEQ ID NO: 483 - DNA, 20 bp, Artificial Sequence
  chemically synthesized
ttaaaactcagatttaaaac

SEQ ID NO: 484 - DNA, 20 bp, Artificial Sequence
  chemically synthesized
taaccccttgttttaaatct

SEQ ID NO: 485 - DNA, 20 bp, Artificial Sequence
  chemically synthesized
acccaaggatttttaaaact

SEQ ID NO: 486 - DNA, 20 bp, Artificial Sequence
  chemically synthesized
atctgagttttaaaaatcct

SEQ ID NO: 487 - DNA, 20 bp, Artificial Sequence
  chemically synthesized
tctgagttttaaaaatcctt

SEQ ID NO: 488 - DNA, 20 bp, Artificial Sequence
  chemically synthesized
gttttaaaaatccttgggta

SEQ ID NO: 489 - DNA, 20 bp, Artificial Sequence
  chemically synthesized
ctggaccttttctttaccca

SEQ ID NO: 490 - DNA, 20 bp, Artificial Sequence
  chemically synthesized
gctggaccttttctttaccc

SEQ ID NO: 491 - DNA, 20 bp, Artificial Sequence
  chemically synthesized
aaaaatccttgggtaaagaa

SEQ ID NO: 492 - DNA, 20 bp, Artificial Sequence
  chemically synthesized
aaaatccttgggtaaagaaa

SEQ ID NO: 493 - DNA, 20 bp, Artificial Sequence
  chemically synthesized
ccttgggtaaagaaaaggtc

SEQ ID NO: 494 - DNA, 20 bp, Artificial Sequence
  chemically synthesized
ttttttcctttatgtgacgc

SEQ ID NO: 495 - DNA, 20 bp, Artificial Sequence
  chemically synthesized
aaaaggtccagcgtcacata

SEQ ID NO: 496 - DNA, 20 bp, Artificial Sequence
  chemically synthesized
aaaggtccagcgtcacataa

SEQ ID NO: 497 - DNA, 20 bp, Artificial Sequence
  chemically synthesized
cacataaaggaaaaaaatgc

SEQ ID NO: 498 - DNA, 20 bp, Artificial Sequence
  chemically synthesized
taccaaattacatgaagatt

SEQ ID NO: 499 - DNA, 20 bp, Artificial Sequence
  chemically synthesized
acaaattaccaaattacatg

SEQ ID NO: 500 - DNA, 20 bp, Artificial Sequence
  chemically synthesized
aaccaaatcttcatgtaatt

SEQ ID NO: 501 - DNA, 20 bp, Artificial Sequence
  chemically synthesized
aatttggtaatttgttacct

SEQ ID NO: 502 - DNA, 20 bp, Artificial Sequence
  chemically synthesized
tttggtaatttgttacctta

SEQ ID NO: 503 - DNA, 20 bp, Artificial Sequence
  chemically synthesized
aaagaaaacccaaagctcta

SEQ ID NO: 504 - DNA, 20 bp, Artificial Sequence
  chemically synthesized
aatttgttaccttagagctt

SEQ ID NO: 505 - DNA, 20 bp, Artificial Sequence
  chemically synthesized
aaaagaaaacccaaagctct

SEQ ID NO: 506 - DNA, 20 bp, Artificial Sequence
  chemically synthesized
atttgttaccttagagcttt

SEQ ID NO: 507 - DNA, 20 bp, Artificial Sequence
  chemically synthesized
aattttcaaaagaaaaccca

SEQ ID NO: 508 - DNA, 20 bp, Artificial Sequence
  chemically synthesized
ttttccttcataattttcaa

SEQ ID NO: 509 - DNA, 20 bp, Artificial Sequence
  chemically synthesized
gttttcttttgaaaattatg

SEQ ID NO: 510 - DNA, 20 bp, Artificial Sequence
  chemically synthesized
ttttcttttgaaaattatga

SEQ ID NO: 511 - DNA, 20 bp, Artificial Sequence
  chemically synthesized
tttgaaaattatgaaggaaa

SEQ ID NO: 512 - DNA, 20 bp, Artificial Sequence
  chemically synthesized
aaaattatgaaggaaaaaga

SEQ ID NO: 513 - DNA, 20 bp, Artificial Sequence
  chemically synthesized
aggaaaaagaaagaattata

SEQ ID NO: 514 - DNA, 20 bp, Artificial Sequence
  chemically synthesized
ggaaaaagaaagaattataa

SEQ ID NO: 515 - DNA, 20 bp, Artificial Sequence
  chemically synthesized
agaaagaattataaaggaaa

SEQ ID NO: 516 - DNA, 20 bp, Artificial Sequence
  chemically synthesized
ggaaaaagaaaataacgcaa

SEQ ID NO: 517 - DNA, 20 bp, Artificial Sequence
  chemically synthesized
aagaaaataacgcaatggac

SEQ ID NO: 518 - DNA, 20 bp, Artificial Sequence
  chemically synthesized
aaaataacgcaatggacaag

SEQ ID NO: 519 - DNA, 20 bp, Artificial Sequence
  chemically synthesized
aacgcaatggacaagtggtg

SEQ ID NO: 520 - DNA, 20 bp, Artificial Sequence
  chemically synthesized
aagtggtgaagctgtgaact

SEQ ID NO: 521 - DNA, 20 bp, Artificial Sequence
  chemically synthesized
agtggtgaagctgtgaactc

SEQ ID NO: 522 - DNA, 20 bp, Artificial Sequence
  chemically synthesized
attgtgcacacctgagttca

SEQ ID NO: 523 - DNA, 20 bp, Artificial Sequence
  chemically synthesized
cctgataattgtgcacacct

SEQ ID NO: 524 - DNA, 20 bp, Artificial Sequence
  chemically synthesized
actcaggtgtgcacaattat

SEQ ID NO: 525 - DNA, 20 bp, Artificial Sequence
  chemically synthesized
ctcaggtgtgcacaattatc

SEQ ID NO: 526 - DNA, 20 bp, Artificial Sequence
  chemically synthesized
tctacctcactttggttttg

SEQ ID NO: 527 - DNA, 20 bp, Artificial Sequence
  chemically synthesized
tcaggaacaccccaaaacca

SEQ ID NO: 528 - DNA, 20 bp, Artificial Sequence
  chemically synthesized
ttctacctcactttggtttt

SEQ ID NO: 529 - DNA, 20 bp, Artificial Sequence
  chemically synthesized
tttctacctcactttggttt

SEQ ID NO: 530 - DNA, 20 bp, Artificial Sequence
  chemically synthesized
gaacaccccaaaaccaaagt

SEQ ID NO: 531 - DNA, 20 bp, Artificial Sequence
  chemically synthesized
aacaccccaaaaccaaagtg

SEQ ID NO: 532 - DNA, 20 bp, Artificial Sequence
  chemically synthesized
atgctatttctacctcactt

SEQ ID NO: 533 - DNA, 20 bp, Artificial Sequence
  chemically synthesized
accccaaaaccaaagtgagg

SEQ ID NO: 534 - DNA, 20 bp, Artificial Sequence
  chemically synthesized
aaaccaaagtgaggtagaaa

SEQ ID NO: 535 - DNA, 20 bp, Artificial Sequence
  chemically synthesized
aagtgaggtagaaatagcat

SEQ ID NO: 536 - DNA, 20 bp, Artificial Sequence
  chemically synthesized
tgaggtagaaatagcatgag

SEQ ID NO: 537 - DNA, 20 bp, Artificial Sequence
  chemically synthesized
taattaattaacatcaaaca

SEQ ID NO: 538 - DNA, 20 bp, Artificial Sequence
  chemically synthesized
aattaattaattattaataa

SEQ ID NO: 539 - DNA, 20 bp, Artificial Sequence
  chemically synthesized
gtaattagcttttggagagt

SEQ ID NO: 540 - DNA, 20 bp, Artificial Sequence
  chemically synthesized
tgtaattagcttttggagag

SEQ ID NO: 541 - DNA, 20 bp, Artificial Sequence
  chemically synthesized
ggacaaaacccactctccaa

SEQ ID NO: 542 - DNA, 20 bp, Artificial Sequence
  chemically synthesized
aagtgtaattagcttttgga

SEQ ID NO: 543 - DNA, 20 bp, Artificial Sequence
  chemically synthesized
tcaagtgtaattagcttttg

SEQ ID NO: 544 - DNA, 20 bp, Artificial Sequence
  chemically synthesized
catcaagtgtaattagcttt

SEQ ID NO: 545 - DNA, 20 bp, Artificial Sequence
  chemically synthesized
gggctgacatcaagtgtaat

SEQ ID NO: 546 - DNA, 20 bp, Artificial Sequence
  chemically synthesized
aagctaattacacttgatgt

SEQ ID NO: 547 - DNA, 20 bp, Artificial Sequence
  chemically synthesized
ttggagagtgggctgacatc

SEQ ID NO: 548 - DNA, 20 bp, Artificial Sequence
  chemically synthesized
gtaattagcttttggagagt

SEQ ID NO: 549 - DNA, 20 bp, Artificial Sequence
  chemically synthesized
tgtaattagcttttggagag

SEQ ID NO: 550 - DNA, 20 bp, Artificial Sequence
  chemically synthesized
gatgtcagcccactctccaa

SEQ ID NO: 551 - DNA, 20 bp, Artificial Sequence
  chemically synthesized
aagtgtaattagcttttgga

SEQ ID NO: 552 - DNA, 20 bp, Artificial Sequence
  chemically synthesized
tcaagtgtaattagcttttg

SEQ ID NO: 553 - DNA, 20 bp, Artificial Sequence
  chemically synthesized
catcaagtgtaattagcttt

SEQ ID NO: 554 - DNA, 20 bp, Artificial Sequence
  chemically synthesized
cctctgacatcaagtgtaat

SEQ ID NO: 555 - DNA, 20 bp, Artificial Sequence
  chemically synthesized
aagctaattacacttgatgt

SEQ ID NO: 556 - DNA, 20 bp, Artificial Sequence
  chemically synthesized
gctaattacacttgatgtca

SEQ ID NO: 557 - DNA, 20 bp, Artificial Sequence
  chemically synthesized
aatctgttacctctgacatc

SEQ ID NO: 558 - DNA, 20 bp, Artificial Sequence
  chemically synthesized
ctaattacacttgatgtcag

SEQ ID NO: 559 - DNA, 20 bp, Artificial Sequence
  chemically synthesized
acacttgatgtcagaggtaa

SEQ ID NO: 560 - DNA, 20 bp, Artificial Sequence
  chemically synthesized
gtaacagatttgcaaaatta

SEQ ID NO: 561 - DNA, 20 bp, Artificial Sequence
  chemically synthesized
taacagatttgcaaaattat

SEQ ID NO: 562 - DNA, 20 bp, Artificial Sequence
  chemically synthesized
ttgcaaaattataggtcaca

SEQ ID NO: 563 - DNA, 20 bp, Artificial Sequence
  chemically synthesized
caaaattataggtcacacgg

SEQ ID NO: 564 - DNA, 20 bp, Artificial Sequence
  chemically synthesized
tttttaaatcattcattcaa

SEQ ID NO: 565 - DNA, 20 bp, Artificial Sequence
  chemically synthesized
tgaatgatttaaaaatcaaa

SEQ ID NO: 566 - DNA, 20 bp, Artificial Sequence
  chemically synthesized
aaaatcaaaaagaaataaaa

SEQ ID NO: 567 - DNA, 20 bp, Artificial Sequence
  chemically synthesized
aaagaaataaaatggcatga

SEQ ID NO: 568 - DNA, 20 bp, Artificial Sequence
  chemically synthesized
agaaataaaatggcatgaaa

SEQ ID NO: 569 - DNA, 20 bp, Artificial Sequence
  chemically synthesized
taaaatggcatgaaagagta

SEQ ID NO: 570 - DNA, 20 bp, Artificial Sequence
  chemically synthesized
agctaaggactggtaggaaa

SEQ ID NO: 571 - DNA, 20 bp, Artificial Sequence
  chemically synthesized
agagtaaagctttttcctac

SEQ ID NO: 572 - DNA, 20 bp, Artificial Sequence
  chemically synthesized
aggaaaagctaaggactggt

SEQ ID NO: 573 - DNA, 20 bp, Artificial Sequence
  chemically synthesized
gaggaaaagctaaggactgg

SEQ ID NO: 574 - DNA, 20 bp, Artificial Sequence
  chemically synthesized
agctttttcctaccagtcct

SEQ ID NO: 575 - DNA, 20 bp, Artificial Sequence
  chemically synthesized
caagaggaaaagctaaggac

SEQ ID NO: 576 - DNA, 20 bp, Artificial Sequence
  chemically synthesized
aagctcaagaggaaaagcta

SEQ ID NO: 577 - DNA, 20 bp, Artificial Sequence
  chemically synthesized
aaagctcaagaggaaaagct

SEQ ID NO: 578 - DNA, 20 bp, Artificial Sequence
  chemically synthesized
ggagaaaagctcaagaggaa

SEQ ID NO: 579 - DNA, 20 bp, Artificial Sequence
  chemically synthesized
agtccttagcttttcctctt

SEQ ID NO: 580 - DNA, 20 bp, Artificial Sequence
  chemically synthesized
aaagaggagaaaagctcaag

SEQ ID NO: 581 - DNA, 20 bp, Artificial Sequence
  chemically synthesized
aaaagaggagaaaagctcaa

SEQ ID NO: 582 - DNA, 20 bp, Artificial Sequence
  chemically synthesized
aaaaaagaggagaaaagctc

SEQ ID NO: 583 - DNA, 20 bp, Artificial Sequence
  chemically synthesized
ttgctcaaaaaagaggagaa

SEQ ID NO: 584 - DNA, 20 bp, Artificial Sequence
  chemically synthesized
aaaaattgctcaaaaaagag

SEQ ID NO: 585 - DNA, 20 bp, Artificial Sequence
  chemically synthesized
gagcttttctcctctttttt

SEQ ID NO: 586 - DNA, 20 bp, Artificial Sequence
  chemically synthesized
acaaaaattgctcaaaaaag

SEQ ID NO: 587 - DNA, 20 bp, Artificial Sequence
  chemically synthesized
aacaaaaattgctcaaaaaa

SEQ ID NO: 588 - DNA, 20 bp, Artificial Sequence
  chemically synthesized
caaacaaaaattgctcaaaa

SEQ ID NO: 589 - DNA, 20 bp, Artificial Sequence
  chemically synthesized
cccttcttggtggattagac

SEQ ID NO: 590 - DNA, 20 bp, Artificial Sequence
  chemically synthesized
acccttcttggtggattaga

SEQ ID NO: 591 - DNA, 20 bp, Artificial Sequence
  chemically synthesized
tttaacctgtctaatccacc

SEQ ID NO: 592 - DNA, 20 bp, Artificial Sequence
  chemically synthesized
aaaaacccttcttggtggat

SEQ ID NO: 593 - DNA, 20 bp, Artificial Sequence
  chemically synthesized
aacctgtctaatccaccaag

SEQ ID NO: 594 - DNA, 20 bp, Artificial Sequence
  chemically synthesized
acctgtctaatccaccaaga

SEQ ID NO: 595 - DNA, 20 bp, Artificial Sequence
  chemically synthesized
cctgtctaatccaccaagaa

SEQ ID NO: 596 - DNA, 20 bp, Artificial Sequence
  chemically synthesized
tacaaaaaaacccttcttgg

SEQ ID NO: 597 - DNA, 20 bp, Artificial Sequence
  chemically synthesized
tgttacaaaaaaacccttct

SEQ ID NO: 598 - DNA, 20 bp, Artificial Sequence
  chemically synthesized
ttgtaagtaagtaagaaaga

SEQ ID NO: 599 - DNA, 20 bp, Artificial Sequence
  chemically synthesized
tttgtaagtaagtaagaaag

SEQ ID NO: 600 - DNA, 20 bp, Artificial Sequence
  chemically synthesized
aggtttgtaagtaagtaaga

SEQ ID NO: 601 - DNA, 20 bp, Artificial Sequence
  chemically synthesized
acacaggtttgtaagtaagt

SEQ ID NO: 602 - DNA, 20 bp, Artificial Sequence
  chemically synthesized
ttccacacaggtttgtaagt

SEQ ID NO: 603 - DNA, 20 bp, Artificial Sequence
  chemically synthesized
gtagttccacacaggtttgt

SEQ ID NO: 604 - DNA, 20 bp, Artificial Sequence
  chemically synthesized
tacttacttacaaacctgtg

SEQ ID NO: 605 - DNA, 20 bp, Artificial Sequence
  chemically synthesized
ctctgcgagtagttccacac

SEQ ID NO: 606 - DNA, 20 bp, Artificial Sequence
  chemically synthesized
tctctgcgagtagttccaca

SEQ ID NO: 607 - DNA, 20 bp, Artificial Sequence
  chemically synthesized
aacctgtgtggaactactcg

SEQ ID NO: 608 - DNA, 20 bp, Artificial Sequence
  chemically synthesized
cctgtgtggaactactcgca

SEQ ID NO: 609 - DNA, 20 bp, Artificial Sequence
  chemically synthesized
cctttgcatttctctgcgag

SEQ ID NO: 610 - DNA, 20 bp, Artificial Sequence
  chemically synthesized
catcctttgcatttctctgc

SEQ ID NO: 611 - DNA, 20 bp, Artificial Sequence
  chemically synthesized
actactcgcagagaaatgca

SEQ ID NO: 612 - DNA, 20 bp, Artificial Sequence
  chemically synthesized
ctactcgcagagaaatgcaa

SEQ ID NO: 613 - DNA, 20 bp, Artificial Sequence
  chemically synthesized
tcgcagagaaatgcaaagga

SEQ ID NO: 614 - DNA, 20 bp, Artificial Sequence
  chemically synthesized
aaatgcaaaggatggaaaca

SEQ ID NO: 615 - DNA, 20 bp, Artificial Sequence
  chemically synthesized
aaggatggaaacacagttca

SEQ ID NO: 616 - DNA, 20 bp, Artificial Sequence
  chemically synthesized
aggatggaaacacagttcat

SEQ ID NO: 617 - DNA, 20 bp, Artificial Sequence
  chemically synthesized
aaacacagttcatgggcttc

SEQ ID NO: 618 - DNA, 20 bp, Artificial Sequence
  chemically synthesized
aacacagttcatgggcttct

SEQ ID NO: 619 - DNA, 20 bp, Artificial Sequence
  chemically synthesized
actgacaggtatcaacccag

SEQ ID NO: 620 - DNA, 20 bp, Artificial Sequence
  chemically synthesized
gatactgacaggtatcaacc

SEQ ID NO: 621 - DNA, 20 bp, Artificial Sequence
  chemically synthesized
gcttctgggttgatacctgt

SEQ ID NO: 622 - DNA, 20 bp, Artificial Sequence
  chemically synthesized
atcacatttgtgatactgac

SEQ ID NO: 623 - DNA, 20 bp, Artificial Sequence
  chemically synthesized
catcacatttgtgatactga

SEQ ID NO: 624 - DNA, 20 bp, Artificial Sequence
  chemically synthesized
tgtcagtatcacaaatgtga

SEQ ID NO: 625 - DNA, 20 bp, Artificial Sequence
  chemically synthesized
gtcagtatcacaaatgtgat

SEQ ID NO: 626 - DNA, 20 bp, Artificial Sequence
  chemically synthesized
tcagtatcacaaatgtgatg

SEQ ID NO: 627 - DNA, 20 bp, Artificial Sequence
  chemically synthesized
tgggaaaaggtgtaaaacag

SEQ ID NO: 628 - DNA, 20 bp, Artificial Sequence
  chemically synthesized
ctttgggaaaaggtgtaaaa

SEQ ID NO: 629 - DNA, 20 bp, Artificial Sequence
  chemically synthesized
ctgttttacaccttttccca

SEQ ID NO: 630 - DNA, 20 bp, Artificial Sequence
  chemically synthesized
aataaataaactttgggaaa

SEQ ID NO: 631 - DNA, 20 bp, Artificial Sequence
  chemically synthesized
aaataaataaactttgggaa

SEQ ID NO: 632 - DNA, 20 bp, Artificial Sequence
  chemically synthesized
atttaaaataaataaacttt

SEQ ID NO: 633 - DNA, 20 bp, Artificial Sequence
  chemically synthesized
aatttaaaataaataaactt

SEQ ID NO: 634 - DNA, 20 bp, Artificial Sequence
  chemically synthesized
ttattttaaattatgtcttg

SEQ ID NO: 635 - DNA, 20 bp, Artificial Sequence
  chemically synthesized
gatgagtttttaaatgccac

SEQ ID NO: 636 - DNA, 20 bp, Artificial Sequence
  chemically synthesized
tttattgtcccatgtgggat

SEQ ID NO: 637 - DNA, 20 bp, Artificial Sequence
  chemically synthesized
atttaaaaactcatcccaca

SEQ ID NO: 638 - DNA, 20 bp, Artificial Sequence
  chemically synthesized
tttaaaaactcatcccacat

SEQ ID NO: 639 - DNA, 20 bp, Artificial Sequence
  chemically synthesized
ttagatttattgtcccatgt

SEQ ID NO: 640 - DNA, 20 bp, Artificial Sequence
  chemically synthesized
tttagatttattgtcccatg

SEQ ID NO: 641 - DNA, 20 bp, Artificial Sequence
  chemically synthesized
atgggacaataaatctaaaa

SEQ ID NO: 642 - DNA, 20 bp, Artificial Sequence
  chemically synthesized
tttggtttttgttgcttttt

SEQ ID NO: 643 - DNA, 20 bp, Artificial Sequence
  chemically synthesized
gcaacaaaaaccaaaccacc

SEQ ID NO: 644 - DNA, 20 bp, Artificial Sequence
  chemically synthesized
tcaaaaggaactgggtggtt

SEQ ID NO: 645 - DNA, 20 bp, Artificial Sequence
  chemically synthesized
cacagtcaaaaggaactggg

SEQ ID NO: 646 - DNA, 20 bp, Artificial Sequence
  chemically synthesized
tctcacagtcaaaaggaact

SEQ ID NO: 647 - DNA, 20 bp, Artificial Sequence
  chemically synthesized
ttctcacagtcaaaaggaac

SEQ ID NO: 648 - DNA, 20 bp, Artificial Sequence
  chemically synthesized
gccctcttctcacagtcaaa

SEQ ID NO: 649 - DNA, 20 bp, Artificial Sequence
  chemically synthesized
tgccctcttctcacagtcaa

SEQ ID NO: 650 - DNA, 20 bp, Artificial Sequence
  chemically synthesized
acccagttccttttgactgt

SEQ ID NO: 651 - DNA, 20 bp, Artificial Sequence
  chemically synthesized
cagttccttttgactgtgag

SEQ ID NO: 652 - DNA, 20 bp, Artificial Sequence
  chemically synthesized
gttccttttgactgtgagaa

SEQ ID NO: 653 - DNA, 20 bp, Artificial Sequence
  chemically synthesized
ttccttttgactgtgagaag

SEQ ID NO: 654 - DNA, 20 bp, Artificial Sequence
  chemically synthesized
attattatgccctcttctca

SEQ ID NO: 655 - DNA, 20 bp, Artificial Sequence
  chemically synthesized
tccttttgactgtgagaaga

SEQ ID NO: 656 - DNA, 20 bp, Artificial Sequence
  chemically synthesized
gagaagagggcataataatt

SEQ ID NO: 657 - DNA, 20 bp, Artificial Sequence
  chemically synthesized
taataatttagttgtaatta

SEQ ID NO: 658 - DNA, 20 bp, Artificial Sequence
  chemically synthesized
ataatttagttgtaattaca

SEQ ID NO: 659 - DNA, 20 bp, Artificial Sequence
  chemically synthesized
atgattgttcataatacata

SEQ ID NO: 660 - DNA, 20 bp, Artificial Sequence
  chemically synthesized
ccactctttaagtgaaggat

SEQ ID NO: 661 - DNA, 20 bp, Artificial Sequence
  chemically synthesized
atcatccaatccttcactta

SEQ ID NO: 662 - DNA, 20 bp, Artificial Sequence
  chemically synthesized
gtaggccactctttaagtga

SEQ ID NO: 663 - DNA, 20 bp, Artificial Sequence
  chemically synthesized
agtaggccactctttaagtg

SEQ ID NO: 664 - DNA, 20 bp, Artificial Sequence
  chemically synthesized
catccaatccttcacttaaa

SEQ ID NO: 665 - DNA, 20 bp, Artificial Sequence
  chemically synthesized
ccaatccttcacttaaagag

SEQ ID NO: 666 - DNA, 20 bp, Artificial Sequence
  chemically synthesized
gaaggagtaggccactcttt

SEQ ID NO: 667 - DNA, 20 bp, Artificial Sequence
  chemically synthesized
gcccatccctgtgaaggagt

SEQ ID NO: 668 - DNA, 20 bp, Artificial Sequence
  chemically synthesized
agcccatccctgtgaaggag

SEQ ID NO: 669 - DNA, 20 bp, Artificial Sequence
  chemically synthesized
aagagtggcctactccttca

SEQ ID NO: 670 - DNA, 20 bp, Artificial Sequence
  chemically synthesized
agagtggcctactccttcac

SEQ ID NO: 671 - DNA, 20 bp, Artificial Sequence
  chemically synthesized
gagtggcctactccttcaca

SEQ ID NO: 672 - DNA, 20 bp, Artificial Sequence
  chemically synthesized
cccagcccatccctgtgaag

SEQ ID NO: 673 - DNA, 20 bp, Artificial Sequence
  chemically synthesized
ttcccagcccatccctgtga

SEQ ID NO: 674 - DNA, 20 bp, Artificial Sequence
  chemically synthesized
attcccagcccatccctgtg

SEQ ID NO: 675 - DNA, 20 bp, Artificial Sequence
  chemically synthesized
ggcctactccttcacaggga

SEQ ID NO: 676 - DNA, 20 bp, Artificial Sequence
  chemically synthesized
gcctactccttcacagggat

SEQ ID NO: 677 - DNA, 20 bp, Artificial Sequence
  chemically synthesized
actccttcacagggatgggc

SEQ ID NO: 678 - DNA, 20 bp, Artificial Sequence
  chemically synthesized
ctccttcacagggatgggct

SEQ ID NO: 679 - DNA, 20 bp, Artificial Sequence
  chemically synthesized
gctggagggctatggattcc

SEQ ID NO: 680 - DNA, 20 bp, Artificial Sequence
  chemically synthesized
agggatgggctgggaatcca

SEQ ID NO: 681 - DNA, 20 bp, Artificial Sequence
  chemically synthesized
atgatagggctggagggcta

SEQ ID NO: 682 - DNA, 20 bp, Artificial Sequence
  chemically synthesized
gctgggaatccatagccctc

SEQ ID NO: 683 - DNA, 20 bp, Artificial Sequence
  chemically synthesized
aggacgatgatagggctgga

SEQ ID NO: 684 - DNA, 20 bp, Artificial Sequence
  chemically synthesized
caggacgatgatagggctgg

SEQ ID NO: 685 - DNA, 20 bp, Artificial Sequence
  chemically synthesized
gcaggacgatgatagggctg

SEQ ID NO: 686 - DNA, 20 bp, Artificial Sequence
  chemically synthesized
tagcaggacgatgatagggc

SEQ ID NO: 687 - DNA, 20 bp, Artificial Sequence
  chemically synthesized
gcagtagcaggacgatgata

SEQ ID NO: 688 - DNA, 20 bp, Artificial Sequence
  chemically synthesized
agcagtagcaggacgatgat

SEQ ID NO: 689 - DNA, 20 bp, Artificial Sequence
  chemically synthesized
aagcagtagcaggacgatga

SEQ ID NO: 690 - DNA, 20 bp, Artificial Sequence
  chemically synthesized
tttaactcccaagcagtagc

SEQ ID NO: 691 - DNA, 20 bp, Artificial Sequence
  chemically synthesized
ttttaactcccaagcagtag

SEQ ID NO: 692 - DNA, 20 bp, Artificial Sequence
  chemically synthesized
atcatcgtcctgctactgct

SEQ ID NO: 693 - DNA, 20 bp, Artificial Sequence
  chemically synthesized
tcatcgtcctgctactgctt

SEQ ID NO: 694 - DNA, 20 bp, Artificial Sequence
  chemically synthesized
attttttaactcccaagcag

SEQ ID NO: 695 - DNA, 20 bp, Artificial Sequence
  chemically synthesized
atcgtcctgctactgcttgg

SEQ ID NO: 696 - DNA, 20 bp, Artificial Sequence
  chemically synthesized
ggtattttttaactcccaag

SEQ ID NO: 697 - DNA, 20 bp, Artificial Sequence
  chemically synthesized
gaaggtattttttaactccc

SEQ ID NO: 698 - DNA, 20 bp, Artificial Sequence
  chemically synthesized
ctgaccttgtgaacatcaga

SEQ ID NO: 699 - DNA, 20 bp, Artificial Sequence
  chemically synthesized
tctgaccttgtgaacatcag

SEQ ID NO: 700 - DNA, 20 bp, Artificial Sequence
  chemically synthesized
tattctgaccttgtgaacat

SEQ ID NO: 701 - DNA, 20 bp, Artificial Sequence
  chemically synthesized
aaataccttctgatgttcac

SEQ ID NO: 702 - DNA, 20 bp, Artificial Sequence
  chemically synthesized
aataccttctgatgttcaca

SEQ ID NO: 703 - DNA, 20 bp, Artificial Sequence
  chemically synthesized
ccttctgatgttcacaaggt

SEQ ID NO: 704 - DNA, 20 bp, Artificial Sequence
  chemically synthesized
ttcagtggaaatcaatcaga

SEQ ID NO: 705 - DNA, 20 bp, Artificial Sequence
  chemically synthesized
cttcagtggaaatcaatcag

SEQ ID NO: 706 - DNA, 20 bp, Artificial Sequence
  chemically synthesized
atgcttcagtggaaatcaat

SEQ ID NO: 707 - DNA, 20 bp, Artificial Sequence
  chemically synthesized
cttctgattgatttccactg

SEQ ID NO: 708 - DNA, 20 bp, Artificial Sequence
  chemically synthesized
tagatttaatgatgcttcag

SEQ ID NO: 709 - DNA, 20 bp, Artificial Sequence
  chemically synthesized
atttagatttaatgatgctt

SEQ ID NO: 710 - DNA, 20 bp, Artificial Sequence
  chemically synthesized
gcatcattaaatctaaatcg

SEQ ID NO: 711 - DNA, 20 bp, Artificial Sequence
  chemically synthesized
ctgctagcaatgccacgatt

SEQ ID NO: 712 - DNA, 20 bp, Artificial Sequence
  chemically synthesized
aatctaaatcgtggcattgc

SEQ ID NO: 713 - DNA, 20 bp, Artificial Sequence
  chemically synthesized
ctaaatcgtggcattgctag

SEQ ID NO: 714 - DNA, 20 bp, Artificial Sequence
  chemically synthesized
aatcgtggcattgctagcag

SEQ ID NO: 715 - DNA, 20 bp, Artificial Sequence
  chemically synthesized
atcgtggcattgctagcagc

SEQ ID NO: 716 - DNA, 20 bp, Artificial Sequence
  chemically synthesized
tacattcagcttcctgctgc

SEQ ID NO: 717 - DNA, 20 bp, Artificial Sequence
  chemically synthesized
gtggcattgctagcagcagg

SEQ ID NO: 718 - DNA, 20 bp, Artificial Sequence
  chemically synthesized
gattgattgattgatacatt

SEQ ID NO: 719 - DNA, 20 bp, Artificial Sequence
  chemically synthesized
agagtgagtaatcggttggt

SEQ ID NO: 720 - DNA, 20 bp, Artificial Sequence
  chemically synthesized
tatcagagtgagtaatcggt

SEQ ID NO: 721 - DNA, 20 bp, Artificial Sequence
  chemically synthesized
attatatcagagtgagtaat

SEQ ID NO: 722 - DNA, 20 bp, Artificial Sequence
  chemically synthesized
aggacttattatatcagagt

SEQ ID NO: 723 - DNA, 20 bp, Artificial Sequence
  chemically synthesized
acacaggacttattatatca

SEQ ID NO: 724 - DNA, 20 bp, Artificial Sequence
  chemically synthesized
attactcactctgatataat

SEQ ID NO: 725 - DNA, 20 bp, Artificial Sequence
  chemically synthesized
atacacaggacttattatat

SEQ ID NO: 726 - DNA, 20 bp, Artificial Sequence
  chemically synthesized
gaacatgtgaatgaatacac

SEQ ID NO: 727 - DNA, 20 bp, Artificial Sequence
  chemically synthesized
ggaacatgtgaatgaataca

SEQ ID NO: 728 - DNA, 20 bp, Artificial Sequence
  chemically synthesized
aagtattggatttttttaaa

SEQ ID NO: 729 - DNA, 20 bp, Artificial Sequence
  chemically synthesized
aaagtattggatttttttaa

SEQ ID NO: 730 - DNA, 20 bp, Artificial Sequence
  chemically synthesized
taaagtattggattttttta

SEQ ID NO: 731 - DNA, 20 bp, Artificial Sequence
  chemically synthesized
acgaaagtaaagtaaagtat

SEQ ID NO: 732 - DNA, 20 bp, Artificial Sequence
  chemically synthesized
ctgacaacgaaagtaaagta

SEQ ID NO: 733 - DNA, 20 bp, Artificial Sequence
  chemically synthesized
ttccactgacaacgaaagta

SEQ ID NO: 734 - DNA, 20 bp, Artificial Sequence
  chemically synthesized
ctttactttactttcgttgt

SEQ ID NO: 735 - DNA, 20 bp, Artificial Sequence
  chemically synthesized
caactttccactgacaacga

SEQ ID NO: 736 - DNA, 20 bp, Artificial Sequence
  chemically synthesized
tactttactttcgttgtcag

SEQ ID NO: 737 - DNA, 20 bp, Artificial Sequence
  chemically synthesized
ttactttcgttgtcagtgga

SEQ ID NO: 738 - DNA, 20 bp, Artificial Sequence
  chemically synthesized
agtggaaagttgtttaaaat

SEQ ID NO: 739 - DNA, 20 bp, Artificial Sequence
  chemically synthesized
tgtttaaaatgagaaacatc

SEQ ID NO: 740 - DNA, 20 bp, Artificial Sequence
  chemically synthesized
tttaaaatgagaaacatctg

SEQ ID NO: 741 - DNA, 20 bp, Artificial Sequence
  chemically synthesized
atgagaaacatctggagctg

SEQ ID NO: 742 - DNA, 20 bp, Artificial Sequence
  chemically synthesized
taaaacattgtctacagctc

SEQ ID NO: 743 - DNA, 20 bp, Artificial Sequence
  chemically synthesized
ccacactaaaacattgtcta

SEQ ID NO: 744 - DNA, 20 bp, Artificial Sequence
  chemically synthesized
tggagctgtagacaatgttt

SEQ ID NO: 745 - DNA, 20 bp, Artificial Sequence
  chemically synthesized
ctgtagacaatgttttagtg

SEQ ID NO: 746 - DNA, 20 bp, Artificial Sequence
  chemically synthesized
gacaatgttttagtgtggtg

SEQ ID NO: 747 - DNA, 20 bp, Artificial Sequence
  chemically synthesized
agtgtggtgtagtttcctcc

SEQ ID NO: 748 - DNA, 20 bp, Artificial Sequence
  chemically synthesized
tcccggagccggaagccagg

SEQ ID NO: 749 - DNA, 20 bp, Artificial Sequence
  chemically synthesized
ttcccggagccggaagccag

SEQ ID NO: 750 - DNA, 20 bp, Artificial Sequence
  chemically synthesized
tgtagtttcctcctggcttc

SEQ ID NO: 751 - DNA, 20 bp, Artificial Sequence
  chemically synthesized
ttttcccggagccggaagcc

SEQ ID NO: 752 - DNA, 20 bp, Artificial Sequence
  chemically synthesized
tttttcccggagccggaagc

SEQ ID NO: 753 - DNA, 20 bp, Artificial Sequence
  chemically synthesized
ttcctcctggcttccggctc

SEQ ID NO: 754 - DNA, 20 bp, Artificial Sequence
  chemically synthesized
tggatttttcccggagccgg

SEQ ID NO: 755 - DNA, 20 bp, Artificial Sequence
  chemically synthesized
tcctcctggcttccggctcc

SEQ ID NO: 756 - DNA, 20 bp, Artificial Sequence
  chemically synthesized
gaatggatttttcccggagc

SEQ ID NO: 757 - DNA, 20 bp, Artificial Sequence
  chemically synthesized
tctagaatggatttttcccg

SEQ ID NO: 758 - DNA, 20 bp, Artificial Sequence
  chemically synthesized
ggtctagaatggatttttcc

SEQ ID NO: 759 - DNA, 20 bp, Artificial Sequence
  chemically synthesized
gctccgggaaaaatccattc

SEQ ID NO: 760 - DNA, 20 bp, Artificial Sequence
  chemically synthesized
cttacctgcttggtctagaa

SEQ ID NO: 761 - DNA, 20 bp, Artificial Sequence
  chemically synthesized
ggaaaaatccattctagacc

SEQ ID NO: 762 - DNA, 20 bp, Artificial Sequence
  chemically synthesized
aaaatccattctagaccaag

SEQ ID NO: 763 - DNA, 20 bp, Artificial Sequence
  chemically synthesized
ccaggcttacctgcttggtc

SEQ ID NO: 764 - DNA, 20 bp, Artificial Sequence
  chemically synthesized
aaatccattctagaccaagc

SEQ ID NO: 765 - DNA, 20 bp, Artificial Sequence
  chemically synthesized
ccattctagaccaagcaggt

SEQ ID NO: 766 - DNA, 20 bp, Artificial Sequence
  chemically synthesized
gtcatccaggcttacctgct

SEQ ID NO: 767 - DNA, 20 bp, Artificial Sequence
  chemically synthesized
ctagaccaagcaggtaagcc

SEQ ID NO: 768 - DNA, 20 bp, Artificial Sequence
  chemically synthesized
ttacttctagtcagtcatcc

SEQ ID NO: 769 - DNA, 20 bp, Artificial Sequence
  chemically synthesized
attacttctagtcagtcatc

SEQ ID NO: 770 - DNA, 20 bp, Artificial Sequence
  chemically synthesized
ggtaagcctggatgactgac

SEQ ID NO: 771 - DNA, 20 bp, Artificial Sequence
  chemically synthesized
aagcctggatgactgactag

SEQ ID NO: 772 - DNA, 20 bp, Artificial Sequence
  chemically synthesized
agaaagaaattacttctagt

SEQ ID NO: 773 - DNA, 20 bp, Artificial Sequence
  chemically synthesized
taatagaaagaaattacttc

SEQ ID NO: 774 - DNA, 20 bp, Artificial Sequence
  chemically synthesized
tagaagtaatttctttctat

SEQ ID NO: 775 - DNA, 20 bp, Artificial Sequence
  chemically synthesized
agaagtaatttctttctatt

SEQ ID NO: 776 - DNA, 20 bp, Artificial Sequence
  chemically synthesized
tcatgtcacatcctaataga

SEQ ID NO: 777 - DNA, 20 bp, Artificial Sequence
  chemically synthesized
atgttcatgtcacatcctaa

SEQ ID NO: 778 - DNA, 20 bp, Artificial Sequence
  chemically synthesized
tgacatgaacatttaaaaaa

SEQ ID NO: 779 - DNA, 20 bp, Artificial Sequence
  chemically synthesized
gaacatttaaaaaatggaaa

SEQ ID NO: 780 - DNA, 20 bp, Artificial Sequence
  chemically synthesized
atttaaaaaatggaaaaagt

SEQ ID NO: 781 - DNA, 20 bp, Artificial Sequence
  chemically synthesized
aaatggaaaaagtcagtcta

SEQ ID NO: 782 - DNA, 20 bp, Artificial Sequence
  chemically synthesized
taaagagatacgaatttcta

SEQ ID NO: 783 - DNA, 20 bp, Artificial Sequence
  chemically synthesized
actatagttatatagataaa

SEQ ID NO: 784 - DNA, 20 bp, Artificial Sequence
  chemically synthesized
atactatagttatatagata

SEQ ID NO: 785 - DNA, 20 bp, Artificial Sequence
  chemically synthesized
atataaatactatagttata

SEQ ID NO: 786 - DNA, 20 bp, Artificial Sequence
  chemically synthesized
tctctttatctatataacta

SEQ ID NO: 787 - DNA, 20 bp, Artificial Sequence
  chemically synthesized
ctataagtatataaatacta

SEQ ID NO: 788 - DNA, 20 bp, Artificial Sequence
  chemically synthesized
ctatagtatttatatactta

SEQ ID NO: 789 - DNA, 20 bp, Artificial Sequence
  chemically synthesized
tcatatatctatatgtctat

SEQ ID NO: 790 - DNA, 20 bp, Artificial Sequence
  chemically synthesized
tttatatacttatagacata

SEQ ID NO: 791 - DNA, 20 bp, Artificial Sequence
  chemically synthesized
gatatatgaaatgaaaactc

SEQ ID NO: 792 - DNA, 20 bp, Artificial Sequence
  chemically synthesized
cagctgagtggggcaggctt

SEQ ID NO: 793 - DNA, 20 bp, Artificial Sequence
  chemically synthesized
aactgtcagctgagtggggc

SEQ ID NO: 794 - DNA, 20 bp, Artificial Sequence
  chemically synthesized
aaactcaagcctgccccact

SEQ ID NO: 795 - DNA, 20 bp, Artificial Sequence
  chemically synthesized
gaactgtcagctgagtgggg

SEQ ID NO: 796 - DNA, 20 bp, Artificial Sequence
  chemically synthesized
tgagaactgtcagctgagtg

SEQ ID NO: 797 - DNA, 20 bp, Artificial Sequence
  chemically synthesized
ttgagaactgtcagctgagt

SEQ ID NO: 798 - DNA, 20 bp, Artificial Sequence
  chemically synthesized
tttgagaactgtcagctgag

SEQ ID NO: 799 - DNA, 20 bp, Artificial Sequence
  chemically synthesized
agcctgccccactcagctga

SEQ ID NO: 800 - DNA, 20 bp, Artificial Sequence
  chemically synthesized
tcatttgagaactgtcagct

SEQ ID NO: 801 - DNA, 20 bp, Artificial Sequence
  chemically synthesized
actgctcatttgagaactgt

SEQ ID NO: 802 - DNA, 20 bp, Artificial Sequence
  chemically synthesized
tcagctgacagttctcaaat

SEQ ID NO: 803 - DNA, 20 bp, Artificial Sequence
  chemically synthesized
gctgacagttctcaaatgag

SEQ ID NO: 804 - DNA, 20 bp, Artificial Sequence
  chemically synthesized
ctactacacactgctcattt

SEQ ID NO: 805 - DNA, 20 bp, Artificial Sequence
  chemically synthesized
gttctcaaatgagcagtgtg

SEQ ID NO: 806 - DNA, 20 bp, Artificial Sequence
  chemically synthesized
ctcaaatgagcagtgtgtag

SEQ ID NO: 807 - DNA, 20 bp, Artificial Sequence
  chemically synthesized
agcagtgtgtagtagtcatt

SEQ ID NO: 808 - DNA, 20 bp, Artificial Sequence
  chemically synthesized
tgtgtagtagtcatttggtg

SEQ ID NO: 809 - DNA, 20 bp, Artificial Sequence
  chemically synthesized
gtagtagtcatttggtgtgg

SEQ ID NO: 810 - DNA, 20 bp, Artificial Sequence
  chemically synthesized
gtagtcatttggtgtggtgg

SEQ ID NO: 811 - DNA, 20 bp, Artificial Sequence
  chemically synthesized
agtcatttggtgtggtggta

SEQ ID NO: 812 - DNA, 20 bp, Artificial Sequence
  chemically synthesized
gtcatttggtgtggtggtag

SEQ ID NO: 813 - DNA, 20 bp, Artificial Sequence
  chemically synthesized
atttggtgtggtggtagagg

SEQ ID NO: 814 - DNA, 20 bp, Artificial Sequence
  chemically synthesized
tttttttgcatattaaagat

SEQ ID NO: 815 - DNA, 20 bp, Artificial Sequence
  chemically synthesized
ttttctttttttgcatatta

SEQ ID NO: 816 - DNA, 20 bp, Artificial Sequence
  chemically synthesized
ttatctttaatatgcaaaaa

SEQ ID NO: 817 - DNA, 20 bp, Artificial Sequence
  chemically synthesized
ttaatatgcaaaaaaagaaa

SEQ ID NO: 818 - DNA, 20 bp, Artificial Sequence
  chemically synthesized
tgatatccatatgaaattca

SEQ ID NO: 819 - DNA, 20 bp, Artificial Sequence
  chemically synthesized
aaaaagccatgaatttcata

SEQ ID NO: 820 - DNA, 20 bp, Artificial Sequence
  chemically synthesized
tcatatggatatcacgccaa

SEQ ID NO: 821 - DNA, 20 bp, Artificial Sequence
  chemically synthesized
catatggatatcacgccaaa

SEQ ID NO: 822 - DNA, 20 bp, Artificial Sequence
  chemically synthesized
cgcattgttttgcatccttt

SEQ ID NO: 823 - DNA, 20 bp, Artificial Sequence
  chemically synthesized
caaaacaatgcgctgcctca

SEQ ID NO: 824 - DNA, 20 bp, Artificial Sequence
  chemically synthesized
acacacacaaaactttgagg

SEQ ID NO: 825 - DNA, 20 bp, Artificial Sequence
  chemically synthesized
cacacacacacaaaactttg

SEQ ID NO: 826 - DNA, 20 bp, Artificial Sequence
  chemically synthesized
acacacacacacaaaacttt

SEQ ID NO: 827 - DNA, 20 bp, Artificial Sequence
  chemically synthesized
gtgtgtgtttgttttgtttt

SEQ ID NO: 828 - DNA, 20 bp, Artificial Sequence
  chemically synthesized
tgtgtgtttgttttgttttt

SEQ ID NO: 829 - DNA, 20 bp, Artificial Sequence
  chemically synthesized
gtgtgtttgttttgttttta

SEQ ID NO: 830 - DNA, 20 bp, Artificial Sequence
  chemically synthesized
tgtgtttgttttgtttttag

SEQ ID NO: 831 - DNA, 20 bp, Artificial Sequence
  chemically synthesized
aaagtgtgctttataaaaaa

SEQ ID NO: 832 - DNA, 20 bp, Artificial Sequence
  chemically synthesized
ataaacaacttttttttata

SEQ ID NO: 833 - DNA, 20 bp, Artificial Sequence
  chemically synthesized
tttttttataaagcacactt

SEQ ID NO: 834 - DNA, 20 bp, Artificial Sequence
  chemically synthesized
taaagaaagattgtaaacta

SEQ ID NO: 835 - DNA, 20 bp, Artificial Sequence
  chemically synthesized
atttataacagttataaaga

SEQ ID NO: 836 - DNA, 20 bp, Artificial Sequence
  chemically synthesized
aaaaatttataacagttata

SEQ ID NO: 837 - DNA, 20 bp, Artificial Sequence
  chemically synthesized
ggttgtttaaaaatttataa

SEQ ID NO: 838 - DNA, 20 bp, Artificial Sequence
  chemically synthesized
ctttatatggaacgcatttt

SEQ ID NO: 839 - DNA, 20 bp, Artificial Sequence
  chemically synthesized
tctttatatggaacgcattt

SEQ ID NO: 840 - DNA, 20 bp, Artificial Sequence
  chemically synthesized
cccaaaatgcgttccatata

SEQ ID NO: 841 - DNA, 20 bp, Artificial Sequence
  chemically synthesized
taacttgccatttctttata

SEQ ID NO: 842 - DNA, 20 bp, Artificial Sequence
  chemically synthesized
atgcgttccatataaagaaa

SEQ ID NO: 843 - DNA, 20 bp, Artificial Sequence
  chemically synthesized
gttccatataaagaaatggc

SEQ ID NO: 844 - DNA, 20 bp, Artificial Sequence
  chemically synthesized
taaagaaatggcaagttatt

SEQ ID NO: 845 - DNA, 20 bp, Artificial Sequence
  chemically synthesized
tggcaagttatttagctatc

SEQ ID NO: 846 - DNA, 20 bp, Artificial Sequence
  chemically synthesized
aactacatgtaaaatcttga

SEQ ID NO: 847 - DNA, 20 bp, Artificial Sequence
  chemically synthesized
agctatcaagattttacatg

SEQ ID NO: 848 - DNA, 20 bp, Artificial Sequence
  chemically synthesized
caattgtacaaaaaagttat

SEQ ID NO: 849 - DNA, 20 bp, Artificial Sequence
  chemically synthesized
gtctatgcaattgtacaaaa

SEQ ID NO: 850 - DNA, 20 bp, Artificial Sequence
  chemically synthesized
aacttttttgtacaattgca

SEQ ID NO: 851 - DNA, 20 bp, Artificial Sequence
  chemically synthesized
attgttttgttaacaatggc

SEQ ID NO: 852 - DNA, 20 bp, Artificial Sequence
  chemically synthesized
tattgttttgttaacaatgg

SEQ ID NO: 853 - DNA, 20 bp, Artificial Sequence
  chemically synthesized
tgttattgttttgttaacaa

SEQ ID NO: 854 - DNA, 20 bp, Artificial Sequence
  chemically synthesized
cattgttaacaaaacaataa

SEQ ID NO: 855 - DNA, 20 bp, Artificial Sequence
  chemically synthesized
taacaaaacaataacagact

SEQ ID NO: 856 - DNA, 20 bp, Artificial Sequence
  chemically synthesized
tgtagatttcagtagtttct

SEQ ID NO: 857 - DNA, 20 bp, Artificial Sequence
  chemically synthesized
tattatactgtagatttcag

SEQ ID NO: 858 - DNA, 20 bp, Artificial Sequence
  chemically synthesized
ttagaaactactgaaatcta

SEQ ID NO: 859 - DNA, 20 bp, Artificial Sequence
  chemically synthesized
tggtattatactgtagattt

SEQ ID NO: 860 - DNA, 20 bp, Artificial Sequence
  chemically synthesized
agggtagtggtattatactg

SEQ ID NO: 861 - DNA, 20 bp, Artificial Sequence
  chemically synthesized
tatatttttgtgaagggtag

SEQ ID NO: 862 - DNA, 20 bp, Artificial Sequence
  chemically synthesized
atctatatttttgtgaaggg

SEQ ID NO: 863 - DNA, 20 bp, Artificial Sequence
  chemically synthesized
taaatctatatttttgtgaa

SEQ ID NO: 864 - DNA, 20 bp, Artificial Sequence
  chemically synthesized
ataaatctatatttttgtga

SEQ ID NO: 865 - DNA, 20 bp, Artificial Sequence
  chemically synthesized
aataaatctatatttttgtg

SEQ ID NO: 866 - DNA, 20 bp, Artificial Sequence
  chemically synthesized
cactacccttcacaaaaata

SEQ ID NO: 867 - DNA, 20 bp, Artificial Sequence
  chemically synthesized
attagacagtaagagtttac

SEQ ID NO: 868 - DNA, 20 bp, Artificial Sequence
  chemically synthesized
caaagaggattagacagtaa

SEQ ID NO: 869 - DNA, 20 bp, Artificial Sequence
  chemically synthesized
aacaaagaggattagacagt

SEQ ID NO: 870 - DNA, 20 bp, Artificial Sequence
  chemically synthesized
atacaacaaagaggattaga

SEQ ID NO: 871 - DNA, 20 bp, Artificial Sequence
  chemically synthesized
attcatacaacaaagaggat

SEQ ID NO: 872 - DNA, 20 bp, Artificial Sequence
  chemically synthesized
ataatattcatacaacaaag

SEQ ID NO: 873 - DNA, 20 bp, Artificial Sequence
  chemically synthesized
tataatattcatacaacaaa

SEQ ID NO: 874 - DNA, 20 bp, Artificial Sequence
  chemically synthesized
tttataatattcatacaaca

SEQ ID NO: 875 - DNA, 20 bp, Artificial Sequence
  chemically synthesized
tgaatattataaaaaccatg

SEQ ID NO: 876 - DNA, 20 bp, Artificial Sequence
  chemically synthesized
gaatattataaaaaccatgc

SEQ ID NO: 877 - DNA, 20 bp, Artificial Sequence
  chemically synthesized
tacaactcctgattcccgca

SEQ ID NO: 878 - DNA, 20 bp, Artificial Sequence
  chemically synthesized
tataaaaaccatgcgggaat

SEQ ID NO: 879 - DNA, 20 bp, Artificial Sequence
  chemically synthesized
ataaaaaccatgcgggaatc

SEQ ID NO: 880 - DNA, 20 bp, Artificial Sequence
  chemically synthesized
aaaaaccatgcgggaatcag

SEQ ID NO: 881 - DNA, 20 bp, Artificial Sequence
  chemically synthesized
catgacagatgaagaaggag

SEQ ID NO: 882 - DNA, 20 bp, Artificial Sequence
  chemically synthesized
agtcatgacagatgaagaag

SEQ ID NO: 883 - DNA, 20 bp, Artificial Sequence
  chemically synthesized
tcagtcatgacagatgaaga

SEQ ID NO: 884 - DNA, 20 bp, Artificial Sequence
  chemically synthesized
atcagtcatgacagatgaag

SEQ ID NO: 885 - DNA, 20 bp, Artificial Sequence
  chemically synthesized
agtatcagtcatgacagatg

SEQ ID NO: 886 - DNA, 20 bp, Artificial Sequence
  chemically synthesized
gtccttagtatcagtcatga

SEQ ID NO: 887 - DNA, 20 bp, Artificial Sequence
  chemically synthesized
catctgtcatgactgatact

SEQ ID NO: 888 - DNA, 20 bp, Artificial Sequence
  chemically synthesized
atctgtcatgactgatacta

SEQ ID NO: 889 - DNA, 20 bp, Artificial Sequence
  chemically synthesized
agcgatggagtccttagtat

SEQ ID NO: 890 - DNA, 20 bp, Artificial Sequence
  chemically synthesized
gggcagagcgatggagtcct

SEQ ID NO: 891 - DNA, 20 bp, Artificial Sequence
  chemically synthesized
atgatttgggcagagcgatg

SEQ ID NO: 892 - DNA, 20 bp, Artificial Sequence
  chemically synthesized
agatgatttgggcagagcga

SEQ ID NO: 893 - DNA, 20 bp, Artificial Sequence
  chemically synthesized
catggcagatgatttgggca

SEQ ID NO: 894 - DNA, 20 bp, Artificial Sequence
  chemically synthesized
cacatggcagatgatttggg

SEQ ID NO: 895 - DNA, 20 bp, Artificial Sequence
  chemically synthesized
ttccacatggcagatgattt

SEQ ID NO: 896 - DNA, 20 bp, Artificial Sequence
  chemically synthesized
tttccacatggcagatgatt

SEQ ID NO: 897 - DNA, 20 bp, Artificial Sequence
  chemically synthesized
tgcccaaatcatctgccatg

SEQ ID NO: 898 - DNA, 20 bp, Artificial Sequence
  chemically synthesized
aggaagtcttttccacatgg

SEQ ID NO: 899 - DNA, 20 bp, Artificial Sequence
  chemically synthesized
aaatcatctgccatgtggaa

SEQ ID NO: 900 - DNA, 20 bp, Artificial Sequence
  chemically synthesized
tgtaggaagtcttttccaca

SEQ ID NO: 901 - DNA, 20 bp, Artificial Sequence
  chemically synthesized
tttccaggacacaatgtagg

SEQ ID NO: 902 - DNA, 20 bp, Artificial Sequence
  chemically synthesized
tgttttccaggacacaatgt

SEQ ID NO: 903 - DNA, 20 bp, Artificial Sequence
  chemically synthesized
ttgttttccaggacacaatg

SEQ ID NO: 904 - DNA, 20 bp, Artificial Sequence
  chemically synthesized
agacttcctacattgtgtcc

SEQ ID NO: 905 - DNA, 20 bp, Artificial Sequence
  chemically synthesized
tttctttctctttgttttcc

SEQ ID NO: 906 - DNA, 20 bp, Artificial Sequence
  chemically synthesized
acattgtgtcctggaaaaca

SEQ ID NO: 907 - DNA, 20 bp, Artificial Sequence
  chemically synthesized
ctttctttctctttgttttc

SEQ ID NO: 908 - DNA, 20 bp, Artificial Sequence
  chemically synthesized
attgtgtcctggaaaacaaa

SEQ ID NO: 909 - DNA, 20 bp, Artificial Sequence
  chemically synthesized
tgtcctggaaaacaaagaga

SEQ ID NO: 910 - DNA, 20 bp, Artificial Sequence
  chemically synthesized
ctggaaaacaaagagaaaga

SEQ ID NO: 911 - DNA, 20 bp, Artificial Sequence
  chemically synthesized
aaaacaaagagaaagaaaga

SEQ ID NO: 912 - DNA, 20 bp, Artificial Sequence
  chemically synthesized
aagaaagacagactttacaa

SEQ ID NO: 913 - DNA, 20 bp, Artificial Sequence
  chemically synthesized
agaaagacagactttacaaa

SEQ ID NO: 914 - DNA, 20 bp, Artificial Sequence
  chemically synthesized
atctatctgcaccttttgta

SEQ ID NO: 915 - DNA, 20 bp, Artificial Sequence
  chemically synthesized
gacagactttacaaaaggtg

SEQ ID NO: 916 - DNA, 20 bp, Artificial Sequence
  chemically synthesized
gactttacaaaaggtgcaga

SEQ ID NO: 917 - DNA, 20 bp, Artificial Sequence
  chemically synthesized
ttacaaaaggtgcagataga

SEQ ID NO: 918 - DNA, 20 bp, Artificial Sequence
  chemically synthesized
tcccaaatggcaaagaaaca

SEQ ID NO: 919 - DNA, 20 bp, Artificial Sequence
  chemically synthesized
tttcccaaatggcaaagaaa

SEQ ID NO: 920 - DNA, 20 bp, Artificial Sequence
  chemically synthesized
cactctgtttctttgccatt

SEQ ID NO: 921 - DNA, 20 bp, Artificial Sequence
  chemically synthesized
gaatgatttcccaaatggca

SEQ ID NO: 922 - DNA, 20 bp, Artificial Sequence
  chemically synthesized
actctgtttctttgccattt

SEQ ID NO: 923 - DNA, 20 bp, Artificial Sequence
  chemically synthesized
atggggaatgatttcccaaa

SEQ ID NO: 924 - DNA, 20 bp, Artificial Sequence
  chemically synthesized
gggaaatcattccccatttc

SEQ ID NO: 925 - DNA, 20 bp, Artificial Sequence
  chemically synthesized
ggaaatcattccccatttct

SEQ ID NO: 926 - DNA, 20 bp, Artificial Sequence
  chemically synthesized
gttgtcttcacccagaaatg

SEQ ID NO: 927 - DNA, 20 bp, Artificial Sequence
  chemically synthesized
tgttgtcttcacccagaaat

SEQ ID NO: 928 - DNA, 20 bp, Artificial Sequence
  chemically synthesized
gtgttgtcttcacccagaaa

SEQ ID NO: 929 - DNA, 20 bp, Artificial Sequence
  chemically synthesized
tcattccccatttctgggtg

SEQ ID NO: 930 - DNA, 20 bp, Artificial Sequence
  chemically synthesized
gcttctgtgttgtcttcacc

SEQ ID NO: 931 - DNA, 20 bp, Artificial Sequence
  chemically synthesized
atttctgggtgaagacaaca

SEQ ID NO: 932 - DNA, 20 bp, Artificial Sequence
  chemically synthesized
tctgggtgaagacaacacag

SEQ ID NO: 933 - DNA, 20 bp, Artificial Sequence
  chemically synthesized
gacaacacagaagctgcatc

SEQ ID NO: 934 - DNA, 20 bp, Artificial Sequence
  chemically synthesized
acaacacagaagctgcatcg

SEQ ID NO: 935 - DNA, 20 bp, Artificial Sequence
  chemically synthesized
caacacagaagctgcatcga

SEQ ID NO: 936 - DNA, 20 bp, Artificial Sequence
  chemically synthesized
tgttgtgtacaccctcgatg

SEQ ID NO: 937 - DNA, 20 bp, Artificial Sequence
  chemically synthesized
gcatcgagggtgtacacaac

SEQ ID NO: 938 - DNA, 20 bp, Artificial Sequence
  chemically synthesized
catcgagggtgtacacaaca

SEQ ID NO: 939 - DNA, 20 bp, Artificial Sequence
  chemically synthesized
aacaaggtttgatttttcac

SEQ ID NO: 940 - DNA, 20 bp, Artificial Sequence
  chemically synthesized
tttgatttttcaccagtttc

SEQ ID NO: 941 - DNA, 20 bp, Artificial Sequence
  chemically synthesized
ttgatttttcaccagtttcc

SEQ ID NO: 942 - DNA, 20 bp, Artificial Sequence
  chemically synthesized
ctttgcttcttcctggaaac

SEQ ID NO: 943 - DNA, 20 bp, Artificial Sequence
  chemically synthesized
atttttcaccagtttccagg

SEQ ID NO: 944 - DNA, 20 bp, Artificial Sequence
  chemically synthesized
tttcaccagtttccaggaag

SEQ ID NO: 945 - DNA, 20 bp, Artificial Sequence
  chemically synthesized
aataaggctttgcttcttcc

SEQ ID NO: 946 - DNA, 20 bp, Artificial Sequence
  chemically synthesized
ccagtttccaggaagaagca

SEQ ID NO: 947 - DNA, 20 bp, Artificial Sequence
  chemically synthesized
gtgtaatggcttcattaata

SEQ ID NO: 948 - DNA, 20 bp, Artificial Sequence
  chemically synthesized
gaagcaaagccttattaatg

SEQ ID NO: 949 - DNA, 20 bp, Artificial Sequence
  chemically synthesized
cgtgtaatggcttcattaat

SEQ ID NO: 950 - DNA, 20 bp, Artificial Sequence
  chemically synthesized
tactaacaaacaacgtgtaa

SEQ ID NO: 951 - DNA, 20 bp, Artificial Sequence
  chemically synthesized
agccattacacgttgtttgt

SEQ ID NO: 952 - DNA, 20 bp, Artificial Sequence
  chemically synthesized
tacacgttgtttgttagtat

SEQ ID NO: 953 - DNA, 20 bp, Artificial Sequence
  chemically synthesized
tgttagtatcagcttaatgt

SEQ ID NO: 954 - DNA, 20 bp, Artificial Sequence
  chemically synthesized
cagtagcctgatccaacatt

SEQ ID NO: 955 - DNA, 20 bp, Artificial Sequence
  chemically synthesized
gtatcagcttaatgttggat

SEQ ID NO: 956 - DNA, 20 bp, Artificial Sequence
  chemically synthesized
tatcagcttaatgttggatc

SEQ ID NO: 957 - DNA, 20 bp, Artificial Sequence
  chemically synthesized
ttaatgttggatcaggctac

SEQ ID NO: 958 - DNA, 20 bp, Artificial Sequence
  chemically synthesized
tttttccatgtaaacaccag

SEQ ID NO: 959 - DNA, 20 bp, Artificial Sequence
  chemically synthesized
acatttttccatgtaaacac

SEQ ID NO: 960 - DNA, 20 bp, Artificial Sequence
  chemically synthesized
tcaggctactggtgtttaca

SEQ ID NO: 961 - DNA, 20 bp, Artificial Sequence
  chemically synthesized
tgtttacatggaaaaatgtc

SEQ ID NO: 962 - DNA, 20 bp, Artificial Sequence
  chemically synthesized
gaaaaatgtcaagctacatt

SEQ ID NO: 963 - DNA, 20 bp, Artificial Sequence
  chemically synthesized
aaaaatgtcaagctacattc

SEQ ID NO: 964 - DNA, 20 bp, Artificial Sequence
  chemically synthesized
ttacattgggaacctgaatg

SEQ ID NO: 965 - DNA, 20 bp, Artificial Sequence
  chemically synthesized
ttttgatatatatttacatt

SEQ ID NO: 966 - DNA, 20 bp, Artificial Sequence
  chemically synthesized
cttttgatatatatttacat

SEQ ID NO: 967 - DNA, 20 bp, Artificial Sequence
  chemically synthesized
ccaatgtaaatatatatcaa

SEQ ID NO: 968 - DNA, 20 bp, Artificial Sequence
  chemically synthesized
tatatatcaaaagaattcca

SEQ ID NO: 969 - DNA, 20 bp, Artificial Sequence
  chemically synthesized
atcaaaagaattccatagat

SEQ ID NO: 970 - DNA, 20 bp, Artificial Sequence
  chemically synthesized
agaaatcttgtgcttatcta

SEQ ID NO: 971 - DNA, 20 bp, Artificial Sequence
  chemically synthesized
agaattccatagataagcac

SEQ ID NO: 972 - DNA, 20 bp, Artificial Sequence
  chemically synthesized
gataagcacaagatttctat

SEQ ID NO: 973 - DNA, 20 bp, Artificial Sequence
  chemically synthesized
gcacaagatttctatcagaa

SEQ ID NO: 974 - DNA, 20 bp, Artificial Sequence
  chemically synthesized
cacaagatttctatcagaac

SEQ ID NO: 975 - DNA, 20 bp, Artificial Sequence
  chemically synthesized
atggaatattcctgttctga

SEQ ID NO: 976 - DNA, 20 bp, Artificial Sequence
  chemically synthesized
agaacaggaatattccatga

SEQ ID NO: 977 - DNA, 20 bp, Artificial Sequence
  chemically synthesized
gaacaggaatattccatgat

SEQ ID NO: 978 - DNA, 20 bp, Artificial Sequence
  chemically synthesized
ggaaaagatgtatcccatca

SEQ ID NO: 979 - DNA, 20 bp, Artificial Sequence
  chemically synthesized
cactcatagccaaggtggaa

SEQ ID NO: 980 - DNA, 20 bp, Artificial Sequence
  chemically synthesized
gggatacatcttttccacct

SEQ ID NO: 981 - DNA, 20 bp, Artificial Sequence
  chemically synthesized
tcaatcactcatagccaagg

SEQ ID NO: 982 - DNA, 20 bp, Artificial Sequence
  chemically synthesized
atcttttccaccttggctat

SEQ ID NO: 983 - DNA, 20 bp, Artificial Sequence
  chemically synthesized
caatcaatcactcatagcca

SEQ ID NO: 984 - DNA, 20 bp, Artificial Sequence
  chemically synthesized
tcaatcaatcactcatagcc

SEQ ID NO: 985 - DNA, 20 bp, Artificial Sequence
  chemically synthesized
agtaatcaatcaatcactca

SEQ ID NO: 986 - DNA, 20 bp, Artificial Sequence
  chemically synthesized
cgttaatacaagtagagagt

SEQ ID NO: 987 - DNA, 20 bp, Artificial Sequence
  chemically synthesized
tgttcgttaatacaagtaga

SEQ ID NO: 988 - DNA, 20 bp, Artificial Sequence
  chemically synthesized
aatgttcgttaatacaagta

SEQ ID NO: 989 - DNA, 20 bp, Artificial Sequence
  chemically synthesized
aaaatgttcgttaatacaag

SEQ ID NO: 990 - DNA, 20 bp, Artificial Sequence
  chemically synthesized
aaaaaaatgttcgttaatac

SEQ ID NO: 991 - DNA, 20 bp, Artificial Sequence
  chemically synthesized
ggtgatggtggtttgattga

SEQ ID NO: 992 - DNA, 20 bp, Artificial Sequence
  chemically synthesized
agttgtgaaggtggtgatgg

SEQ ID NO: 993 - DNA, 20 bp, Artificial Sequence
  chemically synthesized
ggtagttgtgaaggtggtga

SEQ ID NO: 994 - DNA, 20 bp, Artificial Sequence
  chemically synthesized
ggtagtggtagttgtgaagg

SEQ ID NO: 995 - DNA, 20 bp, Artificial Sequence
  chemically synthesized
gatggtagtggtagttgtga

SEQ ID NO: 996 - DNA, 20 bp, Artificial Sequence
  chemically synthesized
tgatggtagtggtagttgtg

SEQ ID NO: 997 - DNA, 20 bp, Artificial Sequence
  chemically synthesized
ggtgctggtgatggtagtgg

SEQ ID NO: 998 - DNA, 20 bp, Artificial Sequence
  chemically synthesized
ttgggtgctggtgatggtag

SEQ ID NO: 999 - DNA, 20 bp, Artificial Sequence
  chemically synthesized
acaactaccactaccatcac

SEQ ID NO: 1000 - DNA, 20 bp, Artificial Sequence
  chemically synthesized
tggttgggtgctggtgatgg

SEQ ID NO: 1001 - DNA, 20 bp, Artificial Sequence
  chemically synthesized
cgatggttgggtgctggtga

SEQ ID NO: 1002 - DNA, 20 bp, Artificial Sequence
  chemically synthesized
tggtgacgatggttgggtgc

SEQ ID NO: 1003 - DNA, 20 bp, Artificial Sequence
  chemically synthesized
tgataatggtgacgatggtt

SEQ ID NO: 1004 - DNA, 20 bp, Artificial Sequence
  chemically synthesized
gtgataatggtgacgatggt

SEQ ID NO: 1005 - DNA, 20 bp, Artificial Sequence
  chemically synthesized
ggcagtgataatggtgacga

SEQ ID NO: 1006 - DNA, 20 bp, Artificial Sequence
  chemically synthesized
ggtgatggtggcagtgataa

SEQ ID NO: 1007 - DNA, 20 bp, Artificial Sequence
  chemically synthesized
tggtgtggcggtgatggtgg

SEQ ID NO: 1008 - DNA, 20 bp, Artificial Sequence
  chemically synthesized
agttggtgtggcggtgatgg

SEQ ID NO: 1009 - DNA, 20 bp, Artificial Sequence
  chemically synthesized
aaaagttggtgtggcggtga

SEQ ID NO: 1010 - DNA, 20 bp, Artificial Sequence
  chemically synthesized
gaaatgaaaagttggtgtgg

SEQ ID NO: 1011 - DNA, 20 bp, Artificial Sequence
  chemically synthesized
tttgaaatgaaaagttggtg

SEQ ID NO: 1012 - DNA, 20 bp, Artificial Sequence
  chemically synthesized
acagctttgaaatgaaaagt

SEQ ID NO: 1013 - DNA, 20 bp, Artificial Sequence
  chemically synthesized
tgaaacagctttgaaatgaa

SEQ ID NO: 1014 - DNA, 20 bp, Artificial Sequence
  chemically synthesized
cacaccaacttttcatttca

SEQ ID NO: 1015 - DNA, 20 bp, Artificial Sequence
  chemically synthesized
ttttcatttcaaagctgttt

SEQ ID NO: 1016 - DNA, 20 bp, Artificial Sequence
  chemically synthesized
tttcatttcaaagctgtttc

SEQ ID NO: 1017 - DNA, 20 bp, Artificial Sequence
  chemically synthesized
agcaagccaacagcctgaaa

SEQ ID NO: 1018 - DNA, 20 bp, Artificial Sequence
  chemically synthesized
tcaaagctgtttcaggctgt

SEQ ID NO: 1019 - DNA, 20 bp, Artificial Sequence
  chemically synthesized
tagcctcagaagcaagccaa

SEQ ID NO: 1020 - DNA, 20 bp, Artificial Sequence
  chemically synthesized
caggctgttggcttgcttct

SEQ ID NO: 1021 - DNA, 20 bp, Artificial Sequence
  chemically synthesized
aggctgttggcttgcttctg

SEQ ID NO: 1022 - DNA, 20 bp, Artificial Sequence
  chemically synthesized
tccaccatagcctcagaagc

SEQ ID NO: 1023 - DNA, 20 bp, Artificial Sequence
  chemically synthesized
cacctccaccatagcctcag

SEQ ID NO: 1024 - DNA, 20 bp, Artificial Sequence
  chemically synthesized
ttggcttgcttctgaggcta

SEQ ID NO: 1025 - DNA, 20 bp, Artificial Sequence
  chemically synthesized
agccacctccaccatagcct

SEQ ID NO: 1026 - DNA, 20 bp, Artificial Sequence
  chemically synthesized
gcttgcttctgaggctatgg

SEQ ID NO: 1027 - DNA, 20 bp, Artificial Sequence
  chemically synthesized
ttgcttctgaggctatggtg

SEQ ID NO: 1028 - DNA, 20 bp, Artificial Sequence
  chemically synthesized
tgcttctgaggctatggtgg

SEQ ID NO: 1029 - DNA, 20 bp, Artificial Sequence
  chemically synthesized
gaaaatagccacctccacca

SEQ ID NO: 1030 - DNA, 20 bp, Artificial Sequence
  chemically synthesized
ttctgaggctatggtggagg

SEQ ID NO: 1031 - DNA, 20 bp, Artificial Sequence
  chemically synthesized
aagtaaaagcagagagaaaa

SEQ ID NO: 1032 - DNA, 20 bp, Artificial Sequence
  chemically synthesized
tcaacccaagtaaaagcaga

SEQ ID NO: 1033 - DNA, 20 bp, Artificial Sequence
  chemically synthesized
tttcaacccaagtaaaagca

SEQ ID NO: 1034 - DNA, 20 bp, Artificial Sequence
  chemically synthesized
tttttcaacccaagtaaaag

SEQ ID NO: 1035 - DNA, 20 bp, Artificial Sequence
  chemically synthesized
attttctctctgcttttact

SEQ ID NO: 1036 - DNA, 20 bp, Artificial Sequence
  chemically synthesized
ttttctctctgcttttactt

SEQ ID NO: 1037 - DNA, 20 bp, Artificial Sequence
  chemically synthesized
ttatttttcaacccaagtaa

SEQ ID NO: 1038 - DNA, 20 bp, Artificial Sequence
  chemically synthesized
ttattattatttttcaaccc

SEQ ID NO: 1039 - DNA, 20 bp, Artificial Sequence
  chemically synthesized
gcaccaaaaggtcaattcaa

SEQ ID NO: 1040 - DNA, 20 bp, Artificial Sequence
  chemically synthesized
gtgcaccaaaaggtcaattc

SEQ ID NO: 1041 - DNA, 20 bp, Artificial Sequence
  chemically synthesized
aaactcttgaattgaccttt

SEQ ID NO: 1042 - DNA, 20 bp, Artificial Sequence
  chemically synthesized
aatgttaatagtgcaccaaa

SEQ ID NO: 1043 - DNA, 20 bp, Artificial Sequence
  chemically synthesized
aaatgttaatagtgcaccaa

SEQ ID NO: 1044 - DNA, 20 bp, Artificial Sequence
  chemically synthesized
tttcctaattcaaatgttaa

SEQ ID NO: 1045 - DNA, 20 bp, Artificial Sequence
  chemically synthesized
tgcactattaacatttgaat

SEQ ID NO: 1046 - DNA, 20 bp, Artificial Sequence
  chemically synthesized
gcactattaacatttgaatt

SEQ ID NO: 1047 - DNA, 20 bp, Artificial Sequence
  chemically synthesized
acatttgaattaggaaacct

SEQ ID NO: 1048 - DNA, 20 bp, Artificial Sequence
  chemically synthesized
gtaaagcaatttttattctg

SEQ ID NO: 1049 - DNA, 20 bp, Artificial Sequence
  chemically synthesized
tgtaaagcaatttttattct

SEQ ID NO: 1050 - DNA, 20 bp, Artificial Sequence
  chemically synthesized
ctagagtaatttggaatgta

SEQ ID NO: 1051 - DNA, 20 bp, Artificial Sequence
  chemically synthesized
aattagggtctagagtaatt

SEQ ID NO: 1052 - DNA, 20 bp, Artificial Sequence
  chemically synthesized
ctttacattccaaattactc

SEQ ID NO: 1053 - DNA, 20 bp, Artificial Sequence
  chemically synthesized
caccttataattagggtcta

SEQ ID NO: 1054 - DNA, 20 bp, Artificial Sequence
  chemically synthesized
gtcaccttataattagggtc

SEQ ID NO: 1055 - DNA, 20 bp, Artificial Sequence
  chemically synthesized
ttactctagaccctaattat

SEQ ID NO: 1056 - DNA, 20 bp, Artificial Sequence
  chemically synthesized
tgtgggtcaccttataatta

SEQ ID NO: 1057 - DNA, 20 bp, Artificial Sequence
  chemically synthesized
tactctagaccctaattata

SEQ ID NO: 1058 - DNA, 20 bp, Artificial Sequence
  chemically synthesized
atgtgggtcaccttataatt

SEQ ID NO: 1059 - DNA, 20 bp, Artificial Sequence
  chemically synthesized
catgtgggtcaccttataat

SEQ ID NO: 1060 - DNA, 20 bp, Artificial Sequence
  chemically synthesized
caaatgcatacaatacatgt

SEQ ID NO: 1061 - DNA, 20 bp, Artificial Sequence
  chemically synthesized
ccaaatgcatacaatacatg

SEQ ID NO: 1062 - DNA, 20 bp, Artificial Sequence
  chemically synthesized
ccacatgtattgtatgcatt

SEQ ID NO: 1063 - DNA, 20 bp, Artificial Sequence
  chemically synthesized
cacatgtattgtatgcattt

SEQ ID NO: 1064 - DNA, 20 bp, Artificial Sequence
  chemically synthesized
ggtattttgtgaatccatct

SEQ ID NO: 1065 - DNA, 20 bp, Artificial Sequence
  chemically synthesized
tattttgtgaatccatctta

SEQ ID NO: 1066 - DNA, 20 bp, Artificial Sequence
  chemically synthesized
atttaggaggagctctaaga

SEQ ID NO: 1067 - DNA, 20 bp, Artificial Sequence
  chemically synthesized
cctcatttaggaggagctct

SEQ ID NO: 1068 - DNA, 20 bp, Artificial Sequence
  chemically synthesized
agttaaccctcatttaggag

SEQ ID NO: 1069 - DNA, 20 bp, Artificial Sequence
  chemically synthesized
tcttagagctcctcctaaat

SEQ ID NO: 1070 - DNA, 20 bp, Artificial Sequence
  chemically synthesized
atagttaaccctcatttagg

SEQ ID NO: 1071 - DNA, 20 bp, Artificial Sequence
  chemically synthesized
cttagagctcctcctaaatg

SEQ ID NO: 1072 - DNA, 20 bp, Artificial Sequence
  chemically synthesized
gatagttaaccctcatttag

SEQ ID NO: 1073 - DNA, 20 bp, Artificial Sequence
  chemically synthesized
ttagagctcctcctaaatga

SEQ ID NO: 1074 - DNA, 20 bp, Artificial Sequence
  chemically synthesized
gtgatagttaaccctcattt

SEQ ID NO: 1075 - DNA, 20 bp, Artificial Sequence
  chemically synthesized
tgtgatagttaaccctcatt

SEQ ID NO: 1076 - DNA, 20 bp, Artificial Sequence
  chemically synthesized
atgagggttaactatcacaa

SEQ ID NO: 1077 - DNA, 20 bp, Artificial Sequence
  chemically synthesized
ttagtaaaaggctattgtga

SEQ ID NO: 1078 - DNA, 20 bp, Artificial Sequence
  chemically synthesized
cgtgctgcattattagtaaa

SEQ ID NO: 1079 - DNA, 20 bp, Artificial Sequence
  chemically synthesized
tcgtgctgcattattagtaa

SEQ ID NO: 1080 - DNA, 20 bp, Artificial Sequence
  chemically synthesized
atagccttttactaataatg

SEQ ID NO: 1081 - DNA, 20 bp, Artificial Sequence
  chemically synthesized
gctaggtcgtgctgcattat

SEQ ID NO: 1082 - DNA, 20 bp, Artificial Sequence
  chemically synthesized
actaataatgcagcacgacc

SEQ ID NO: 1083 - DNA, 20 bp, Artificial Sequence
  chemically synthesized
cgtgctgggagattcgtgct

SEQ ID NO: 1084 - DNA, 20 bp, Artificial Sequence
  chemically synthesized
ccgtgctgggagattcgtgc

SEQ ID NO: 1085 - DNA, 20 bp, Artificial Sequence
  chemically synthesized
acgacctagcacgaatctcc

SEQ ID NO: 1086 - DNA, 20 bp, Artificial Sequence
  chemically synthesized
ctagcacgaatctcccagca

SEQ ID NO: 1087 - DNA, 20 bp, Artificial Sequence
  chemically synthesized
gttctttttctccgtgctgg

SEQ ID NO: 1088 - DNA, 20 bp, Artificial Sequence
  chemically synthesized
agcacgaatctcccagcacg

SEQ ID NO: 1089 - DNA, 20 bp, Artificial Sequence
  chemically synthesized
ctgttctttttctccgtgct

SEQ ID NO: 1090 - DNA, 20 bp, Artificial Sequence
  chemically synthesized
gctgttctttttctccgtgc

SEQ ID NO: 1091 - DNA, 20 bp, Artificial Sequence
  chemically synthesized
aatctcccagcacggagaaa

SEQ ID NO: 1092 - DNA, 20 bp, Artificial Sequence
  chemically synthesized
cccagcacggagaaaaagaa

SEQ ID NO: 1093 - DNA, 20 bp, Artificial Sequence
  chemically synthesized
aaagaacagcacaatgtccc

SEQ ID NO: 1094 - DNA, 20 bp, Artificial Sequence
  chemically synthesized
aagaacagcacaatgtccct

SEQ ID NO: 1095 - DNA, 20 bp, Artificial Sequence
  chemically synthesized
attttgctacgaagtaccca

SEQ ID NO: 1096 - DNA, 20 bp, Artificial Sequence
  chemically synthesized
aattttgctacgaagtaccc

SEQ ID NO: 1097 - DNA, 20 bp, Artificial Sequence
  chemically synthesized
gaattttgctacgaagtacc

SEQ ID NO: 1098 - DNA, 20 bp, Artificial Sequence
  chemically synthesized
caatgtccctgggtacttcg

SEQ ID NO: 1099 - DNA, 20 bp, Artificial Sequence
  chemically synthesized
taaatctgaattttgctacg

SEQ ID NO: 1100 - DNA, 20 bp, Artificial Sequence
  chemically synthesized
gggtacttcgtagcaaaatt

SEQ ID NO: 1101 - DNA, 20 bp, Artificial Sequence
  chemically synthesized
ttcgtagcaaaattcagatt

SEQ ID NO: 1102 - DNA, 20 bp, Artificial Sequence
  chemically synthesized
cgtagcaaaattcagattta

SEQ ID NO: 1103 - DNA, 20 bp, Artificial Sequence
  chemically synthesized
gcaaaattcagatttagagt

SEQ ID NO: 1104 - DNA, 20 bp, Artificial Sequence
  chemically synthesized
gatttagagtaagataatct

SEQ ID NO: 1105 - DNA, 20 bp, Artificial Sequence
  chemically synthesized
gcaagccataaagtaagtct

SEQ ID NO: 1106 - DNA, 20 bp, Artificial Sequence
  chemically synthesized
ataatctgagacttacttta

SEQ ID NO: 1107 - DNA, 20 bp, Artificial Sequence
  chemically synthesized
gaaaaggcaagccataaagt

SEQ ID NO: 1108 - DNA, 20 bp, Artificial Sequence
  chemically synthesized
agacgaaaaggcaagccata

SEQ ID NO: 1109 - DNA, 20 bp, Artificial Sequence
  chemically synthesized
tgggacatagacgaaaaggc

SEQ ID NO: 1110 - DNA, 20 bp, Artificial Sequence
  chemically synthesized
actatgggacatagacgaaa

SEQ ID NO: 1111 - DNA, 20 bp, Artificial Sequence
  chemically synthesized
aactatgggacatagacgaa

SEQ ID NO: 1112 - DNA, 20 bp, Artificial Sequence
  chemically synthesized
gccttttcgtctatgtccca

SEQ ID NO: 1113 - DNA, 20 bp, Artificial Sequence
  chemically synthesized
ccatgtaaaactatgggaca

SEQ ID NO: 1114 - DNA, 20 bp, Artificial Sequence
  chemically synthesized
aattagccatgtaaaactat

SEQ ID NO: 1115 - DNA, 20 bp, Artificial Sequence
  chemically synthesized
aaattagccatgtaaaacta

SEQ ID NO: 1116 - DNA, 20 bp, Artificial Sequence
  chemically synthesized
ctatgtcccatagttttaca

SEQ ID NO: 1117 - DNA, 20 bp, Artificial Sequence
  chemically synthesized
caatgtgcaataattaaaat

SEQ ID NO: 1118 - DNA, 20 bp, Artificial Sequence
  chemically synthesized
taattttaattattgcacat

SEQ ID NO: 1119 - DNA, 20 bp, Artificial Sequence
  chemically synthesized
gacaatacttgaatagtgga

SEQ ID NO: 1120 - DNA, 20 bp, Artificial Sequence
  chemically synthesized
agacaatacttgaatagtgg

SEQ ID NO: 1121 - DNA, 20 bp, Artificial Sequence
  chemically synthesized
ggtaaatccttccactattc

SEQ ID NO: 1122 - DNA, 20 bp, Artificial Sequence
  chemically synthesized
caaagacaatacttgaatag

SEQ ID NO: 1123 - DNA, 20 bp, Artificial Sequence
  chemically synthesized
ttccaaagacaatacttgaa

SEQ ID NO: 1124 - DNA, 20 bp, Artificial Sequence
  chemically synthesized
cactattcaagtattgtctt

SEQ ID NO: 1125 - DNA, 20 bp, Artificial Sequence
  chemically synthesized
agtaaagcatttcagttcca

SEQ ID NO: 1126 - DNA, 20 bp, Artificial Sequence
  chemically synthesized
aatagcctagtaaagcattt

SEQ ID NO: 1127 - DNA, 20 bp, Artificial Sequence
  chemically synthesized
ttggaactgaaatgctttac

SEQ ID NO: 1128 - DNA, 20 bp, Artificial Sequence
  chemically synthesized
tggaactgaaatgctttact

SEQ ID NO: 1129 - DNA, 20 bp, Artificial Sequence
  chemically synthesized
aaggtagtaatagcctagta

SEQ ID NO: 1130 - DNA, 20 bp, Artificial Sequence
  chemically synthesized
atggcaaggtagtaatagcc

SEQ ID NO: 1131 - DNA, 20 bp, Artificial Sequence
  chemically synthesized
gatacatggcaaggtagtaa

SEQ ID NO: 1132 - DNA, 20 bp, Artificial Sequence
  chemically synthesized
aaagttgatacatggcaagg

SEQ ID NO: 1133 - DNA, 20 bp, Artificial Sequence
  chemically synthesized
tgtaaagttgatacatggca

SEQ ID NO: 1134 - DNA, 20 bp, Artificial Sequence
  chemically synthesized
ctgtaaagttgatacatggc

SEQ ID NO: 1135 - DNA, 20 bp, Artificial Sequence
  chemically synthesized
gaatctgtaaagttgataca

SEQ ID NO: 1136 - DNA, 20 bp, Artificial Sequence
  chemically synthesized
cttgccatgtatcaacttta

SEQ ID NO: 1137 - DNA, 20 bp, Artificial Sequence
  chemically synthesized
aattattatgggaatctgta

SEQ ID NO: 1138 - DNA, 20 bp, Artificial Sequence
  chemically synthesized
gtatttttaacaattattat

SEQ ID NO: 1139 - DNA, 20 bp, Artificial Sequence
  chemically synthesized
ggtatttttaacaattatta

SEQ ID NO: 1140 - DNA, 20 bp, Artificial Sequence
  chemically synthesized
gggatatctttaatttttat

SEQ ID NO: 1141 - DNA, 20 bp, Artificial Sequence
  chemically synthesized
aaaaataccaataaaaatta

SEQ ID NO: 1142 - DNA, 20 bp, Artificial Sequence
  chemically synthesized
ctatagctttaatttttatt

SEQ ID NO: 1143 - DNA, 20 bp, Artificial Sequence
  chemically synthesized
tctatagctttaatttttat

SEQ ID NO: 1144 - DNA, 20 bp, Artificial Sequence
  chemically synthesized
agatatcccaataaaaatta

SEQ ID NO: 1145 - DNA, 20 bp, Artificial Sequence
  chemically synthesized
cccaataaaaattaaagcta

SEQ ID NO: 1146 - DNA, 20 bp, Artificial Sequence
  chemically synthesized
taaaaattaaagctatagac

SEQ ID NO: 1147 - DNA, 20 bp, Artificial Sequence
  chemically synthesized
aaaaattaaagctatagact

SEQ ID NO: 1148 - DNA, 20 bp, Artificial Sequence
  chemically synthesized
aaaattaaagctatagacta

SEQ ID NO: 1149 - DNA, 20 bp, Artificial Sequence
  chemically synthesized
aaaatactctccctagtcta

SEQ ID NO: 1150 - DNA, 20 bp, Artificial Sequence
  chemically synthesized
aattaaagctatagactagg

SEQ ID NO: 1151 - DNA, 20 bp, Artificial Sequence
  chemically synthesized
ttaaagctatagactaggga

SEQ ID NO: 1152 - DNA, 20 bp, Artificial Sequence
  chemically synthesized
ttaaaacaaaatactctccc

SEQ ID NO: 1153 - DNA, 20 bp, Artificial Sequence
  chemically synthesized
tttgttttaatatttatttc

SEQ ID NO: 1154 - DNA, 20 bp, Artificial Sequence
  chemically synthesized
tgttttaatatttatttcaa

SEQ ID NO: 1155 - DNA, 20 bp, Artificial Sequence
  chemically synthesized
aatatttatttcaagagata

SEQ ID NO: 1156 - DNA, 20 bp, Artificial Sequence
  chemically synthesized
atccgcttcattttgtagag

SEQ ID NO: 1157 - DNA, 20 bp, Artificial Sequence
  chemically synthesized
tgaatccgcttcattttgta

SEQ ID NO: 1158 - DNA, 20 bp, Artificial Sequence
  chemically synthesized
tatagcttctctacaaaatg

SEQ ID NO: 1159 - DNA, 20 bp, Artificial Sequence
  chemically synthesized
cgtgaatccgcttcattttg

SEQ ID NO: 1160 - DNA, 20 bp, Artificial Sequence
  chemically synthesized
agcttctctacaaaatgaag

SEQ ID NO: 1161 - DNA, 20 bp, Artificial Sequence
  chemically synthesized
tacaaaatgaagcggattca

SEQ ID NO: 1162 - DNA, 20 bp, Artificial Sequence
  chemically synthesized
acaaaatgaagcggattcac

SEQ ID NO: 1163 - DNA, 20 bp, Artificial Sequence
  chemically synthesized
aaatgaagcggattcacggg

SEQ ID NO: 1164 - DNA, 20 bp, Artificial Sequence
  chemically synthesized
aatgaagcggattcacgggc

SEQ ID NO: 1165 - DNA, 20 bp, Artificial Sequence
  chemically synthesized
ttcacgggcaggcacttaaa

SEQ ID NO: 1166 - DNA, 20 bp, Artificial Sequence
  chemically synthesized
atctggtgccatcactgttt

SEQ ID NO: 1167 - DNA, 20 bp, Artificial Sequence
  chemically synthesized
ggcaggcacttaaacagtga

SEQ ID NO: 1168 - DNA, 20 bp, Artificial Sequence
  chemically synthesized
cacttaaacagtgatggcac

SEQ ID NO: 1169 - DNA, 20 bp, Artificial Sequence
  chemically synthesized
aagtaagtcttcagttgatc

SEQ ID NO: 1170 - DNA, 20 bp, Artificial Sequence
  chemically synthesized
tgatggcaccagatcaactg

SEQ ID NO: 1171 - DNA, 20 bp, Artificial Sequence
  chemically synthesized
acttttaataagtaagtctt

SEQ ID NO: 1172 - DNA, 20 bp, Artificial Sequence
  chemically synthesized
acattaaacttttaataagt

SEQ ID NO: 1173 - DNA, 20 bp, Artificial Sequence
  chemically synthesized
actgaagacttacttattaa

SEQ ID NO: 1174 - DNA, 20 bp, Artificial Sequence
  chemically synthesized
aatgacattaaacttttaat

SEQ ID NO: 1175 - DNA, 20 bp, Artificial Sequence
  chemically synthesized
attaaaagtttaatgtcatt

SEQ ID NO: 1176 - DNA, 20 bp, Artificial Sequence
  chemically synthesized
ttaaaagtttaatgtcattc

SEQ ID NO: 1177 - DNA, 20 bp, Artificial Sequence
  chemically synthesized
gtcattcaggcatttctatt

SEQ ID NO: 1178 - DNA, 20 bp, Artificial Sequence
  chemically synthesized
tcattcaggcatttctatta

SEQ ID NO: 1179 - DNA, 20 bp, Artificial Sequence
  chemically synthesized
tacaaacttggtcaccttaa

SEQ ID NO: 1180 - DNA, 20 bp, Artificial Sequence
  chemically synthesized
gcatttctattaaggtgacc

SEQ ID NO: 1181 - DNA, 20 bp, Artificial Sequence
  chemically synthesized
aaaagatagatatacaaact

SEQ ID NO: 1182 - DNA, 20 bp, Artificial Sequence
  chemically synthesized
actaataaagcacaaaaaga

SEQ ID NO: 1183 - DNA, 20 bp, Artificial Sequence
  chemically synthesized
ttgcactaataaagcacaaa

SEQ ID NO: 1184 - DNA, 20 bp, Artificial Sequence
  chemically synthesized
tctatctttttgtgctttat

SEQ ID NO: 1185 - DNA, 20 bp, Artificial Sequence
  chemically synthesized
tgaaattctttgcactaata

SEQ ID NO: 1186 - DNA, 20 bp, Artificial Sequence
  chemically synthesized
ttttgtgctttattagtgca

SEQ ID NO: 1187 - DNA, 20 bp, Artificial Sequence
  chemically synthesized
tattagtgcaaagaatttca

SEQ ID NO: 1188 - DNA, 20 bp, Artificial Sequence
  chemically synthesized
ttagtgcaaagaatttcatg

SEQ ID NO: 1189 - DNA, 20 bp, Artificial Sequence
  chemically synthesized
atggagtattaattatattt

SEQ ID NO: 1190 - DNA, 20 bp, Artificial Sequence
  chemically synthesized
tatattttagaaaatcactt

SEQ ID NO: 1191 - DNA, 20 bp, Artificial Sequence
  chemically synthesized
tagaaaatcactttggattt

SEQ ID NO: 1192 - DNA, 20 bp, Artificial Sequence
  chemically synthesized
gcagtctcagccaaaatcca

SEQ ID NO: 1193 - DNA, 20 bp, Artificial Sequence
  chemically synthesized
aatcactttggattttggct

SEQ ID NO: 1194 - DNA, 20 bp, Artificial Sequence
  chemically synthesized
tggattttggctgagactgc

SEQ ID NO: 1195 - DNA, 20 bp, Artificial Sequence
  chemically synthesized
aatttttatacttgcagtct

SEQ ID NO: 1196 - DNA, 20 bp, Artificial Sequence
  chemically synthesized
ttaaaaaatttttatacttg

SEQ ID NO: 1197 - DNA, 20 bp, Artificial Sequence
  chemically synthesized
agtataaaaattttttaaca

SEQ ID NO: 1198 - DNA, 20 bp, Artificial Sequence
  chemically synthesized
agcatatgcaactattcata

SEQ ID NO: 1199 - DNA, 20 bp, Artificial Sequence
  chemically synthesized
ctattggcccactttatgaa

SEQ ID NO: 1200 - DNA, 20 bp, Artificial Sequence
  chemically synthesized
atatgcaactattcataaag

SEQ ID NO: 1201 - DNA, 20 bp, Artificial Sequence
  chemically synthesized
tatgcaactattcataaagt

SEQ ID NO: 1202 - DNA, 20 bp, Artificial Sequence
  chemically synthesized
ctattcataaagtgggccaa

SEQ ID NO: 1203 - DNA, 20 bp, Artificial Sequence
  chemically synthesized
cataaagtgggccaatagtt

SEQ ID NO: 1204 - DNA, 20 bp, Artificial Sequence
  chemically synthesized
actgagggctgccaaactat

SEQ ID NO: 1205 - DNA, 20 bp, Artificial Sequence
  chemically synthesized
aaagtgggccaatagtttgg

SEQ ID NO: 1206 - DNA, 20 bp, Artificial Sequence
  chemically synthesized
gccaatagtttggcagccct

SEQ ID NO: 1207 - DNA, 20 bp, Artificial Sequence
  chemically synthesized
tagtttggcagccctcagtg

SEQ ID NO: 1208 - DNA, 20 bp, Artificial Sequence
  chemically synthesized
tgatttcagttcttcactga

SEQ ID NO: 1209 - DNA, 20 bp, Artificial Sequence
  chemically synthesized
atgatttcagttcttcactg

SEQ ID NO: 1210 - DNA, 20 bp, Artificial Sequence
  chemically synthesized
aatgatttcagttcttcact

SEQ ID NO: 1211 - DNA, 20 bp, Artificial Sequence
  chemically synthesized
cagaaagccaaaaatgattt

SEQ ID NO: 1212 - DNA, 20 bp, Artificial Sequence
  chemically synthesized
tgaagaactgaaatcatttt

SEQ ID NO: 1213 - DNA, 20 bp, Artificial Sequence
  chemically synthesized
tgtggtttttatggcacaga

SEQ ID NO: 1214 - DNA, 20 bp, Artificial Sequence
  chemically synthesized
ttcctgtggtttttatggca

SEQ ID NO: 1215 - DNA, 20 bp, Artificial Sequence
  chemically synthesized
tcgtcttcctgtggttttta

SEQ ID NO: 1216 - DNA, 20 bp, Artificial Sequence
  chemically synthesized
tttctgtgccataaaaacca

SEQ ID NO: 1217 - DNA, 20 bp, Artificial Sequence
  chemically synthesized
ttctgtgccataaaaaccac

SEQ ID NO: 1218 - DNA, 20 bp, Artificial Sequence
  chemically synthesized
tgtgccataaaaaccacagg

SEQ ID NO: 1219 - DNA, 20 bp, Artificial Sequence
  chemically synthesized
cccactgtgtcgtcttcctg

SEQ ID NO: 1220 - DNA, 20 bp, Artificial Sequence
  chemically synthesized
aaaaccacaggaagacgaca

SEQ ID NO: 1221 - DNA, 20 bp, Artificial Sequence
  chemically synthesized
accacaggaagacgacacag

SEQ ID NO: 1222 - DNA, 20 bp, Artificial Sequence
  chemically synthesized
ccacaggaagacgacacagt

SEQ ID NO: 1223 - DNA, 20 bp, Artificial Sequence
  chemically synthesized
cacaggaagacgacacagtg

SEQ ID NO: 1224 - DNA, 20 bp, Artificial Sequence
  chemically synthesized
tgagctctaaggagcagcaa

SEQ ID NO: 1225 - DNA, 20 bp, Artificial Sequence
  chemically synthesized
ctgagctctaaggagcagca

SEQ ID NO: 1226 - DNA, 20 bp, Artificial Sequence
  chemically synthesized
gtggggcctttgctgctcct

SEQ ID NO: 1227 - DNA, 20 bp, Artificial Sequence
  chemically synthesized
ggggcctttgctgctcctta

SEQ ID NO: 1228 - DNA, 20 bp, Artificial Sequence
  chemically synthesized
gtactctgagctctaaggag

SEQ ID NO: 1229 - DNA, 20 bp, Artificial Sequence
  chemically synthesized
tttgtactctgagctctaag

SEQ ID NO: 1230 - DNA, 20 bp, Artificial Sequence
  chemically synthesized
ctttgctgctccttagagct

SEQ ID NO: 1231 - DNA, 20 bp, Artificial Sequence
  chemically synthesized
tatttgtactctgagctcta

SEQ ID NO: 1232 - DNA, 20 bp, Artificial Sequence
  chemically synthesized
atatttgtactctgagctct

SEQ ID NO: 1233 - DNA, 20 bp, Artificial Sequence
  chemically synthesized
ttgctgctccttagagctca

SEQ ID NO: 1234 - DNA, 20 bp, Artificial Sequence
  chemically synthesized
cagttatatatttgtactct

SEQ ID NO: 1235 - DNA, 20 bp, Artificial Sequence
  chemically synthesized
gccctccaacttgatagcag

SEQ ID NO: 1236 - DNA, 20 bp, Artificial Sequence
  chemically synthesized
aatatataactgctgctatc

SEQ ID NO: 1237 - DNA, 20 bp, Artificial Sequence
  chemically synthesized
gaagccctccaacttgatag

SEQ ID NO: 1238 - DNA, 20 bp, Artificial Sequence
  chemically synthesized
tataactgctgctatcaagt

SEQ ID NO: 1239 - DNA, 20 bp, Artificial Sequence
  chemically synthesized
ggggaagccctccaacttga

SEQ ID NO: 1240 - DNA, 20 bp, Artificial Sequence
  chemically synthesized
taactgctgctatcaagttg

SEQ ID NO: 1241 - DNA, 20 bp, Artificial Sequence
  chemically synthesized
aactgctgctatcaagttgg

SEQ ID NO: 1242 - DNA, 20 bp, Artificial Sequence
  chemically synthesized
actgctgctatcaagttgga

SEQ ID NO: 1243 - DNA, 20 bp, Artificial Sequence
  chemically synthesized
gccaaaaatagatacagggg

SEQ ID NO: 1244 - DNA, 20 bp, Artificial Sequence
  chemically synthesized
acagccaaaaatagatacag

SEQ ID NO: 1245 - DNA, 20 bp, Artificial Sequence
  chemically synthesized
gacagccaaaaatagataca

SEQ ID NO: 1246 - DNA, 20 bp, Artificial Sequence
  chemically synthesized
ggacagccaaaaatagatac

SEQ ID NO: 1247 - DNA, 20 bp, Artificial Sequence
  chemically synthesized
tggacagccaaaaatagata

SEQ ID NO: 1248 - DNA, 20 bp, Artificial Sequence
  chemically synthesized
gcttcccctgtatctatttt

SEQ ID NO: 1249 - DNA, 20 bp, Artificial Sequence
  chemically synthesized
ggttgctggacagccaaaaa

SEQ ID NO: 1250 - DNA, 20 bp, Artificial Sequence
  chemically synthesized
tgtatctatttttggctgtc

SEQ ID NO: 1251 - DNA, 20 bp, Artificial Sequence
  chemically synthesized
gatttcccagggttgctgga

SEQ ID NO: 1252 - DNA, 20 bp, Artificial Sequence
  chemically synthesized
ttttggctgtccagcaaccc

SEQ ID NO: 1253 - DNA, 20 bp, Artificial Sequence
  chemically synthesized
tgcagatttcccagggttgc

SEQ ID NO: 1254 - DNA, 20 bp, Artificial Sequence
  chemically synthesized
tttggctgtccagcaaccct

SEQ ID NO: 1255 - DNA, 20 bp, Artificial Sequence
  chemically synthesized
ataattatgcagatttccca

SEQ ID NO: 1256 - DNA, 20 bp, Artificial Sequence
  chemically synthesized
aataattatgcagatttccc

SEQ ID NO: 1257 - DNA, 20 bp, Artificial Sequence
  chemically synthesized
gaataattatgcagatttcc

SEQ ID NO: 1258 - DNA, 20 bp, Artificial Sequence
  chemically synthesized
tttatgcatgaataattatg

SEQ ID NO: 1259 - DNA, 20 bp, Artificial Sequence
  chemically synthesized
aattattcatgcataaattg

SEQ ID NO: 1260 - DNA, 20 bp, Artificial Sequence
  chemically synthesized
attcatgcataaattgaaga

SEQ ID NO: 1261 - DNA, 20 bp, Artificial Sequence
  chemically synthesized
atgcataaattgaagataga

SEQ ID NO: 1262 - DNA, 20 bp, Artificial Sequence
  chemically synthesized
agtaattaaaaattggcagt

SEQ ID NO: 1263 - DNA, 20 bp, Artificial Sequence
  chemically synthesized
cgctagtaattaaaaattgg

SEQ ID NO: 1264 - DNA, 20 bp, Artificial Sequence
  chemically synthesized
gatcgctagtaattaaaaat

SEQ ID NO: 1265 - DNA, 20 bp, Artificial Sequence
  chemically synthesized
aactgccaatttttaattac

SEQ ID NO: 1266 - DNA, 20 bp, Artificial Sequence
  chemically synthesized
ttgttaaccgtaaagatcgc

SEQ ID NO: 1267 - DNA, 20 bp, Artificial Sequence
  chemically synthesized
ttaattactagcgatcttta

SEQ ID NO: 1268 - DNA, 20 bp, Artificial Sequence
  chemically synthesized
tactgattttgttaaccgta

SEQ ID NO: 1269 - DNA, 20 bp, Artificial Sequence
  chemically synthesized
atctttacggttaacaaaat

SEQ ID NO: 1270 - DNA, 20 bp, Artificial Sequence
  chemically synthesized
taacaaaatcagtaaaaaca

SEQ ID NO: 1271 - DNA, 20 bp, Artificial Sequence
  chemically synthesized
aaatcagtaaaaacaaagtc

SEQ ID NO: 1272 - DNA, 20 bp, Artificial Sequence
  chemically synthesized
aatcagtaaaaacaaagtcc

SEQ ID NO: 1273 - DNA, 20 bp, Artificial Sequence
  chemically synthesized
gcaccatgttgtaaaggtcc

SEQ ID NO: 1274 - DNA, 20 bp, Artificial Sequence
  chemically synthesized
attcaggcaccatgttgtaa

SEQ ID NO: 1275 - DNA, 20 bp, Artificial Sequence
  chemically synthesized
agtccaggacctttacaaca

SEQ ID NO: 1276 - DNA, 20 bp, Artificial Sequence
  chemically synthesized
cattcaggcaccatgttgta

SEQ ID NO: 1277 - DNA, 20 bp, Artificial Sequence
  chemically synthesized
aaatacttcgaattacattc

SEQ ID NO: 1278 - DNA, 20 bp, Artificial Sequence
  chemically synthesized
gaaatacttcgaattacatt

SEQ ID NO: 1279 - DNA, 20 bp, Artificial Sequence
  chemically synthesized
tggtgcctgaatgtaattcg

SEQ ID NO: 1280 - DNA, 20 bp, Artificial Sequence
  chemically synthesized
gtaattcgaagtatttctca

SEQ ID NO: 1281 - DNA, 20 bp, Artificial Sequence
  chemically synthesized
tatagtcacatgtgggccat

SEQ ID NO: 1282 - DNA, 20 bp, Artificial Sequence
  chemically synthesized
tacatactatagtcacatgt

SEQ ID NO: 1283 - DNA, 20 bp, Artificial Sequence
  chemically synthesized
ctacatactatagtcacatg

SEQ ID NO: 1284 - DNA, 20 bp, Artificial Sequence
  chemically synthesized
tcatggcccacatgtgacta

SEQ ID NO: 1285 - DNA, 20 bp, Artificial Sequence
  chemically synthesized
ccacatgtgactatagtatg

SEQ ID NO: 1286 - DNA, 20 bp, Artificial Sequence
  chemically synthesized
actaggtggactacatacta

SEQ ID NO: 1287 - DNA, 20 bp, Artificial Sequence
  chemically synthesized
actatagtatgtagtccacc

SEQ ID NO: 1288 - DNA, 20 bp, Artificial Sequence
  chemically synthesized
atagtatgtagtccacctag

SEQ ID NO: 1289 - DNA, 20 bp, Artificial Sequence
  chemically synthesized
tatgttttctagctactagg

SEQ ID NO: 1290 - DNA, 20 bp, Artificial Sequence
  chemically synthesized
tatgtagtccacctagtagc

SEQ ID NO: 1291 - DNA, 20 bp, Artificial Sequence
  chemically synthesized
taatatgttttctagctact

SEQ ID NO: 1292 - DNA, 20 bp, Artificial Sequence
  chemically synthesized
gtaatatgttttctagctac

SEQ ID NO: 1293 - DNA, 20 bp, Artificial Sequence
  chemically synthesized
atgttttgtaatatgttttc

SEQ ID NO: 1294 - DNA, 20 bp, Artificial Sequence
  chemically synthesized
tattacaaaacatcaacgaa

SEQ ID NO: 1295 - DNA, 20 bp, Artificial Sequence
  chemically synthesized
attacaaaacatcaacgaaa

SEQ ID NO: 1296 - DNA, 20 bp, Artificial Sequence
  chemically synthesized
ttacaaaacatcaacgaaaa

SEQ ID NO: 1297 - DNA, 20 bp, Artificial Sequence
  chemically synthesized
tacaaaacatcaacgaaaag

SEQ ID NO: 1298 - DNA, 20 bp, Artificial Sequence
  chemically synthesized
caaaacatcaacgaaaaggg

SEQ ID NO: 1299 - DNA, 20 bp, Artificial Sequence
  chemically synthesized
aagctgacaggaaaaaaaat

SEQ ID NO: 1300 - DNA, 20 bp, Artificial Sequence
  chemically synthesized
aaactcattttttttcctgt

SEQ ID NO: 1301 - DNA, 20 bp, Artificial Sequence
  chemically synthesized
gtgattatcgataagctgac

SEQ ID NO: 1302 - DNA, 20 bp, Artificial Sequence
  chemically synthesized
tgtgattatcgataagctga

SEQ ID NO: 1303 - DNA, 20 bp, Artificial Sequence
  chemically synthesized
gacactttgtgattatcgat

SEQ ID NO: 1304 - DNA, 20 bp, Artificial Sequence
  chemically synthesized
tcagcttatcgataatcaca

SEQ ID NO: 1305 - DNA, 20 bp, Artificial Sequence
  chemically synthesized
tcacaaagtgtctttctttt

SEQ ID NO: 1306 - DNA, 20 bp, Artificial Sequence
  chemically synthesized
cacaaagtgtctttcttttt

SEQ ID NO: 1307 - DNA, 20 bp, Artificial Sequence
  chemically synthesized
tagcacacagcctaaaaaga

SEQ ID NO: 1308 - DNA, 20 bp, Artificial Sequence
  chemically synthesized
cccctagcacacagcctaaa

SEQ ID NO: 1309 - DNA, 20 bp, Artificial Sequence
  chemically synthesized
tttctttttaggctgtgtgc

SEQ ID NO: 1310 - DNA, 20 bp, Artificial Sequence
  chemically synthesized
ttctttttaggctgtgtgct

SEQ ID NO: 1311 - DNA, 20 bp, Artificial Sequence
  chemically synthesized
tctttttaggctgtgtgcta

SEQ ID NO: 1312 - DNA, 20 bp, Artificial Sequence
  chemically synthesized
catctacatcccctagcaca

SEQ ID NO: 1313 - DNA, 20 bp, Artificial Sequence
  chemically synthesized
ctttttaggctgtgtgctag

SEQ ID NO: 1314 - DNA, 20 bp, Artificial Sequence
  chemically synthesized
aggctgtgtgctaggggatg

SEQ ID NO: 1315 - DNA, 20 bp, Artificial Sequence
  chemically synthesized
gaactgccatctacatcccc

SEQ ID NO: 1316 - DNA, 20 bp, Artificial Sequence
  chemically synthesized
tgtgtgctaggggatgtaga

SEQ ID NO: 1317 - DNA, 20 bp, Artificial Sequence
  chemically synthesized
gtgctaggggatgtagatgg

SEQ ID NO: 1318 - DNA, 20 bp, Artificial Sequence
  chemically synthesized
aaaacaaataaatgcattta

SEQ ID NO: 1319 - DNA, 20 bp, Artificial Sequence
  chemically synthesized
aaatgcatttatggattata

SEQ ID NO: 1320 - DNA, 20 bp, Artificial Sequence
  chemically synthesized
catttatggattatatagcc

SEQ ID NO: 1321 - DNA, 20 bp, Artificial Sequence
  chemically synthesized
ttatggattatatagccaag

SEQ ID NO: 1322 - DNA, 20 bp, Artificial Sequence
  chemically synthesized
caaggaagagaagcaccact

SEQ ID NO: 1323 - DNA, 20 bp, Artificial Sequence
  chemically synthesized
aacaccatttcaaggaagag

SEQ ID NO: 1324 - DNA, 20 bp, Artificial Sequence
  chemically synthesized
ctgaacaccatttcaaggaa

SEQ ID NO: 1325 - DNA, 20 bp, Artificial Sequence
  chemically synthesized
aactgaacaccatttcaagg

SEQ ID NO: 1326 - DNA, 20 bp, Artificial Sequence
  chemically synthesized
ggtgcttctcttccttgaaa

SEQ ID NO: 1327 - DNA, 20 bp, Artificial Sequence
  chemically synthesized
agtaactgaacaccatttca

SEQ ID NO: 1328 - DNA, 20 bp, Artificial Sequence
  chemically synthesized
tagtaactgaacaccatttc

SEQ ID NO: 1329 - DNA, 20 bp, Artificial Sequence
  chemically synthesized
ctcttccttgaaatggtgtt

SEQ ID NO: 1330 - DNA, 20 bp, Artificial Sequence
  chemically synthesized
aatggtgttcagttactaac

SEQ ID NO: 1331 - DNA, 20 bp, Artificial Sequence
  chemically synthesized
ggtgttcagttactaactgg

SEQ ID NO: 1332 - DNA, 20 bp, Artificial Sequence
  chemically synthesized
gtgttcagttactaactgga

SEQ ID NO: 1333 - DNA, 20 bp, Artificial Sequence
  chemically synthesized
tcaagaattttccttccagt

SEQ ID NO: 1334 - DNA, 20 bp, Artificial Sequence
  chemically synthesized
agactcaagaattttccttc

SEQ ID NO: 1335 - DNA, 20 bp, Artificial Sequence
  chemically synthesized
taactggaaggaaaattctt

SEQ ID NO: 1336 - DNA, 20 bp, Artificial Sequence
  chemically synthesized
ttatgcttcttgagagactc

SEQ ID NO: 1337 - DNA, 20 bp, Artificial Sequence
  chemically synthesized
ggaaaattcttgagtctctc

SEQ ID NO: 1338 - DNA, 20 bp, Artificial Sequence
  chemically synthesized
aaattcttgagtctctcaag

SEQ ID NO: 1339 - DNA, 20 bp, Artificial Sequence
  chemically synthesized
ctagaacttatgcttcttga

SEQ ID NO: 1340 - DNA, 20 bp, Artificial Sequence
  chemically synthesized
ccctagaacttatgcttctt

SEQ ID NO: 1341 - DNA, 20 bp, Artificial Sequence
  chemically synthesized
ttgagtctctcaagaagcat

SEQ ID NO: 1342 - DNA, 20 bp, Artificial Sequence
  chemically synthesized
ctctcaagaagcataagttc

SEQ ID NO: 1343 - DNA, 20 bp, Artificial Sequence
  chemically synthesized
tctcaagaagcataagttct

SEQ ID NO: 1344 - DNA, 20 bp, Artificial Sequence
  chemically synthesized
ctcaagaagcataagttcta

SEQ ID NO: 1345 - DNA, 20 bp, Artificial Sequence
  chemically synthesized
tcaagaagcataagttctag

SEQ ID NO: 1346 - DNA, 20 bp, Artificial Sequence
  chemically synthesized
ctttaaatagcagatacccc

SEQ ID NO: 1347 - DNA, 20 bp, Artificial Sequence
  chemically synthesized
ctaggggtatctgctattta

SEQ ID NO: 1348 - DNA, 20 bp, Artificial Sequence
  chemically synthesized
cctggcaaatctttaaatag

SEQ ID NO: 1349 - DNA, 20 bp, Artificial Sequence
  chemically synthesized
ttccctggcaaatctttaaa

SEQ ID NO: 1350 - DNA, 20 bp, Artificial Sequence
  chemically synthesized
tctgctatttaaagatttgc

SEQ ID NO: 1351 - DNA, 20 bp, Artificial Sequence
  chemically synthesized
ctgctatttaaagatttgcc

SEQ ID NO: 1352 - DNA, 20 bp, Artificial Sequence
  chemically synthesized
tgctatttaaagatttgcca

SEQ ID NO: 1353 - DNA, 20 bp, Artificial Sequence
  chemically synthesized
taaagatttgccagggaaaa

SEQ ID NO: 1354 - DNA, 20 bp, Artificial Sequence
  chemically synthesized
aataatgaacctgttttccc

SEQ ID NO: 1355 - DNA, 20 bp, Artificial Sequence
  chemically synthesized
aaagatttgccagggaaaac

SEQ ID NO: 1356 - DNA, 20 bp, Artificial Sequence
  chemically synthesized
cggagtgtgcatggcacatt

SEQ ID NO: 1357 - DNA, 20 bp, Artificial Sequence
  chemically synthesized
actttttgtcggagtgtgca

SEQ ID NO: 1358 - DNA, 20 bp, Artificial Sequence
  chemically synthesized
gccatgcacactccgacaaa

SEQ ID NO: 1359 - DNA, 20 bp, Artificial Sequence
  chemically synthesized
ggccacccaactttttgtcg

SEQ ID NO: 1360 - DNA, 20 bp, Artificial Sequence
  chemically synthesized
aaggccacccaactttttgt

SEQ ID NO: 1361 - DNA, 20 bp, Artificial Sequence
  chemically synthesized
tgcacactccgacaaaaagt

SEQ ID NO: 1362 - DNA, 20 bp, Artificial Sequence
  chemically synthesized
gcacactccgacaaaaagtt

SEQ ID NO: 1363 - DNA, 20 bp, Artificial Sequence
  chemically synthesized
cactccgacaaaaagttggg

SEQ ID NO: 1364 - DNA, 20 bp, Artificial Sequence
  chemically synthesized
aaagttgggtggcctttaac

SEQ ID NO: 1365 - DNA, 20 bp, Artificial Sequence
  chemically synthesized
cagcagtgtaaaccggttaa

SEQ ID NO: 1366 - DNA, 20 bp, Artificial Sequence
  chemically synthesized
gcagcagtgtaaaccggtta

SEQ ID NO: 1367 - DNA, 20 bp, Artificial Sequence
  chemically synthesized
gaaaatgcagcagtgtaaac

SEQ ID NO: 1368 - DNA, 20 bp, Artificial Sequence
  chemically synthesized
ggtcatttgtgaaaatgcag

SEQ ID NO: 1369 - DNA, 20 bp, Artificial Sequence
  chemically synthesized
caaggtcatttgtgaaaatg

SEQ ID NO: 1370 - DNA, 20 bp, Artificial Sequence
  chemically synthesized
cattttcacaaatgaccttg

SEQ ID NO: 1371 - DNA, 20 bp, Artificial Sequence
  chemically synthesized
atagcacaaagatggccaca

SEQ ID NO: 1372 - DNA, 20 bp, Artificial Sequence
  chemically synthesized
tatagcacaaagatggccac

SEQ ID NO: 1373 - DNA, 20 bp, Artificial Sequence
  chemically synthesized
ttatttttatagcacaaaga

SEQ ID NO: 1374 - DNA, 20 bp, Artificial Sequence
  chemically synthesized
ttctttatttttatagcaca

SEQ ID NO: 1375 - DNA, 20 bp, Artificial Sequence
  chemically synthesized
ctaaaagttctttattttta

SEQ ID NO: 1376 - DNA, 20 bp, Artificial Sequence
  chemically synthesized
atctttgtgctataaaaata

SEQ ID NO: 1377 - DNA, 20 bp, Artificial Sequence
  chemically synthesized
ctataaaaataaagaacttt

SEQ ID NO: 1378 - DNA, 20 bp, Artificial Sequence
  chemically synthesized
ataaaaataaagaactttta

SEQ ID NO: 1379 - DNA, 20 bp, Artificial Sequence
  chemically synthesized
agatgatgaggtgactctaa

SEQ ID NO: 1380 - DNA, 20 bp, Artificial Sequence
  chemically synthesized
aaggcataatatagatgatg

SEQ ID NO: 1381 - DNA, 20 bp, Artificial Sequence
  chemically synthesized
aaaggcataatatagatgat

SEQ ID NO: 1382 - DNA, 20 bp, Artificial Sequence
  chemically synthesized
aagtaaccaaaggcataata

SEQ ID NO: 1383 - DNA, 20 bp, Artificial Sequence
  chemically synthesized
catcatctatattatgcctt

SEQ ID NO: 1384 - DNA, 20 bp, Artificial Sequence
  chemically synthesized
gtatttagtgaagtaaccaa

SEQ ID NO: 1385 - DNA, 20 bp, Artificial Sequence
  chemically synthesized
ggtatttagtgaagtaacca

SEQ ID NO: 1386 - DNA, 20 bp, Artificial Sequence
  chemically synthesized
ggtaaagcaggtatttagtg

SEQ ID NO: 1387 - DNA, 20 bp, Artificial Sequence
  chemically synthesized
attctggtaaagcaggtatt

SEQ ID NO: 1388 - DNA, 20 bp, Artificial Sequence
  chemically synthesized
tcactaaatacctgctttac

SEQ ID NO: 1389 - DNA, 20 bp, Artificial Sequence
  chemically synthesized
attatttattctggtaaagc

SEQ ID NO: 1390 - DNA, 20 bp, Artificial Sequence
  chemically synthesized
aattatttattctggtaaag

SEQ ID NO: 1391 - DNA, 20 bp, Artificial Sequence
  chemically synthesized
tagaattatttattctggta

SEQ ID NO: 1392 - DNA, 20 bp, Artificial Sequence
  chemically synthesized
gaaattagaattatttattc

SEQ ID NO: 1393 - DNA, 20 bp, Artificial Sequence
  chemically synthesized
aaaactccatggaaagaaat

SEQ ID NO: 1394 - DNA, 20 bp, Artificial Sequence
  chemically synthesized
ataattctaatttctttcca

SEQ ID NO: 1395 - DNA, 20 bp, Artificial Sequence
  chemically synthesized
aattctaatttctttccatg

SEQ ID NO: 1396 - DNA, 20 bp, Artificial Sequence
  chemically synthesized
ctaatgaaaaactccatgga

SEQ ID NO: 1397 - DNA, 20 bp, Artificial Sequence
  chemically synthesized
ggatctaatgaaaaactcca

SEQ ID NO: 1398 - DNA, 20 bp, Artificial Sequence
  chemically synthesized
ctttccatggagtttttcat

SEQ ID NO: 1399 - DNA, 20 bp, Artificial Sequence
  chemically synthesized
atggagtttttcattagatc

SEQ ID NO: 1400 - DNA, 20 bp, Artificial Sequence
  chemically synthesized
ttttcattagatccagaaaa

SEQ ID NO: 1401 - DNA, 20 bp, Artificial Sequence
  chemically synthesized
agagattgacttcttttttc

SEQ ID NO: 1402 - DNA, 20 bp, Artificial Sequence
  chemically synthesized
tcattagatccagaaaaaag

SEQ ID NO: 1403 - DNA, 20 bp, Artificial Sequence
  chemically synthesized
agggcagtagtttgtaaaaa

SEQ ID NO: 1404 - DNA, 20 bp, Artificial Sequence
  chemically synthesized
ttagggcagtagtttgtaaa

SEQ ID NO: 1405 - DNA, 20 bp, Artificial Sequence
  chemically synthesized
agtatgattctttagggcag

SEQ ID NO: 1406 - DNA, 20 bp, Artificial Sequence
  chemically synthesized
ttttacaaactactgcccta

SEQ ID NO: 1407 - DNA, 20 bp, Artificial Sequence
  chemically synthesized
taaagtatgattctttaggg

SEQ ID NO: 1408 - DNA, 20 bp, Artificial Sequence
  chemically synthesized
gattaaagtatgattcttta

SEQ ID NO: 1409 - DNA, 20 bp, Artificial Sequence
  chemically synthesized
ggattaaagtatgattcttt

SEQ ID NO: 1410 - DNA, 20 bp, Artificial Sequence
  chemically synthesized
cggattaaagtatgattctt

SEQ ID NO: 1411 - DNA, 20 bp, Artificial Sequence
  chemically synthesized
cttacccctccaacggatta

SEQ ID NO: 1412 - DNA, 20 bp, Artificial Sequence
  chemically synthesized
agaatcatactttaatccgt

SEQ ID NO: 1413 - DNA, 20 bp, Artificial Sequence
  chemically synthesized
aatcatactttaatccgttg

SEQ ID NO: 1414 - DNA, 20 bp, Artificial Sequence
  chemically synthesized
atcatactttaatccgttgg

SEQ ID NO: 1415 - DNA, 20 bp, Artificial Sequence
  chemically synthesized
tcatactttaatccgttgga

SEQ ID NO: 1416 - DNA, 20 bp, Artificial Sequence
  chemically synthesized
catactttaatccgttggag

SEQ ID NO: 1417 - DNA, 20 bp, Artificial Sequence
  chemically synthesized
gtgcagtcttacccctccaa

SEQ ID NO: 1418 - DNA, 20 bp, Artificial Sequence
  chemically synthesized
ctttaatccgttggaggggt

SEQ ID NO: 1419 - DNA, 20 bp, Artificial Sequence
  chemically synthesized
tctatagtcatgtcacagtg

SEQ ID NO: 1420 - DNA, 20 bp, Artificial Sequence
  chemically synthesized
tactttctatagtcatgtca

SEQ ID NO: 1421 - DNA, 20 bp, Artificial Sequence
  chemically synthesized
actgcactgtgacatgacta

SEQ ID NO: 1422 - DNA, 20 bp, Artificial Sequence
  chemically synthesized
cactgtgacatgactataga

SEQ ID NO: 1423 - DNA, 20 bp, Artificial Sequence
  chemically synthesized
tgtgacatgactatagaaag

SEQ ID NO: 1424 - DNA, 20 bp, Artificial Sequence
  chemically synthesized
ggatacaaatctactttcta

SEQ ID NO: 1425 - DNA, 20 bp, Artificial Sequence
  chemically synthesized
tagaaagtagatttgtatcc

SEQ ID NO: 1426 - DNA, 20 bp, Artificial Sequence
  chemically synthesized
cacacatggataatagaact

SEQ ID NO: 1427 - DNA, 20 bp, Artificial Sequence
  chemically synthesized
acacacatggataatagaac

SEQ ID NO: 1428 - DNA, 20 bp, Artificial Sequence
  chemically synthesized
tgccttacacacatggataa

SEQ ID NO: 1429 - DNA, 20 bp, Artificial Sequence
  chemically synthesized
gttctattatccatgtgtgt

SEQ ID NO: 1430 - DNA, 20 bp, Artificial Sequence
  chemically synthesized
aatgctctgccttacacaca

SEQ ID NO: 1431 - DNA, 20 bp, Artificial Sequence
  chemically synthesized
ttctattatccatgtgtgta

SEQ ID NO: 1432 - DNA, 20 bp, Artificial Sequence
  chemically synthesized
tattatccatgtgtgtaagg

SEQ ID NO: 1433 - DNA, 20 bp, Artificial Sequence
  chemically synthesized
ttatccatgtgtgtaaggca

SEQ ID NO: 1434 - DNA, 20 bp, Artificial Sequence
  chemically synthesized
tgtgtgtaaggcagagcatt

SEQ ID NO: 1435 - DNA, 20 bp, Artificial Sequence
  chemically synthesized
gtgtgtaaggcagagcattc

SEQ ID NO: 1436 - DNA, 20 bp, Artificial Sequence
  chemically synthesized
gtgtaaggcagagcattcgg

SEQ ID NO: 1437 - DNA, 20 bp, Artificial Sequence
  chemically synthesized
tgtaaggcagagcattcggg

SEQ ID NO: 1438 - DNA, 20 bp, Artificial Sequence
  chemically synthesized
aggtcattaatgttacctga

SEQ ID NO: 1439 - DNA, 20 bp, Artificial Sequence
  chemically synthesized
tgactttagaaaaatctgtc

SEQ ID NO: 1440 - DNA, 20 bp, Artificial Sequence
  chemically synthesized
ttgactttagaaaaatctgt

SEQ ID NO: 1441 - DNA, 20 bp, Artificial Sequence
  chemically synthesized
ttacctgacagatttttcta

SEQ ID NO: 1442 - DNA, 20 bp, Artificial Sequence
  chemically synthesized
tgagattgtaattttgactt

SEQ ID NO: 1443 - DNA, 20 bp, Artificial Sequence
  chemically synthesized
cctctcatacttcatagtat

SEQ ID NO: 1444 - DNA, 20 bp, Artificial Sequence
  chemically synthesized
aattacaatctcatactatg

SEQ ID NO: 1445 - DNA, 20 bp, Artificial Sequence
  chemically synthesized
tcagtacctctcatacttca

SEQ ID NO: 1446 - DNA, 20 bp, Artificial Sequence
  chemically synthesized
aatctcatactatgaagtat

SEQ ID NO: 1447 - DNA, 20 bp, Artificial Sequence
  chemically synthesized
tctcatactatgaagtatga

SEQ ID NO: 1448 - DNA, 20 bp, Artificial Sequence
  chemically synthesized
ctcatactatgaagtatgag

SEQ ID NO: 1449 - DNA, 20 bp, Artificial Sequence
  chemically synthesized
gaagtatgagaggtactgaa

SEQ ID NO: 1450 - DNA, 20 bp, Artificial Sequence
  chemically synthesized
gtatgagaggtactgaaaag

SEQ ID NO: 1451 - DNA, 20 bp, Artificial Sequence
  chemically synthesized
cctgaatcctggctgctttt

SEQ ID NO: 1452 - DNA, 20 bp, Artificial Sequence
  chemically synthesized
gagaggtactgaaaagcagc

SEQ ID NO: 1453 - DNA, 20 bp, Artificial Sequence
  chemically synthesized
agaggtactgaaaagcagcc

SEQ ID NO: 1454 - DNA, 20 bp, Artificial Sequence
  chemically synthesized
actgaaaagcagccaggatt

SEQ ID NO: 1455 - DNA, 20 bp, Artificial Sequence
  chemically synthesized
ctgaaaagcagccaggattc

SEQ ID NO: 1456 - DNA, 20 bp, Artificial Sequence
  chemically synthesized
gattgcaaatgcctgaatcc

SEQ ID NO: 1457 - DNA, 20 bp, Artificial Sequence
  chemically synthesized
caggcatttgcaatcacctt

SEQ ID NO: 1458 - DNA, 20 bp, Artificial Sequence
  chemically synthesized
aggcatttgcaatcaccttc

SEQ ID NO: 1459 - DNA, 20 bp, Artificial Sequence
  chemically synthesized
ttctgtcaccttgtgcctga

SEQ ID NO: 1460 - DNA, 20 bp, Artificial Sequence
  chemically synthesized
ttgcaatcaccttcaggcac

SEQ ID NO: 1461 - DNA, 20 bp, Artificial Sequence
  chemically synthesized
tttctgtcaccttgtgcctg

SEQ ID NO: 1462 - DNA, 20 bp, Artificial Sequence
  chemically synthesized
tgcaatcaccttcaggcaca

SEQ ID NO: 1463 - DNA, 20 bp, Artificial Sequence
  chemically synthesized
caccttcaggcacaaggtga

SEQ ID NO: 1464 - DNA, 20 bp, Artificial Sequence
  chemically synthesized
gtgacagaaaactatgtcta

SEQ ID NO: 1465 - DNA, 20 bp, Artificial Sequence
  chemically synthesized
atcaatactttctatagaca

SEQ ID NO: 1466 - DNA, 20 bp, Artificial Sequence
  chemically synthesized
cagaaaactatgtctataga

SEQ ID NO: 1467 - DNA, 20 bp, Artificial Sequence
  chemically synthesized
gattaaatcaatactttcta

SEQ ID NO: 1468 - DNA, 20 bp, Artificial Sequence
  chemically synthesized
tattgatttaatccattctt

SEQ ID NO: 1469 - DNA, 20 bp, Artificial Sequence
  chemically synthesized
attgatttaatccattctta

SEQ ID NO: 1470 - DNA, 20 bp, Artificial Sequence
  chemically synthesized
tgttcaataatccttaagaa

SEQ ID NO: 1471 - DNA, 20 bp, Artificial Sequence
  chemically synthesized
ctttgtgttcaataatcctt

SEQ ID NO: 1472 - DNA, 20 bp, Artificial Sequence
  chemically synthesized
cttaaggattattgaacaca

SEQ ID NO: 1473 - DNA, 20 bp, Artificial Sequence
  chemically synthesized
ttaaggattattgaacacaa

SEQ ID NO: 1474 - DNA, 20 bp, Artificial Sequence
  chemically synthesized
ctgccctaatgttcaaggca

SEQ ID NO: 1475 - DNA, 20 bp, Artificial Sequence
  chemically synthesized
aggcactatgccttgaacat

SEQ ID NO: 1476 - DNA, 20 bp, Artificial Sequence
  chemically synthesized
tacaactgccctaatgttca

SEQ ID NO: 1477 - DNA, 20 bp, Artificial Sequence
  chemically synthesized
ggcactatgccttgaacatt

SEQ ID NO: 1478 - DNA, 20 bp, Artificial Sequence
  chemically synthesized
atacaactgccctaatgttc

SEQ ID NO: 1479 - DNA, 20 bp, Artificial Sequence
  chemically synthesized
gcactatgccttgaacatta

SEQ ID NO: 1480 - DNA, 20 bp, Artificial Sequence
  chemically synthesized
ctatgccttgaacattaggg

SEQ ID NO: 1481 - DNA, 20 bp, Artificial Sequence
  chemically synthesized
agggcagttgtatgtttttc

SEQ ID NO: 1482 - DNA, 20 bp, Artificial Sequence
  chemically synthesized
cagttgtatgtttttcaagt

SEQ ID NO: 1483 - DNA, 20 bp, Artificial Sequence
  chemically synthesized
gagactaaatgtgttgcagt

SEQ ID NO: 1484 - DNA, 20 bp, Artificial Sequence
  chemically synthesized
gtgtgagactaaatgtgttg

SEQ ID NO: 1485 - DNA, 20 bp, Artificial Sequence
  chemically synthesized
ggcgctaactgcaacacatt

SEQ ID NO: 1486 - DNA, 20 bp, Artificial Sequence
  chemically synthesized
ctcaggcagtggtgacgtgt

SEQ ID NO: 1487 - DNA, 20 bp, Artificial Sequence
  chemically synthesized
ctcacacgtcaccactgcct

SEQ ID NO: 1488 - DNA, 20 bp, Artificial Sequence
  chemically synthesized
tcacacgtcaccactgcctg

SEQ ID NO: 1489 - DNA, 20 bp, Artificial Sequence
  chemically synthesized
aaaacaattccctcaggcag

SEQ ID NO: 1490 - DNA, 20 bp, Artificial Sequence
  chemically synthesized
cacacgtcaccactgcctga

SEQ ID NO: 1491 - DNA, 20 bp, Artificial Sequence
  chemically synthesized
tggaaaacaattccctcagg

SEQ ID NO: 1492 - DNA, 20 bp, Artificial Sequence
  chemically synthesized
ctgtggaaaacaattccctc

SEQ ID NO: 1493 - DNA, 20 bp, Artificial Sequence
  chemically synthesized
gctgtggaaaacaattccct

SEQ ID NO: 1494 - DNA, 20 bp, Artificial Sequence
  chemically synthesized
cctgagggaattgttttcca

SEQ ID NO: 1495 - DNA, 20 bp, Artificial Sequence
  chemically synthesized
gaattgttttccacagcgat

SEQ ID NO: 1496 - DNA, 20 bp, Artificial Sequence
  chemically synthesized
agtctcaattccaatcgctg

SEQ ID NO: 1497 - DNA, 20 bp, Artificial Sequence
  chemically synthesized
tttccacagcgattggaatt

SEQ ID NO: 1498 - DNA, 20 bp, Artificial Sequence
  chemically synthesized
cgattggaattgagactttc

SEQ ID NO: 1499 - DNA, 20 bp, Artificial Sequence
  chemically synthesized
ggaattgagactttctggca

SEQ ID NO: 1500 - DNA, 20 bp, Artificial Sequence
  chemically synthesized
ggtcttggatctttgccaga

SEQ ID NO: 1501 - DNA, 20 bp, Artificial Sequence
  chemically synthesized
ttgaggtcttggatctttgc

SEQ ID NO: 1502 - DNA, 20 bp, Artificial Sequence
  chemically synthesized
agactttctggcaaagatcc

SEQ ID NO: 1503 - DNA, 20 bp, Artificial Sequence
  chemically synthesized
ccagattgctattgaggtct

SEQ ID NO: 1504 - DNA, 20 bp, Artificial Sequence
  chemically synthesized
gcaaagatccaagacctcaa

SEQ ID NO: 1505 - DNA, 20 bp, Artificial Sequence
  chemically synthesized
agagcaccagattgctattg

SEQ ID NO: 1506 - DNA, 20 bp, Artificial Sequence
  chemically synthesized
tagagcaccagattgctatt

SEQ ID NO: 1507 - DNA, 20 bp, Artificial Sequence
  chemically synthesized
ccaagacctcaatagcaatc

SEQ ID NO: 1508 - DNA, 20 bp, Artificial Sequence
  chemically synthesized
atttttaaaaaatagagcac

SEQ ID NO: 1509 - DNA, 20 bp, Artificial Sequence
  chemically synthesized
aattgtatttttaaaaaata

SEQ ID NO: 1510 - DNA, 20 bp, Artificial Sequence
  chemically synthesized
ggaattgtatttttaaaaaa

SEQ ID NO: 1511 - DNA, 20 bp, Artificial Sequence
  chemically synthesized
tgaatgctaacaatttattt

SEQ ID NO: 1512 - DNA, 20 bp, Artificial Sequence
  chemically synthesized
ctgaatgctaacaatttatt

SEQ ID NO: 1513 - DNA, 20 bp, Artificial Sequence
  chemically synthesized
acaattcccaaataaattgt

SEQ ID NO: 1514 - DNA, 20 bp, Artificial Sequence
  chemically synthesized
ccaaataaattgttagcatt

SEQ ID NO: 1515 - DNA, 20 bp, Artificial Sequence
  chemically synthesized
tgttagcattcagttgtcca

SEQ ID NO: 1516 - DNA, 20 bp, Artificial Sequence
  chemically synthesized
gttagcattcagttgtccaa

SEQ ID NO: 1517 - DNA, 20 bp, Artificial Sequence
  chemically synthesized
gcattcagttgtccaaagga

SEQ ID NO: 1518 - DNA, 20 bp, Artificial Sequence
  chemically synthesized
gtagtattccggctttcctt

SEQ ID NO: 1519 - DNA, 20 bp, Artificial Sequence
  chemically synthesized
tcagttgtccaaaggaaagc

SEQ ID NO: 1520 - DNA, 20 bp, Artificial Sequence
  chemically synthesized
caaatttccctgtagtattc

SEQ ID NO: 1521 - DNA, 20 bp, Artificial Sequence
  chemically synthesized
aaaggaaagccggaatacta

SEQ ID NO: 1522 - DNA, 20 bp, Artificial Sequence
  chemically synthesized
aaggaaagccggaatactac

SEQ ID NO: 1523 - DNA, 20 bp, Artificial Sequence
  chemically synthesized
aggaaagccggaatactaca

SEQ ID NO: 1524 - DNA, 20 bp, Artificial Sequence
  chemically synthesized
aagataagcaaatttccctg

SEQ ID NO: 1525 - DNA, 20 bp, Artificial Sequence
  chemically synthesized
aattatagagaagaaaagat

SEQ ID NO: 1526 - DNA, 20 bp, Artificial Sequence
  chemically synthesized
gattaaattatagagaagaa

SEQ ID NO: 1527 - DNA, 20 bp, Artificial Sequence
  chemically synthesized
tcagagattaaattatagag

SEQ ID NO: 1528 - DNA, 20 bp, Artificial Sequence
  chemically synthesized
ttttcagagattaaattata

SEQ ID NO: 1529 - DNA, 20 bp, Artificial Sequence
  chemically synthesized
ttttttcagagattaaatta

SEQ ID NO: 1530 - DNA, 20 bp, Artificial Sequence
  chemically synthesized
cgtaaagcagatttttttca

SEQ ID NO: 1531 - DNA, 20 bp, Artificial Sequence
  chemically synthesized
tacgtaaagcagattttttt

SEQ ID NO: 1532 - DNA, 20 bp, Artificial Sequence
  chemically synthesized
tatcccaaatgtacgtaaag

SEQ ID NO: 1533 - DNA, 20 bp, Artificial Sequence
  chemically synthesized
aaatatcccaaatgtacgta

SEQ ID NO: 1534 - DNA, 20 bp, Artificial Sequence
  chemically synthesized
aaatctgctttacgtacatt

SEQ ID NO: 1535 - DNA, 20 bp, Artificial Sequence
  chemically synthesized
aatctgctttacgtacattt

SEQ ID NO: 1536 - DNA, 20 bp, Artificial Sequence
  chemically synthesized
gtacatttgggatattttca

SEQ ID NO: 1537 - DNA, 20 bp, Artificial Sequence
  chemically synthesized
atattttcatagcattaaaa

SEQ ID NO: 1538 - DNA, 20 bp, Artificial Sequence
  chemically synthesized
tattttcatagcattaaaaa

SEQ ID NO: 1539 - DNA, 20 bp, Artificial Sequence
  chemically synthesized
tcattattgttttgattctt

SEQ ID NO: 1540 - DNA, 20 bp, Artificial Sequence
  chemically synthesized
tgttttgattctttggcttc

SEQ ID NO: 1541 - DNA, 20 bp, Artificial Sequence
  chemically synthesized
agacaagtttccagaagcca

SEQ ID NO: 1542 - DNA, 20 bp, Artificial Sequence
  chemically synthesized
gtgttcagacaagtttccag

SEQ ID NO: 1543 - DNA, 20 bp, Artificial Sequence
  chemically synthesized
atggtgttcagacaagtttc

SEQ ID NO: 1544 - DNA, 20 bp, Artificial Sequence
  chemically synthesized
gaggtgtatggtgttcagac

SEQ ID NO: 1545 - DNA, 20 bp, Artificial Sequence
  chemically synthesized
tacctgaggtgtatggtgtt

SEQ ID NO: 1546 - DNA, 20 bp, Artificial Sequence
  chemically synthesized
tgtctgaacaccatacacct

SEQ ID NO: 1547 - DNA, 20 bp, Artificial Sequence
  chemically synthesized
acttgactacctgaggtgta

SEQ ID NO: 1548 - DNA, 20 bp, Artificial Sequence
  chemically synthesized
gtctgaacaccatacacctc

SEQ ID NO: 1549 - DNA, 20 bp, Artificial Sequence
  chemically synthesized
tgaacaccatacacctcagg

SEQ ID NO: 1550 - DNA, 20 bp, Artificial Sequence
  chemically synthesized
tttgcagacttgactacctg

SEQ ID NO: 1551 - DNA, 20 bp, Artificial Sequence
  chemically synthesized
atttgcagacttgactacct

SEQ ID NO: 1552 - DNA, 20 bp, Artificial Sequence
  chemically synthesized
accatacacctcaggtagtc

SEQ ID NO: 1553 - DNA, 20 bp, Artificial Sequence
  chemically synthesized
tgaagttatataggcatttg

SEQ ID NO: 1554 - DNA, 20 bp, Artificial Sequence
  chemically synthesized
acatgtaattgaagttatat

SEQ ID NO: 1555 - DNA, 20 bp, Artificial Sequence
  chemically synthesized
cacatgtaattgaagttata

SEQ ID NO: 1556 - DNA, 20 bp, Artificial Sequence
  chemically synthesized
aaggctagcacatgtaattg

SEQ ID NO: 1557 - DNA, 20 bp, Artificial Sequence
  chemically synthesized
ataacttcaattacatgtgc

SEQ ID NO: 1558 - DNA, 20 bp, Artificial Sequence
  chemically synthesized
aaatgaatttcagaaaaggc

SEQ ID NO: 1559 - DNA, 20 bp, Artificial Sequence
  chemically synthesized
tcacaaatgaatttcagaaa

SEQ ID NO: 1560 - DNA, 20 bp, Artificial Sequence
  chemically synthesized
ctcacaaatgaatttcagaa

SEQ ID NO: 1561 - DNA, 20 bp, Artificial Sequence
  chemically synthesized
tttcactcacaaatgaattt

SEQ ID NO: 1562 - DNA, 20 bp, Artificial Sequence
  chemically synthesized
cttttctgaaattcatttgt

SEQ ID NO: 1563 - DNA, 20 bp, Artificial Sequence
  chemically synthesized
tttgtgagtgaaacatgttt

SEQ ID NO: 1564 - DNA, 20 bp, Artificial Sequence
  chemically synthesized
ttgtgagtgaaacatgttta

SEQ ID NO: 1565 - DNA, 20 bp, Artificial Sequence
  chemically synthesized
tgagtgaaacatgtttaagg

SEQ ID NO: 1566 - DNA, 20 bp, Artificial Sequence
  chemically synthesized
gtttaaggtggtcaaaatta

SEQ ID NO: 1567 - DNA, 20 bp, Artificial Sequence
  chemically synthesized
atggtgcatttttctacaaa

SEQ ID NO: 1568 - DNA, 20 bp, Artificial Sequence
  chemically synthesized
ttattcattttaactttttg

SEQ ID NO: 1569 - DNA, 20 bp, Artificial Sequence
  chemically synthesized
agttaaaatgaataaatttt

SEQ ID NO: 1570 - DNA, 20 bp, Artificial Sequence
  chemically synthesized
gttaaaatgaataaatttta

SEQ ID NO: 1571 - DNA, 20 bp, Artificial Sequence
  chemically synthesized
ttaaaatgaataaattttaa

SEQ ID NO: 1572 - DNA, 20 bp, Artificial Sequence
  chemically synthesized
taaaatgaataaattttaag

SEQ ID NO: 1573 - DNA, 20 bp, Artificial Sequence
  chemically synthesized
ttttaaggggcacttaccat

SEQ ID NO: 1574 - DNA, 20 bp, Artificial Sequence
  chemically synthesized
cttgggttcattcttatggt

SEQ ID NO: 1575 - DNA, 20 bp, Artificial Sequence
  chemically synthesized
acttcttgggttcattctta

SEQ ID NO: 1576 - DNA, 20 bp, Artificial Sequence
  chemically synthesized
cttaccataagaatgaaccc

SEQ ID NO: 1577 - DNA, 20 bp, Artificial Sequence
  chemically synthesized
accataagaatgaacccaag

SEQ ID NO: 1578 - DNA, 20 bp, Artificial Sequence
  chemically synthesized
cttcgtatgtgagacttctt

SEQ ID NO: 1579 - DNA, 20 bp, Artificial Sequence
  chemically synthesized
acttcgtatgtgagacttct

SEQ ID NO: 1580 - DNA, 20 bp, Artificial Sequence
  chemically synthesized
cccaagaagtctcacatacg

SEQ ID NO: 1581 - DNA, 20 bp, Artificial Sequence
  chemically synthesized
ggttcatgtacttcgtatgt

SEQ ID NO: 1582 - DNA, 20 bp, Artificial Sequence
  chemically synthesized
cacatacgaagtacatgaac

SEQ ID NO: 1583 - DNA, 20 bp, Artificial Sequence
  chemically synthesized
acatacgaagtacatgaacc

SEQ ID NO: 1584 - DNA, 20 bp, Artificial Sequence
  chemically synthesized
aatgcccctgacggtttgcc

SEQ ID NO: 1585 - DNA, 20 bp, Artificial Sequence
  chemically synthesized
acatgaaccaggcaaaccgt

SEQ ID NO: 1586 - DNA, 20 bp, Artificial Sequence
  chemically synthesized
catgaaccaggcaaaccgtc

SEQ ID NO: 1587 - DNA, 20 bp, Artificial Sequence
  chemically synthesized
atgaaccaggcaaaccgtca

SEQ ID NO: 1588 - DNA, 20 bp, Artificial Sequence
  chemically synthesized
tgaaccaggcaaaccgtcag

SEQ ID NO: 1589 - DNA, 20 bp, Artificial Sequence
  chemically synthesized
gaagcattgaatgcccctga

SEQ ID NO: 1590 - DNA, 20 bp, Artificial Sequence
  chemically synthesized
ggggcattcaatgcttcacc

SEQ ID NO: 1591 - DNA, 20 bp, Artificial Sequence
  chemically synthesized
tgaggaaacctgacttggtg

SEQ ID NO: 1592 - DNA, 20 bp, Artificial Sequence
  chemically synthesized
cattcaatgcttcaccaagt

SEQ ID NO: 1593 - DNA, 20 bp, Artificial Sequence
  chemically synthesized
attcaatgcttcaccaagtc

SEQ ID NO: 1594 - DNA, 20 bp, Artificial Sequence
  chemically synthesized
gaaattgaggaaacctgact

SEQ ID NO: 1595 - DNA, 20 bp, Artificial Sequence
  chemically synthesized
taggctgggaggagaaattg

SEQ ID NO: 1596 - DNA, 20 bp, Artificial Sequence
  chemically synthesized
gtaggctgggaggagaaatt

SEQ ID NO: 1597 - DNA, 20 bp, Artificial Sequence
  chemically synthesized
gtttcctcaatttctcctcc

SEQ ID NO: 1598 - DNA, 20 bp, Artificial Sequence
  chemically synthesized
agggaatggtaggctgggag

SEQ ID NO: 1599 - DNA, 20 bp, Artificial Sequence
  chemically synthesized
ggagggaatggtaggctggg

SEQ ID NO: 1600 - DNA, 20 bp, Artificial Sequence
  chemically synthesized
gggagggaatggtaggctgg

SEQ ID NO: 1601 - DNA, 20 bp, Artificial Sequence
  chemically synthesized
cagggagggaatggtaggct

SEQ ID NO: 1602 - DNA, 20 bp, Artificial Sequence
  chemically synthesized
ccagggagggaatggtaggc

SEQ ID NO: 1603 - DNA, 20 bp, Artificial Sequence
  chemically synthesized
ggggccagggagggaatggt

SEQ ID NO: 1604 - DNA, 20 bp, Artificial Sequence
  chemically synthesized
tggggccagggagggaatgg

SEQ ID NO: 1605 - DNA, 20 bp, Artificial Sequence
  chemically synthesized
cagtggggccagggagggaa

SEQ ID NO: 1606 - DNA, 20 bp, Artificial Sequence
  chemically synthesized
ccagcctaccattccctccc

SEQ ID NO: 1607 - DNA, 20 bp, Artificial Sequence
  chemically synthesized
ttgggcagtggggccaggga

SEQ ID NO: 1608 - DNA, 20 bp, Artificial Sequence
  chemically synthesized
tttgggcagtggggccaggg

SEQ ID NO: 1609 - DNA, 20 bp, Artificial Sequence
  chemically synthesized
ctttgggcagtggggccagg

SEQ ID NO: 1610 - DNA, 20 bp, Artificial Sequence
  chemically synthesized
ggctttgggcagtggggcca

SEQ ID NO: 1611 - DNA, 20 bp, Artificial Sequence
  chemically synthesized
aggctttgggcagtggggcc

SEQ ID NO: 1612 - DNA, 20 bp, Artificial Sequence
  chemically synthesized
aaggctttgggcagtggggc

SEQ ID NO: 1613 - DNA, 20 bp, Artificial Sequence
  chemically synthesized
ttccaaggctttgggcagtg

SEQ ID NO: 1614 - DNA, 20 bp, Artificial Sequence
  chemically synthesized
cttccaaggctttgggcagt

SEQ ID NO: 1615 - DNA, 20 bp, Artificial Sequence
  chemically synthesized
ctccctggccccactgccca

SEQ ID NO: 1616 - DNA, 20 bp, Artificial Sequence
  chemically synthesized
ccttccaaggctttgggcag

SEQ ID NO: 1617 - DNA, 20 bp, Artificial Sequence
  chemically synthesized
cctccttccaaggctttggg

SEQ ID NO: 1618 - DNA, 20 bp, Artificial Sequence
  chemically synthesized
ggccccactgcccaaagcct

SEQ ID NO: 1619 - DNA, 20 bp, Artificial Sequence
  chemically synthesized
gtgcctccttccaaggcttt

SEQ ID NO: 1620 - DNA, 20 bp, Artificial Sequence
  chemically synthesized
agtgcctccttccaaggctt

SEQ ID NO: 1621 - DNA, 20 bp, Artificial Sequence
  chemically synthesized
cccactgcccaaagccttgg

SEQ ID NO: 1622 - DNA, 20 bp, Artificial Sequence
  chemically synthesized
ccactgcccaaagccttgga

SEQ ID NO: 1623 - DNA, 20 bp, Artificial Sequence
  chemically synthesized
actgcccaaagccttggaag

SEQ ID NO: 1624 - DNA, 20 bp, Artificial Sequence
  chemically synthesized
ctgcccaaagccttggaagg

SEQ ID NO: 1625 - DNA, 20 bp, Artificial Sequence
  chemically synthesized
tgtgccagtgcctccttcca

SEQ ID NO: 1626 - DNA, 20 bp, Artificial Sequence
  chemically synthesized
ctgtgccagtgcctccttcc

SEQ ID NO: 1627 - DNA, 20 bp, Artificial Sequence
  chemically synthesized
aaagccttggaaggaggcac

SEQ ID NO: 1628 - DNA, 20 bp, Artificial Sequence
  chemically synthesized
cttggaaggaggcactggca

SEQ ID NO: 1629 - DNA, 20 bp, Artificial Sequence
  chemically synthesized
attcttcagtgtgtctgtgc

SEQ ID NO: 1630 - DNA, 20 bp, Artificial Sequence
  chemically synthesized
gcactggcacagacacactg

SEQ ID NO: 1631 - DNA, 20 bp, Artificial Sequence
  chemically synthesized
taatcaatttaatgattctt

SEQ ID NO: 1632 - DNA, 20 bp, Artificial Sequence
  chemically synthesized
tgaagaatcattaaattgat

SEQ ID NO: 1633 - DNA, 20 bp, Artificial Sequence
  chemically synthesized
ttaaattgattagacttgta

SEQ ID NO: 1634 - DNA, 20 bp, Artificial Sequence
  chemically synthesized
ctgccaacatcatgccatac

SEQ ID NO: 1635 - DNA, 20 bp, Artificial Sequence
  chemically synthesized
agacttgtatggcatgatgt

SEQ ID NO: 1636 - DNA, 20 bp, Artificial Sequence
  chemically synthesized
cttgtatggcatgatgttgg

SEQ ID NO: 1637 - DNA, 20 bp, Artificial Sequence
  chemically synthesized
tgtatggcatgatgttggca

SEQ ID NO: 1638 - DNA, 20 bp, Artificial Sequence
  chemically synthesized
actgattcatttaaacacag

SEQ ID NO: 1639 - DNA, 20 bp, Artificial Sequence
  chemically synthesized
ccactgattcatttaaacac

SEQ ID NO: 1640 - DNA, 20 bp, Artificial Sequence
  chemically synthesized
accactgattcatttaaaca

SEQ ID NO: 1641 - DNA, 20 bp, Artificial Sequence
  chemically synthesized
actcctgtgtttaaatgaat

SEQ ID NO: 1642 - DNA, 20 bp, Artificial Sequence
  chemically synthesized
cctgtgtttaaatgaatcag

SEQ ID NO: 1643 - DNA, 20 bp, Artificial Sequence
  chemically synthesized
aaatgaatcagtggtctctc

SEQ ID NO: 1644 - DNA, 20 bp, Artificial Sequence
  chemically synthesized
tagcaacaggatggactgga

SEQ ID NO: 1645 - DNA, 20 bp, Artificial Sequence
  chemically synthesized
cttagcaacaggatggactg

SEQ ID NO: 1646 - DNA, 20 bp, Artificial Sequence
  chemically synthesized
tccttagcaacaggatggac

SEQ ID NO: 1647 - DNA, 20 bp, Artificial Sequence
  chemically synthesized
tggattccttagcaacagga

SEQ ID NO: 1648 - DNA, 20 bp, Artificial Sequence
  chemically synthesized
ctccagtccatcctgttgct

SEQ ID NO: 1649 - DNA, 20 bp, Artificial Sequence
  chemically synthesized
tccagtccatcctgttgcta

SEQ ID NO: 1650 - DNA, 20 bp, Artificial Sequence
  chemically synthesized
attctggattccttagcaac

SEQ ID NO: 1651 - DNA, 20 bp, Artificial Sequence
  chemically synthesized
gattctggattccttagcaa

SEQ ID NO: 1652 - DNA, 20 bp, Artificial Sequence
  chemically synthesized
catcctgttgctaaggaatc

SEQ ID NO: 1653 - DNA, 20 bp, Artificial Sequence
  chemically synthesized
tgagaagattctggattcct

SEQ ID NO: 1654 - DNA, 20 bp, Artificial Sequence
  chemically synthesized
cttcttaaatgagaagattc

SEQ ID NO: 1655 - DNA, 20 bp, Artificial Sequence
  chemically synthesized
aatccagaatcttctcattt

SEQ ID NO: 1656 - DNA, 20 bp, Artificial Sequence
  chemically synthesized
gagagtccttcttaaatgag

SEQ ID NO: 1657 - DNA, 20 bp, Artificial Sequence
  chemically synthesized
ccagaatcttctcatttaag

SEQ ID NO: 1658 - DNA, 20 bp, Artificial Sequence
  chemically synthesized
gtggagagtccttcttaaat

SEQ ID NO: 1659 - DNA, 20 bp, Artificial Sequence
  chemically synthesized
cagaatcttctcatttaaga

SEQ ID NO: 1660 - DNA, 20 bp, Artificial Sequence
  chemically synthesized
agacaggctggatgggtgga

SEQ ID NO: 1661 - DNA, 20 bp, Artificial Sequence
  chemically synthesized
ggagacaggctggatgggtg

SEQ ID NO: 1662 - DNA, 20 bp, Artificial Sequence
  chemically synthesized
agaaggactctccacccatc

SEQ ID NO: 1663 - DNA, 20 bp, Artificial Sequence
  chemically synthesized
tgggagacaggctggatggg

SEQ ID NO: 1664 - DNA, 20 bp, Artificial Sequence
  chemically synthesized
ttctgggagacaggctggat

SEQ ID NO: 1665 - DNA, 20 bp, Artificial Sequence
  chemically synthesized
gttctgggagacaggctgga

SEQ ID NO: 1666 - DNA, 20 bp, Artificial Sequence
  chemically synthesized
cagtgttctgggagacaggc

SEQ ID NO: 1667 - DNA, 20 bp, Artificial Sequence
  chemically synthesized
cacccatccagcctgtctcc

SEQ ID NO: 1668 - DNA, 20 bp, Artificial Sequence
  chemically synthesized
atgacagtgttctgggagac

SEQ ID NO: 1669 - DNA, 20 bp, Artificial Sequence
  chemically synthesized
gatgacagtgttctgggaga

SEQ ID NO: 1670 - DNA, 20 bp, Artificial Sequence
  chemically synthesized
atgggatgacagtgttctgg

SEQ ID NO: 1671 - DNA, 20 bp, Artificial Sequence
  chemically synthesized
ccatgggatgacagtgttct

SEQ ID NO: 1672 - DNA, 20 bp, Artificial Sequence
  chemically synthesized
cccatgggatgacagtgttc

SEQ ID NO: 1673 - DNA, 20 bp, Artificial Sequence
  chemically synthesized
aaagctctcccatgggatga

SEQ ID NO: 1674 - DNA, 20 bp, Artificial Sequence
  chemically synthesized
cccagaacactgtcatccca

SEQ ID NO: 1675 - DNA, 20 bp, Artificial Sequence
  chemically synthesized
ccagaacactgtcatcccat

SEQ ID NO: 1676 - DNA, 20 bp, Artificial Sequence
  chemically synthesized
agaacactgtcatcccatgg

SEQ ID NO: 1677 - DNA, 20 bp, Artificial Sequence
  chemically synthesized
aacactgtcatcccatggga

SEQ ID NO: 1678 - DNA, 20 bp, Artificial Sequence
  chemically synthesized
gagaaggaaagctctcccat

SEQ ID NO: 1679 - DNA, 20 bp, Artificial Sequence
  chemically synthesized
agagaaggaaagctctccca

SEQ ID NO: 1680 - DNA, 20 bp, Artificial Sequence
  chemically synthesized
tctgaaggaggagagaagga

SEQ ID NO: 1681 - DNA, 20 bp, Artificial Sequence
  chemically synthesized
ttaatctgaaggaggagaga

SEQ ID NO: 1682 - DNA, 20 bp, Artificial Sequence
  chemically synthesized
tttaatctgaaggaggagag

SEQ ID NO: 1683 - DNA, 20 bp, Artificial Sequence
  chemically synthesized
gaatttaatctgaaggagga

SEQ ID NO: 1684 - DNA, 20 bp, Artificial Sequence
  chemically synthesized
gctttccttctctcctcctt

SEQ ID NO: 1685 - DNA, 20 bp, Artificial Sequence
  chemically synthesized
aagaatttaatctgaaggag

SEQ ID NO: 1686 - DNA, 20 bp, Artificial Sequence
  chemically synthesized
ccaagaatttaatctgaagg

SEQ ID NO: 1687 - DNA, 20 bp, Artificial Sequence
  chemically synthesized
accaagaatttaatctgaag

SEQ ID NO: 1688 - DNA, 20 bp, Artificial Sequence
  chemically synthesized
ttaccaagaatttaatctga

SEQ ID NO: 1689 - DNA, 20 bp, Artificial Sequence
  chemically synthesized
tttaccaagaatttaatctg

SEQ ID NO: 1690 - DNA, 20 bp, Artificial Sequence
  chemically synthesized
cctccttcagattaaattct

SEQ ID NO: 1691 - DNA, 20 bp, Artificial Sequence
  chemically synthesized
ttcagattaaattcttggta

SEQ ID NO: 1692 - DNA, 20 bp, Artificial Sequence
  chemically synthesized
aaatcaaggttgtctttacc

SEQ ID NO: 1693 - DNA, 20 bp, Artificial Sequence
  chemically synthesized
tgacagcccaagtaaaatca

SEQ ID NO: 1694 - DNA, 20 bp, Artificial Sequence
  chemically synthesized
ctgacagcccaagtaaaatc

SEQ ID NO: 1695 - DNA, 20 bp, Artificial Sequence
  chemically synthesized
aagacaaccttgattttact

SEQ ID NO: 1696 - DNA, 20 bp, Artificial Sequence
  chemically synthesized
agacaaccttgattttactt

SEQ ID NO: 1697 - DNA, 20 bp, Artificial Sequence
  chemically synthesized
cttgattttacttgggctgt

SEQ ID NO: 1698 - DNA, 20 bp, Artificial Sequence
  chemically synthesized
aaagtgttaactgacagccc

SEQ ID NO: 1699 - DNA, 20 bp, Artificial Sequence
  chemically synthesized
gatgacaaagtgttaactga

SEQ ID NO: 1700 - DNA, 20 bp, Artificial Sequence
  chemically synthesized
taagtgactgttggatgaca

SEQ ID NO: 1701 - DNA, 20 bp, Artificial Sequence
  chemically synthesized
gttaacactttgtcatccaa

SEQ ID NO: 1702 - DNA, 20 bp, Artificial Sequence
  chemically synthesized
ttacctaattaagtgactgt

SEQ ID NO: 1703 - DNA, 20 bp, Artificial Sequence
  chemically synthesized
tcatccaacagtcacttaat

SEQ ID NO: 1704 - DNA, 20 bp, Artificial Sequence
  chemically synthesized
catccaacagtcacttaatt

SEQ ID NO: 1705 - DNA, 20 bp, Artificial Sequence
  chemically synthesized
gaatatcgaattacctaatt

SEQ ID NO: 1706 - DNA, 20 bp, Artificial Sequence
  chemically synthesized
taattaggtaattcgatatt

SEQ ID NO: 1707 - DNA, 20 bp, Artificial Sequence
  chemically synthesized
cgatattcagacaatattcc

SEQ ID NO: 1708 - DNA, 20 bp, Artificial Sequence
  chemically synthesized
tattcagacaatattcctgg

SEQ ID NO: 1709 - DNA, 20 bp, Artificial Sequence
  chemically synthesized
agacaatattcctggtggaa

SEQ ID NO: 1710 - DNA, 20 bp, Artificial Sequence
  chemically synthesized
cttcttactcctattccacc

SEQ ID NO: 1711 - DNA, 20 bp, Artificial Sequence
  chemically synthesized
gacaatattcctggtggaat

SEQ ID NO: 1712 - DNA, 20 bp, Artificial Sequence
  chemically synthesized
gcttcttactcctattccac

SEQ ID NO: 1713 - DNA, 20 bp, Artificial Sequence
  chemically synthesized
caatattcctggtggaatag

SEQ ID NO: 1714 - DNA, 20 bp, Artificial Sequence
  chemically synthesized
attcctggtggaataggagt

SEQ ID NO: 1715 - DNA, 20 bp, Artificial Sequence
  chemically synthesized
cctggtggaataggagtaag

SEQ ID NO: 1716 - DNA, 20 bp, Artificial Sequence
  chemically synthesized
ggtttcaggttttacggtga

SEQ ID NO: 1717 - DNA, 20 bp, Artificial Sequence
  chemically synthesized
gaatgtggtttcaggtttta

SEQ ID NO: 1718 - DNA, 20 bp, Artificial Sequence
  chemically synthesized
ttatcactgaatgtggtttc

SEQ ID NO: 1719 - DNA, 20 bp, Artificial Sequence
  chemically synthesized
cttatcactgaatgtggttt

SEQ ID NO: 1720 - DNA, 20 bp, Artificial Sequence
  chemically synthesized
gtaaaacctgaaaccacatt

SEQ ID NO: 1721 - DNA, 20 bp, Artificial Sequence
  chemically synthesized
tgcagtcttatcactgaatg

SEQ ID NO: 1722 - DNA, 20 bp, Artificial Sequence
  chemically synthesized
ctgaaaccacattcagtgat

SEQ ID NO: 1723 - DNA, 20 bp, Artificial Sequence
  chemically synthesized
gggttgaaagggatagggtg

SEQ ID NO: 1724 - DNA, 20 bp, Artificial Sequence
  chemically synthesized
tttatgggttgaaagggata

SEQ ID NO: 1725 - DNA, 20 bp, Artificial Sequence
  chemically synthesized
atttatgggttgaaagggat

SEQ ID NO: 1726 - DNA, 20 bp, Artificial Sequence
  chemically synthesized
tatttatgggttgaaaggga

SEQ ID NO: 1727 - DNA, 20 bp, Artificial Sequence
  chemically synthesized
tgcctatttatgggttgaaa

SEQ ID NO: 1728 - DNA, 20 bp, Artificial Sequence
  chemically synthesized
atgcctatttatgggttgaa

SEQ ID NO: 1729 - DNA, 20 bp, Artificial Sequence
  chemically synthesized
aatgcctatttatgggttga

SEQ ID NO: 1730 - DNA, 20 bp, Artificial Sequence
  chemically synthesized
tatccctttcaacccataaa

SEQ ID NO: 1731 - DNA, 20 bp, Artificial Sequence
  chemically synthesized
atccctttcaacccataaat

SEQ ID NO: 1732 - DNA, 20 bp, Artificial Sequence
  chemically synthesized
tttttaaaatgcctatttat

SEQ ID NO: 1733 - DNA, 20 bp, Artificial Sequence
  chemically synthesized
gtttttaaaatgcctattta

SEQ ID NO: 1734 - DNA, 20 bp, Artificial Sequence
  chemically synthesized
ttaaatattggagttttgag

SEQ ID NO: 1735 - DNA, 20 bp, Artificial Sequence
  chemically synthesized
attaaatattggagttttga

SEQ ID NO: 1736 - DNA, 20 bp, Artificial Sequence
  chemically synthesized
aaattaaatattggagtttt

SEQ ID NO: 1737 - DNA, 20 bp, Artificial Sequence
  chemically synthesized
gattaaaaaattaaatattg

SEQ ID NO: 1738 - DNA, 20 bp, Artificial Sequence
  chemically synthesized
tcgattaaaaaattaaatat

SEQ ID NO: 1739 - DNA, 20 bp, Artificial Sequence
  chemically synthesized
atttaattttttaatcgaat

SEQ ID NO: 1740 - DNA, 20 bp, Artificial Sequence
  chemically synthesized
gaattggttattgttctgtg

SEQ ID NO: 1741 - DNA, 20 bp, Artificial Sequence
  chemically synthesized
atttggtatttgaagccaca

SEQ ID NO: 1742 - DNA, 20 bp, Artificial Sequence
  chemically synthesized
tcttttttatttggtatttg

SEQ ID NO: 1743 - DNA, 20 bp, Artificial Sequence
  chemically synthesized
gcttcaaataccaaataaaa

SEQ ID NO: 1744 - DNA, 20 bp, Artificial Sequence
  chemically synthesized
agaagatgatcttttttatt

SEQ ID NO: 1745 - DNA, 20 bp, Artificial Sequence
  chemically synthesized
ataaaaaagatcatcttctg

SEQ ID NO: 1746 - DNA, 20 bp, Artificial Sequence
  chemically synthesized
taaaaaagatcatcttctga

SEQ ID NO: 1747 - DNA, 20 bp, Artificial Sequence
  chemically synthesized
aaaaaagatcatcttctgaa

SEQ ID NO: 1748 - DNA, 20 bp, Artificial Sequence
  chemically synthesized
catctcaacgtacccttcag

SEQ ID NO: 1749 - DNA, 20 bp, Artificial Sequence
  chemically synthesized
catcatctcaacgtaccctt

SEQ ID NO: 1750 - DNA, 20 bp, Artificial Sequence
  chemically synthesized
catcttctgaagggtacgtt

SEQ ID NO: 1751 - DNA, 20 bp, Artificial Sequence
  chemically synthesized
agggtacgttgagatgatgt

SEQ ID NO: 1752 - DNA, 20 bp, Artificial Sequence
  chemically synthesized
atgatgtaagcctttcaaat

SEQ ID NO: 1753 - DNA, 20 bp, Artificial Sequence
  chemically synthesized
actcttaactctcatttgaa

SEQ ID NO: 1754 - DNA, 20 bp, Artificial Sequence
  chemically synthesized
cactcttaactctcatttga

SEQ ID NO: 1755 - DNA, 20 bp, Artificial Sequence
  chemically synthesized
gatgtaagcctttcaaatga

SEQ ID NO: 1756 - DNA, 20 bp, Artificial Sequence
  chemically synthesized
aagcctttcaaatgagagtt

SEQ ID NO: 1757 - DNA, 20 bp, Artificial Sequence
  chemically synthesized
gcctttcaaatgagagttaa

SEQ ID NO: 1758 - DNA, 20 bp, Artificial Sequence
  chemically synthesized
tcaaatgagagttaagagtg

SEQ ID NO: 1759 - DNA, 20 bp, Artificial Sequence
  chemically synthesized
caaatgagagttaagagtgt

SEQ ID NO: 1760 - DNA, 20 bp, Artificial Sequence
  chemically synthesized
gagagttaagagtgtgggtc

SEQ ID NO: 1761 - DNA, 20 bp, Artificial Sequence
  chemically synthesized
gagttaagagtgtgggtctg

SEQ ID NO: 1762 - DNA, 20 bp, Artificial Sequence
  chemically synthesized
taagagtgtgggtctggagc

SEQ ID NO: 1763 - DNA, 20 bp, Artificial Sequence
  chemically synthesized
ggatccaggcagtctggctc

SEQ ID NO: 1764 - DNA, 20 bp, Artificial Sequence
  chemically synthesized
gggtctggagccagactgcc

SEQ ID NO: 1765 - DNA, 20 bp, Artificial Sequence
  chemically synthesized
ggatttggatccaggcagtc

SEQ ID NO: 1766 - DNA, 20 bp, Artificial Sequence
  chemically synthesized
gccaaggatttggatccagg

SEQ ID NO: 1767 - DNA, 20 bp, Artificial Sequence
  chemically synthesized
agagccaaggatttggatcc

SEQ ID NO: 1768 - DNA, 20 bp, Artificial Sequence
  chemically synthesized
cagagccaaggatttggatc

SEQ ID NO: 1769 - DNA, 20 bp, Artificial Sequence
  chemically synthesized
actgcctggatccaaatcct

SEQ ID NO: 1770 - DNA, 20 bp, Artificial Sequence
  chemically synthesized
aggtgacagagccaaggatt

SEQ ID NO: 1771 - DNA, 20 bp, Artificial Sequence
  chemically synthesized
tgtcccaggtgacagagcca

SEQ ID NO: 1772 - DNA, 20 bp, Artificial Sequence
  chemically synthesized
gtgtcccaggtgacagagcc

SEQ ID NO: 1773 - DNA, 20 bp, Artificial Sequence
  chemically synthesized
aaatccttggctctgtcacc

SEQ ID NO: 1774 - DNA, 20 bp, Artificial Sequence
  chemically synthesized
gcagtgtgtcccaggtgaca

SEQ ID NO: 1775 - DNA, 20 bp, Artificial Sequence
  chemically synthesized
aatccttggctctgtcacct

SEQ ID NO: 1776 - DNA, 20 bp, Artificial Sequence
  chemically synthesized
aagcagtgtgtcccaggtga

SEQ ID NO: 1777 - DNA, 20 bp, Artificial Sequence
  chemically synthesized
gagagtaagcagtgtgtccc

SEQ ID NO: 1778 - DNA, 20 bp, Artificial Sequence
  chemically synthesized
agagagtaagcagtgtgtcc

SEQ ID NO: 1779 - DNA, 20 bp, Artificial Sequence
  chemically synthesized
tgagtcaatgagagagtaag

SEQ ID NO: 1780 - DNA, 20 bp, Artificial Sequence
  chemically synthesized
gactgagtcaatgagagagt

SEQ ID NO: 1781 - DNA, 20 bp, Artificial Sequence
  chemically synthesized
aggagactgagtcaatgaga

SEQ ID NO: 1782 - DNA, 20 bp, Artificial Sequence
  chemically synthesized
taaggagactgagtcaatga

SEQ ID NO: 1783 - DNA, 20 bp, Artificial Sequence
  chemically synthesized
tgcttactctctcattgact

SEQ ID NO: 1784 - DNA, 20 bp, Artificial Sequence
  chemically synthesized
gataaggagactgagtcaat

SEQ ID NO: 1785 - DNA, 20 bp, Artificial Sequence
  chemically synthesized
gttttacagataaggagact

SEQ ID NO: 1786 - DNA, 20 bp, Artificial Sequence
  chemically synthesized
aaccccgttttacagataag

SEQ ID NO: 1787 - DNA, 20 bp, Artificial Sequence
  chemically synthesized
ttaaccccgttttacagata

SEQ ID NO: 1788 - DNA, 20 bp, Artificial Sequence
  chemically synthesized
attaaccccgttttacagat

SEQ ID NO: 1789 - DNA, 20 bp, Artificial Sequence
  chemically synthesized
cagtctccttatctgtaaaa

SEQ ID NO: 1790 - DNA, 20 bp, Artificial Sequence
  chemically synthesized
agtctccttatctgtaaaac

SEQ ID NO: 1791 - DNA, 20 bp, Artificial Sequence
  chemically synthesized
gtctccttatctgtaaaacg

SEQ ID NO: 1792 - DNA, 20 bp, Artificial Sequence
  chemically synthesized
ctcttattaaccccgtttta

SEQ ID NO: 1793 - DNA, 20 bp, Artificial Sequence
  chemically synthesized
atctgtaaaacggggttaat

SEQ ID NO: 1794 - DNA, 20 bp, Artificial Sequence
  chemically synthesized
ctgtaaaacggggttaataa

SEQ ID NO: 1795 - DNA, 20 bp, Artificial Sequence
  chemically synthesized
taataagagtacctacctca

SEQ ID NO: 1796 - DNA, 20 bp, Artificial Sequence
  chemically synthesized
aataagagtacctacctcac

SEQ ID NO: 1797 - DNA, 20 bp, Artificial Sequence
  chemically synthesized
tcatgacaaacctgtgaggt

SEQ ID NO: 1798 - DNA, 20 bp, Artificial Sequence
  chemically synthesized
ttcatgacaaacctgtgagg

SEQ ID NO: 1799 - DNA, 20 bp, Artificial Sequence
  chemically synthesized
atcttcatgacaaacctgtg

SEQ ID NO: 1800 - DNA, 20 bp, Artificial Sequence
  chemically synthesized
catcttcatgacaaacctgt

SEQ ID NO: 1801 - DNA, 20 bp, Artificial Sequence
  chemically synthesized
tacctcacaggtttgtcatg

SEQ ID NO: 1802 - DNA, 20 bp, Artificial Sequence
  chemically synthesized
atgaagatgacatgatgaaa

SEQ ID NO: 1803 - DNA, 20 bp, Artificial Sequence
  chemically synthesized
agatgacatgatgaaaaaga

SEQ ID NO: 1804 - DNA, 20 bp, Artificial Sequence
  chemically synthesized
gacatgatgaaaaagatggc

SEQ ID NO: 1805 - DNA, 20 bp, Artificial Sequence
  chemically synthesized
tgaaaaagatggcaagtgct

SEQ ID NO: 1806 - DNA, 20 bp, Artificial Sequence
  chemically synthesized
tgtgtgccaagcattgttct

SEQ ID NO: 1807 - DNA, 20 bp, Artificial Sequence
  chemically synthesized
caagtgctgagaacaatgct

SEQ ID NO: 1808 - DNA, 20 bp, Artificial Sequence
  chemically synthesized
tgagaacaatgcttggcaca

SEQ ID NO: 1809 - DNA, 20 bp, Artificial Sequence
  chemically synthesized
ttgagcacttactgtgtgcc

SEQ ID NO: 1810 - DNA, 20 bp, Artificial Sequence
  chemically synthesized
aacaatgcttggcacacagt

SEQ ID NO: 1811 - DNA, 20 bp, Artificial Sequence
  chemically synthesized
cattttagcgaacatttttt

SEQ ID NO: 1812 - DNA, 20 bp, Artificial Sequence
  chemically synthesized
tcaaaaaatgttcgctaaaa

SEQ ID NO: 1813 - DNA, 20 bp, Artificial Sequence
  chemically synthesized
caaaaaatgttcgctaaaat

SEQ ID NO: 1814 - DNA, 20 bp, Artificial Sequence
  chemically synthesized
aaaaatgttcgctaaaatgg

SEQ ID NO: 1815 - DNA, 20 bp, Artificial Sequence
  chemically synthesized
acgctctttctctcccattt

SEQ ID NO: 1816 - DNA, 20 bp, Artificial Sequence
  chemically synthesized
aaatgttcgctaaaatggga

SEQ ID NO: 1817 - DNA, 20 bp, Artificial Sequence
  chemically synthesized
gttcgctaaaatgggagaga

SEQ ID NO: 1818 - DNA, 20 bp, Artificial Sequence
  chemically synthesized
tcgctaaaatgggagagaaa

SEQ ID NO: 1819 - DNA, 20 bp, Artificial Sequence
  chemically synthesized
aaaatgggagagaaagagcg

SEQ ID NO: 1820 - DNA, 20 bp, Artificial Sequence
  chemically synthesized
aaatgggagagaaagagcgt

SEQ ID NO: 1821 - DNA, 20 bp, Artificial Sequence
  chemically synthesized
agagaaagagcgtaggaacc

SEQ ID NO: 1822 - DNA, 20 bp, Artificial Sequence
  chemically synthesized
gagcgtaggaaccaagaaaa

SEQ ID NO: 1823 - DNA, 20 bp, Artificial Sequence
  chemically synthesized
agcgtaggaaccaagaaaaa

SEQ ID NO: 1824 - DNA, 20 bp, Artificial Sequence
  chemically synthesized
gcttttgtttccttttttct

SEQ ID NO: 1825 - DNA, 20 bp, Artificial Sequence
  chemically synthesized
accaagaaaaaaggaaacaa

SEQ ID NO: 1826 - DNA, 20 bp, Artificial Sequence
  chemically synthesized
aaggaaacaaaagcaaaatg

SEQ ID NO: 1827 - DNA, 20 bp, Artificial Sequence
  chemically synthesized
aaagcaaaatgaagtcatcc

SEQ ID NO: 1828 - DNA, 20 bp, Artificial Sequence
  chemically synthesized
gcaaaatgaagtcatcccag

SEQ ID NO: 1829 - DNA, 20 bp, Artificial Sequence
  chemically synthesized
cccttagtttttattcttct

SEQ ID NO: 1830 - DNA, 20 bp, Artificial Sequence
  chemically synthesized
gcccttagtttttattcttc

SEQ ID NO: 1831 - DNA, 20 bp, Artificial Sequence
  chemically synthesized
atcccagaagaataaaaact

SEQ ID NO: 1832 - DNA, 20 bp, Artificial Sequence
  chemically synthesized
tcccagaagaataaaaacta

SEQ ID NO: 1833 - DNA, 20 bp, Artificial Sequence
  chemically synthesized
cccagaagaataaaaactaa

SEQ ID NO: 1834 - DNA, 20 bp, Artificial Sequence
  chemically synthesized
agaataaaaactaagggcgc

SEQ ID NO: 1835 - DNA, 20 bp, Artificial Sequence
  chemically synthesized
gcattttctgccagcgccct

SEQ ID NO: 1836 - DNA, 20 bp, Artificial Sequence
  chemically synthesized
ataaaaactaagggcgctgg

SEQ ID NO: 1837 - DNA, 20 bp, Artificial Sequence
  chemically synthesized
aggaccttagcattttctgc

SEQ ID NO: 1838 - DNA, 20 bp, Artificial Sequence
  chemically synthesized
gggcgctggcagaaaatgct

SEQ ID NO: 1839 - DNA, 20 bp, Artificial Sequence
  chemically synthesized
ggcgctggcagaaaatgcta

SEQ ID NO: 1840 - DNA, 20 bp, Artificial Sequence
  chemically synthesized
ggcagaaaatgctaaggtcc

SEQ ID NO: 1841 - DNA, 20 bp, Artificial Sequence
  chemically synthesized
ttcttccacttccaggacct

SEQ ID NO: 1842 - DNA, 20 bp, Artificial Sequence
  chemically synthesized
agaaaatgctaaggtcctgg

SEQ ID NO: 1843 - DNA, 20 bp, Artificial Sequence
  chemically synthesized
aaatgctaaggtcctggaag

SEQ ID NO: 1844 - DNA, 20 bp, Artificial Sequence
  chemically synthesized
taaagctttcttccacttcc

SEQ ID NO: 1845 - DNA, 20 bp, Artificial Sequence
  chemically synthesized
tgctaaggtcctggaagtgg

SEQ ID NO: 1846 - DNA, 20 bp, Artificial Sequence
  chemically synthesized
ataaagctttcttccacttc

SEQ ID NO: 1847 - DNA, 20 bp, Artificial Sequence
  chemically synthesized
aaggtcctggaagtggaaga

SEQ ID NO: 1848 - DNA, 20 bp, Artificial Sequence
  chemically synthesized
aacataactgatgagtcata

SEQ ID NO: 1849 - DNA, 20 bp, Artificial Sequence
  chemically synthesized
aagaaagctttatgactcat

SEQ ID NO: 1850 - DNA, 20 bp, Artificial Sequence
  chemically synthesized
tagccttgaacataactgat

SEQ ID NO: 1851 - DNA, 20 bp, Artificial Sequence
  chemically synthesized
atgactcatcagttatgttc

SEQ ID NO: 1852 - DNA, 20 bp, Artificial Sequence
  chemically synthesized
tgactcatcagttatgttca

SEQ ID NO: 1853 - DNA, 20 bp, Artificial Sequence
  chemically synthesized
caaaatcttcaaaataaatt

SEQ ID NO: 1854 - DNA, 20 bp, Artificial Sequence
  chemically synthesized
tcaaggctaaatttattttg

SEQ ID NO: 1855 - DNA, 20 bp, Artificial Sequence
  chemically synthesized
atttattttgaagattttgt

SEQ ID NO: 1856 - DNA, 20 bp, Artificial Sequence
  chemically synthesized
gattttgttagtgttgcaaa

SEQ ID NO: 1857 - DNA, 20 bp, Artificial Sequence
  chemically synthesized
gttagtgttgcaaatggcaa

SEQ ID NO: 1858 - DNA, 20 bp, Artificial Sequence
  chemically synthesized
aaatggcaacagatgatgaa

SEQ ID NO: 1859 - DNA, 20 bp, Artificial Sequence
  chemically synthesized
tggcaacagatgatgaacgg

SEQ ID NO: 1860 - DNA, 20 bp, Artificial Sequence
  chemically synthesized
ggcaacagatgatgaacggc

SEQ ID NO: 1861 - DNA, 20 bp, Artificial Sequence
  chemically synthesized
tgaacggcaggattccaacc

SEQ ID NO: 1862 - DNA, 20 bp, Artificial Sequence
  chemically synthesized
gaacggcaggattccaacct

SEQ ID NO: 1863 - DNA, 20 bp, Artificial Sequence
  chemically synthesized
aacggcaggattccaaccta

SEQ ID NO: 1864 - DNA, 20 bp, Artificial Sequence
  chemically synthesized
atcctttgtagtccctaggt

SEQ ID NO: 1865 - DNA, 20 bp, Artificial Sequence
  chemically synthesized
ggcaatcctttgtagtccct

SEQ ID NO: 1866 - DNA, 20 bp, Artificial Sequence
  chemically synthesized
tggcaatcctttgtagtccc

SEQ ID NO: 1867 - DNA, 20 bp, Artificial Sequence
  chemically synthesized
attccaacctagggactaca

SEQ ID NO: 1868 - DNA, 20 bp, Artificial Sequence
  chemically synthesized
ttccaacctagggactacaa

SEQ ID NO: 1869 - DNA, 20 bp, Artificial Sequence
  chemically synthesized
tttaaaatggcaatcctttg

SEQ ID NO: 1870 - DNA, 20 bp, Artificial Sequence
  chemically synthesized
tacaaaggattgccatttta

SEQ ID NO: 1871 - DNA, 20 bp, Artificial Sequence
  chemically synthesized
caaaggattgccattttaaa

SEQ ID NO: 1872 - DNA, 20 bp, Artificial Sequence
  chemically synthesized
gagcaagaatctctttaaaa

SEQ ID NO: 1873 - DNA, 20 bp, Artificial Sequence
  chemically synthesized
acaagactggggttgggagc

SEQ ID NO: 1874 - DNA, 20 bp, Artificial Sequence
  chemically synthesized
gagattcttgctcccaaccc

SEQ ID NO: 1875 - DNA, 20 bp, Artificial Sequence
  chemically synthesized
gacgacaagactggggttgg

SEQ ID NO: 1876 - DNA, 20 bp, Artificial Sequence
  chemically synthesized
atgacgacaagactggggtt

SEQ ID NO: 1877 - DNA, 20 bp, Artificial Sequence
  chemically synthesized
catgacgacaagactggggt

SEQ ID NO: 1878 - DNA, 20 bp, Artificial Sequence
  chemically synthesized
tcaccatgacgacaagactg

SEQ ID NO: 1879 - DNA, 20 bp, Artificial Sequence
  chemically synthesized
atcaccatgacgacaagact

SEQ ID NO: 1880 - DNA, 20 bp, Artificial Sequence
  chemically synthesized
catcaccatgacgacaagac

SEQ ID NO: 1881 - DNA, 20 bp, Artificial Sequence
  chemically synthesized
caaccccagtcttgtcgtca

SEQ ID NO: 1882 - DNA, 20 bp, Artificial Sequence
  chemically synthesized
gttgtcatcaccatgacgac

SEQ ID NO: 1883 - DNA, 20 bp, Artificial Sequence
  chemically synthesized
tgtcgtcatggtgatgacaa

SEQ ID NO: 1884 - DNA, 20 bp, Artificial Sequence
  chemically synthesized
gacaacggcaatgaacattt

SEQ ID NO: 1885 - DNA, 20 bp, Artificial Sequence
  chemically synthesized
acaacggcaatgaacatttg

SEQ ID NO: 1886 - DNA, 20 bp, Artificial Sequence
  chemically synthesized
atttgaggaatgttcctcat

SEQ ID NO: 1887 - DNA, 20 bp, Artificial Sequence
  chemically synthesized
ctctccacttgcagctcatg

SEQ ID NO: 1888 - DNA, 20 bp, Artificial Sequence
  chemically synthesized
cctctccacttgcagctcat

SEQ ID NO: 1889 - DNA, 20 bp, Artificial Sequence
  chemically synthesized
gaatgttcctcatgagctgc

SEQ ID NO: 1890 - DNA, 20 bp, Artificial Sequence
  chemically synthesized
tgttcctcatgagctgcaag

SEQ ID NO: 1891 - DNA, 20 bp, Artificial Sequence
  chemically synthesized
ttcctcatgagctgcaagtg

SEQ ID NO: 1892 - DNA, 20 bp, Artificial Sequence
  chemically synthesized
ggtagtcacctctccacttg

SEQ ID NO: 1893 - DNA, 20 bp, Artificial Sequence
  chemically synthesized
cctcatgagctgcaagtgga

SEQ ID NO: 1894 - DNA, 20 bp, Artificial Sequence
  chemically synthesized
ctcatgagctgcaagtggag

SEQ ID NO: 1895 - DNA, 20 bp, Artificial Sequence
  chemically synthesized
gtgtcatcatgtaaggatgg

SEQ ID NO: 1896 - DNA, 20 bp, Artificial Sequence
  chemically synthesized
attgtgtcatcatgtaagga

SEQ ID NO: 1897 - DNA, 20 bp, Artificial Sequence
  chemically synthesized
acacattgtgtcatcatgta

SEQ ID NO: 1898 - DNA, 20 bp, Artificial Sequence
  chemically synthesized
tacacattgtgtcatcatgt

SEQ ID NO: 1899 - DNA, 20 bp, Artificial Sequence
  chemically synthesized
tttatgtttggcgtttgtgt

SEQ ID NO: 1900 - DNA, 20 bp, Artificial Sequence
  chemically synthesized
ctcatcctgctttttatgtt

SEQ ID NO: 1901 - DNA, 20 bp, Artificial Sequence
  chemically synthesized
acacaaacgccaaacataaa

SEQ ID NO: 1902 - DNA, 20 bp, Artificial Sequence
  chemically synthesized
caaacgccaaacataaaaag

SEQ ID NO: 1903 - DNA, 20 bp, Artificial Sequence
  chemically synthesized
aaacgccaaacataaaaagc

SEQ ID NO: 1904 - DNA, 20 bp, Artificial Sequence
  chemically synthesized
ccaaacataaaaagcaggat

SEQ ID NO: 1905 - DNA, 20 bp, Artificial Sequence
  chemically synthesized
acataaaaagcaggatgaga

SEQ ID NO: 1906 - DNA, 20 bp, Artificial Sequence
  chemically synthesized
aaaaagcaggatgagacaga

SEQ ID NO: 1907 - DNA, 20 bp, Artificial Sequence
  chemically synthesized
aagcaggatgagacagacag

SEQ ID NO: 1908 - DNA, 20 bp, Artificial Sequence
  chemically synthesized
gatgagacagacagaagcca

SEQ ID NO: 1909 - DNA, 20 bp, Artificial Sequence
  chemically synthesized
cagacagaagccatggccgt

SEQ ID NO: 1910 - DNA, 20 bp, Artificial Sequence
  chemically synthesized
gagattcaggctcacggcca

SEQ ID NO: 1911 - DNA, 20 bp, Artificial Sequence
  chemically synthesized
gttagtgagattcaggctca

SEQ ID NO: 1912 - DNA, 20 bp, Artificial Sequence
  chemically synthesized
gagagaggttagtgagattc

SEQ ID NO: 1913 - DNA, 20 bp, Artificial Sequence
  chemically synthesized
tgagagaggttagtgagatt

SEQ ID NO: 1914 - DNA, 20 bp, Artificial Sequence
  chemically synthesized
agccaatgagagaggttagt

SEQ ID NO: 1915 - DNA, 20 bp, Artificial Sequence
  chemically synthesized
ggaaagccaatgagagaggt

SEQ ID NO: 1916 - DNA, 20 bp, Artificial Sequence
  chemically synthesized
atctcactaacctctctcat

SEQ ID NO: 1917 - DNA, 20 bp, Artificial Sequence
  chemically synthesized
ccctggaaagccaatgagag

SEQ ID NO: 1918 - DNA, 20 bp, Artificial Sequence
  chemically synthesized
cccctggaaagccaatgaga

SEQ ID NO: 1919 - DNA, 20 bp, Artificial Sequence
  chemically synthesized
tacccctggaaagccaatga

SEQ ID NO: 1920 - DNA, 20 bp, Artificial Sequence
  chemically synthesized
aatacccctggaaagccaat

SEQ ID NO: 1921 - DNA, 20 bp, Artificial Sequence
  chemically synthesized
aacctctctcattggctttc

SEQ ID NO: 1922 - DNA, 20 bp, Artificial Sequence
  chemically synthesized
acctctctcattggctttcc

SEQ ID NO: 1923 - DNA, 20 bp, Artificial Sequence
  chemically synthesized
cctctctcattggctttcca

SEQ ID NO: 1924 - DNA, 20 bp, Artificial Sequence
  chemically synthesized
ctctctcattggctttccag

SEQ ID NO: 1925 - DNA, 20 bp, Artificial Sequence
  chemically synthesized
aaggaagaaatacccctgga

SEQ ID NO: 1926 - DNA, 20 bp, Artificial Sequence
  chemically synthesized
attaaaggaagaaatacccc

SEQ ID NO: 1927 - DNA, 20 bp, Artificial Sequence
  chemically synthesized
cctctctctattattaaagg

SEQ ID NO: 1928 - DNA, 20 bp, Artificial Sequence
  chemically synthesized
ggtatttcttcctttaataa

SEQ ID NO: 1929 - DNA, 20 bp, Artificial Sequence
  chemically synthesized
cttcctctctctattattaa

SEQ ID NO: 1930 - DNA, 20 bp, Artificial Sequence
  chemically synthesized
tcttcctctctctattatta

SEQ ID NO: 1931 - DNA, 20 bp, Artificial Sequence
  chemically synthesized
tatttcttcctttaataata

SEQ ID NO: 1932 - DNA, 20 bp, Artificial Sequence
  chemically synthesized
tttcttcctttaataataga

SEQ ID NO: 1933 - DNA, 20 bp, Artificial Sequence
  chemically synthesized
tcttcctttaataatagaga

SEQ ID NO: 1934 - DNA, 20 bp, Artificial Sequence
  chemically synthesized
cttcctttaataatagagag

SEQ ID NO: 1935 - DNA, 20 bp, Artificial Sequence
  chemically synthesized
cctttaataatagagagagg

SEQ ID NO: 1936 - DNA, 20 bp, Artificial Sequence
  chemically synthesized
tttaataatagagagaggaa

SEQ ID NO: 1937 - DNA, 20 bp, Artificial Sequence
  chemically synthesized
ttaataatagagagaggaag

SEQ ID NO: 1938 - DNA, 20 bp, Artificial Sequence
  chemically synthesized
ataatagagagaggaagagg

SEQ ID NO: 1939 - DNA, 20 bp, Artificial Sequence
  chemically synthesized
aatagagagaggaagaggca

SEQ ID NO: 1940 - DNA, 20 bp, Artificial Sequence
  chemically synthesized
agaggaagaggcagagatat

SEQ ID NO: 1941 - DNA, 20 bp, Artificial Sequence
  chemically synthesized
gaagaggcagagatatcaga

SEQ ID NO: 1942 - DNA, 20 bp, Artificial Sequence
  chemically synthesized
aagaggcagagatatcagaa

SEQ ID NO: 1943 - DNA, 20 bp, Artificial Sequence
  chemically synthesized
agaggcagagatatcagaaa

SEQ ID NO: 1944 - DNA, 20 bp, Artificial Sequence
  chemically synthesized
gtttggtaaaagaagcaaat

SEQ ID NO: 1945 - DNA, 20 bp, Artificial Sequence
  chemically synthesized
caacatttgtttggtaaaag

SEQ ID NO: 1946 - DNA, 20 bp, Artificial Sequence
  chemically synthesized
tctcaacatttgtttggtaa

SEQ ID NO: 1947 - DNA, 20 bp, Artificial Sequence
  chemically synthesized
tggtcatctcaacatttgtt

SEQ ID NO: 1948 - DNA, 20 bp, Artificial Sequence
  chemically synthesized
tcttttaccaaacaaatgtt

SEQ ID NO: 1949 - DNA, 20 bp, Artificial Sequence
  chemically synthesized
tttttccagcagagaataaa

SEQ ID NO: 1950 - DNA, 20 bp, Artificial Sequence
  chemically synthesized
gatgaccatttattctctgc

SEQ ID NO: 1951 - DNA, 20 bp, Artificial Sequence
  chemically synthesized
ttttttttttttttccagca

SEQ ID NO: 1952 - DNA, 20 bp, Artificial Sequence
  chemically synthesized
ttttttttttttttttccag

SEQ ID NO: 1953 - DNA, 20 bp, Artificial Sequence
  chemically synthesized
tttttttttttttttttttc

SEQ ID NO: 1954 - DNA, 20 bp, Artificial Sequence
  chemically synthesized
aaaaaaaaaaaaaaaaaaaa

SEQ ID NO: 1955 - DNA, 20 bp, Artificial Sequence
  chemically synthesized
aacagaaacaaaaaacccaa

SEQ ID NO: 1956 - DNA, 20 bp, Artificial Sequence
  chemically synthesized
tttgactagatgtgtctttt

SEQ ID NO: 1957 - DNA, 20 bp, Artificial Sequence
  chemically synthesized
atttgactagatgtgtcttt

SEQ ID NO: 1958 - DNA, 20 bp, Artificial Sequence
  chemically synthesized
aaaaacccaaaagacacatc

SEQ ID NO: 1959 - DNA, 20 bp, Artificial Sequence
  chemically synthesized
gtatgtaaaggttatttgac

SEQ ID NO: 1960 - DNA, 20 bp, Artificial Sequence
  chemically synthesized
ctgatcttaagtgtatgtaa

SEQ ID NO: 1961 - DNA, 20 bp, Artificial Sequence
  chemically synthesized
actgatcttaagtgtatgta

SEQ ID NO: 1962 - DNA, 20 bp, Artificial Sequence
  chemically synthesized
aataacctttacatacactt

SEQ ID NO: 1963 - DNA, 20 bp, Artificial Sequence
  chemically synthesized
cctttacatacacttaagat

SEQ ID NO: 1964 - DNA, 20 bp, Artificial Sequence
  chemically synthesized
tatctgtttacactgatctt

SEQ ID NO: 1965 - DNA, 20 bp, Artificial Sequence
  chemically synthesized
acacttaagatcagtgtaaa

SEQ ID NO: 1966 - DNA, 20 bp, Artificial Sequence
  chemically synthesized
tgtaaacagataacatgatc

SEQ ID NO: 1967 - DNA, 20 bp, Artificial Sequence
  chemically synthesized
aaacagataacatgatccag

SEQ ID NO: 1968 - DNA, 20 bp, Artificial Sequence
  chemically synthesized
attttacaaatgacgtcttc

SEQ ID NO: 1969 - DNA, 20 bp, Artificial Sequence
  chemically synthesized
gacgtcatttgtaaaatcca

SEQ ID NO: 1970 - DNA, 20 bp, Artificial Sequence
  chemically synthesized
cgtcatttgtaaaatccata

SEQ ID NO: 1971 - DNA, 20 bp, Artificial Sequence
  chemically synthesized
agtttaatgcgtgaactcta

SEQ ID NO: 1972 - DNA, 20 bp, Artificial Sequence
  chemically synthesized
atagagttcacgcattaaac

SEQ ID NO: 1973 - DNA, 20 bp, Artificial Sequence
  chemically synthesized
attctgtgccagttttcatc

SEQ ID NO: 1974 - DNA, 20 bp, Artificial Sequence
  chemically synthesized
gcattaaactggatgaaaac

SEQ ID NO: 1975 - DNA, 20 bp, Artificial Sequence
  chemically synthesized
aaactggatgaaaactggca

SEQ ID NO: 1976 - DNA, 20 bp, Artificial Sequence
  chemically synthesized
gtcagatttctattctgtgc

SEQ ID NO: 1977 - DNA, 20 bp, Artificial Sequence
  chemically synthesized
ggatgaaaactggcacagaa

SEQ ID NO: 1978 - DNA, 20 bp, Artificial Sequence
  chemically synthesized
agaatagaaatctgacaaat

SEQ ID NO: 1979 - DNA, 20 bp, Artificial Sequence
  chemically synthesized
gaatagaaatctgacaaatt

SEQ ID NO: 1980 - DNA, 20 bp, Artificial Sequence
  chemically synthesized
gaaaacaatgcccaatttgt

SEQ ID NO: 1981 - DNA, 20 bp, Artificial Sequence
  chemically synthesized
acaaattgggcattgttttc

SEQ ID NO: 1982 - DNA, 20 bp, Artificial Sequence
  chemically synthesized
caaattgggcattgttttca

SEQ ID NO: 1983 - DNA, 20 bp, Artificial Sequence
  chemically synthesized
ctttttttaacattaagttt

SEQ ID NO: 1984 - DNA, 20 bp, Artificial Sequence
  chemically synthesized
ctgagactttttttaacatt

SEQ ID NO: 1985 - DNA, 20 bp, Artificial Sequence
  chemically synthesized
ctcaaacttaatgttaaaaa

SEQ ID NO: 1986 - DNA, 20 bp, Artificial Sequence
  chemically synthesized
cttaatgttaaaaaaagtct

SEQ ID NO: 1987 - DNA, 20 bp, Artificial Sequence
  chemically synthesized
gtcaagagtgaagagattct

SEQ ID NO: 1988 - DNA, 20 bp, Artificial Sequence
  chemically synthesized
tgctgattgtcaagagtgaa

SEQ ID NO: 1989 - DNA, 20 bp, Artificial Sequence
  chemically synthesized
tgtgctgattgtcaagagtg

SEQ ID NO: 1990 - DNA, 20 bp, Artificial Sequence
  chemically synthesized
ttcaatgtgctgattgtcaa

SEQ ID NO: 1991 - DNA, 20 bp, Artificial Sequence
  chemically synthesized
atctcttcactcttgacaat

SEQ ID NO: 1992 - DNA, 20 bp, Artificial Sequence
  chemically synthesized
gtttcaatgtgctgattgtc

SEQ ID NO: 1993 - DNA, 20 bp, Artificial Sequence
  chemically synthesized
tcagcacattgaaacataaa

SEQ ID NO: 1994 - DNA, 20 bp, Artificial Sequence
  chemically synthesized
gcacattgaaacataaacag

SEQ ID NO: 1995 - DNA, 20 bp, Artificial Sequence
  chemically synthesized
gtgcagactttgggcacaca

SEQ ID NO: 1996 - DNA, 20 bp, Artificial Sequence
  chemically synthesized
atgtgcagactttgggcaca

SEQ ID NO: 1997 - DNA, 20 bp, Artificial Sequence
  chemically synthesized
tagttgactctgtgtgccca

SEQ ID NO: 1998 - DNA, 20 bp, Artificial Sequence
  chemically synthesized
gcatttgatgtgcagacttt

SEQ ID NO: 1999 - DNA, 20 bp, Artificial Sequence
  chemically synthesized
tgcatttgatgtgcagactt

SEQ ID NO: 2000 - DNA, 20 bp, Artificial Sequence
  chemically synthesized
tctaccttgcatttgatgtg

SEQ ID NO: 2001 - DNA, 20 bp, Artificial Sequence
  chemically synthesized
aaagtctgcacatcaaatgc

SEQ ID NO: 2002 - DNA, 20 bp, Artificial Sequence
  chemically synthesized
aagtctgcacatcaaatgca

SEQ ID NO: 2003 - DNA, 20 bp, Artificial Sequence
  chemically synthesized
tctgcacatcaaatgcaagg

SEQ ID NO: 2004 - DNA, 20 bp, Artificial Sequence
  chemically synthesized
atgcaaggtagaacccgaca

SEQ ID NO: 2005 - DNA, 20 bp, Artificial Sequence
  chemically synthesized
gcaaggtagaacccgacata

SEQ ID NO: 2006 - DNA, 20 bp, Artificial Sequence
  chemically synthesized
caaggtagaacccgacatag

SEQ ID NO: 2007 - DNA, 20 bp, Artificial Sequence
  chemically synthesized
tggagtccagcctctatgtc

SEQ ID NO: 2008 - DNA, 20 bp, Artificial Sequence
  chemically synthesized
atggagtccagcctctatgt

SEQ ID NO: 2009 - DNA, 20 bp, Artificial Sequence
  chemically synthesized
gtagaacccgacatagaggc

SEQ ID NO: 2010 - DNA, 20 bp, Artificial Sequence
  chemically synthesized
tctcccaagaggatggagtc

SEQ ID NO: 2011 - DNA, 20 bp, Artificial Sequence
  chemically synthesized
caaattctcccaagaggatg

SEQ ID NO: 2012 - DNA, 20 bp, Artificial Sequence
  chemically synthesized
gaggctggactccatcctct

SEQ ID NO: 2013 - DNA, 20 bp, Artificial Sequence
  chemically synthesized
aggctggactccatcctctt

SEQ ID NO: 2014 - DNA, 20 bp, Artificial Sequence
  chemically synthesized
aacaaattctcccaagagga

SEQ ID NO: 2015 - DNA, 20 bp, Artificial Sequence
  chemically synthesized
gctggactccatcctcttgg

SEQ ID NO: 2016 - DNA, 20 bp, Artificial Sequence
  chemically synthesized
atagaacaaattctcccaag

SEQ ID NO: 2017 - DNA, 20 bp, Artificial Sequence
  chemically synthesized
gatagaacaaattctcccaa

SEQ ID NO: 2018 - DNA, 20 bp, Artificial Sequence
  chemically synthesized
cagatagaacaaattctccc

SEQ ID NO: 2019 - DNA, 20 bp, Artificial Sequence
  chemically synthesized
ggagaatttgttctatctga

SEQ ID NO: 2020 - DNA, 20 bp, Artificial Sequence
  chemically synthesized
aatgctcagcttctatcaga

SEQ ID NO: 2021 - DNA, 20 bp, Artificial Sequence
  chemically synthesized
gaatttgttctatctgatag

SEQ ID NO: 2022 - DNA, 20 bp, Artificial Sequence
  chemically synthesized
tggaaatgctcagcttctat

SEQ ID NO: 2023 - DNA, 20 bp, Artificial Sequence
  chemically synthesized
tgttctatctgatagaagct

SEQ ID NO: 2024 - DNA, 20 bp, Artificial Sequence
  chemically synthesized
aatttcatcatggaaatgct

SEQ ID NO: 2025 - DNA, 20 bp, Artificial Sequence
  chemically synthesized
aaatgcctccaatttcatca

SEQ ID NO: 2026 - DNA, 20 bp, Artificial Sequence
  chemically synthesized
gagcatttccatgatgaaat

SEQ ID NO: 2027 - DNA, 20 bp, Artificial Sequence
  chemically synthesized
gcatttccatgatgaaattg

SEQ ID NO: 2028 - DNA, 20 bp, Artificial Sequence
  chemically synthesized
catttccatgatgaaattgg

SEQ ID NO: 2029 - DNA, 20 bp, Artificial Sequence
  chemically synthesized
tgatgaaattggaggcattt

SEQ ID NO: 2030 - DNA, 20 bp, Artificial Sequence
  chemically synthesized
attggaggcatttgagaaaa

SEQ ID NO: 2031 - DNA, 20 bp, Artificial Sequence
  chemically synthesized
gaggcatttgagaaaacaga

SEQ ID NO: 2032 - DNA, 20 bp, Artificial Sequence
  chemically synthesized
atttgagaaaacagaaagaa

SEQ ID NO: 2033 - DNA, 20 bp, Artificial Sequence
  chemically synthesized
agaaaacagaaagaacagat

SEQ ID NO: 2034 - DNA, 20 bp, Artificial Sequence
  chemically synthesized
gaaaacagaaagaacagatg

SEQ ID NO: 2035 - DNA, 20 bp, Artificial Sequence
  chemically synthesized
aaaacagaaagaacagatga

SEQ ID NO: 2036 - DNA, 20 bp, Artificial Sequence
  chemically synthesized
aaacagaaagaacagatgag

SEQ ID NO: 2037 - DNA, 20 bp, Artificial Sequence
  chemically synthesized
cagaaagaacagatgagggg

SEQ ID NO: 2038 - DNA, 20 bp, Artificial Sequence
  chemically synthesized
gaaagaacagatgaggggaa

SEQ ID NO: 2039 - DNA, 20 bp, Artificial Sequence
  chemically synthesized
aaagaacagatgaggggaag

SEQ ID NO: 2040 - DNA, 20 bp, Artificial Sequence
  chemically synthesized
aacagatgaggggaagaggt

SEQ ID NO: 2041 - DNA, 20 bp, Artificial Sequence
  chemically synthesized
tgaggggaagaggtaagtcc

SEQ ID NO: 2042 - DNA, 20 bp, Artificial Sequence
  chemically synthesized
gaagaggtaagtcccagtaa

SEQ ID NO: 2043 - DNA, 20 bp, Artificial Sequence
  chemically synthesized
aagaggtaagtcccagtaat

SEQ ID NO: 2044 - DNA, 20 bp, Artificial Sequence
  chemically synthesized
tctgtggcttgcccattact

SEQ ID NO: 2045 - DNA, 20 bp, Artificial Sequence
  chemically synthesized
ctctgtggcttgcccattac

SEQ ID NO: 2046 - DNA, 20 bp, Artificial Sequence
  chemically synthesized
ggtaagtcccagtaatgggc

SEQ ID NO: 2047 - DNA, 20 bp, Artificial Sequence
  chemically synthesized
tcccagtaatgggcaagcca

SEQ ID NO: 2048 - DNA, 20 bp, Artificial Sequence
  chemically synthesized
ccagtaatgggcaagccaca

SEQ ID NO: 2049 - DNA, 20 bp, Artificial Sequence
  chemically synthesized
taatgggcaagccacagagc

SEQ ID NO: 2050 - DNA, 20 bp, Artificial Sequence
  chemically synthesized
cattcctggatctggctctg

SEQ ID NO: 2051 - DNA, 20 bp, Artificial Sequence
  chemically synthesized
gcaagccacagagccagatc

SEQ ID NO: 2052 - DNA, 20 bp, Artificial Sequence
  chemically synthesized
caagccacagagccagatcc

SEQ ID NO: 2053 - DNA, 20 bp, Artificial Sequence
  chemically synthesized
ggaaagctcattcctggatc

SEQ ID NO: 2054 - DNA, 20 bp, Artificial Sequence
  chemically synthesized
acagagccagatccaggaat

SEQ ID NO: 2055 - DNA, 20 bp, Artificial Sequence
  chemically synthesized
ggaagtggaaagctcattcc

SEQ ID NO: 2056 - DNA, 20 bp, Artificial Sequence
  chemically synthesized
tgaattggggaggaagtgga

SEQ ID NO: 2057 - DNA, 20 bp, Artificial Sequence
  chemically synthesized
ttgctgaattggggaggaag

SEQ ID NO: 2058 - DNA, 20 bp, Artificial Sequence
  chemically synthesized
tatttgctgaattggggagg

SEQ ID NO: 2059 - DNA, 20 bp, Artificial Sequence
  chemically synthesized
tgatatttgctgaattgggg

SEQ ID NO: 2060 - DNA, 20 bp, Artificial Sequence
  chemically synthesized
tttccacttcctccccaatt

SEQ ID NO: 2061 - DNA, 20 bp, Artificial Sequence
  chemically synthesized
ctgatatttgctgaattggg

SEQ ID NO: 2062 - DNA, 20 bp, Artificial Sequence
  chemically synthesized
tcctgatatttgctgaattg

SEQ ID NO: 2063 - DNA, 20 bp, Artificial Sequence
  chemically synthesized
ctcctgatatttgctgaatt

SEQ ID NO: 2064 - DNA, 20 bp, Artificial Sequence
  chemically synthesized
gctcctgatatttgctgaat

SEQ ID NO: 2065 - DNA, 20 bp, Artificial Sequence
  chemically synthesized
ctccccaattcagcaaatat

SEQ ID NO: 2066 - DNA, 20 bp, Artificial Sequence
  chemically synthesized
tccccaattcagcaaatatc

SEQ ID NO: 2067 - DNA, 20 bp, Artificial Sequence
  chemically synthesized
cccaattcagcaaatatcag

SEQ ID NO: 2068 - DNA, 20 bp, Artificial Sequence
  chemically synthesized
gcaaatatcaggagccttac

SEQ ID NO: 2069 - DNA, 20 bp, Artificial Sequence
  chemically synthesized
caaatatcaggagccttacg

SEQ ID NO: 2070 - DNA, 20 bp, Artificial Sequence
  chemically synthesized
tctttagccattgcctcgta

SEQ ID NO: 2071 - DNA, 20 bp, Artificial Sequence
  chemically synthesized
gtctttagccattgcctcgt

SEQ ID NO: 2072 - DNA, 20 bp, Artificial Sequence
  chemically synthesized
tcaggagccttacgaggcaa

SEQ ID NO: 2073 - DNA, 20 bp, Artificial Sequence
  chemically synthesized
gccttacgaggcaatggcta

SEQ ID NO: 2074 - DNA, 20 bp, Artificial Sequence
  chemically synthesized
aatcaaggccagtgggtctt

SEQ ID NO: 2075 - DNA, 20 bp, Artificial Sequence
  chemically synthesized
ggcaatggctaaagacccac

SEQ ID NO: 2076 - DNA, 20 bp, Artificial Sequence
  chemically synthesized
atctatgaatcaaggccagt

SEQ ID NO: 2077 - DNA, 20 bp, Artificial Sequence
  chemically synthesized
aatctatgaatcaaggccag

SEQ ID NO: 2078 - DNA, 20 bp, Artificial Sequence
  chemically synthesized
aggaatctatgaatcaaggc

SEQ ID NO: 2079 - DNA, 20 bp, Artificial Sequence
  chemically synthesized
gacccactggccttgattca

SEQ ID NO: 2080 - DNA, 20 bp, Artificial Sequence
  chemically synthesized
atgtaggaatctatgaatca

SEQ ID NO: 2081 - DNA, 20 bp, Artificial Sequence
  chemically synthesized
gatgtaggaatctatgaatc

SEQ ID NO: 2082 - DNA, 20 bp, Artificial Sequence
  chemically synthesized
aaataaatgcatacagatgt

SEQ ID NO: 2083 - DNA, 20 bp, Artificial Sequence
  chemically synthesized
caaataaatgcatacagatg

SEQ ID NO: 2084 - DNA, 20 bp, Artificial Sequence
  chemically synthesized
gaaatacaaataaatgcata

SEQ ID NO: 2085 - DNA, 20 bp, Artificial Sequence
  chemically synthesized
tgcatttatttgtatttcaa

SEQ ID NO: 2086 - DNA, 20 bp, Artificial Sequence
  chemically synthesized
atttatttgtatttcaaaag

SEQ ID NO: 2087 - DNA, 20 bp, Artificial Sequence
  chemically synthesized
tttcaaaagtagactctgat

SEQ ID NO: 2088 - DNA, 20 bp, Artificial Sequence
  chemically synthesized
catagaacactttctcatca

SEQ ID NO: 2089 - DNA, 20 bp, Artificial Sequence
  chemically synthesized
aaaagtagactctgatgaga

SEQ ID NO: 2090 - DNA, 20 bp, Artificial Sequence
  chemically synthesized
atcatagaacactttctcat

SEQ ID NO: 2091 - DNA, 20 bp, Artificial Sequence
  chemically synthesized
atgagaaagtgttctatgat

SEQ ID NO: 2092 - DNA, 20 bp, Artificial Sequence
  chemically synthesized
tgtccaattatgacttatca

SEQ ID NO: 2093 - DNA, 20 bp, Artificial Sequence
  chemically synthesized
gttctatgataagtcataat

SEQ ID NO: 2094 - DNA, 20 bp, Artificial Sequence
  chemically synthesized
tatgataagtcataattgga

SEQ ID NO: 2095 - DNA, 20 bp, Artificial Sequence
  chemically synthesized
taagtcataattggacagaa

SEQ ID NO: 2096 - DNA, 20 bp, Artificial Sequence
  chemically synthesized
gtcataattggacagaaaag

SEQ ID NO: 2097 - DNA, 20 bp, Artificial Sequence
  chemically synthesized
tcataattggacagaaaagt

SEQ ID NO: 2098 - DNA, 20 bp, Artificial Sequence
  chemically synthesized
cataattggacagaaaagta

SEQ ID NO: 2099 - DNA, 20 bp, Artificial Sequence
  chemically synthesized
ctattgacatgtatggacag

SEQ ID NO: 2100 - DNA, 20 bp, Artificial Sequence
  chemically synthesized
aggctattgacatgtatgga

SEQ ID NO: 2101 - DNA, 20 bp, Artificial Sequence
  chemically synthesized
agacaggctattgacatgta

SEQ ID NO: 2102 - DNA, 20 bp, Artificial Sequence
  chemically synthesized
cttctgtccatacatgtcaa

SEQ ID NO: 2103 - DNA, 20 bp, Artificial Sequence
  chemically synthesized
tacatgtcaatagcctgtct

SEQ ID NO: 2104 - DNA, 20 bp, Artificial Sequence
  chemically synthesized
acatgtcaatagcctgtctt

SEQ ID NO: 2105 - DNA, 20 bp, Artificial Sequence
  chemically synthesized
ggaaattgcatgcccaagac

SEQ ID NO: 2106 - DNA, 20 bp, Artificial Sequence
  chemically synthesized
aggaaattgcatgcccaaga

SEQ ID NO: 2107 - DNA, 20 bp, Artificial Sequence
  chemically synthesized
ttaaaggaaattgcatgccc

SEQ ID NO: 2108 - DNA, 20 bp, Artificial Sequence
  chemically synthesized
tttgaaaaccaagattttaa

SEQ ID NO: 2109 - DNA, 20 bp, Artificial Sequence
  chemically synthesized
gtttgaaaaccaagatttta

SEQ ID NO: 2110 - DNA, 20 bp, Artificial Sequence
  chemically synthesized
tgcaatttcctttaaaatct

SEQ ID NO: 2111 - DNA, 20 bp, Artificial Sequence
  chemically synthesized
gttaaaacagtttgaaaacc

SEQ ID NO: 2112 - DNA, 20 bp, Artificial Sequence
  chemically synthesized
tcccattgctatagttaaaa

SEQ ID NO: 2113 - DNA, 20 bp, Artificial Sequence
  chemically synthesized
ttttcaaactgttttaacta

SEQ ID NO: 2114 - DNA, 20 bp, Artificial Sequence
  chemically synthesized
aactgttttaactatagcaa

SEQ ID NO: 2115 - DNA, 20 bp, Artificial Sequence
  chemically synthesized
actgttttaactatagcaat

SEQ ID NO: 2116 - DNA, 20 bp, Artificial Sequence
  chemically synthesized
taggagatgtcccattgcta

SEQ ID NO: 2117 - DNA, 20 bp, Artificial Sequence
  chemically synthesized
tccatataagattgttttag

SEQ ID NO: 2118 - DNA, 20 bp, Artificial Sequence
  chemically synthesized
attccatataagattgtttt

SEQ ID NO: 2119 - DNA, 20 bp, Artificial Sequence
  chemically synthesized
aattccatataagattgttt

SEQ ID NO: 2120 - DNA, 20 bp, Artificial Sequence
  chemically synthesized
tctcctaaaacaatcttata

SEQ ID NO: 2121 - DNA, 20 bp, Artificial Sequence
  chemically synthesized
aaaatattggaattccatat

SEQ ID NO: 2122 - DNA, 20 bp, Artificial Sequence
  chemically synthesized
atatggaattccaatatttt

SEQ ID NO: 2123 - DNA, 20 bp, Artificial Sequence
  chemically synthesized
ctttgaactgctcaaaatat

SEQ ID NO: 2124 - DNA, 20 bp, Artificial Sequence
  chemically synthesized
tggaattccaatattttgag

SEQ ID NO: 2125 - DNA, 20 bp, Artificial Sequence
  chemically synthesized
ccaatattttgagcagttca

SEQ ID NO: 2126 - DNA, 20 bp, Artificial Sequence
  chemically synthesized
atattttgagcagttcaaag

SEQ ID NO: 2127 - DNA, 20 bp, Artificial Sequence
  chemically synthesized
attttgagcagttcaaagca

SEQ ID NO: 2128 - DNA, 20 bp, Artificial Sequence
  chemically synthesized
gcagttcaaagcagagctgt

SEQ ID NO: 2129 - DNA, 20 bp, Artificial Sequence
  chemically synthesized
agttcaaagcagagctgtga

SEQ ID NO: 2130 - DNA, 20 bp, Artificial Sequence
  chemically synthesized
atgctgtacaggatctctca

SEQ ID NO: 2131 - DNA, 20 bp, Artificial Sequence
  chemically synthesized
gagctgtgagagatcctgta

SEQ ID NO: 2132 - DNA, 20 bp, Artificial Sequence
  chemically synthesized
gggaaagggagatgctgtac

SEQ ID NO: 2133 - DNA, 20 bp, Artificial Sequence
  chemically synthesized
ggggaaagggagatgctgta

SEQ ID NO: 2134 - DNA, 20 bp, Artificial Sequence
  chemically synthesized
tgatgggtggaggggaaagg

SEQ ID NO: 2135 - DNA, 20 bp, Artificial Sequence
  chemically synthesized
aatgatgggtggaggggaaa

SEQ ID NO: 2136 - DNA, 20 bp, Artificial Sequence
  chemically synthesized
gaatgatgggtggaggggaa

SEQ ID NO: 2137 - DNA, 20 bp, Artificial Sequence
  chemically synthesized
agaatgatgggtggagggga

SEQ ID NO: 2138 - DNA, 20 bp, Artificial Sequence
  chemically synthesized
actgagaatgatgggtggag

SEQ ID NO: 2139 - DNA, 20 bp, Artificial Sequence
  chemically synthesized
cactgagaatgatgggtgga

SEQ ID NO: 2140 - DNA, 20 bp, Artificial Sequence
  chemically synthesized
ccactgagaatgatgggtgg

SEQ ID NO: 2141 - DNA, 20 bp, Artificial Sequence
  chemically synthesized
gccactgagaatgatgggtg

SEQ ID NO: 2142 - DNA, 20 bp, Artificial Sequence
  chemically synthesized
gagccactgagaatgatggg

SEQ ID NO: 2143 - DNA, 20 bp, Artificial Sequence
  chemically synthesized
ttggagccactgagaatgat

SEQ ID NO: 2144 - DNA, 20 bp, Artificial Sequence
  chemically synthesized
tcccctccacccatcattct

SEQ ID NO: 2145 - DNA, 20 bp, Artificial Sequence
  chemically synthesized
cttggagccactgagaatga

SEQ ID NO: 2146 - DNA, 20 bp, Artificial Sequence
  chemically synthesized
cctccacccatcattctcag

SEQ ID NO: 2147 - DNA, 20 bp, Artificial Sequence
  chemically synthesized
ttagtcttcttggagccact

SEQ ID NO: 2148 - DNA, 20 bp, Artificial Sequence
  chemically synthesized
ccatcattctcagtggctcc

SEQ ID NO: 2149 - DNA, 20 bp, Artificial Sequence
  chemically synthesized
tcattctcagtggctccaag

SEQ ID NO: 2150 - DNA, 20 bp, Artificial Sequence
  chemically synthesized
gggagtttttagtcttcttg

SEQ ID NO: 2151 - DNA, 20 bp, Artificial Sequence
  chemically synthesized
cagggagtttttagtcttct

SEQ ID NO: 2152 - DNA, 20 bp, Artificial Sequence
  chemically synthesized
aaattgtttcagggagtttt

SEQ ID NO: 2153 - DNA, 20 bp, Artificial Sequence
  chemically synthesized
agttctcaaattgtttcagg

SEQ ID NO: 2154 - DNA, 20 bp, Artificial Sequence
  chemically synthesized
gtagttctcaaattgtttca

SEQ ID NO: 2155 - DNA, 20 bp, Artificial Sequence
  chemically synthesized
agtagttctcaaattgtttc

SEQ ID NO: 2156 - DNA, 20 bp, Artificial Sequence
  chemically synthesized
tagtagttctcaaattgttt

SEQ ID NO: 2157 - DNA, 20 bp, Artificial Sequence
  chemically synthesized
aaaactccctgaaacaattt

SEQ ID NO: 2158 - DNA, 20 bp, Artificial Sequence
  chemically synthesized
tgaaacaatttgagaactac

SEQ ID NO: 2159 - DNA, 20 bp, Artificial Sequence
  chemically synthesized
caatttgagaactactagtc

SEQ ID NO: 2160 - DNA, 20 bp, Artificial Sequence
  chemically synthesized
acctcttcattccagactag

SEQ ID NO: 2161 - DNA, 20 bp, Artificial Sequence
  chemically synthesized
catacctcttcattccagac

SEQ ID NO: 2162 - DNA, 20 bp, Artificial Sequence
  chemically synthesized
agaactactagtctggaatg

SEQ ID NO: 2163 - DNA, 20 bp, Artificial Sequence
  chemically synthesized
aactactagtctggaatgaa

SEQ ID NO: 2164 - DNA, 20 bp, Artificial Sequence
  chemically synthesized
agctccatacctcttcattc

SEQ ID NO: 2165 - DNA, 20 bp, Artificial Sequence
  chemically synthesized
actactagtctggaatgaag

SEQ ID NO: 2166 - DNA, 20 bp, Artificial Sequence
  chemically synthesized
tagtctggaatgaagaggta

SEQ ID NO: 2167 - DNA, 20 bp, Artificial Sequence
  chemically synthesized
gtctggaatgaagaggtatg

SEQ ID NO: 2168 - DNA, 20 bp, Artificial Sequence
  chemically synthesized
aaaggtttctattggtgtcg

SEQ ID NO: 2169 - DNA, 20 bp, Artificial Sequence
  chemically synthesized
gtatggagctacgacaccaa

SEQ ID NO: 2170 - DNA, 20 bp, Artificial Sequence
  chemically synthesized
gagttttgaaaggtttctat

SEQ ID NO: 2171 - DNA, 20 bp, Artificial Sequence
  chemically synthesized
aaccttgagtgagttttgaa

SEQ ID NO: 2172 - DNA, 20 bp, Artificial Sequence
  chemically synthesized
taaccttgagtgagttttga

SEQ ID NO: 2173 - DNA, 20 bp, Artificial Sequence
  chemically synthesized
aaacctttcaaaactcactc

SEQ ID NO: 2174 - DNA, 20 bp, Artificial Sequence
  chemically synthesized
aacctttcaaaactcactca

SEQ ID NO: 2175 - DNA, 20 bp, Artificial Sequence
  chemically synthesized
tttgaaccctaaccttgagt

SEQ ID NO: 2176 - DNA, 20 bp, Artificial Sequence
  chemically synthesized
tttcaaaactcactcaaggt

SEQ ID NO: 2177 - DNA, 20 bp, Artificial Sequence
  chemically synthesized
ttcaaaactcactcaaggtt

SEQ ID NO: 2178 - DNA, 20 bp, Artificial Sequence
  chemically synthesized
tcaaaactcactcaaggtta

SEQ ID NO: 2179 - DNA, 20 bp, Artificial Sequence
  chemically synthesized
aagttttgaaccctaacctt

SEQ ID NO: 2180 - DNA, 20 bp, Artificial Sequence
  chemically synthesized
aggttagggttcaaaacttc

SEQ ID NO: 2181 - DNA, 20 bp, Artificial Sequence
  chemically synthesized
tatccttaaatgtatactag

SEQ ID NO: 2182 - DNA, 20 bp, Artificial Sequence
  chemically synthesized
aactatccttaaatgtatac

SEQ ID NO: 2183 - DNA, 20 bp, Artificial Sequence
  chemically synthesized
aaaacttctagtatacattt

SEQ ID NO: 2184 - DNA, 20 bp, Artificial Sequence
  chemically synthesized
aaacttctagtatacattta

SEQ ID NO: 2185 - DNA, 20 bp, Artificial Sequence
  chemically synthesized
ttctagtatacatttaagga

SEQ ID NO: 2186 - DNA, 20 bp, Artificial Sequence
  chemically synthesized
tacatttaaggatagtttct

SEQ ID NO: 2187 - DNA, 20 bp, Artificial Sequence
  chemically synthesized
ggagagagggaagaaaaact

SEQ ID NO: 2188 - DNA, 20 bp, Artificial Sequence
  chemically synthesized
agaaagagaaggagagaggg

SEQ ID NO: 2189 - DNA, 20 bp, Artificial Sequence
  chemically synthesized
ggaagaaagagaaggagaga

SEQ ID NO: 2190 - DNA, 20 bp, Artificial Sequence
  chemically synthesized
gggaagaaagagaaggagag

SEQ ID NO: 2191 - DNA, 20 bp, Artificial Sequence
  chemically synthesized
agggaagaaagagaaggaga

SEQ ID NO: 2192 - DNA, 20 bp, Artificial Sequence
  chemically synthesized
ggagggaagaaagagaagga

SEQ ID NO: 2193 - DNA, 20 bp, Artificial Sequence
  chemically synthesized
agggagggaagaaagagaag

SEQ ID NO: 2194 - DNA, 20 bp, Artificial Sequence
  chemically synthesized
aaagggagggaagaaagaga

SEQ ID NO: 2195 - DNA, 20 bp, Artificial Sequence
  chemically synthesized
gaaagggagggaagaaagag

SEQ ID NO: 2196 - DNA, 20 bp, Artificial Sequence
  chemically synthesized
ggagaaagggagggaagaaa

SEQ ID NO: 2197 - DNA, 20 bp, Artificial Sequence
  chemically synthesized
aaggagaaagggagggaaga

SEQ ID NO: 2198 - DNA, 20 bp, Artificial Sequence
  chemically synthesized
agagaaggagaaagggaggg

SEQ ID NO: 2199 - DNA, 20 bp, Artificial Sequence
  chemically synthesized
gggagagaaggagaaaggga

SEQ ID NO: 2200 - DNA, 20 bp, Artificial Sequence
  chemically synthesized
agggagagaaggagaaaggg

SEQ ID NO: 2201 - DNA, 20 bp, Artificial Sequence
  chemically synthesized
aagggagagaaggagaaagg

SEQ ID NO: 2202 - DNA, 20 bp, Artificial Sequence
  chemically synthesized
ggaagggagagaaggagaaa

SEQ ID NO: 2203 - DNA, 20 bp, Artificial Sequence
  chemically synthesized
aggaagggagagaaggagaa

SEQ ID NO: 2204 - DNA, 20 bp, Artificial Sequence
  chemically synthesized
gaggaagggagagaaggaga

SEQ ID NO: 2205 - DNA, 20 bp, Artificial Sequence
  chemically synthesized
aagagaggaagggagagaag

SEQ ID NO: 2206 - DNA, 20 bp, Artificial Sequence
  chemically synthesized
ggaagagaggaagggagaga

SEQ ID NO: 2207 - DNA, 20 bp, Artificial Sequence
  chemically synthesized
aggaagagaggaagggagag

SEQ ID NO: 2208 - DNA, 20 bp, Artificial Sequence
  chemically synthesized
agaaggaagagaggaaggga

SEQ ID NO: 2209 - DNA, 20 bp, Artificial Sequence
  chemically synthesized
tcagaaggaagagaggaagg

SEQ ID NO: 2210 - DNA, 20 bp, Artificial Sequence
  chemically synthesized
attcagaaggaagagaggaa

SEQ ID NO: 2211 - DNA, 20 bp, Artificial Sequence
  chemically synthesized
aattcagaaggaagagagga

SEQ ID NO: 2212 - DNA, 20 bp, Artificial Sequence
  chemically synthesized
aaattcagaaggaagagagg

SEQ ID NO: 2213 - DNA, 20 bp, Artificial Sequence
  chemically synthesized
aggaaattcagaaggaagag

SEQ ID NO: 2214 - DNA, 20 bp, Artificial Sequence
  chemically synthesized
taggaaattcagaaggaaga

SEQ ID NO: 2215 - DNA, 20 bp, Artificial Sequence
  chemically synthesized
tgtaggaaattcagaaggaa

SEQ ID NO: 2216 - DNA, 20 bp, Artificial Sequence
  chemically synthesized
catgtaggaaattcagaagg

SEQ ID NO: 2217 - DNA, 20 bp, Artificial Sequence
  chemically synthesized
agtcatgtaggaaattcaga

SEQ ID NO: 2218 - DNA, 20 bp, Artificial Sequence
  chemically synthesized
gagtcatgtaggaaattcag

SEQ ID NO: 2219 - DNA, 20 bp, Artificial Sequence
  chemically synthesized
gctgagtcatgtaggaaatt

SEQ ID NO: 2220 - DNA, 20 bp, Artificial Sequence
  chemically synthesized
aagaaatcgctgagtcatgt

SEQ ID NO: 2221 - DNA, 20 bp, Artificial Sequence
  chemically synthesized
tctgaatttcctacatgact

SEQ ID NO: 2222 - DNA, 20 bp, Artificial Sequence
  chemically synthesized
taagaaatcgctgagtcatg

SEQ ID NO: 2223 - DNA, 20 bp, Artificial Sequence
  chemically synthesized
gatactcctaagaaatcgct

SEQ ID NO: 2224 - DNA, 20 bp, Artificial Sequence
  chemically synthesized
tacatgactcagcgatttct

SEQ ID NO: 2225 - DNA, 20 bp, Artificial Sequence
  chemically synthesized
acatgactcagcgatttctt

SEQ ID NO: 2226 - DNA, 20 bp, Artificial Sequence
  chemically synthesized
atgactcagcgatttcttag

SEQ ID NO: 2227 - DNA, 20 bp, Artificial Sequence
  chemically synthesized
gctgaaaatctgatactcct

SEQ ID NO: 2228 - DNA, 20 bp, Artificial Sequence
  chemically synthesized
cagcgatttcttaggagtat

SEQ ID NO: 2229 - DNA, 20 bp, Artificial Sequence
  chemically synthesized
tcttaggagtatcagatttt

SEQ ID NO: 2230 - DNA, 20 bp, Artificial Sequence
  chemically synthesized
tacctggcccttacgtggtc

SEQ ID NO: 2231 - DNA, 20 bp, Artificial Sequence
  chemically synthesized
gattttcagcttgaccacgt

SEQ ID NO: 2232 - DNA, 20 bp, Artificial Sequence
  chemically synthesized
attttcagcttgaccacgta

SEQ ID NO: 2233 - DNA, 20 bp, Artificial Sequence
  chemically synthesized
ttttcagcttgaccacgtaa

SEQ ID NO: 2234 - DNA, 20 bp, Artificial Sequence
  chemically synthesized
ttaaatacctggcccttacg

SEQ ID NO: 2235 - DNA, 20 bp, Artificial Sequence
  chemically synthesized
cagcttgaccacgtaagggc

SEQ ID NO: 2236 - DNA, 20 bp, Artificial Sequence
  chemically synthesized
agcttgaccacgtaagggcc

SEQ ID NO: 2237 - DNA, 20 bp, Artificial Sequence
  chemically synthesized
cacgtaagggccaggtattt

SEQ ID NO: 2238 - DNA, 20 bp, Artificial Sequence
  chemically synthesized
tgaggagcatcttaaatacc

SEQ ID NO: 2239 - DNA, 20 bp, Artificial Sequence
  chemically synthesized
aggtatttaagatgctcctc

SEQ ID NO: 2240 - DNA, 20 bp, Artificial Sequence
  chemically synthesized
atttaagatgctcctcaagc

SEQ ID NO: 2241 - DNA, 20 bp, Artificial Sequence
  chemically synthesized
cctcttttccctggcttgag

SEQ ID NO: 2242 - DNA, 20 bp, Artificial Sequence
  chemically synthesized
tttaagatgctcctcaagcc

SEQ ID NO: 2243 - DNA, 20 bp, Artificial Sequence
  chemically synthesized
ttaagatgctcctcaagcca

SEQ ID NO: 2244 - DNA, 20 bp, Artificial Sequence
  chemically synthesized
tccctcttttccctggcttg

SEQ ID NO: 2245 - DNA, 20 bp, Artificial Sequence
  chemically synthesized
ctccctcttttccctggctt

SEQ ID NO: 2246 - DNA, 20 bp, Artificial Sequence
  chemically synthesized
atgctcctcaagccagggaa

SEQ ID NO: 2247 - DNA, 20 bp, Artificial Sequence
  chemically synthesized
gctcctcaagccagggaaaa

SEQ ID NO: 2248 - DNA, 20 bp, Artificial Sequence
  chemically synthesized
atttttctccctcttttccc

SEQ ID NO: 2249 - DNA, 20 bp, Artificial Sequence
  chemically synthesized
ctcctcaagccagggaaaag

SEQ ID NO: 2250 - DNA, 20 bp, Artificial Sequence
  chemically synthesized
tcctcaagccagggaaaaga

SEQ ID NO: 2251 - DNA, 20 bp, Artificial Sequence
  chemically synthesized
ctcaagccagggaaaagagg

SEQ ID NO: 2252 - DNA, 20 bp, Artificial Sequence
  chemically synthesized
agggaaaagagggagaaaaa

SEQ ID NO: 2253 - DNA, 20 bp, Artificial Sequence
  chemically synthesized
gggaaaagagggagaaaaat

SEQ ID NO: 2254 - DNA, 20 bp, Artificial Sequence
  chemically synthesized
agagggagaaaaatgggtac

SEQ ID NO: 2255 - DNA, 20 bp, Artificial Sequence
  chemically synthesized
aaaaatgggtactagctcct

SEQ ID NO: 2256 - DNA, 20 bp, Artificial Sequence
  chemically synthesized
gacacccacagctgaggagc

SEQ ID NO: 2257 - DNA, 20 bp, Artificial Sequence
  chemically synthesized
tagtgacacccacagctgag

SEQ ID NO: 2258 - DNA, 20 bp, Artificial Sequence
  chemically synthesized
gggtactagctcctcagctg

SEQ ID NO: 2259 - DNA, 20 bp, Artificial Sequence
  chemically synthesized
ggtactagctcctcagctgt

SEQ ID NO: 2260 - DNA, 20 bp, Artificial Sequence
  chemically synthesized
actagtgacacccacagctg

SEQ ID NO: 2261 - DNA, 20 bp, Artificial Sequence
  chemically synthesized
cactagtgacacccacagct

SEQ ID NO: 2262 - DNA, 20 bp, Artificial Sequence
  chemically synthesized
tctcccactagtgacaccca

SEQ ID NO: 2263 - DNA, 20 bp, Artificial Sequence
  chemically synthesized
tcctcagctgtgggtgtcac

SEQ ID NO: 2264 - DNA, 20 bp, Artificial Sequence
  chemically synthesized
tcagctgtgggtgtcactag

SEQ ID NO: 2265 - DNA, 20 bp, Artificial Sequence
  chemically synthesized
cagctgtgggtgtcactagt

SEQ ID NO: 2266 - DNA, 20 bp, Artificial Sequence
  chemically synthesized
gctgtgggtgtcactagtgg

SEQ ID NO: 2267 - DNA, 20 bp, Artificial Sequence
  chemically synthesized
atttggtatggatctcccac

SEQ ID NO: 2268 - DNA, 20 bp, Artificial Sequence
  chemically synthesized
gatgggaacatcatttggta

SEQ ID NO: 2269 - DNA, 20 bp, Artificial Sequence
  chemically synthesized
caaatgatgggaacatcatt

SEQ ID NO: 2270 - DNA, 20 bp, Artificial Sequence
  chemically synthesized
caaatgatgttcccatcatt

SEQ ID NO: 2271 - DNA, 20 bp, Artificial Sequence
  chemically synthesized
aaatgatgttcccatcattt

SEQ ID NO: 2272 - DNA, 20 bp, Artificial Sequence
  chemically synthesized
tgttctcctccccaaatgat

SEQ ID NO: 2273 - DNA, 20 bp, Artificial Sequence
  chemically synthesized
aatgatgttcccatcatttg

SEQ ID NO: 2274 - DNA, 20 bp, Artificial Sequence
  chemically synthesized
atgttctcctccccaaatga

SEQ ID NO: 2275 - DNA, 20 bp, Artificial Sequence
  chemically synthesized
tgatgttcccatcatttggg

SEQ ID NO: 2276 - DNA, 20 bp, Artificial Sequence
  chemically synthesized
gatgttcccatcatttgggg

SEQ ID NO: 2277 - DNA, 20 bp, Artificial Sequence
  chemically synthesized
tgttcccatcatttggggag

SEQ ID NO: 2278 - DNA, 20 bp, Artificial Sequence
  chemically synthesized
gaacatcattctttccttga

SEQ ID NO: 2279 - DNA, 20 bp, Artificial Sequence
  chemically synthesized
gggatttcagccatcaagga

SEQ ID NO: 2280 - DNA, 20 bp, Artificial Sequence
  chemically synthesized
tactgggatttcagccatca

SEQ ID NO: 2281 - DNA, 20 bp, Artificial Sequence
  chemically synthesized
atactgggatttcagccatc

SEQ ID NO: 2282 - DNA, 20 bp, Artificial Sequence
  chemically synthesized
ttccttgatggctgaaatcc

SEQ ID NO: 2283 - DNA, 20 bp, Artificial Sequence
  chemically synthesized
agtgattcatactgggattt

SEQ ID NO: 2284 - DNA, 20 bp, Artificial Sequence
  chemically synthesized
aggggtgagtgattcatact

SEQ ID NO: 2285 - DNA, 20 bp, Artificial Sequence
  chemically synthesized
aaggggtgagtgattcatac

SEQ ID NO: 2286 - DNA, 20 bp, Artificial Sequence
  chemically synthesized
aggaatcaaaaagaaggggt

SEQ ID NO: 2287 - DNA, 20 bp, Artificial Sequence
  chemically synthesized
ctaaaggaatcaaaaagaag

SEQ ID NO: 2288 - DNA, 20 bp, Artificial Sequence
  chemically synthesized
gctaaaggaatcaaaaagaa

SEQ ID NO: 2289 - DNA, 20 bp, Artificial Sequence
  chemically synthesized
tgctaaaggaatcaaaaaga

SEQ ID NO: 2290 - DNA, 20 bp, Artificial Sequence
  chemically synthesized
ttgctaaaggaatcaaaaag

SEQ ID NO: 2291 - DNA, 20 bp, Artificial Sequence
  chemically synthesized
accttgctaaaggaatcaaa

SEQ ID NO: 2292 - DNA, 20 bp, Artificial Sequence
  chemically synthesized
ccccttctttttgattcctt

SEQ ID NO: 2293 - DNA, 20 bp, Artificial Sequence
  chemically synthesized
ttctttttgattcctttagc

SEQ ID NO: 2294 - DNA, 20 bp, Artificial Sequence
  chemically synthesized
tctttttgattcctttagca

SEQ ID NO: 2295 - DNA, 20 bp, Artificial Sequence
  chemically synthesized
ttttaaaaaaaccttgctaa

SEQ ID NO: 2296 - DNA, 20 bp, Artificial Sequence
  chemically synthesized
tttttaaaaaaaccttgcta

SEQ ID NO: 2297 - DNA, 20 bp, Artificial Sequence
  chemically synthesized
ttagcaaggtttttttaaaa

SEQ ID NO: 2298 - DNA, 20 bp, Artificial Sequence
  chemically synthesized
agacagtattatgaaacata

SEQ ID NO: 2299 - DNA, 20 bp, Artificial Sequence
  chemically synthesized
ttatgtttcataatactgtc

SEQ ID NO: 2300 - DNA, 20 bp, Artificial Sequence
  chemically synthesized
tgtttcataatactgtctgg

SEQ ID NO: 2301 - DNA, 20 bp, Artificial Sequence
  chemically synthesized
gaattaattctgccaccaga

SEQ ID NO: 2302 - DNA, 20 bp, Artificial Sequence
  chemically synthesized
ttcataatactgtctggtgg

SEQ ID NO: 2303 - DNA, 20 bp, Artificial Sequence
  chemically synthesized
aagggaattaattctgccac

SEQ ID NO: 2304 - DNA, 20 bp, Artificial Sequence
  chemically synthesized
cttatagtcttacaggggaa

SEQ ID NO: 2305 - DNA, 20 bp, Artificial Sequence
  chemically synthesized
gcttatagtcttacagggga

SEQ ID NO: 2306 - DNA, 20 bp, Artificial Sequence
  chemically synthesized
aattaattcccttcccctgt

SEQ ID NO: 2307 - DNA, 20 bp, Artificial Sequence
  chemically synthesized
ggcttatagtcttacagggg

SEQ ID NO: 2308 - DNA, 20 bp, Artificial Sequence
  chemically synthesized
agaggcttatagtcttacag

SEQ ID NO: 2309 - DNA, 20 bp, Artificial Sequence
  chemically synthesized
aagaggcttatagtcttaca

SEQ ID NO: 2310 - DNA, 20 bp, Artificial Sequence
  chemically synthesized
caagaggcttatagtcttac

SEQ ID NO: 2311 - DNA, 20 bp, Artificial Sequence
  chemically synthesized
tcaagaggcttatagtctta

SEQ ID NO: 2312 - DNA, 20 bp, Artificial Sequence
  chemically synthesized
cccttcccctgtaagactat

SEQ ID NO: 2313 - DNA, 20 bp, Artificial Sequence
  chemically synthesized
ccccgtcctcaagaggctta

SEQ ID NO: 2314 - DNA, 20 bp, Artificial Sequence
  chemically synthesized
tgtaagactataagcctctt

SEQ ID NO: 2315 - DNA, 20 bp, Artificial Sequence
  chemically synthesized
gtaagactataagcctcttg

SEQ ID NO: 2316 - DNA, 20 bp, Artificial Sequence
  chemically synthesized
atgtggaccccgtcctcaag

SEQ ID NO: 2317 - DNA, 20 bp, Artificial Sequence
  chemically synthesized
gactataagcctcttgagga

SEQ ID NO: 2318 - DNA, 20 bp, Artificial Sequence
  chemically synthesized
catgtggaccccgtcctcaa

SEQ ID NO: 2319 - DNA, 20 bp, Artificial Sequence
  chemically synthesized
actataagcctcttgaggac

SEQ ID NO: 2320 - DNA, 20 bp, Artificial Sequence
  chemically synthesized
ctataagcctcttgaggacg

SEQ ID NO: 2321 - DNA, 20 bp, Artificial Sequence
  chemically synthesized
aacatgtggaccccgtcctc

SEQ ID NO: 2322 - DNA, 20 bp, Artificial Sequence
  chemically synthesized
agaggtggatgagcaacatg

SEQ ID NO: 2323 - DNA, 20 bp, Artificial Sequence
  chemically synthesized
ttgggcatagagaggtggat

SEQ ID NO: 2324 - DNA, 20 bp, Artificial Sequence
  chemically synthesized
gggcattgggcatagagagg

SEQ ID NO: 2325 - DNA, 20 bp, Artificial Sequence
  chemically synthesized
acagggcattgggcatagag

SEQ ID NO: 2326 - DNA, 20 bp, Artificial Sequence
  chemically synthesized
tacagggcattgggcataga

SEQ ID NO: 2327 - DNA, 20 bp, Artificial Sequence
  chemically synthesized
ggtacagggcattgggcata

SEQ ID NO: 2328 - DNA, 20 bp, Artificial Sequence
  chemically synthesized
acggtacagggcattgggca

SEQ ID NO: 2329 - DNA, 20 bp, Artificial Sequence
  chemically synthesized
tatatacggtacagggcatt

SEQ ID NO: 2330 - DNA, 20 bp, Artificial Sequence
  chemically synthesized
gtatatacggtacagggcat

SEQ ID NO: 2331 - DNA, 20 bp, Artificial Sequence
  chemically synthesized
aagtgtgtatatacggtaca

SEQ ID NO: 2332 - DNA, 20 bp, Artificial Sequence
  chemically synthesized
aaagtgtgtatatacggtac

SEQ ID NO: 2333 - DNA, 20 bp, Artificial Sequence
  chemically synthesized
aaaagtgtgtatatacggta

SEQ ID NO: 2334 - DNA, 20 bp, Artificial Sequence
  chemically synthesized
ataccaaaagtgtgtatata

SEQ ID NO: 2335 - DNA, 20 bp, Artificial Sequence
  chemically synthesized
gtaccgtatatacacacttt

SEQ ID NO: 2336 - DNA, 20 bp, Artificial Sequence
  chemically synthesized
cagtatttatcaaataccaa

SEQ ID NO: 2337 - DNA, 20 bp, Artificial Sequence
  chemically synthesized
ttttggtatttgataaatac

SEQ ID NO: 2338 - DNA, 20 bp, Artificial Sequence
  chemically synthesized
tatttgataaatactggctg

SEQ ID NO: 2339 - DNA, 20 bp, Artificial Sequence
  chemically synthesized
ctttaccaattcacttcagc

SEQ ID NO: 2340 - DNA, 20 bp, Artificial Sequence
  chemically synthesized
actactttaccaattcactt

SEQ ID NO: 2341 - DNA, 20 bp, Artificial Sequence
  chemically synthesized
aaatactggctgaagtgaat

SEQ ID NO: 2342 - DNA, 20 bp, Artificial Sequence
  chemically synthesized
ctggctgaagtgaattggta

SEQ ID NO: 2343 - DNA, 20 bp, Artificial Sequence
  chemically synthesized
gctgaagtgaattggtaaag

SEQ ID NO: 2344 - DNA, 20 bp, Artificial Sequence
  chemically synthesized
gaagtgaattggtaaagtag

SEQ ID NO: 2345 - DNA, 20 bp, Artificial Sequence
  chemically synthesized
tgaattggtaaagtagtagt

SEQ ID NO: 2346 - DNA, 20 bp, Artificial Sequence
  chemically synthesized
gaattggtaaagtagtagtt

SEQ ID NO: 2347 - DNA, 20 bp, Artificial Sequence
  chemically synthesized
gtagtagttgggtcatgacc

SEQ ID NO: 2348 - DNA, 20 bp, Artificial Sequence
  chemically synthesized
agtagttgggtcatgaccaa

SEQ ID NO: 2349 - DNA, 20 bp, Artificial Sequence
  chemically synthesized
gtagttgggtcatgaccaag

SEQ ID NO: 2350 - DNA, 20 bp, Artificial Sequence
  chemically synthesized
agttgggtcatgaccaagag

SEQ ID NO: 2351 - DNA, 20 bp, Artificial Sequence
  chemically synthesized
taacacagaaggactcctct

SEQ ID NO: 2352 - DNA, 20 bp, Artificial Sequence
  chemically synthesized
caagttacttataacacaga

SEQ ID NO: 2353 - DNA, 20 bp, Artificial Sequence
  chemically synthesized
gcaagttacttataacacag

SEQ ID NO: 2354 - DNA, 20 bp, Artificial Sequence
  chemically synthesized
gaggagtccttctgtgttat

SEQ ID NO: 2355 - DNA, 20 bp, Artificial Sequence
  chemically synthesized
agggcaagttacttataaca

SEQ ID NO: 2356 - DNA, 20 bp, Artificial Sequence
  chemically synthesized
aaagtgtgccagtgaagggc

SEQ ID NO: 2357 - DNA, 20 bp, Artificial Sequence
  chemically synthesized
ataagtaacttgcccttcac

SEQ ID NO: 2358 - DNA, 20 bp, Artificial Sequence
  chemically synthesized
aactaaagtgtgccagtgaa

SEQ ID NO: 2359 - DNA, 20 bp, Artificial Sequence
  chemically synthesized
aaactaaagtgtgccagtga

SEQ ID NO: 2360 - DNA, 20 bp, Artificial Sequence
  chemically synthesized
caaactaaagtgtgccagtg

SEQ ID NO: 2361 - DNA, 20 bp, Artificial Sequence
  chemically synthesized
gcatccaaactaaagtgtgc

SEQ ID NO: 2362 - DNA, 20 bp, Artificial Sequence
  chemically synthesized
tgcccttcactggcacactt

SEQ ID NO: 2363 - DNA, 20 bp, Artificial Sequence
  chemically synthesized
ttcactggcacactttagtt

SEQ ID NO: 2364 - DNA, 20 bp, Artificial Sequence
  chemically synthesized
cacctttggcatccaaacta

SEQ ID NO: 2365 - DNA, 20 bp, Artificial Sequence
  chemically synthesized
acactttagtttggatgcca

SEQ ID NO: 2366 - DNA, 20 bp, Artificial Sequence
  chemically synthesized
cactttagtttggatgccaa

SEQ ID NO: 2367 - DNA, 20 bp, Artificial Sequence
  chemically synthesized
tttagtttggatgccaaagg

SEQ ID NO: 2368 - DNA, 20 bp, Artificial Sequence
  chemically synthesized
ttagtttggatgccaaaggt

SEQ ID NO: 2369 - DNA, 20 bp, Artificial Sequence
  chemically synthesized
cgaaacaagttacccacctt

SEQ ID NO: 2370 - DNA, 20 bp, Artificial Sequence
  chemically synthesized
caaaggtgggtaacttgttt

SEQ ID NO: 2371 - DNA, 20 bp, Artificial Sequence
  chemically synthesized
ccaaagttacatgccgaaac

SEQ ID NO: 2372 - DNA, 20 bp, Artificial Sequence
  chemically synthesized
cttgtttcggcatgtaactt

SEQ ID NO: 2373 - DNA, 20 bp, Artificial Sequence
  chemically synthesized
ttcggcatgtaactttggtc

SEQ ID NO: 2374 - DNA, 20 bp, Artificial Sequence
  chemically synthesized
aagttttcaaaactagacca

SEQ ID NO: 2375 - DNA, 20 bp, Artificial Sequence
  chemically synthesized
agatctcaagttttcaaaac

SEQ ID NO: 2376 - DNA, 20 bp, Artificial Sequence
  chemically synthesized
tggtctagttttgaaaactt

SEQ ID NO: 2377 - DNA, 20 bp, Artificial Sequence
  chemically synthesized
ctgtccttcctaaagatctc

SEQ ID NO: 2378 - DNA, 20 bp, Artificial Sequence
  chemically synthesized
ttttgaaaacttgagatctt

SEQ ID NO: 2379 - DNA, 20 bp, Artificial Sequence
  chemically synthesized
tttgaaaacttgagatcttt

SEQ ID NO: 2380 - DNA, 20 bp, Artificial Sequence
  chemically synthesized
gaaaacttgagatctttagg

SEQ ID NO: 2381 - DNA, 20 bp, Artificial Sequence
  chemically synthesized
aaaacttgagatctttagga

SEQ ID NO: 2382 - DNA, 20 bp, Artificial Sequence
  chemically synthesized
taacaacactgtccttccta

SEQ ID NO: 2383 - DNA, 20 bp, Artificial Sequence
  chemically synthesized
cttgagatctttaggaagga

SEQ ID NO: 2384 - DNA, 20 bp, Artificial Sequence
  chemically synthesized
tttaggaaggacagtgttgt

SEQ ID NO: 2385 - DNA, 20 bp, Artificial Sequence
  chemically synthesized
ggaaggacagtgttgttaga

SEQ ID NO: 2386 - DNA, 20 bp, Artificial Sequence
  chemically synthesized
tgttagaaagccatgtgatt

SEQ ID NO: 2387 - DNA, 20 bp, Artificial Sequence
  chemically synthesized
taattacattctaaatcaca

SEQ ID NO: 2388 - DNA, 20 bp, Artificial Sequence
  chemically synthesized
tgtgatttagaatgtaatta

SEQ ID NO: 2389 - DNA, 20 bp, Artificial Sequence
  chemically synthesized
gtaattatggttatgtactt

SEQ ID NO: 2390 - DNA, 20 bp, Artificial Sequence
  chemically synthesized
agaatcatcgttacattctg

SEQ ID NO: 2391 - DNA, 20 bp, Artificial Sequence
  chemically synthesized
tatgtatcattaagcattca

SEQ ID NO: 2392 - DNA, 20 bp, Artificial Sequence
  chemically synthesized
tactaaagatatgtatcatt

SEQ ID NO: 2393 - DNA, 20 bp, Artificial Sequence
  chemically synthesized
tgcttaatgatacatatctt

SEQ ID NO: 2394 - DNA, 20 bp, Artificial Sequence
  chemically synthesized
ggcttagtgtagaattacta

SEQ ID NO: 2395 - DNA, 20 bp, Artificial Sequence
  chemically synthesized
atctttagtaattctacact

SEQ ID NO: 2396 - DNA, 20 bp, Artificial Sequence
  chemically synthesized
gttctgaatatggcttagtg

SEQ ID NO: 2397 - DNA, 20 bp, Artificial Sequence
  chemically synthesized
actgagttctgaatatggct

SEQ ID NO: 2398 - DNA, 20 bp, Artificial Sequence
  chemically synthesized
attctacactaagccatatt

SEQ ID NO: 2399 - DNA, 20 bp, Artificial Sequence
  chemically synthesized
tgataactgagttctgaata

SEQ ID NO: 2400 - DNA, 20 bp, Artificial Sequence
  chemically synthesized
actaagccatattcagaact

SEQ ID NO: 2401 - DNA, 20 bp, Artificial Sequence
  chemically synthesized
gaaataatcaattgataact

SEQ ID NO: 2402 - DNA, 20 bp, Artificial Sequence
  chemically synthesized
attgattatttcttaatatg

SEQ ID NO: 2403 - DNA, 20 bp, Artificial Sequence
  chemically synthesized
gtcatttgctgctacatatt

SEQ ID NO: 2404 - DNA, 20 bp, Artificial Sequence
  chemically synthesized
gattatttcttaatatgtag

SEQ ID NO: 2405 - DNA, 20 bp, Artificial Sequence
  chemically synthesized
aaggatctggaacataacac

SEQ ID NO: 2406 - DNA, 20 bp, Artificial Sequence
  chemically synthesized
aaatgacttgtgttatgttc

SEQ ID NO: 2407 - DNA, 20 bp, Artificial Sequence
  chemically synthesized
atggtttctgaagaaggatc

SEQ ID NO: 2408 - DNA, 20 bp, Artificial Sequence
  chemically synthesized
ttatgttccagatccttctt

SEQ ID NO: 2409 - DNA, 20 bp, Artificial Sequence
  chemically synthesized
taaaatatggtttctgaaga

SEQ ID NO: 2410 - DNA, 20 bp, Artificial Sequence
  chemically synthesized
ataaaatatggtttctgaag

SEQ ID NO: 2411 - DNA, 20 bp, Artificial Sequence
  chemically synthesized
ttcataaaatatggtttctg

SEQ ID NO: 2412 - DNA, 20 bp, Artificial Sequence
  chemically synthesized
aggtccattttcataaaata

SEQ ID NO: 2413 - DNA, 20 bp, Artificial Sequence
  chemically synthesized
gaaaccatattttatgaaaa

SEQ ID NO: 2414 - DNA, 20 bp, Artificial Sequence
  chemically synthesized
ttttatgaaaatggacctcc

SEQ ID NO: 2415 - DNA, 20 bp, Artificial Sequence
  chemically synthesized
ttatgaaaatggacctccca

SEQ ID NO: 2416 - DNA, 20 bp, Artificial Sequence
  chemically synthesized
agagttagcttggctctggg

SEQ ID NO: 2417 - DNA, 20 bp, Artificial Sequence
  chemically synthesized
tagagttagcttggctctgg

SEQ ID NO: 2418 - DNA, 20 bp, Artificial Sequence
  chemically synthesized
aaaatggacctcccagagcc

SEQ ID NO: 2419 - DNA, 20 bp, Artificial Sequence
  chemically synthesized
attagagttagcttggctct

SEQ ID NO: 2420 - DNA, 20 bp, Artificial Sequence
  chemically synthesized
gattagagttagcttggctc

SEQ ID NO: 2421 - DNA, 20 bp, Artificial Sequence
  chemically synthesized
agaagagattagagttagct

SEQ ID NO: 2422 - DNA, 20 bp, Artificial Sequence
  chemically synthesized
attttagaagagattagagt

SEQ ID NO: 2423 - DNA, 20 bp, Artificial Sequence
  chemically synthesized
gaggattttagaagagatta

SEQ ID NO: 2424 - DNA, 20 bp, Artificial Sequence
  chemically synthesized
gggaggattttagaagagat

SEQ ID NO: 2425 - DNA, 20 bp, Artificial Sequence
  chemically synthesized
gatgagggaggattttagaa

SEQ ID NO: 2426 - DNA, 20 bp, Artificial Sequence
  chemically synthesized
gtgatgagggaggattttag

SEQ ID NO: 2427 - DNA, 20 bp, Artificial Sequence
  chemically synthesized
caagtgatgagggaggattt

SEQ ID NO: 2428 - DNA, 20 bp, Artificial Sequence
  chemically synthesized
ggggacccaagtgatgaggg

SEQ ID NO: 2429 - DNA, 20 bp, Artificial Sequence
  chemically synthesized
tggggacccaagtgatgagg

SEQ ID NO: 2430 - DNA, 20 bp, Artificial Sequence
  chemically synthesized
cgtggggacccaagtgatga

SEQ ID NO: 2431 - DNA, 20 bp, Artificial Sequence
  chemically synthesized
taaaatcctccctcatcact

SEQ ID NO: 2432 - DNA, 20 bp, Artificial Sequence
  chemically synthesized
acgtggggacccaagtgatg

SEQ ID NO: 2433 - DNA, 20 bp, Artificial Sequence
  chemically synthesized
aaaatcctccctcatcactt

SEQ ID NO: 2434 - DNA, 20 bp, Artificial Sequence
  chemically synthesized
tacgtggggacccaagtgat

SEQ ID NO: 2435 - DNA, 20 bp, Artificial Sequence
  chemically synthesized
taatgagtacgtggggaccc

SEQ ID NO: 2436 - DNA, 20 bp, Artificial Sequence
  chemically synthesized
aatgtgttaatgagtacgtg

SEQ ID NO: 2437 - DNA, 20 bp, Artificial Sequence
  chemically synthesized
taatgtgttaatgagtacgt

SEQ ID NO: 2438 - DNA, 20 bp, Artificial Sequence
  chemically synthesized
gtaatgtgttaatgagtacg

SEQ ID NO: 2439 - DNA, 20 bp, Artificial Sequence
  chemically synthesized
tccttttgtaatgtgttaat

SEQ ID NO: 2440 - DNA, 20 bp, Artificial Sequence
  chemically synthesized
tactcattaacacattacaa

SEQ ID NO: 2441 - DNA, 20 bp, Artificial Sequence
  chemically synthesized
actcattaacacattacaaa

SEQ ID NO: 2442 - DNA, 20 bp, Artificial Sequence
  chemically synthesized
cattaacacattacaaaagg

SEQ ID NO: 2443 - DNA, 20 bp, Artificial Sequence
  chemically synthesized
attaacacattacaaaagga

SEQ ID NO: 2444 - DNA, 20 bp, Artificial Sequence
  chemically synthesized
ctttttctaaagtgaaaaaa

SEQ ID NO: 2445 - DNA, 20 bp, Artificial Sequence
  chemically synthesized
actttttctaaagtgaaaaa

SEQ ID NO: 2446 - DNA, 20 bp, Artificial Sequence
  chemically synthesized
gaaggtcctttttttcactt

SEQ ID NO: 2447 - DNA, 20 bp, Artificial Sequence
  chemically synthesized
cctttttttcactttagaaa

SEQ ID NO: 2448 - DNA, 20 bp, Artificial Sequence
  chemically synthesized
tttgtttttaactttttcta

SEQ ID NO: 2449 - DNA, 20 bp, Artificial Sequence
  chemically synthesized
aatgatattttctactgtaa

SEQ ID NO: 2450 - DNA, 20 bp, Artificial Sequence
  chemically synthesized
atgatattttctactgtaaa

SEQ ID NO: 2451 - DNA, 20 bp, Artificial Sequence
  chemically synthesized
tagaactagtccttttacag

SEQ ID NO: 2452 - DNA, 20 bp, Artificial Sequence
  chemically synthesized
gcgtagaactagtcctttta

SEQ ID NO: 2453 - DNA, 20 bp, Artificial Sequence
  chemically synthesized
attttctactgtaaaaggac

SEQ ID NO: 2454 - DNA, 20 bp, Artificial Sequence
  chemically synthesized
ctgttttgtcagcgtagaac

SEQ ID NO: 2455 - DNA, 20 bp, Artificial Sequence
  chemically synthesized
tagcctctgttttgtcagcg

SEQ ID NO: 2456 - DNA, 20 bp, Artificial Sequence
  chemically synthesized
ctagttctacgctgacaaaa

SEQ ID NO: 2457 - DNA, 20 bp, Artificial Sequence
  chemically synthesized
tcaagtagcctctgttttgt

SEQ ID NO: 2458 - DNA, 20 bp, Artificial Sequence
  chemically synthesized
agttctacgctgacaaaaca

SEQ ID NO: 2459 - DNA, 20 bp, Artificial Sequence
  chemically synthesized
gttctacgctgacaaaacag

SEQ ID NO: 2460 - DNA, 20 bp, Artificial Sequence
  chemically synthesized
ttaaaaatgttgtaatcaag

SEQ ID NO: 2461 - DNA, 20 bp, Artificial Sequence
  chemically synthesized
cttttaaaaatgttgtaatc

SEQ ID NO: 2462 - DNA, 20 bp, Artificial Sequence
  chemically synthesized
cttgattacaacatttttaa

SEQ ID NO: 2463 - DNA, 20 bp, Artificial Sequence
  chemically synthesized
tgaaactttatttatcggtc

SEQ ID NO: 2464 - DNA, 20 bp, Artificial Sequence
  chemically synthesized
aagttcttgaccgataaata

SEQ ID NO: 2465 - DNA, 20 bp, Artificial Sequence
  chemically synthesized
atatctgaaactttatttat

SEQ ID NO: 2466 - DNA, 20 bp, Artificial Sequence
  chemically synthesized
ttgaccgataaataaagttt

SEQ ID NO: 2467 - DNA, 20 bp, Artificial Sequence
  chemically synthesized
tccaaaaaaaaataaatgtt

SEQ ID NO: 2468 - DNA, 20 bp, Artificial Sequence
  chemically synthesized
tctaaacatttatttttttt

SEQ ID NO: 2469 - DNA, 20 bp, Artificial Sequence
  chemically synthesized
atttatttttttttggaaat

SEQ ID NO: 2470 - DNA, 20 bp, Artificial Sequence
  chemically synthesized
tttttggaaatgagtttctg

SEQ ID NO: 2471 - DNA, 20 bp, Artificial Sequence
  chemically synthesized
acactgtaactgaaggtcta

SEQ ID NO: 2472 - DNA, 20 bp, Artificial Sequence
  chemically synthesized
aatgagtttctgtagacctt

SEQ ID NO: 2473 - DNA, 20 bp, Artificial Sequence
  chemically synthesized
tttctgtagaccttcagtta

SEQ ID NO: 2474 - DNA, 20 bp, Artificial Sequence
  chemically synthesized
cagatggacactgtaactga

SEQ ID NO: 2475 - DNA, 20 bp, Artificial Sequence
  chemically synthesized
ccagatggacactgtaactg

SEQ ID NO: 2476 - DNA, 20 bp, Artificial Sequence
  chemically synthesized
cttcagttacagtgtccatc

SEQ ID NO: 2477 - DNA, 20 bp, Artificial Sequence
  chemically synthesized
caacacatcacattgccaga

SEQ ID NO: 2478 - DNA, 20 bp, Artificial Sequence
  chemically synthesized
ctgacaacacatcacattgc

SEQ ID NO: 2479 - DNA, 20 bp, Artificial Sequence
  chemically synthesized
ctggcaatgtgatgtgttgt

SEQ ID NO: 2480 - DNA, 20 bp, Artificial Sequence
  chemically synthesized
tggcaatgtgatgtgttgtc

SEQ ID NO: 2481 - DNA, 20 bp, Artificial Sequence
  chemically synthesized
gtgttgtcaggaaatgaatc

SEQ ID NO: 2482 - DNA, 20 bp, Artificial Sequence
  chemically synthesized
caggaaatgaatcaagacaa

SEQ ID NO: 2483 - DNA, 20 bp, Artificial Sequence
  chemically synthesized
aggaaatgaatcaagacaaa

SEQ ID NO: 2484 - DNA, 20 bp, Artificial Sequence
  chemically synthesized
ggaaatgaatcaagacaaaa

SEQ ID NO: 2485 - DNA, 20 bp, Artificial Sequence
  chemically synthesized
aatgaatcaagacaaaaggg

SEQ ID NO: 2486 - DNA, 20 bp, Artificial Sequence
  chemically synthesized
aagacaaaagggaagtgtgc

SEQ ID NO: 2487 - DNA, 20 bp, Artificial Sequence
  chemically synthesized
agacaaaagggaagtgtgct

SEQ ID NO: 2488 - DNA, 20 bp, Artificial Sequence
  chemically synthesized
gacaaaagggaagtgtgctg

SEQ ID NO: 2489 - DNA, 20 bp, Artificial Sequence
  chemically synthesized
aaaagggaagtgtgctgggg

SEQ ID NO: 2490 - DNA, 20 bp, Artificial Sequence
  chemically synthesized
atttagactcaggactgccc

SEQ ID NO: 2491 - DNA, 20 bp, Artificial Sequence
  chemically synthesized
aagtgtgctggggcagtcct

SEQ ID NO: 2492 - DNA, 20 bp, Artificial Sequence
  chemically synthesized
caagccctttatttagactc

SEQ ID NO: 2493 - DNA, 20 bp, Artificial Sequence
  chemically synthesized
ccaagccctttatttagact

SEQ ID NO: 2494 - DNA, 20 bp, Artificial Sequence
  chemically synthesized
ggcagtcctgagtctaaata

SEQ ID NO: 2495 - DNA, 20 bp, Artificial Sequence
  chemically synthesized
gcagtcctgagtctaaataa

SEQ ID NO: 2496 - DNA, 20 bp, Artificial Sequence
  chemically synthesized
cagtcctgagtctaaataaa

SEQ ID NO: 2497 - DNA, 20 bp, Artificial Sequence
  chemically synthesized
acctgaccaagccctttatt

SEQ ID NO: 2498 - DNA, 20 bp, Artificial Sequence
  chemically synthesized
ctgagtctaaataaagggct

SEQ ID NO: 2499 - DNA, 20 bp, Artificial Sequence
  chemically synthesized
gtctaaataaagggcttggt

SEQ ID NO: 2500 - DNA, 20 bp, Artificial Sequence
  chemically synthesized
tctaaataaagggcttggtc

SEQ ID NO: 2501 - DNA, 20 bp, Artificial Sequence
  chemically synthesized
agacttctcgggacctgacc

SEQ ID NO: 2502 - DNA, 20 bp, Artificial Sequence
  chemically synthesized
aaagggcttggtcaggtccc

SEQ ID NO: 2503 - DNA, 20 bp, Artificial Sequence
  chemically synthesized
gggcttggtcaggtcccgag

SEQ ID NO: 2504 - DNA, 20 bp, Artificial Sequence
  chemically synthesized
ccgaggaaattagacttctc

SEQ ID NO: 2505 - DNA, 20 bp, Artificial Sequence
  chemically synthesized
cccgaggaaattagacttct

SEQ ID NO: 2506 - DNA, 20 bp, Artificial Sequence
  chemically synthesized
cccgagaagtctaatttcct

SEQ ID NO: 2507 - DNA, 20 bp, Artificial Sequence
  chemically synthesized
tttatagtgcccgaggaaat

SEQ ID NO: 2508 - DNA, 20 bp, Artificial Sequence
  chemically synthesized
ccgagaagtctaatttcctc

SEQ ID NO: 2509 - DNA, 20 bp, Artificial Sequence
  chemically synthesized
tgtcaattttatagtgcccg

SEQ ID NO: 2510 - DNA, 20 bp, Artificial Sequence
  chemically synthesized
atgtcaattttatagtgccc

SEQ ID NO: 2511 - DNA, 20 bp, Artificial Sequence
  chemically synthesized
aatcaataatgtcaatttta

SEQ ID NO: 2512 - DNA, 20 bp, Artificial Sequence
  chemically synthesized
ttgattgtaattcattattt

SEQ ID NO: 2513 - DNA, 20 bp, Artificial Sequence
  chemically synthesized
gattgtaattcattatttta

SEQ ID NO: 2514 - DNA, 20 bp, Artificial Sequence
  chemically synthesized
gtaattcattattttagagt

SEQ ID NO: 2515 - DNA, 20 bp, Artificial Sequence
  chemically synthesized
ttattttagagttggaattg

SEQ ID NO: 2516 - DNA, 20 bp, Artificial Sequence
  chemically synthesized
tattttagagttggaattgc

SEQ ID NO: 2517 - DNA, 20 bp, Artificial Sequence
  chemically synthesized
ttagagttggaattgcagga

SEQ ID NO: 2518 - DNA, 20 bp, Artificial Sequence
  chemically synthesized
ttgcaggacagtactgtttc

SEQ ID NO: 2519 - DNA, 20 bp, Artificial Sequence
  chemically synthesized
tgcaggacagtactgtttct

SEQ ID NO: 2520 - DNA, 20 bp, Artificial Sequence
  chemically synthesized
aggctaaaagcacccagaaa

SEQ ID NO: 2521 - DNA, 20 bp, Artificial Sequence
  chemically synthesized
taaaagaggctaaaagcacc

SEQ ID NO: 2522 - DNA, 20 bp, Artificial Sequence
  chemically synthesized
gtactgtttctgggtgcttt

SEQ ID NO: 2523 - DNA, 20 bp, Artificial Sequence
  chemically synthesized
attaatataaaagaggctaa

SEQ ID NO: 2524 - DNA, 20 bp, Artificial Sequence
  chemically synthesized
tcagtgaattaatataaaag

SEQ ID NO: 2525 - DNA, 20 bp, Artificial Sequence
  chemically synthesized
gtcagtgaattaatataaaa

SEQ ID NO: 2526 - DNA, 20 bp, Artificial Sequence
  chemically synthesized
tagtcagtgaattaatataa

SEQ ID NO: 2527 - DNA, 20 bp, Artificial Sequence
  chemically synthesized
ccttaagtattttaaatagt

SEQ ID NO: 2528 - DNA, 20 bp, Artificial Sequence
  chemically synthesized
tcttccttaagtattttaaa

SEQ ID NO: 2529 - DNA, 20 bp, Artificial Sequence
  chemically synthesized
actgactatttaaaatactt

SEQ ID NO: 2530 - DNA, 20 bp, Artificial Sequence
  chemically synthesized
ctgactatttaaaatactta

SEQ ID NO: 2531 - DNA, 20 bp, Artificial Sequence
  chemically synthesized
actatttaaaatacttaagg

SEQ ID NO: 2532 - DNA, 20 bp, Artificial Sequence
  chemically synthesized
aaagggacttattcttcctt

SEQ ID NO: 2533 - DNA, 20 bp, Artificial Sequence
  chemically synthesized
taaaatacttaaggaagaat

SEQ ID NO: 2534 - DNA, 20 bp, Artificial Sequence
  chemically synthesized
aggaagaataagtccctttt

SEQ ID NO: 2535 - DNA, 20 bp, Artificial Sequence
  chemically synthesized
ggaagaataagtcccttttt

SEQ ID NO: 2536 - DNA, 20 bp, Artificial Sequence
  chemically synthesized
aataacagaaatcctaaaaa

SEQ ID NO: 2537 - DNA, 20 bp, Artificial Sequence
  chemically synthesized
aaataacagaaatcctaaaa

SEQ ID NO: 2538 - DNA, 20 bp, Artificial Sequence
  chemically synthesized
aaaataacagaaatcctaaa

SEQ ID NO: 2539 - DNA, 20 bp, Artificial Sequence
  chemically synthesized
ttttttgacttataaaataa

SEQ ID NO: 2540 - DNA, 20 bp, Artificial Sequence
  chemically synthesized
taggatttctgttattttat

SEQ ID NO: 2541 - DNA, 20 bp, Artificial Sequence
  chemically synthesized
ataagtcaaaaaaattcaaa

SEQ ID NO: 2542 - DNA, 20 bp, Artificial Sequence
  chemically synthesized
aattcaaatggccacacttg

SEQ ID NO: 2543 - DNA, 20 bp, Artificial Sequence
  chemically synthesized
attcaaatggccacacttgc

SEQ ID NO: 2544 - DNA, 20 bp, Artificial Sequence
  chemically synthesized
caccaaagagcctgcaagtg

SEQ ID NO: 2545 - DNA, 20 bp, Artificial Sequence
  chemically synthesized
atattcaccaaagagcctgc

SEQ ID NO: 2546 - DNA, 20 bp, Artificial Sequence
  chemically synthesized
ggccacacttgcaggctctt

SEQ ID NO: 2547 - DNA, 20 bp, Artificial Sequence
  chemically synthesized
ttatattcatattcaccaaa

SEQ ID NO: 2548 - DNA, 20 bp, Artificial Sequence
  chemically synthesized
atttatattcatattcacca

SEQ ID NO: 2549 - DNA, 20 bp, Artificial Sequence
  chemically synthesized
gctgaaattgaattgattta

SEQ ID NO: 2550 - DNA, 20 bp, Artificial Sequence
  chemically synthesized
tctataaatcaattcaattt

SEQ ID NO: 2551 - DNA, 20 bp, Artificial Sequence
  chemically synthesized
ttcagctgaacaagattatt

SEQ ID NO: 2552 - DNA, 20 bp, Artificial Sequence
  chemically synthesized
ttcagctcaataatcttgtt

SEQ ID NO: 2553 - DNA, 20 bp, Artificial Sequence
  chemically synthesized
tgatcaactttcagctgaac

SEQ ID NO: 2554 - DNA, 20 bp, Artificial Sequence
  chemically synthesized
caataatcttgttcagctga

SEQ ID NO: 2555 - DNA, 20 bp, Artificial Sequence
  chemically synthesized
cttctgtgctgatcaacttt

SEQ ID NO: 2556 - DNA, 20 bp, Artificial Sequence
  chemically synthesized
ttgttcagctgaaagttgat

SEQ ID NO: 2557 - DNA, 20 bp, Artificial Sequence
  chemically synthesized
cagctgaaagttgatcagca

SEQ ID NO: 2558 - DNA, 20 bp, Artificial Sequence
  chemically synthesized
ctgaaagttgatcagcacag

SEQ ID NO: 2559 - DNA, 20 bp, Artificial Sequence
  chemically synthesized
cattacatgtatagagtcac

SEQ ID NO: 2560 - DNA, 20 bp, Artificial Sequence
  chemically synthesized
tcattacatgtatagagtca

SEQ ID NO: 2561 - DNA, 20 bp, Artificial Sequence
  chemically synthesized
tctgactcattacatgtata

SEQ ID NO: 2562 - DNA, 20 bp, Artificial Sequence
  chemically synthesized
attctgactcattacatgta

SEQ ID NO: 2563 - DNA, 20 bp, Artificial Sequence
  chemically synthesized
tgtgactctatacatgtaat

SEQ ID NO: 2564 - DNA, 20 bp, Artificial Sequence
  chemically synthesized
actctatacatgtaatgagt

SEQ ID NO: 2565 - DNA, 20 bp, Artificial Sequence
  chemically synthesized
atacatgtaatgagtcagaa

SEQ ID NO: 2566 - DNA, 20 bp, Artificial Sequence
  chemically synthesized
cagaatggacaacgaaataa

SEQ ID NO: 2567 - DNA, 20 bp, Artificial Sequence
  chemically synthesized
gacaacgaaataatagcgta

SEQ ID NO: 2568 - DNA, 20 bp, Artificial Sequence
  chemically synthesized
aacgaaataatagcgtaaag

SEQ ID NO: 2569 - DNA, 20 bp, Artificial Sequence
  chemically synthesized
acgaaataatagcgtaaagc

SEQ ID NO: 2570 - DNA, 20 bp, Artificial Sequence
  chemically synthesized
cgaaataatagcgtaaagca

SEQ ID NO: 2571 - DNA, 20 bp, Artificial Sequence
  chemically synthesized
taatagcgtaaagcagggat

SEQ ID NO: 2572 - DNA, 20 bp, Artificial Sequence
  chemically synthesized
attggcaaattttccccata

SEQ ID NO: 2573 - DNA, 20 bp, Artificial Sequence
  chemically synthesized
ttggcaaattttccccataa

SEQ ID NO: 2574 - DNA, 20 bp, Artificial Sequence
  chemically synthesized
tggcaaattttccccataaa

SEQ ID NO: 2575 - DNA, 20 bp, Artificial Sequence
  chemically synthesized
ttactatctggccctttatg

SEQ ID NO: 2576 - DNA, 20 bp, Artificial Sequence
  chemically synthesized
tttactatctggccctttat

SEQ ID NO: 2577 - DNA, 20 bp, Artificial Sequence
  chemically synthesized
atttactatctggcccttta

SEQ ID NO: 2578 - DNA, 20 bp, Artificial Sequence
  chemically synthesized
aaattttccccataaagggc

SEQ ID NO: 2579 - DNA, 20 bp, Artificial Sequence
  chemically synthesized
tttccccataaagggccaga

SEQ ID NO: 2580 - DNA, 20 bp, Artificial Sequence
  chemically synthesized
agcctgaaatatttactatc

SEQ ID NO: 2581 - DNA, 20 bp, Artificial Sequence
  chemically synthesized
gggccagatagtaaatattt

SEQ ID NO: 2582 - DNA, 20 bp, Artificial Sequence
  chemically synthesized
ggccagatagtaaatatttc

SEQ ID NO: 2583 - DNA, 20 bp, Artificial Sequence
  chemically synthesized
gtaaatatttcaggctttgc

SEQ ID NO: 2584 - DNA, 20 bp, Artificial Sequence
  chemically synthesized
ccagagaccgtgggcttgca

SEQ ID NO: 2585 - DNA, 20 bp, Artificial Sequence
  chemically synthesized
tttcaggctttgcaagccca

SEQ ID NO: 2586 - DNA, 20 bp, Artificial Sequence
  chemically synthesized
atagctggtccagagaccgt

SEQ ID NO: 2587 - DNA, 20 bp, Artificial Sequence
  chemically synthesized
ctttgcaagcccacggtctc

SEQ ID NO: 2588 - DNA, 20 bp, Artificial Sequence
  chemically synthesized
aatagctggtccagagaccg

SEQ ID NO: 2589 - DNA, 20 bp, Artificial Sequence
  chemically synthesized
caagcccacggtctctggac

SEQ ID NO: 2590 - DNA, 20 bp, Artificial Sequence
  chemically synthesized
agtgctgaatagctggtcca

SEQ ID NO: 2591 - DNA, 20 bp, Artificial Sequence
  chemically synthesized
gcagtgctgaatagctggtc

SEQ ID NO: 2592 - DNA, 20 bp, Artificial Sequence
  chemically synthesized
cggtctctggaccagctatt

SEQ ID NO: 2593 - DNA, 20 bp, Artificial Sequence
  chemically synthesized
ttgcagcagtgctgaatagc

SEQ ID NO: 2594 - DNA, 20 bp, Artificial Sequence
  chemically synthesized
gtagttgcagcagtgctgaa

SEQ ID NO: 2595 - DNA, 20 bp, Artificial Sequence
  chemically synthesized
ccagggcagagtagttgcag

SEQ ID NO: 2596 - DNA, 20 bp, Artificial Sequence
  chemically synthesized
ttaccagggcagagtagttg

SEQ ID NO: 2597 - DNA, 20 bp, Artificial Sequence
  chemically synthesized
ttctcattaccagggcagag

SEQ ID NO: 2598 - DNA, 20 bp, Artificial Sequence
  chemically synthesized
ctgctgcaactactctgccc

SEQ ID NO: 2599 - DNA, 20 bp, Artificial Sequence
  chemically synthesized
gctttctcattaccagggca

SEQ ID NO: 2600 - DNA, 20 bp, Artificial Sequence
  chemically synthesized
ttgctttctcattaccaggg

SEQ ID NO: 2601 - DNA, 20 bp, Artificial Sequence
  chemically synthesized
aactactctgccctggtaat

SEQ ID NO: 2602 - DNA, 20 bp, Artificial Sequence
  chemically synthesized
tagttgctttctcattacca

SEQ ID NO: 2603 - DNA, 20 bp, Artificial Sequence
  chemically synthesized
atagttgctttctcattacc

SEQ ID NO: 2604 - DNA, 20 bp, Artificial Sequence
  chemically synthesized
tatagttgctttctcattac

SEQ ID NO: 2605 - DNA, 20 bp, Artificial Sequence
  chemically synthesized
actctgccctggtaatgaga

SEQ ID NO: 2606 - DNA, 20 bp, Artificial Sequence
  chemically synthesized
tggtaatgagaaagcaacta

SEQ ID NO: 2607 - DNA, 20 bp, Artificial Sequence
  chemically synthesized
ggtaatgagaaagcaactat

SEQ ID NO: 2608 - DNA, 20 bp, Artificial Sequence
  chemically synthesized
attcatttacatgttgccta

SEQ ID NO: 2609 - DNA, 20 bp, Artificial Sequence
  chemically synthesized
ataggcaacatgtaaatgaa

SEQ ID NO: 2610 - DNA, 20 bp, Artificial Sequence
  chemically synthesized
taggcaacatgtaaatgaat

SEQ ID NO: 2611 - DNA, 20 bp, Artificial Sequence
  chemically synthesized
aacatgtaaatgaatgggta

SEQ ID NO: 2612 - DNA, 20 bp, Artificial Sequence
  chemically synthesized
tataaagctttattggaaca

SEQ ID NO: 2613 - DNA, 20 bp, Artificial Sequence
  chemically synthesized
ggtatggctgtgttccaata

SEQ ID NO: 2614 - DNA, 20 bp, Artificial Sequence
  chemically synthesized
ctgtttttataaagctttat

SEQ ID NO: 2615 - DNA, 20 bp, Artificial Sequence
  chemically synthesized
gcccaatacctgtttttata

SEQ ID NO: 2616 - DNA, 20 bp, Artificial Sequence
  chemically synthesized
ccaataaagctttataaaaa

SEQ ID NO: 2617 - DNA, 20 bp, Artificial Sequence
  chemically synthesized
caataaagctttataaaaac

SEQ ID NO: 2618 - DNA, 20 bp, Artificial Sequence
  chemically synthesized
agctttataaaaacaggtat

SEQ ID NO: 2619 - DNA, 20 bp, Artificial Sequence
  chemically synthesized
gctttataaaaacaggtatt

SEQ ID NO: 2620 - DNA, 20 bp, Artificial Sequence
  chemically synthesized
tataaaaacaggtattgggc

SEQ ID NO: 2621 - DNA, 20 bp, Artificial Sequence
  chemically synthesized
aacaggtattgggccagatt

SEQ ID NO: 2622 - DNA, 20 bp, Artificial Sequence
  chemically synthesized
tacagcccaaatgccaaatc

SEQ ID NO: 2623 - DNA, 20 bp, Artificial Sequence
  chemically synthesized
attgggccagatttggcatt

SEQ ID NO: 2624 - DNA, 20 bp, Artificial Sequence
  chemically synthesized
ttgggccagatttggcattt

SEQ ID NO: 2625 - DNA, 20 bp, Artificial Sequence
  chemically synthesized
tttggcatttgggctgtatg

SEQ ID NO: 2626 - DNA, 20 bp, Artificial Sequence
  chemically synthesized
caggactagcaaactacata

SEQ ID NO: 2627 - DNA, 20 bp, Artificial Sequence
  chemically synthesized
ttgggctgtatgtagtttgc

SEQ ID NO: 2628 - DNA, 20 bp, Artificial Sequence
  chemically synthesized
tgtatgtagtttgctagtcc

SEQ ID NO: 2629 - DNA, 20 bp, Artificial Sequence
  chemically synthesized
ttatccctttaatccaggac

SEQ ID NO: 2630 - DNA, 20 bp, Artificial Sequence
  chemically synthesized
agtttgctagtcctggatta

SEQ ID NO: 2631 - DNA, 20 bp, Artificial Sequence
  chemically synthesized
gtttgctagtcctggattaa

SEQ ID NO: 2632 - DNA, 20 bp, Artificial Sequence
  chemically synthesized
agcggttatccctttaatcc

SEQ ID NO: 2633 - DNA, 20 bp, Artificial Sequence
  chemically synthesized
tttgctagtcctggattaaa

SEQ ID NO: 2634 - DNA, 20 bp, Artificial Sequence
  chemically synthesized
gagcggttatccctttaatc

SEQ ID NO: 2635 - DNA, 20 bp, Artificial Sequence
  chemically synthesized
gctcccacaaaggatttgag

SEQ ID NO: 2636 - DNA, 20 bp, Artificial Sequence
  chemically synthesized
tatgctcccacaaaggattt

SEQ ID NO: 2637 - DNA, 20 bp, Artificial Sequence
  chemically synthesized
ataaccgctcaaatcctttg

SEQ ID NO: 2638 - DNA, 20 bp, Artificial Sequence
  chemically synthesized
taaccgctcaaatcctttgt

SEQ ID NO: 2639 - DNA, 20 bp, Artificial Sequence
  chemically synthesized
accgctcaaatcctttgtgg

SEQ ID NO: 2640 - DNA, 20 bp, Artificial Sequence
  chemically synthesized
tttcctgtatgctcccacaa

SEQ ID NO: 2641 - DNA, 20 bp, Artificial Sequence
  chemically synthesized
gtttcctgtatgctcccaca

SEQ ID NO: 2642 - DNA, 20 bp, Artificial Sequence
  chemically synthesized
aaatcctttgtgggagcata

SEQ ID NO: 2643 - DNA, 20 bp, Artificial Sequence
  chemically synthesized
aatcctttgtgggagcatac

SEQ ID NO: 2644 - DNA, 20 bp, Artificial Sequence
  chemically synthesized
ttgtgggagcatacaggaaa

SEQ ID NO: 2645 - DNA, 20 bp, Artificial Sequence
  chemically synthesized
ggagcatacaggaaacagaa

SEQ ID NO: 2646 - DNA, 20 bp, Artificial Sequence
  chemically synthesized
aaacagaatggtgcctgaaa

SEQ ID NO: 2647 - DNA, 20 bp, Artificial Sequence
  chemically synthesized
aacagaatggtgcctgaaaa

SEQ ID NO: 2648 - DNA, 20 bp, Artificial Sequence
  chemically synthesized
acagaatggtgcctgaaaaa

SEQ ID NO: 2649 - DNA, 20 bp, Artificial Sequence
  chemically synthesized
aatatggtgtgccctttttc

SEQ ID NO: 2650 - DNA, 20 bp, Artificial Sequence
  chemically synthesized
aaatatggtgtgcccttttt

SEQ ID NO: 2651 - DNA, 20 bp, Artificial Sequence
  chemically synthesized
aacaaaggcagatagaaata

SEQ ID NO: 2652 - DNA, 20 bp, Artificial Sequence
  chemically synthesized
acataaagaacaaaggcaga

SEQ ID NO: 2653 - DNA, 20 bp, Artificial Sequence
  chemically synthesized
agcaacataaagaacaaagg

SEQ ID NO: 2654 - DNA, 20 bp, Artificial Sequence
  chemically synthesized
aagagcaacataaagaacaa

SEQ ID NO: 2655 - DNA, 20 bp, Artificial Sequence
  chemically synthesized
gaagagcaacataaagaaca

SEQ ID NO: 2656 - DNA, 20 bp, Artificial Sequence
  chemically synthesized
ttttatggaagagcaacata

SEQ ID NO: 2657 - DNA, 20 bp, Artificial Sequence
  chemically synthesized
tctgtggttcttttatggaa

SEQ ID NO: 2658 - DNA, 20 bp, Artificial Sequence
  chemically synthesized
tttatgttgctcttccataa

SEQ ID NO: 2659 - DNA, 20 bp, Artificial Sequence
  chemically synthesized
attctgtggttcttttatgg

SEQ ID NO: 2660 - DNA, 20 bp, Artificial Sequence
  chemically synthesized
cttattctgtggttctttta

SEQ ID NO: 2661 - DNA, 20 bp, Artificial Sequence
  chemically synthesized
gctcttccataaaagaacca

SEQ ID NO: 2662 - DNA, 20 bp, Artificial Sequence
  chemically synthesized
ccataaaagaaccacagaat

SEQ ID NO: 2663 - DNA, 20 bp, Artificial Sequence
  chemically synthesized
aaaattaaaatcttattctg

SEQ ID NO: 2664 - DNA, 20 bp, Artificial Sequence
  chemically synthesized
gaataagattttaattttaa

SEQ ID NO: 2665 - DNA, 20 bp, Artificial Sequence
  chemically synthesized
aagattttaattttaaaaga

SEQ ID NO: 2666 - DNA, 20 bp, Artificial Sequence
  chemically synthesized
attttaattttaaaagacgg

SEQ ID NO: 2667 - DNA, 20 bp, Artificial Sequence
  chemically synthesized
ttttaattttaaaagacggt

SEQ ID NO: 2668 - DNA, 20 bp, Artificial Sequence
  chemically synthesized
aaaagacggtaggttttaca

SEQ ID NO: 2669 - DNA, 20 bp, Artificial Sequence
  chemically synthesized
ggtaggttttacaaagctgt

SEQ ID NO: 2670 - DNA, 20 bp, Artificial Sequence
  chemically synthesized
gtaggttttacaaagctgtt

SEQ ID NO: 2671 - DNA, 20 bp, Artificial Sequence
  chemically synthesized
gttttacaaagctgttgggt

SEQ ID NO: 2672 - DNA, 20 bp, Artificial Sequence
  chemically synthesized
cccctaaattaccaacccaa

SEQ ID NO: 2673 - DNA, 20 bp, Artificial Sequence
  chemically synthesized
aagctgttgggttggtaatt

SEQ ID NO: 2674 - DNA, 20 bp, Artificial Sequence
  chemically synthesized
agctgttgggttggtaattt

SEQ ID NO: 2675 - DNA, 20 bp, Artificial Sequence
  chemically synthesized
gctgttgggttggtaattta

SEQ ID NO: 2676 - DNA, 20 bp, Artificial Sequence
  chemically synthesized
ctgttgggttggtaatttag

SEQ ID NO: 2677 - DNA, 20 bp, Artificial Sequence
  chemically synthesized
ggtaatttaggggtatttga

SEQ ID NO: 2678 - DNA, 20 bp, Artificial Sequence
  chemically synthesized
ggtatttgatagaatgtacg

SEQ ID NO: 2679 - DNA, 20 bp, Artificial Sequence
  chemically synthesized
gtatttgatagaatgtacgc

SEQ ID NO: 2680 - DNA, 20 bp, Artificial Sequence
  chemically synthesized
gaatgtacgcgggcttattt

SEQ ID NO: 2681 - DNA, 20 bp, Artificial Sequence
  chemically synthesized
atgtacgcgggcttatttga

SEQ ID NO: 2682 - DNA, 20 bp, Artificial Sequence
  chemically synthesized
tgtacgcgggcttatttgag

SEQ ID NO: 2683 - DNA, 20 bp, Artificial Sequence
  chemically synthesized
cataccatcccctctcaaat

SEQ ID NO: 2684 - DNA, 20 bp, Artificial Sequence
  chemically synthesized
gtacgcgggcttatttgaga

SEQ ID NO: 2685 - DNA, 20 bp, Artificial Sequence
  chemically synthesized
tacgcgggcttatttgagag

SEQ ID NO: 2686 - DNA, 20 bp, Artificial Sequence
  chemically synthesized
cgggcttatttgagagggga

SEQ ID NO: 2687 - DNA, 20 bp, Artificial Sequence
  chemically synthesized
agaggggatggtatgaaaaa

SEQ ID NO: 2688 - DNA, 20 bp, Artificial Sequence
  chemically synthesized
aggggatggtatgaaaaaaa

SEQ ID NO: 2689 - DNA, 20 bp, Artificial Sequence
  chemically synthesized
ggggatggtatgaaaaaaag

SEQ ID NO: 2690 - DNA, 20 bp, Artificial Sequence
  chemically synthesized
atggtatgaaaaaaagagga

SEQ ID NO: 2691 - DNA, 20 bp, Artificial Sequence
  chemically synthesized
atgaaaaaaagaggatggca

SEQ ID NO: 2692 - DNA, 20 bp, Artificial Sequence
  chemically synthesized
tgaaaaaaagaggatggcat

SEQ ID NO: 2693 - DNA, 20 bp, Artificial Sequence
  chemically synthesized
aaaaagaggatggcatgggc

SEQ ID NO: 2694 - DNA, 20 bp, Artificial Sequence
  chemically synthesized
aagaggatggcatgggctgg

SEQ ID NO: 2695 - DNA, 20 bp, Artificial Sequence
  chemically synthesized
gaggatggcatgggctggtg

SEQ ID NO: 2696 - DNA, 20 bp, Artificial Sequence
  chemically synthesized
ctgtgccacattatctccac

SEQ ID NO: 2697 - DNA, 20 bp, Artificial Sequence
  chemically synthesized
atgggctggtggagataatg

SEQ ID NO: 2698 - DNA, 20 bp, Artificial Sequence
  chemically synthesized
ctggtggagataatgtggca

SEQ ID NO: 2699 - DNA, 20 bp, Artificial Sequence
  chemically synthesized
tggtggagataatgtggcac

SEQ ID NO: 2700 - DNA, 20 bp, Artificial Sequence
  chemically synthesized
ggagataatgtggcacaggt

SEQ ID NO: 2701 - DNA, 20 bp, Artificial Sequence
  chemically synthesized
gataatgtggcacaggtcag

SEQ ID NO: 2702 - DNA, 20 bp, Artificial Sequence
  chemically synthesized
ataatgtggcacaggtcagt

SEQ ID NO: 2703 - DNA, 20 bp, Artificial Sequence
  chemically synthesized
tgtggcacaggtcagtaggc

SEQ ID NO: 2704 - DNA, 20 bp, Artificial Sequence
  chemically synthesized
tggcacaggtcagtaggcaa

SEQ ID NO: 2705 - DNA, 20 bp, Artificial Sequence
  chemically synthesized
tcagtaggcaagagattgta

SEQ ID NO: 2706 - DNA, 20 bp, Artificial Sequence
  chemically synthesized
cagtaggcaagagattgtac

SEQ ID NO: 2707 - DNA, 20 bp, Artificial Sequence
  chemically synthesized
taggcaagagattgtacagg

SEQ ID NO: 2708 - DNA, 20 bp, Artificial Sequence
  chemically synthesized
gcaagagattgtacaggtag

SEQ ID NO: 2709 - DNA, 20 bp, Artificial Sequence
  chemically synthesized
gattgtacaggtagcagaaa

SEQ ID NO: 2710 - DNA, 20 bp, Artificial Sequence
  chemically synthesized
tgtacaggtagcagaaatag

SEQ ID NO: 2711 - DNA, 20 bp, Artificial Sequence
  chemically synthesized
acaatccagaaagcagttag

SEQ ID NO: 2712 - DNA, 20 bp, Artificial Sequence
  chemically synthesized
aaaacaatccagaaagcagt

SEQ ID NO: 2713 - DNA, 20 bp, Artificial Sequence
  chemically synthesized
tagcactgctaactgctttc

SEQ ID NO: 2714 - DNA, 20 bp, Artificial Sequence
  chemically synthesized
cagtaaaacaatccagaaag

SEQ ID NO: 2715 - DNA, 20 bp, Artificial Sequence
  chemically synthesized
atgcagtaaaacaatccaga

SEQ ID NO: 2716 - DNA, 20 bp, Artificial Sequence
  chemically synthesized
cttaatgcagtaaaacaatc

SEQ ID NO: 2717 - DNA, 20 bp, Artificial Sequence
  chemically synthesized
ctggattgttttactgcatt

SEQ ID NO: 2718 - DNA, 20 bp, Artificial Sequence
  chemically synthesized
ggattgttttactgcattaa

SEQ ID NO: 2719 - DNA, 20 bp, Artificial Sequence
  chemically synthesized
gccaagataagctcttaatg

SEQ ID NO: 2720 - DNA, 20 bp, Artificial Sequence
  chemically synthesized
actgcattaagagcttatct

SEQ ID NO: 2721 - DNA, 20 bp, Artificial Sequence
  chemically synthesized
tgaataataggagccaagat

SEQ ID NO: 2722 - DNA, 20 bp, Artificial Sequence
  chemically synthesized
atgaatgaataataggagcc

SEQ ID NO: 2723 - DNA, 20 bp, Artificial Sequence
  chemically synthesized
tatagatgaatgaataatag

SEQ ID NO: 2724 - DNA, 20 bp, Artificial Sequence
  chemically synthesized
tatatagatgaatgaataat

SEQ ID NO: 2725 - DNA, 20 bp, Artificial Sequence
  chemically synthesized
ttatatagatgaatgaataa

SEQ ID NO: 2726 - DNA, 20 bp, Artificial Sequence
  chemically synthesized
attattcattcatctatata

SEQ ID NO: 2727 - DNA, 20 bp, Artificial Sequence
  chemically synthesized
attcattcatctatataaag

SEQ ID NO: 2728 - DNA, 20 bp, Artificial Sequence
  chemically synthesized
aaatgtggtaccactttata

SEQ ID NO: 2729 - DNA, 20 bp, Artificial Sequence
  chemically synthesized
tataaagtggtaccacattt

SEQ ID NO: 2730 - DNA, 20 bp, Artificial Sequence
  chemically synthesized
taaagtggtaccacatttta

SEQ ID NO: 2731 - DNA, 20 bp, Artificial Sequence
  chemically synthesized
gtattaggctctctaaaatg

SEQ ID NO: 2732 - DNA, 20 bp, Artificial Sequence
  chemically synthesized
aagtggtaccacattttaga

SEQ ID NO: 2733 - DNA, 20 bp, Artificial Sequence
  chemically synthesized
ctagtcagtagtatggtatt

SEQ ID NO: 2734 - DNA, 20 bp, Artificial Sequence
  chemically synthesized
cctagtcagtagtatggtat

SEQ ID NO: 2735 - DNA, 20 bp, Artificial Sequence
  chemically synthesized
cgctctcctagtcagtagta

SEQ ID NO: 2736 - DNA, 20 bp, Artificial Sequence
  chemically synthesized
cctaataccatactactgac

SEQ ID NO: 2737 - DNA, 20 bp, Artificial Sequence
  chemically synthesized
ctaataccatactactgact

SEQ ID NO: 2738 - DNA, 20 bp, Artificial Sequence
  chemically synthesized
agaaacgctctcctagtcag

SEQ ID NO: 2739 - DNA, 20 bp, Artificial Sequence
  chemically synthesized
aataccatactactgactag

SEQ ID NO: 2740 - DNA, 20 bp, Artificial Sequence
  chemically synthesized
taccatactactgactagga

SEQ ID NO: 2741 - DNA, 20 bp, Artificial Sequence
  chemically synthesized
gaaagaaacgctctcctagt

SEQ ID NO: 2742 - DNA, 20 bp, Artificial Sequence
  chemically synthesized
tgatgaaagaaacgctctcc

SEQ ID NO: 2743 - DNA, 20 bp, Artificial Sequence
  chemically synthesized
atatgtatgtgcattgatga

SEQ ID NO: 2744 - DNA, 20 bp, Artificial Sequence
  chemically synthesized
acatataaaaatatctttgt

SEQ ID NO: 2745 - DNA, 20 bp, Artificial Sequence
  chemically synthesized
gatcatttagcagactaaca

SEQ ID NO: 2746 - DNA, 20 bp, Artificial Sequence
  chemically synthesized
ataagtctctgatcatttag

SEQ ID NO: 2747 - DNA, 20 bp, Artificial Sequence
  chemically synthesized
ttgttagtctgctaaatgat

SEQ ID NO: 2748 - DNA, 20 bp, Artificial Sequence
  chemically synthesized
tccataagtctctgatcatt

SEQ ID NO: 2749 - DNA, 20 bp, Artificial Sequence
  chemically synthesized
gttagtctgctaaatgatca

SEQ ID NO: 2750 - DNA, 20 bp, Artificial Sequence
  chemically synthesized
gctaaatgatcagagactta

SEQ ID NO: 2751 - DNA, 20 bp, Artificial Sequence
  chemically synthesized
ccattaagtgatttgtccat

SEQ ID NO: 2752 - DNA, 20 bp, Artificial Sequence
  chemically synthesized
cttatggacaaatcacttaa

SEQ ID NO: 2753 - DNA, 20 bp, Artificial Sequence
  chemically synthesized
ttatggacaaatcacttaat

SEQ ID NO: 2754 - DNA, 20 bp, Artificial Sequence
  chemically synthesized
tatggacaaatcacttaatg

SEQ ID NO: 2755 - DNA, 20 bp, Artificial Sequence
  chemically synthesized
atttaaaaaataaccccatt

SEQ ID NO: 2756 - DNA, 20 bp, Artificial Sequence
  chemically synthesized
gtttgtttattgtacccatg

SEQ ID NO: 2757 - DNA, 20 bp, Artificial Sequence
  chemically synthesized
attctataggaaaactacat

SEQ ID NO: 2758 - DNA, 20 bp, Artificial Sequence
  chemically synthesized
cattctataggaaaactaca

SEQ ID NO: 2759 - DNA, 20 bp, Artificial Sequence
  chemically synthesized
gtacccatgtagttttccta

SEQ ID NO: 2760 - DNA, 20 bp, Artificial Sequence
  chemically synthesized
catgtagttttcctatagaa

SEQ ID NO: 2761 - DNA, 20 bp, Artificial Sequence
  chemically synthesized
ctaaagctctgccattctat

SEQ ID NO: 2762 - DNA, 20 bp, Artificial Sequence
  chemically synthesized
tctaaagctctgccattcta

SEQ ID NO: 2763 - DNA, 20 bp, Artificial Sequence
  chemically synthesized
gtagttttcctatagaatgg

SEQ ID NO: 2764 - DNA, 20 bp, Artificial Sequence
  chemically synthesized
agttttcctatagaatggca

SEQ ID NO: 2765 - DNA, 20 bp, Artificial Sequence
  chemically synthesized
cctatagaatggcagagctt

SEQ ID NO: 2766 - DNA, 20 bp, Artificial Sequence
  chemically synthesized
tatagaatggcagagcttta

SEQ ID NO: 2767 - DNA, 20 bp, Artificial Sequence
  chemically synthesized
tagaatggcagagctttaga

SEQ ID NO: 2768 - DNA, 20 bp, Artificial Sequence
  chemically synthesized
ttactataaggtactctcta

SEQ ID NO: 2769 - DNA, 20 bp, Artificial Sequence
  chemically synthesized
gagctttagagagtacctta

SEQ ID NO: 2770 - DNA, 20 bp, Artificial Sequence
  chemically synthesized
ttagagagtaccttatagta

SEQ ID NO: 2771 - DNA, 20 bp, Artificial Sequence
  chemically synthesized
tcattatctactttactata

SEQ ID NO: 2772 - DNA, 20 bp, Artificial Sequence
  chemically synthesized
gtcattatctactttactat

SEQ ID NO: 2773 - DNA, 20 bp, Artificial Sequence
  chemically synthesized
gagagtaccttatagtaaag

SEQ ID NO: 2774 - DNA, 20 bp, Artificial Sequence
  chemically synthesized
aaattgaattatagtgtaat

SEQ ID NO: 2775 - DNA, 20 bp, Artificial Sequence
  chemically synthesized
tatgtgtagaaattgaatta

SEQ ID NO: 2776 - DNA, 20 bp, Artificial Sequence
  chemically synthesized
ttcctttgtaagtatatgtg

SEQ ID NO: 2777 - DNA, 20 bp, Artificial Sequence
  chemically synthesized
tttctacacatatacttaca

SEQ ID NO: 2778 - DNA, 20 bp, Artificial Sequence
  chemically synthesized
ttctacacatatacttacaa

SEQ ID NO: 2779 - DNA, 20 bp, Artificial Sequence
  chemically synthesized
tacacatatacttacaaagg

SEQ ID NO: 2780 - DNA, 20 bp, Artificial Sequence
  chemically synthesized
tctctaatctcttcctttgt

SEQ ID NO: 2781 - DNA, 20 bp, Artificial Sequence
  chemically synthesized
cacatatacttacaaaggaa

SEQ ID NO: 2782 - DNA, 20 bp, Artificial Sequence
  chemically synthesized
atacttacaaaggaagagat

SEQ ID NO: 2783 - DNA, 20 bp, Artificial Sequence
  chemically synthesized
acttacaaaggaagagatta

SEQ ID NO: 2784 - DNA, 20 bp, Artificial Sequence
  chemically synthesized
acaaaggaagagattagaga

SEQ ID NO: 2785 - DNA, 20 bp, Artificial Sequence
  chemically synthesized
aggaagagattagagataga

SEQ ID NO: 2786 - DNA, 20 bp, Artificial Sequence
  chemically synthesized
gagattagagatagacagat

SEQ ID NO: 2787 - DNA, 20 bp, Artificial Sequence
  chemically synthesized
ttagagatagacagattaga

SEQ ID NO: 2788 - DNA, 20 bp, Artificial Sequence
  chemically synthesized
tagacagattagatagaaat

SEQ ID NO: 2789 - DNA, 20 bp, Artificial Sequence
  chemically synthesized
gatagaaattggctaatatt

SEQ ID NO: 2790 - DNA, 20 bp, Artificial Sequence
  chemically synthesized
tatatttgaacactgaatat

SEQ ID NO: 2791 - DNA, 20 bp, Artificial Sequence
  chemically synthesized
tcagtgttcaaatatacact

SEQ ID NO: 2792 - DNA, 20 bp, Artificial Sequence
  chemically synthesized
cttgggagatttgagtggct

SEQ ID NO: 2793 - DNA, 20 bp, Artificial Sequence
  chemically synthesized
aaacacttgggagatttgag

SEQ ID NO: 2794 - DNA, 20 bp, Artificial Sequence
  chemically synthesized
cacaaacacttgggagattt

SEQ ID NO: 2795 - DNA, 20 bp, Artificial Sequence
  chemically synthesized
ctgagccactcaaatctccc

SEQ ID NO: 2796 - DNA, 20 bp, Artificial Sequence
  chemically synthesized
agttgttcacaaacacttgg

SEQ ID NO: 2797 - DNA, 20 bp, Artificial Sequence
  chemically synthesized
ttagttgttcacaaacactt

SEQ ID NO: 2798 - DNA, 20 bp, Artificial Sequence
  chemically synthesized
cttagttgttcacaaacact

SEQ ID NO: 2799 - DNA, 20 bp, Artificial Sequence
  chemically synthesized
ccaagtgtttgtgaacaact

SEQ ID NO: 2800 - DNA, 20 bp, Artificial Sequence
  chemically synthesized
ggttggtctctagatatact

SEQ ID NO: 2801 - DNA, 20 bp, Artificial Sequence
  chemically synthesized
tgtgaacaactaagtatatc

SEQ ID NO: 2802 - DNA, 20 bp, Artificial Sequence
  chemically synthesized
tgaacaactaagtatatcta

SEQ ID NO: 2803 - DNA, 20 bp, Artificial Sequence
  chemically synthesized
atatctttctggttggtctc

SEQ ID NO: 2804 - DNA, 20 bp, Artificial Sequence
  chemically synthesized
aagtatatctagagaccaac

SEQ ID NO: 2805 - DNA, 20 bp, Artificial Sequence
  chemically synthesized
atatctagagaccaaccaga

SEQ ID NO: 2806 - DNA, 20 bp, Artificial Sequence
  chemically synthesized
tgtgattatatctttctggt

SEQ ID NO: 2807 - DNA, 20 bp, Artificial Sequence
  chemically synthesized
gctttgtgattatatctttc

SEQ ID NO: 2808 - DNA, 20 bp, Artificial Sequence
  chemically synthesized
accagaaagatataatcaca

SEQ ID NO: 2809 - DNA, 20 bp, Artificial Sequence
  chemically synthesized
gatatgaatgtgtaaacatt

SEQ ID NO: 2810 - DNA, 20 bp, Artificial Sequence
  chemically synthesized
atataagcaggagcatattc

SEQ ID NO: 2811 - DNA, 20 bp, Artificial Sequence
  chemically synthesized
ataataggcaatataagcag

SEQ ID NO: 2812 - DNA, 20 bp, Artificial Sequence
  chemically synthesized
gcataataggcaatataagc

SEQ ID NO: 2813 - DNA, 20 bp, Artificial Sequence
  chemically synthesized
tgcataataggcaatataag

SEQ ID NO: 2814 - DNA, 20 bp, Artificial Sequence
  chemically synthesized
tcctgcataataggcaatat

SEQ ID NO: 2815 - DNA, 20 bp, Artificial Sequence
  chemically synthesized
tgcttatattgcctattatg

SEQ ID NO: 2816 - DNA, 20 bp, Artificial Sequence
  chemically synthesized
gcttatattgcctattatgc

SEQ ID NO: 2817 - DNA, 20 bp, Artificial Sequence
  chemically synthesized
ccaacactatcctgcataat

SEQ ID NO: 2818 - DNA, 20 bp, Artificial Sequence
  chemically synthesized
gccaacactatcctgcataa

SEQ ID NO: 2819 - DNA, 20 bp, Artificial Sequence
  chemically synthesized
atattgcctattatgcagga

SEQ ID NO: 2820 - DNA, 20 bp, Artificial Sequence
  chemically synthesized
cctattatgcaggatagtgt

SEQ ID NO: 2821 - DNA, 20 bp, Artificial Sequence
  chemically synthesized
tgcaggatagtgttggccat

SEQ ID NO: 2822 - DNA, 20 bp, Artificial Sequence
  chemically synthesized
tccatttagtgataaaccga

SEQ ID NO: 2823 - DNA, 20 bp, Artificial Sequence
  chemically synthesized
gccatcggtttatcactaaa

SEQ ID NO: 2824 - DNA, 20 bp, Artificial Sequence
  chemically synthesized
catcggtttatcactaaatg

SEQ ID NO: 2825 - DNA, 20 bp, Artificial Sequence
  chemically synthesized
cggtttatcactaaatggag

SEQ ID NO: 2826 - DNA, 20 bp, Artificial Sequence
  chemically synthesized
gagtggcatgcttctccatt

SEQ ID NO: 2827 - DNA, 20 bp, Artificial Sequence
  chemically synthesized
tatcaaaattaataaatgag

SEQ ID NO: 2828 - DNA, 20 bp, Artificial Sequence
  chemically synthesized
tgttatcaaaattaataaat

SEQ ID NO: 2829 - DNA, 20 bp, Artificial Sequence
  chemically synthesized
tcatttattaattttgataa

SEQ ID NO: 2830 - DNA, 20 bp, Artificial Sequence
  chemically synthesized
tattaattttgataacagtt

SEQ ID NO: 2831 - DNA, 20 bp, Artificial Sequence
  chemically synthesized
attttgataacagtttagca

SEQ ID NO: 2832 - DNA, 20 bp, Artificial Sequence
  chemically synthesized
aacagtttagcaaagccatt

SEQ ID NO: 2833 - DNA, 20 bp, Artificial Sequence
  chemically synthesized
tttagcaaagccattaagat

SEQ ID NO: 2834 - DNA, 20 bp, Artificial Sequence
  chemically synthesized
ggcttctaatcttatcttaa

SEQ ID NO: 2835 - DNA, 20 bp, Artificial Sequence
  chemically synthesized
caaagccattaagataagat

SEQ ID NO: 2836 - DNA, 20 bp, Artificial Sequence
  chemically synthesized
agccattaagataagattag

SEQ ID NO: 2837 - DNA, 20 bp, Artificial Sequence
  chemically synthesized
gccattcagcaggttaagtt

SEQ ID NO: 2838 - DNA, 20 bp, Artificial Sequence
  chemically synthesized
ggccattcagcaggttaagt

SEQ ID NO: 2839 - DNA, 20 bp, Artificial Sequence
  chemically synthesized
ttatggccattcagcaggtt

SEQ ID NO: 2840 - DNA, 20 bp, Artificial Sequence
  chemically synthesized
gcctaacttaacctgctgaa

SEQ ID NO: 2841 - DNA, 20 bp, Artificial Sequence
  chemically synthesized
cttatttatggccattcagc

SEQ ID NO: 2842 - DNA, 20 bp, Artificial Sequence
  chemically synthesized
ccttatttatggccattcag

SEQ ID NO: 2843 - DNA, 20 bp, Artificial Sequence
  chemically synthesized
gtgccttatttatggccatt

SEQ ID NO: 2844 - DNA, 20 bp, Artificial Sequence
  chemically synthesized
cctgctgaatggccataaat

SEQ ID NO: 2845 - DNA, 20 bp, Artificial Sequence
  chemically synthesized
ctgctgaatggccataaata

SEQ ID NO: 2846 - DNA, 20 bp, Artificial Sequence
  chemically synthesized
aaagtcaagtgccttattta

SEQ ID NO: 2847 - DNA, 20 bp, Artificial Sequence
  chemically synthesized
cctggaagccaagaaaagtc

SEQ ID NO: 2848 - DNA, 20 bp, Artificial Sequence
  chemically synthesized
ataaggcacttgacttttct

SEQ ID NO: 2849 - DNA, 20 bp, Artificial Sequence
  chemically synthesized
gagtacctggaagccaagaa

SEQ ID NO: 2850 - DNA, 20 bp, Artificial Sequence
  chemically synthesized
acttgacttttcttggcttc

SEQ ID NO: 2851 - DNA, 20 bp, Artificial Sequence
  chemically synthesized
cttgacttttcttggcttcc

SEQ ID NO: 2852 - DNA, 20 bp, Artificial Sequence
  chemically synthesized
acaaagagtacctggaagcc

SEQ ID NO: 2853 - DNA, 20 bp, Artificial Sequence
  chemically synthesized
ttttcacaaagagtacctgg

SEQ ID NO: 2854 - DNA, 20 bp, Artificial Sequence
  chemically synthesized
ttattttcacaaagagtacc

SEQ ID NO: 2855 - DNA, 20 bp, Artificial Sequence
  chemically synthesized
ttatcttttattttcacaaa

SEQ ID NO: 2856 - DNA, 20 bp, Artificial Sequence
  chemically synthesized
ctttatcttttattttcaca

SEQ ID NO: 2857 - DNA, 20 bp, Artificial Sequence
  chemically synthesized
ggtactctttgtgaaaataa

SEQ ID NO: 2858 - DNA, 20 bp, Artificial Sequence
  chemically synthesized
ctttgtgaaaataaaagata

SEQ ID NO: 2859 - DNA, 20 bp, Artificial Sequence
  chemically synthesized
gtgaaaataaaagataaaga

SEQ ID NO: 2860 - DNA, 20 bp, Artificial Sequence
  chemically synthesized
tgaaaataaaagataaagaa

SEQ ID NO: 2861 - DNA, 20 bp, Artificial Sequence
  chemically synthesized
aataaaagataaagaaaggt

SEQ ID NO: 2862 - DNA, 20 bp, Artificial Sequence
  chemically synthesized
gaaaggttagctgacacctt

SEQ ID NO: 2863 - DNA, 20 bp, Artificial Sequence
  chemically synthesized
agagttggtcctgaaggtgt

SEQ ID NO: 2864 - DNA, 20 bp, Artificial Sequence
  chemically synthesized
aaaggttagctgacaccttc

SEQ ID NO: 2865 - DNA, 20 bp, Artificial Sequence
  chemically synthesized
tgccacagagttggtcctga

SEQ ID NO: 2866 - DNA, 20 bp, Artificial Sequence
  chemically synthesized
ttgccacagagttggtcctg

SEQ ID NO: 2867 - DNA, 20 bp, Artificial Sequence
  chemically synthesized
caccttcaggaccaactctg

SEQ ID NO: 2868 - DNA, 20 bp, Artificial Sequence
  chemically synthesized
gttgccccttgccacagagt

SEQ ID NO: 2869 - DNA, 20 bp, Artificial Sequence
  chemically synthesized
ttcaggaccaactctgtggc

SEQ ID NO: 2870 - DNA, 20 bp, Artificial Sequence
  chemically synthesized
tcaggaccaactctgtggca

SEQ ID NO: 2871 - DNA, 20 bp, Artificial Sequence
  chemically synthesized
ttctgttgccccttgccaca

SEQ ID NO: 2872 - DNA, 20 bp, Artificial Sequence
  chemically synthesized
caggaccaactctgtggcaa

SEQ ID NO: 2873 - DNA, 20 bp, Artificial Sequence
  chemically synthesized
aggaccaactctgtggcaag

SEQ ID NO: 2874 - DNA, 20 bp, Artificial Sequence
  chemically synthesized
ttttctgttgccccttgcca

SEQ ID NO: 2875 - DNA, 20 bp, Artificial Sequence
  chemically synthesized
aactctgtggcaaggggcaa

SEQ ID NO: 2876 - DNA, 20 bp, Artificial Sequence
  chemically synthesized
tgtggcaaggggcaacagaa

SEQ ID NO: 2877 - DNA, 20 bp, Artificial Sequence
  chemically synthesized
aacagaaaagttgtaaattt

SEQ ID NO: 2878 - DNA, 20 bp, Artificial Sequence
  chemically synthesized
acagaaaagttgtaaatttg

SEQ ID NO: 2879 - DNA, 20 bp, Artificial Sequence
  chemically synthesized
tgtaaatttgaggtacataa

SEQ ID NO: 2880 - DNA, 20 bp, Artificial Sequence
  chemically synthesized
cataaagtatatagataggt

SEQ ID NO: 2881 - DNA, 20 bp, Artificial Sequence
  chemically synthesized
taaacataaagtatatagat

SEQ ID NO: 2882 - DNA, 20 bp, Artificial Sequence
  chemically synthesized
ataaacataaagtatataga

SEQ ID NO: 2883 - DNA, 20 bp, Artificial Sequence
  chemically synthesized
cttcataaacataaagtata

SEQ ID NO: 2884 - DNA, 20 bp, Artificial Sequence
  chemically synthesized
ttatgctcttcataaacata

SEQ ID NO: 2885 - DNA, 20 bp, Artificial Sequence
  chemically synthesized
ctatatactttatgtttatg

SEQ ID NO: 2886 - DNA, 20 bp, Artificial Sequence
  chemically synthesized
atatactttatgtttatgaa

SEQ ID NO: 2887 - DNA, 20 bp, Artificial Sequence
  chemically synthesized
tttatgtttatgaagagcat

SEQ ID NO: 2888 - DNA, 20 bp, Artificial Sequence
  chemically synthesized
gagcataagttttttaaaaa

SEQ ID NO: 2889 - DNA, 20 bp, Artificial Sequence
  chemically synthesized
gataattgcccacagaggaa

SEQ ID NO: 2890 - DNA, 20 bp, Artificial Sequence
  chemically synthesized
taaaaacggcttttcctctg

SEQ ID NO: 2891 - DNA, 20 bp, Artificial Sequence
  chemically synthesized
aaaaacggcttttcctctgt

SEQ ID NO: 2892 - DNA, 20 bp, Artificial Sequence
  chemically synthesized
tgctagataattgcccacag

SEQ ID NO: 2893 - DNA, 20 bp, Artificial Sequence
  chemically synthesized
ctgctagataattgcccaca

SEQ ID NO: 2894 - DNA, 20 bp, Artificial Sequence
  chemically synthesized
ccctgctagataattgccca

SEQ ID NO: 2895 - DNA, 20 bp, Artificial Sequence
  chemically synthesized
ttcctctgtgggcaattatc

SEQ ID NO: 2896 - DNA, 20 bp, Artificial Sequence
  chemically synthesized
ctctgtgggcaattatctag

SEQ ID NO: 2897 - DNA, 20 bp, Artificial Sequence
  chemically synthesized
tctgtgggcaattatctagc

SEQ ID NO: 2898 - DNA, 20 bp, Artificial Sequence
  chemically synthesized
ctgtgggcaattatctagca

SEQ ID NO: 2899 - DNA, 20 bp, Artificial Sequence
  chemically synthesized
cgtggtttacttaaccctgc

SEQ ID NO: 2900 - DNA, 20 bp, Artificial Sequence
  chemically synthesized
ggcaattatctagcagggtt

SEQ ID NO: 2901 - DNA, 20 bp, Artificial Sequence
  chemically synthesized
gcagggttaagtaaaccacg

SEQ ID NO: 2902 - DNA, 20 bp, Artificial Sequence
  chemically synthesized
gggttaagtaaaccacgcgg

SEQ ID NO: 2903 - DNA, 20 bp, Artificial Sequence
  chemically synthesized
tgctattaaataccaccgcg

SEQ ID NO: 2904 - DNA, 20 bp, Artificial Sequence
  chemically synthesized
aaccacgcggtggtatttaa

SEQ ID NO: 2905 - DNA, 20 bp, Artificial Sequence
  chemically synthesized
gccagaggtctgacatttag

SEQ ID NO: 2906 - DNA, 20 bp, Artificial Sequence
  chemically synthesized
agcacatttccactaaatgt

SEQ ID NO: 2907 - DNA, 20 bp, Artificial Sequence
  chemically synthesized
agagccagaggtctgacatt

SEQ ID NO: 2908 - DNA, 20 bp, Artificial Sequence
  chemically synthesized
tccactaaatgtcagacctc

SEQ ID NO: 2909 - DNA, 20 bp, Artificial Sequence
  chemically synthesized
aaaacagatgtgagagccag

SEQ ID NO: 2910 - DNA, 20 bp, Artificial Sequence
  chemically synthesized
caaaacagatgtgagagcca

SEQ ID NO: 2911 - DNA, 20 bp, Artificial Sequence
  chemically synthesized
ctcaaaacagatgtgagagc

SEQ ID NO: 2912 - DNA, 20 bp, Artificial Sequence
  chemically synthesized
gtaactcaaaacagatgtga

SEQ ID NO: 2913 - DNA, 20 bp, Artificial Sequence
  chemically synthesized
gagtaactcaaaacagatgt

SEQ ID NO: 2914 - DNA, 20 bp, Artificial Sequence
  chemically synthesized
ctggctctcacatctgtttt

SEQ ID NO: 2915 - DNA, 20 bp, Artificial Sequence
  chemically synthesized
gctgtttgagtaactcaaaa

SEQ ID NO: 2916 - DNA, 20 bp, Artificial Sequence
  chemically synthesized
tctgttttgagttactcaaa

SEQ ID NO: 2917 - DNA, 20 bp, Artificial Sequence
  chemically synthesized
gctgttttggacagctgttt

SEQ ID NO: 2918 - DNA, 20 bp, Artificial Sequence
  chemically synthesized
actcaaacagctgtccaaaa

SEQ ID NO: 2919 - DNA, 20 bp, Artificial Sequence
  chemically synthesized
attgctacagctgttttgga

SEQ ID NO: 2920 - DNA, 20 bp, Artificial Sequence
  chemically synthesized
catgattgctacagctgttt

SEQ ID NO: 2921 - DNA, 20 bp, Artificial Sequence
  chemically synthesized
acagctgtccaaaacagctg

SEQ ID NO: 2922 - DNA, 20 bp, Artificial Sequence
  chemically synthesized
aacaaagttcatgattgcta

SEQ ID NO: 2923 - DNA, 20 bp, Artificial Sequence
  chemically synthesized
ttgttgtgttacaaaaaaca

SEQ ID NO: 2924 - DNA, 20 bp, Artificial Sequence
  chemically synthesized
gttttttgtaacacaacaat

SEQ ID NO: 2925 - DNA, 20 bp, Artificial Sequence
  chemically synthesized
gtaacacaacaatgagaaca

SEQ ID NO: 2926 - DNA, 20 bp, Artificial Sequence
  chemically synthesized
cacaacaatgagaacatgga

SEQ ID NO: 2927 - DNA, 20 bp, Artificial Sequence
  chemically synthesized
aacaatgagaacatggatgg

SEQ ID NO: 2928 - DNA, 20 bp, Artificial Sequence
  chemically synthesized
gagaacatggatggtagtgt

SEQ ID NO: 2929 - DNA, 20 bp, Artificial Sequence
  chemically synthesized
agtgttagaataaaactata

SEQ ID NO: 2930 - DNA, 20 bp, Artificial Sequence
  chemically synthesized
gtgttagaataaaactataa

SEQ ID NO: 2931 - DNA, 20 bp, Artificial Sequence
  chemically synthesized
taatgtctcagagaccttta

SEQ ID NO: 2932 - DNA, 20 bp, Artificial Sequence
  chemically synthesized
ataaaactataaaggtctct

SEQ ID NO: 2933 - DNA, 20 bp, Artificial Sequence
  chemically synthesized
aagacgttgctaatgtctca

SEQ ID NO: 2934 - DNA, 20 bp, Artificial Sequence
  chemically synthesized
tataaaggtctctgagacat

SEQ ID NO: 2935 - DNA, 20 bp, Artificial Sequence
  chemically synthesized
ccaagacgttgctaatgtct

SEQ ID NO: 2936 - DNA, 20 bp, Artificial Sequence
  chemically synthesized
ctgagacattagcaacgtct

SEQ ID NO: 2937 - DNA, 20 bp, Artificial Sequence
  chemically synthesized
agacattagcaacgtcttgg

SEQ ID NO: 2938 - DNA, 20 bp, Artificial Sequence
  chemically synthesized
ttgccgtggaagtttctgcc

SEQ ID NO: 2939 - DNA, 20 bp, Artificial Sequence
  chemically synthesized
cgtcttggcagaaacttcca

SEQ ID NO: 2940 - DNA, 20 bp, Artificial Sequence
  chemically synthesized
ttttgagatttttgccgtgg

SEQ ID NO: 2941 - DNA, 20 bp, Artificial Sequence
  chemically synthesized
aaattttgagatttttgccg

SEQ ID NO: 2942 - DNA, 20 bp, Artificial Sequence
  chemically synthesized
ttcaaaaaaatttaaatttt

SEQ ID NO: 2943 - DNA, 20 bp, Artificial Sequence
  chemically synthesized
caaaatttaaatttttttga

SEQ ID NO: 2944 - DNA, 20 bp, Artificial Sequence
  chemically synthesized
tttttgaaagataattcaac

SEQ ID NO: 2945 - DNA, 20 bp, Artificial Sequence
  chemically synthesized
ttttgaaagataattcaacc

SEQ ID NO: 2946 - DNA, 20 bp, Artificial Sequence
  chemically synthesized
gaaagataattcaaccaggc

SEQ ID NO: 2947 - DNA, 20 bp, Artificial Sequence
  chemically synthesized
tgatctcagtttttcttgcc

SEQ ID NO: 2948 - DNA, 20 bp, Artificial Sequence
  chemically synthesized
tcaaccaggcaagaaaaact

SEQ ID NO: 2949 - DNA, 20 bp, Artificial Sequence
  chemically synthesized
aatactaatctatgtgatct

SEQ ID NO: 2950 - DNA, 20 bp, Artificial Sequence
  chemically synthesized
caagaaaaactgagatcaca

SEQ ID NO: 2951 - DNA, 20 bp, Artificial Sequence
  chemically synthesized
aaaactgagatcacatagat

SEQ ID NO: 2952 - DNA, 20 bp, Artificial Sequence
  chemically synthesized
gattagtatttttaaaccac

SEQ ID NO: 2953 - DNA, 20 bp, Artificial Sequence
  chemically synthesized
gtatttttaaaccactggtt

SEQ ID NO: 2954 - DNA, 20 bp, Artificial Sequence
  chemically synthesized
aaatggattttctgaaccag

SEQ ID NO: 2955 - DNA, 20 bp, Artificial Sequence
  chemically synthesized
actaaatggattttctgaac

SEQ ID NO: 2956 - DNA, 20 bp, Artificial Sequence
  chemically synthesized
actggttcagaaaatccatt

SEQ ID NO: 2957 - DNA, 20 bp, Artificial Sequence
  chemically synthesized
ggttcagaaaatccatttag

SEQ ID NO: 2958 - DNA, 20 bp, Artificial Sequence
  chemically synthesized
gttcagaaaatccatttagt

SEQ ID NO: 2959 - DNA, 20 bp, Artificial Sequence
  chemically synthesized
gctggttgcaacccactaaa

SEQ ID NO: 2960 - DNA, 20 bp, Artificial Sequence
  chemically synthesized
tccatttagtgggttgcaac

SEQ ID NO: 2961 - DNA, 20 bp, Artificial Sequence
  chemically synthesized
tttatttaaaaacaaaatgc

SEQ ID NO: 2962 - DNA, 20 bp, Artificial Sequence
  chemically synthesized
ttgtttttaaataaataaaa

SEQ ID NO: 2963 - DNA, 20 bp, Artificial Sequence
  chemically synthesized
aaataaataaaatagaaaaa

SEQ ID NO: 2964 - DNA, 20 bp, Artificial Sequence
  chemically synthesized
aaaacagcatgcactgtatg

SEQ ID NO: 2965 - DNA, 20 bp, Artificial Sequence
  chemically synthesized
gatgccttccatactacata

SEQ ID NO: 2966 - DNA, 20 bp, Artificial Sequence
  chemically synthesized
agcatgcactgtatgtagta

SEQ ID NO: 2967 - DNA, 20 bp, Artificial Sequence
  chemically synthesized
atgcactgtatgtagtatgg

SEQ ID NO: 2968 - DNA, 20 bp, Artificial Sequence
  chemically synthesized
tgcactgtatgtagtatgga

SEQ ID NO: 2969 - DNA, 20 bp, Artificial Sequence
  chemically synthesized
tcagaaacaaaagtttcatc

SEQ ID NO: 2970 - DNA, 20 bp, Artificial Sequence
  chemically synthesized
catacaaagatcagaaacaa

SEQ ID NO: 2971 - DNA, 20 bp, Artificial Sequence
  chemically synthesized
tgtcatatgcatacaaagat

SEQ ID NO: 2972 - DNA, 20 bp, Artificial Sequence
  chemically synthesized
tacagtgtcatatgcataca

SEQ ID NO: 2973 - DNA, 20 bp, Artificial Sequence
  chemically synthesized
tatgtacacacacacattta

SEQ ID NO: 2974 - DNA, 20 bp, Artificial Sequence
  chemically synthesized
taaatgtgtgtgtgtacata

SEQ ID NO: 2975 - DNA, 20 bp, Artificial Sequence
  chemically synthesized
atgtgtgtgtgtacatatgg

SEQ ID NO: 2976 - DNA, 20 bp, Artificial Sequence
  chemically synthesized
tgtgtgtgtgtacatatggt

SEQ ID NO: 2977 - DNA, 20 bp, Artificial Sequence
  chemically synthesized
tttattttatatctttaccc

SEQ ID NO: 2978 - DNA, 20 bp, Artificial Sequence
  chemically synthesized
ttacatcacaaactggggta

SEQ ID NO: 2979 - DNA, 20 bp, Artificial Sequence
  chemically synthesized
acattttacatcacaaactg

SEQ ID NO: 2980 - DNA, 20 bp, Artificial Sequence
  chemically synthesized
aacattttacatcacaaact

SEQ ID NO: 2981 - DNA, 20 bp, Artificial Sequence
  chemically synthesized
gaacattttacatcacaaac

SEQ ID NO: 2982 - DNA, 20 bp, Artificial Sequence
  chemically synthesized
tgtaaaatgttcctctgata

SEQ ID NO: 2983 - DNA, 20 bp, Artificial Sequence
  chemically synthesized
ttgatggttatccatatcag

SEQ ID NO: 2984 - DNA, 20 bp, Artificial Sequence
  chemically synthesized
tttgatggttatccatatca

SEQ ID NO: 2985 - DNA, 20 bp, Artificial Sequence
  chemically synthesized
gttttgatggttatccatat

SEQ ID NO: 2986 - DNA, 20 bp, Artificial Sequence
  chemically synthesized
gatatggataaccatcaaaa

SEQ ID NO: 2987 - DNA, 20 bp, Artificial Sequence
  chemically synthesized
gatttctgactctgttttga

SEQ ID NO: 2988 - DNA, 20 bp, Artificial Sequence
  chemically synthesized
tatggataaccatcaaaaca

SEQ ID NO: 2989 - DNA, 20 bp, Artificial Sequence
  chemically synthesized
gataaccatcaaaacagagt

SEQ ID NO: 2990 - DNA, 20 bp, Artificial Sequence
  chemically synthesized
agagtcagaaatcactgtcc

SEQ ID NO: 2991 - DNA, 20 bp, Artificial Sequence
  chemically synthesized
aacacttttgacatccagga

SEQ ID NO: 2992 - DNA, 20 bp, Artificial Sequence
  chemically synthesized
ttttaacacttttgacatcc

SEQ ID NO: 2993 - DNA, 20 bp, Artificial Sequence
  chemically synthesized
attttaacacttttgacatc

SEQ ID NO: 2994 - DNA, 20 bp, Artificial Sequence
  chemically synthesized
atcactgtcctggatgtcaa

SEQ ID NO: 2995 - DNA, 20 bp, Artificial Sequence
  chemically synthesized
aagtgttaaaatgacctttc

SEQ ID NO: 2996 - DNA, 20 bp, Artificial Sequence
  chemically synthesized
agtgttaaaatgacctttca

SEQ ID NO: 2997 - DNA, 20 bp, Artificial Sequence
  chemically synthesized
tcaaatggaagagccttgaa

SEQ ID NO: 2998 - DNA, 20 bp, Artificial Sequence
  chemically synthesized
ttcaaatggaagagccttga

SEQ ID NO: 2999 - DNA, 20 bp, Artificial Sequence
  chemically synthesized
acaaagtctttcaaatggaa

SEQ ID NO: 3000 - DNA, 20 bp, Artificial Sequence
  chemically synthesized
ttacaaagtctttcaaatgg

SEQ ID NO: 3001 - DNA, 20 bp, Artificial Sequence
  chemically synthesized
ttcaaggctcttccatttga

SEQ ID NO: 3002 - DNA, 20 bp, Artificial Sequence
  chemically synthesized
ggattacaaagtctttcaaa

SEQ ID NO: 3003 - DNA, 20 bp, Artificial Sequence
  chemically synthesized
cttaacatcttgggattaca

SEQ ID NO: 3004 - DNA, 20 bp, Artificial Sequence
  chemically synthesized
ttgaaagactttgtaatccc

SEQ ID NO: 3005 - DNA, 20 bp, Artificial Sequence
  chemically synthesized
cttgagaatcttaacatctt

SEQ ID NO: 3006 - DNA, 20 bp, Artificial Sequence
  chemically synthesized
ctttgtaatcccaagatgtt

SEQ ID NO: 3007 - DNA, 20 bp, Artificial Sequence
  chemically synthesized
tcttgagaatcttaacatct

SEQ ID NO: 3008 - DNA, 20 bp, Artificial Sequence
  chemically synthesized
cccaagatgttaagattctc

SEQ ID NO: 3009 - DNA, 20 bp, Artificial Sequence
  chemically synthesized
gatattaagcagaaattctt

SEQ ID NO: 3010 - DNA, 20 bp, Artificial Sequence
  chemically synthesized
tgtgttcagctgatattaag

SEQ ID NO: 3011 - DNA, 20 bp, Artificial Sequence
  chemically synthesized
caagaatttctgcttaatat

SEQ ID NO: 3012 - DNA, 20 bp, Artificial Sequence
  chemically synthesized
agatgtgttcagctgatatt

SEQ ID NO: 3013 - DNA, 20 bp, Artificial Sequence
  chemically synthesized
taccagttggtagatgtgtt

SEQ ID NO: 3014 - DNA, 20 bp, Artificial Sequence
  chemically synthesized
agctgaacacatctaccaac

SEQ ID NO: 3015 - DNA, 20 bp, Artificial Sequence
  chemically synthesized
gggaacatcttaccagttgg

SEQ ID NO: 3016 - DNA, 20 bp, Artificial Sequence
  chemically synthesized
gaacacatctaccaactggt

SEQ ID NO: 3017 - DNA, 20 bp, Artificial Sequence
  chemically synthesized
ggcgggaacatcttaccagt

SEQ ID NO: 3018 - DNA, 20 bp, Artificial Sequence
  chemically synthesized
gtttggcgggaacatcttac

SEQ ID NO: 3019 - DNA, 20 bp, Artificial Sequence
  chemically synthesized
catataccgtcaagtttggc

SEQ ID NO: 3020 - DNA, 20 bp, Artificial Sequence
  chemically synthesized
acatataccgtcaagtttgg

SEQ ID NO: 3021 - DNA, 20 bp, Artificial Sequence
  chemically synthesized
gatgttcccgccaaacttga

SEQ ID NO: 3022 - DNA, 20 bp, Artificial Sequence
  chemically synthesized
cacacatataccgtcaagtt

SEQ ID NO: 3023 - DNA, 20 bp, Artificial Sequence
  chemically synthesized
gtacacacacatataccgtc

SEQ ID NO: 3024 - DNA, 20 bp, Artificial Sequence
  chemically synthesized
tgttttttaattttgaaaaa

SEQ ID NO: 3025 - DNA, 20 bp, Artificial Sequence
  chemically synthesized
ttttcaaaattaaaaaacaa

SEQ ID NO: 3026 - DNA, 20 bp, Artificial Sequence
  chemically synthesized
ttaaaaaacaaaagtgcttt

SEQ ID NO: 3027 - DNA, 20 bp, Artificial Sequence
  chemically synthesized
aaaacaaaagtgcttttagt

SEQ ID NO: 3028 - DNA, 20 bp, Artificial Sequence
  chemically synthesized
gatgctttctttccaactaa

SEQ ID NO: 3029 - DNA, 20 bp, Artificial Sequence
  chemically synthesized
caaaagtgcttttagttgga

SEQ ID NO: 3030 - DNA, 20 bp, Artificial Sequence
  chemically synthesized
agtgcttttagttggaaaga

SEQ ID NO: 3031 - DNA, 20 bp, Artificial Sequence
  chemically synthesized
gcactcaaaaaagtggtttt

SEQ ID NO: 3032 - DNA, 20 bp, Artificial Sequence
  chemically synthesized
catccaaaaaccactttttt

SEQ ID NO: 3033 - DNA, 20 bp, Artificial Sequence
  chemically synthesized
tattgatgcactcaaaaaag

SEQ ID NO: 3034 - DNA, 20 bp, Artificial Sequence
  chemically synthesized
aattattgatgcactcaaaa

SEQ ID NO: 3035 - DNA, 20 bp, Artificial Sequence
  chemically synthesized
tttttgagtgcatcaataat

SEQ ID NO: 3036 - DNA, 20 bp, Artificial Sequence
  chemically synthesized
gtttcattattgtaaaaatt

SEQ ID NO: 3037 - DNA, 20 bp, Artificial Sequence
  chemically synthesized
agtttcattattgtaaaaat

SEQ ID NO: 3038 - DNA, 20 bp, Artificial Sequence
  chemically synthesized
cccaaattcaagtggataaa

SEQ ID NO: 3039 - DNA, 20 bp, Artificial Sequence
  chemically synthesized
tttttctccccaaattcaag

SEQ ID NO: 3040 - DNA, 20 bp, Artificial Sequence
  chemically synthesized
actttttatccacttgaatt

SEQ ID NO: 3041 - DNA, 20 bp, Artificial Sequence
  chemically synthesized
ctttttatccacttgaattt

SEQ ID NO: 3042 - DNA, 20 bp, Artificial Sequence
  chemically synthesized
tttttatccacttgaatttg

SEQ ID NO: 3043 - DNA, 20 bp, Artificial Sequence
  chemically synthesized
gcctttttctccccaaattc

SEQ ID NO: 3044 - DNA, 20 bp, Artificial Sequence
  chemically synthesized
tttatccacttgaatttggg

SEQ ID NO: 3045 - DNA, 20 bp, Artificial Sequence
  chemically synthesized
cacttgaatttggggagaaa

SEQ ID NO: 3046 - DNA, 20 bp, Artificial Sequence
  chemically synthesized
acttgaatttggggagaaaa

SEQ ID NO: 3047 - DNA, 20 bp, Artificial Sequence
  chemically synthesized
ttggggagaaaaaggcctgt

SEQ ID NO: 3048 - DNA, 20 bp, Artificial Sequence
  chemically synthesized
ggagaaaaaggcctgtaaga

SEQ ID NO: 3049 - DNA, 20 bp, Artificial Sequence
  chemically synthesized
gctaactcaggctttcttac

SEQ ID NO: 3050 - DNA, 20 bp, Artificial Sequence
  chemically synthesized
agctaactcaggctttctta

SEQ ID NO: 3051 - DNA, 20 bp, Artificial Sequence
  chemically synthesized
aaaggcctgtaagaaagcct

SEQ ID NO: 3052 - DNA, 20 bp, Artificial Sequence
  chemically synthesized
gcctgtaagaaagcctgagt

SEQ ID NO: 3053 - DNA, 20 bp, Artificial Sequence
  chemically synthesized
ttgctactttcagctaactc

SEQ ID NO: 3054 - DNA, 20 bp, Artificial Sequence
  chemically synthesized
tttgctactttcagctaact

SEQ ID NO: 3055 - DNA, 20 bp, Artificial Sequence
  chemically synthesized
agaaagcctgagttagctga

SEQ ID NO: 3056 - DNA, 20 bp, Artificial Sequence
  chemically synthesized
aagcctgagttagctgaaag

SEQ ID NO: 3057 - DNA, 20 bp, Artificial Sequence
  chemically synthesized
tcctcacgttttgctacttt

SEQ ID NO: 3058 - DNA, 20 bp, Artificial Sequence
  chemically synthesized
agctgaaagtagcaaaacgt

SEQ ID NO: 3059 - DNA, 20 bp, Artificial Sequence
  chemically synthesized
gctgaaagtagcaaaacgtg

SEQ ID NO: 3060 - DNA, 20 bp, Artificial Sequence
  chemically synthesized
gcaaaacgtgaggaaatgcc

SEQ ID NO: 3061 - DNA, 20 bp, Artificial Sequence
  chemically synthesized
gtgaggaaatgccaagatca

SEQ ID NO: 3062 - DNA, 20 bp, Artificial Sequence
  chemically synthesized
attctgtaataccatgatct

SEQ ID NO: 3063 - DNA, 20 bp, Artificial Sequence
  chemically synthesized
atgccaagatcatggtatta

SEQ ID NO: 3064 - DNA, 20 bp, Artificial Sequence
  chemically synthesized
atcatggtattacagaatga

SEQ ID NO: 3065 - DNA, 20 bp, Artificial Sequence
  chemically synthesized
tcatggtattacagaatgat

SEQ ID NO: 3066 - DNA, 20 bp, Artificial Sequence
  chemically synthesized
ggtattacagaatgataggc

SEQ ID NO: 3067 - DNA, 20 bp, Artificial Sequence
  chemically synthesized
agctaaggtattggaaaatc

SEQ ID NO: 3068 - DNA, 20 bp, Artificial Sequence
  chemically synthesized
ggccagattttccaatacct

SEQ ID NO: 3069 - DNA, 20 bp, Artificial Sequence
  chemically synthesized
caagagagtagctaaggtat

SEQ ID NO: 3070 - DNA, 20 bp, Artificial Sequence
  chemically synthesized
aaaacacaagagagtagcta

SEQ ID NO: 3071 - DNA, 20 bp, Artificial Sequence
  chemically synthesized
aaaaacacaagagagtagct

SEQ ID NO: 3072 - DNA, 20 bp, Artificial Sequence
  chemically synthesized
acacaaaaaacacaagagag

SEQ ID NO: 3073 - DNA, 20 bp, Artificial Sequence
  chemically synthesized
aatacacaaaaaacacaaga

SEQ ID NO: 3074 - DNA, 20 bp, Artificial Sequence
  chemically synthesized
taaatacacaaaaaacacaa

SEQ ID NO: 3075 - DNA, 20 bp, Artificial Sequence
  chemically synthesized
attaaatacacaaaaaacac

SEQ ID NO: 3076 - DNA, 20 bp, Artificial Sequence
  chemically synthesized
atttaattgttttgtttttt

SEQ ID NO: 3077 - DNA, 20 bp, Artificial Sequence
  chemically synthesized
agaatgtgaatttattttct

SEQ ID NO: 3078 - DNA, 20 bp, Artificial Sequence
  chemically synthesized
gaatgtgaatttattttctc

SEQ ID NO: 3079 - DNA, 20 bp, Artificial Sequence
  chemically synthesized
aatttattttctcaggccac

SEQ ID NO: 3080 - DNA, 20 bp, Artificial Sequence
  chemically synthesized
cagtggtacccttgtggcct

SEQ ID NO: 3081 - DNA, 20 bp, Artificial Sequence
  chemically synthesized
atttattttctcaggccaca

SEQ ID NO: 3082 - DNA, 20 bp, Artificial Sequence
  chemically synthesized
tttattttctcaggccacaa

SEQ ID NO: 3083 - DNA, 20 bp, Artificial Sequence
  chemically synthesized
cttactcagtggtacccttg

SEQ ID NO: 3084 - DNA, 20 bp, Artificial Sequence
  chemically synthesized
caggccacaagggtaccact

SEQ ID NO: 3085 - DNA, 20 bp, Artificial Sequence
  chemically synthesized
ccacaagggtaccactgagt

SEQ ID NO: 3086 - DNA, 20 bp, Artificial Sequence
  chemically synthesized
ttaagttccggcttactcag

SEQ ID NO: 3087 - DNA, 20 bp, Artificial Sequence
  chemically synthesized
aagggtaccactgagtaagc

SEQ ID NO: 3088 - DNA, 20 bp, Artificial Sequence
  chemically synthesized
aacttaagttccggcttact

SEQ ID NO: 3089 - DNA, 20 bp, Artificial Sequence
  chemically synthesized
cactgagtaagccggaactt

SEQ ID NO: 3090 - DNA, 20 bp, Artificial Sequence
  chemically synthesized
aattccattaacttaagttc

SEQ ID NO: 3091 - DNA, 20 bp, Artificial Sequence
  chemically synthesized
taagccggaacttaagttaa

SEQ ID NO: 3092 - DNA, 20 bp, Artificial Sequence
  chemically synthesized
gataccaattccattaactt

SEQ ID NO: 3093 - DNA, 20 bp, Artificial Sequence
  chemically synthesized
ggaacttaagttaatggaat

SEQ ID NO: 3094 - DNA, 20 bp, Artificial Sequence
  chemically synthesized
taagttaatggaattggtat

SEQ ID NO: 3095 - DNA, 20 bp, Artificial Sequence
  chemically synthesized
taatggaattggtatcggac

SEQ ID NO: 3096 - DNA, 20 bp, Artificial Sequence
  chemically synthesized
aatggaattggtatcggaca

SEQ ID NO: 3097 - DNA, 20 bp, Artificial Sequence
  chemically synthesized
ttctcaaatgtgggagaagg

SEQ ID NO: 3098 - DNA, 20 bp, Artificial Sequence
  chemically synthesized
aagttctcaaatgtgggaga

SEQ ID NO: 3099 - DNA, 20 bp, Artificial Sequence
  chemically synthesized
taagttctcaaatgtgggag

SEQ ID NO: 3100 - DNA, 20 bp, Artificial Sequence
  chemically synthesized
atttaagttctcaaatgtgg

SEQ ID NO: 3101 - DNA, 20 bp, Artificial Sequence
  chemically synthesized
ggcttccttctcccacattt

SEQ ID NO: 3102 - DNA, 20 bp, Artificial Sequence
  chemically synthesized
tgatttaagttctcaaatgt

SEQ ID NO: 3103 - DNA, 20 bp, Artificial Sequence
  chemically synthesized
ctgatttaagttctcaaatg

SEQ ID NO: 3104 - DNA, 20 bp, Artificial Sequence
  chemically synthesized
ccacatttgagaacttaaat

SEQ ID NO: 3105 - DNA, 20 bp, Artificial Sequence
  chemically synthesized
caggccttaagggctgattt

SEQ ID NO: 3106 - DNA, 20 bp, Artificial Sequence
  chemically synthesized
gagaacttaaatcagccctt

SEQ ID NO: 3107 - DNA, 20 bp, Artificial Sequence
  chemically synthesized
agaacttaaatcagccctta

SEQ ID NO: 3108 - DNA, 20 bp, Artificial Sequence
  chemically synthesized
ggaagaatttcaggccttaa

SEQ ID NO: 3109 - DNA, 20 bp, Artificial Sequence
  chemically synthesized
cggaagaatttcaggcctta

SEQ ID NO: 3110 - DNA, 20 bp, Artificial Sequence
  chemically synthesized
acggaagaatttcaggcctt

SEQ ID NO: 3111 - DNA, 20 bp, Artificial Sequence
  chemically synthesized
agtgcttacggaagaatttc

SEQ ID NO: 3112 - DNA, 20 bp, Artificial Sequence
  chemically synthesized
tagtgcttacggaagaattt

SEQ ID NO: 3113 - DNA, 20 bp, Artificial Sequence
  chemically synthesized
aaggcctgaaattcttccgt

SEQ ID NO: 3114 - DNA, 20 bp, Artificial Sequence
  chemically synthesized
tactaaattagtgcttacgg

SEQ ID NO: 3115 - DNA, 20 bp, Artificial Sequence
  chemically synthesized
gtttactaaattagtgctta

SEQ ID NO: 3116 - DNA, 20 bp, Artificial Sequence
  chemically synthesized
ttcttccgtaagcactaatt

SEQ ID NO: 3117 - DNA, 20 bp, Artificial Sequence
  chemically synthesized
ctggatagtgtttactaaat

SEQ ID NO: 3118 - DNA, 20 bp, Artificial Sequence
  chemically synthesized
ctaatttagtaaacactatc

SEQ ID NO: 3119 - DNA, 20 bp, Artificial Sequence
  chemically synthesized
taatttagtaaacactatcc

SEQ ID NO: 3120 - DNA, 20 bp, Artificial Sequence
  chemically synthesized
tttagtaaacactatccagg

SEQ ID NO: 3121 - DNA, 20 bp, Artificial Sequence
  chemically synthesized
ctcaattcaggccacctgga

SEQ ID NO: 3122 - DNA, 20 bp, Artificial Sequence
  chemically synthesized
gaaactcaattcaggccacc

SEQ ID NO: 3123 - DNA, 20 bp, Artificial Sequence
  chemically synthesized
ctatccaggtggcctgaatt

SEQ ID NO: 3124 - DNA, 20 bp, Artificial Sequence
  chemically synthesized
aaacttgggaaactcaattc

SEQ ID NO: 3125 - DNA, 20 bp, Artificial Sequence
  chemically synthesized
gaaacttgggaaactcaatt

SEQ ID NO: 3126 - DNA, 20 bp, Artificial Sequence
  chemically synthesized
tggcctgaattgagtttccc

SEQ ID NO: 3127 - DNA, 20 bp, Artificial Sequence
  chemically synthesized
acttacttgtatggaaactt

SEQ ID NO: 3128 - DNA, 20 bp, Artificial Sequence
  chemically synthesized
tacttacttgtatggaaact

SEQ ID NO: 3129 - DNA, 20 bp, Artificial Sequence
  chemically synthesized
agtttcccaagtttccatac

SEQ ID NO: 3130 - DNA, 20 bp, Artificial Sequence
  chemically synthesized
tcccaagtttccatacaagt

SEQ ID NO: 3131 - DNA, 20 bp, Artificial Sequence
  chemically synthesized
tgttgatttacttacttgta

SEQ ID NO: 3132 - DNA, 20 bp, Artificial Sequence
  chemically synthesized
acaagtaagtaaatcaacat

SEQ ID NO: 3133 - DNA, 20 bp, Artificial Sequence
  chemically synthesized
aagtaagtaaatcaacatca

SEQ ID NO: 3134 - DNA, 20 bp, Artificial Sequence
  chemically synthesized
ctgatatggtatttagcagt

SEQ ID NO: 3135 - DNA, 20 bp, Artificial Sequence
  chemically synthesized
tcctctgatatggtatttag

SEQ ID NO: 3136 - DNA, 20 bp, Artificial Sequence
  chemically synthesized
acctcctctgatatggtatt

SEQ ID NO: 3137 - DNA, 20 bp, Artificial Sequence
  chemically synthesized
ctgactgctaaataccatat

SEQ ID NO: 3138 - DNA, 20 bp, Artificial Sequence
  chemically synthesized
gactgctaaataccatatca

SEQ ID NO: 3139 - DNA, 20 bp, Artificial Sequence
  chemically synthesized
actgctaaataccatatcag

SEQ ID NO: 3140 - DNA, 20 bp, Artificial Sequence
  chemically synthesized
gaaatatacctcctctgata

SEQ ID NO: 3141 - DNA, 20 bp, Artificial Sequence
  chemically synthesized
tgctaaataccatatcagag

SEQ ID NO: 3142 - DNA, 20 bp, Artificial Sequence
  chemically synthesized
gctaaataccatatcagagg

SEQ ID NO: 3143 - DNA, 20 bp, Artificial Sequence
  chemically synthesized
gaggtatatttcttgtcttc

SEQ ID NO: 3144 - DNA, 20 bp, Artificial Sequence
  chemically synthesized
aggtatatttcttgtcttcc

SEQ ID NO: 3145 - DNA, 20 bp, Artificial Sequence
  chemically synthesized
gtagaagcttcctggaagac

SEQ ID NO: 3146 - DNA, 20 bp, Artificial Sequence
  chemically synthesized
tatatttcttgtcttccagg

SEQ ID NO: 3147 - DNA, 20 bp, Artificial Sequence
  chemically synthesized
tgggtgtagaagcttcctgg

SEQ ID NO: 3148 - DNA, 20 bp, Artificial Sequence
  chemically synthesized
acatgggtgtagaagcttcc

SEQ ID NO: 3149 - DNA, 20 bp, Artificial Sequence
  chemically synthesized
tagataccacatgggtgtag

SEQ ID NO: 3150 - DNA, 20 bp, Artificial Sequence
  chemically synthesized
agctagataccacatgggtg

SEQ ID NO: 3151 - DNA, 20 bp, Artificial Sequence
  chemically synthesized
aggaagcttctacacccatg

SEQ ID NO: 3152 - DNA, 20 bp, Artificial Sequence
  chemically synthesized
cttaaagctagataccacat

SEQ ID NO: 3153 - DNA, 20 bp, Artificial Sequence
  chemically synthesized
ccttaaagctagataccaca

SEQ ID NO: 3154 - DNA, 20 bp, Artificial Sequence
  chemically synthesized
ttctacacccatgtggtatc

SEQ ID NO: 3155 - DNA, 20 bp, Artificial Sequence
  chemically synthesized
cccatgtggtatctagcttt

SEQ ID NO: 3156 - DNA, 20 bp, Artificial Sequence
  chemically synthesized
ccatgtggtatctagcttta

SEQ ID NO: 3157 - DNA, 20 bp, Artificial Sequence
  chemically synthesized
gcttttagagtccttaaagc

SEQ ID NO: 3158 - DNA, 20 bp, Artificial Sequence
  chemically synthesized
tcccgcttttagagtcctta

SEQ ID NO: 3159 - DNA, 20 bp, Artificial Sequence
  chemically synthesized
tctagctttaaggactctaa

SEQ ID NO: 3160 - DNA, 20 bp, Artificial Sequence
  chemically synthesized
agctttaaggactctaaaag

SEQ ID NO: 3161 - DNA, 20 bp, Artificial Sequence
  chemically synthesized
gctttaaggactctaaaagc

SEQ ID NO: 3162 - DNA, 20 bp, Artificial Sequence
  chemically synthesized
ctccctgtgtcccgctttta

SEQ ID NO: 3163 - DNA, 20 bp, Artificial Sequence
  chemically synthesized
atctccctgtgtcccgcttt

SEQ ID NO: 3164 - DNA, 20 bp, Artificial Sequence
  chemically synthesized
aggactctaaaagcgggaca

SEQ ID NO: 3165 - DNA, 20 bp, Artificial Sequence
  chemically synthesized
ggactctaaaagcgggacac

SEQ ID NO: 3166 - DNA, 20 bp, Artificial Sequence
  chemically synthesized
gactctaaaagcgggacaca

SEQ ID NO: 3167 - DNA, 20 bp, Artificial Sequence
  chemically synthesized
ctctaaaagcgggacacagg

SEQ ID NO: 3168 - DNA, 20 bp, Artificial Sequence
  chemically synthesized
aaaagcgggacacagggaga

SEQ ID NO: 3169 - DNA, 20 bp, Artificial Sequence
  chemically synthesized
ggacacagggagatggtgca

SEQ ID NO: 3170 - DNA, 20 bp, Artificial Sequence
  chemically synthesized
gacacagggagatggtgcaa

SEQ ID NO: 3171 - DNA, 20 bp, Artificial Sequence
  chemically synthesized
gtgcaaaggatttcacctta

SEQ ID NO: 3172 - DNA, 20 bp, Artificial Sequence
  chemically synthesized
gtccaccctaattagctgta

SEQ ID NO: 3173 - DNA, 20 bp, Artificial Sequence
  chemically synthesized
ggtccaccctaattagctgt

SEQ ID NO: 3174 - DNA, 20 bp, Artificial Sequence
  chemically synthesized
gatttcaccttacagctaat

SEQ ID NO: 3175 - DNA, 20 bp, Artificial Sequence
  chemically synthesized
atttcaccttacagctaatt

SEQ ID NO: 3176 - DNA, 20 bp, Artificial Sequence
  chemically synthesized
tttcaccttacagctaatta

SEQ ID NO: 3177 - DNA, 20 bp, Artificial Sequence
  chemically synthesized
caccttacagctaattaggg

SEQ ID NO: 3178 - DNA, 20 bp, Artificial Sequence
  chemically synthesized
agtttctggtccaccctaat

SEQ ID NO: 3179 - DNA, 20 bp, Artificial Sequence
  chemically synthesized
tacagctaattagggtggac

SEQ ID NO: 3180 - DNA, 20 bp, Artificial Sequence
  chemically synthesized
attagggtggaccagaaact

SEQ ID NO: 3181 - DNA, 20 bp, Artificial Sequence
  chemically synthesized
ttagggtggaccagaaactc

SEQ ID NO: 3182 - DNA, 20 bp, Artificial Sequence
  chemically synthesized
cctttttgtacctgagtttc

SEQ ID NO: 3183 - DNA, 20 bp, Artificial Sequence
  chemically synthesized
ctagactcctttttgtacct

SEQ ID NO: 3184 - DNA, 20 bp, Artificial Sequence
  chemically synthesized
accagaaactcaggtacaaa

SEQ ID NO: 3185 - DNA, 20 bp, Artificial Sequence
  chemically synthesized
ccagaaactcaggtacaaaa

SEQ ID NO: 3186 - DNA, 20 bp, Artificial Sequence
  chemically synthesized
agaaactcaggtacaaaaag

SEQ ID NO: 3187 - DNA, 20 bp, Artificial Sequence
  chemically synthesized
ctcaggtacaaaaaggagtc

SEQ ID NO: 3188 - DNA, 20 bp, Artificial Sequence
  chemically synthesized
tcaggtacaaaaaggagtct

SEQ ID NO: 3189 - DNA, 20 bp, Artificial Sequence
  chemically synthesized
ggtacaaaaaggagtctagg

SEQ ID NO: 3190 - DNA, 20 bp, Artificial Sequence
  chemically synthesized
aaaaaggagtctaggaagtc

SEQ ID NO: 3191 - DNA, 20 bp, Artificial Sequence
  chemically synthesized
cataggcagccttgacttcc

SEQ ID NO: 3192 - DNA, 20 bp, Artificial Sequence
  chemically synthesized
aaaaggagtctaggaagtca

SEQ ID NO: 3193 - DNA, 20 bp, Artificial Sequence
  chemically synthesized
ggaagtcaaggctgcctatg

SEQ ID NO: 3194 - DNA, 20 bp, Artificial Sequence
  chemically synthesized
tgactctgcttcttcatagg

SEQ ID NO: 3195 - DNA, 20 bp, Artificial Sequence
  chemically synthesized
agtcaaggctgcctatgaag

SEQ ID NO: 3196 - DNA, 20 bp, Artificial Sequence
  chemically synthesized
tcatgactctgcttcttcat

SEQ ID NO: 3197 - DNA, 20 bp, Artificial Sequence
  chemically synthesized
ctcatgactctgcttcttca

SEQ ID NO: 3198 - DNA, 20 bp, Artificial Sequence
  chemically synthesized
caaggctgcctatgaagaag

SEQ ID NO: 3199 - DNA, 20 bp, Artificial Sequence
  chemically synthesized
aggctgcctatgaagaagca

SEQ ID NO: 3200 - DNA, 20 bp, Artificial Sequence
  chemically synthesized
ctatgaagaagcagagtcat

SEQ ID NO: 3201 - DNA, 20 bp, Artificial Sequence
  chemically synthesized
cagagtcatgagccttgctg

SEQ ID NO: 3202 - DNA, 20 bp, Artificial Sequence
  chemically synthesized
gtagagaagaagctacagca

SEQ ID NO: 3203 - DNA, 20 bp, Artificial Sequence
  chemically synthesized
agtagagaagaagctacagc

SEQ ID NO: 3204 - DNA, 20 bp, Artificial Sequence
  chemically synthesized
ggttagtagagaagaagcta

SEQ ID NO: 3205 - DNA, 20 bp, Artificial Sequence
  chemically synthesized
acaagaggttagtagagaag

SEQ ID NO: 3206 - DNA, 20 bp, Artificial Sequence
  chemically synthesized
taaacaagaggttagtagag

SEQ ID NO: 3207 - DNA, 20 bp, Artificial Sequence
  chemically synthesized
atctaaacaagaggttagta

SEQ ID NO: 3208 - DNA, 20 bp, Artificial Sequence
  chemically synthesized
acatctaaacaagaggttag

SEQ ID NO: 3209 - DNA, 20 bp, Artificial Sequence
  chemically synthesized
tccacatctaaacaagaggt

SEQ ID NO: 3210 - DNA, 20 bp, Artificial Sequence
  chemically synthesized
ttctctactaacctcttgtt

SEQ ID NO: 3211 - DNA, 20 bp, Artificial Sequence
  chemically synthesized
ttcttccacatctaaacaag

SEQ ID NO: 3212 - DNA, 20 bp, Artificial Sequence
  chemically synthesized
tttcttccacatctaaacaa

SEQ ID NO: 3213 - DNA, 20 bp, Artificial Sequence
  chemically synthesized
catttcttccacatctaaac

SEQ ID NO: 3214 - DNA, 20 bp, Artificial Sequence
  chemically synthesized
actaacctcttgtttagatg

SEQ ID NO: 3215 - DNA, 20 bp, Artificial Sequence
  chemically synthesized
aacctcttgtttagatgtgg

SEQ ID NO: 3216 - DNA, 20 bp, Artificial Sequence
  chemically synthesized
ttagatgtggaagaaatgcc

SEQ ID NO: 3217 - DNA, 20 bp, Artificial Sequence
  chemically synthesized
tagatgtggaagaaatgccc

SEQ ID NO: 3218 - DNA, 20 bp, Artificial Sequence
  chemically synthesized
agatgtggaagaaatgccca

SEQ ID NO: 3219 - DNA, 20 bp, Artificial Sequence
  chemically synthesized
ggctgccctgttggcaccct

SEQ ID NO: 3220 - DNA, 20 bp, Artificial Sequence
  chemically synthesized
tggctgccctgttggcaccc

SEQ ID NO: 3221 - DNA, 20 bp, Artificial Sequence
  chemically synthesized
agaaatgcccagggtgccaa

SEQ ID NO: 3222 - DNA, 20 bp, Artificial Sequence
  chemically synthesized
gaaatgcccagggtgccaac

SEQ ID NO: 3223 - DNA, 20 bp, Artificial Sequence
  chemically synthesized
aaatgcccagggtgccaaca

SEQ ID NO: 3224 - DNA, 20 bp, Artificial Sequence
  chemically synthesized
tgcccagggtgccaacaggg

SEQ ID NO: 3225 - DNA, 20 bp, Artificial Sequence
  chemically synthesized
aaagttgctggctgccctgt

SEQ ID NO: 3226 - DNA, 20 bp, Artificial Sequence
  chemically synthesized
cagggtgccaacagggcagc

SEQ ID NO: 3227 - DNA, 20 bp, Artificial Sequence
  chemically synthesized
tacctgctctggaaagttgc

SEQ ID NO: 3228 - DNA, 20 bp, Artificial Sequence
  chemically synthesized
cagggcagccagcaactttc

SEQ ID NO: 3229 - DNA, 20 bp, Artificial Sequence
  chemically synthesized
gggcagccagcaactttcca

SEQ ID NO: 3230 - DNA, 20 bp, Artificial Sequence
  chemically synthesized
cagccagcaactttccagag

SEQ ID NO: 3231 - DNA, 20 bp, Artificial Sequence
  chemically synthesized
gcttgcttacctgctctgga

SEQ ID NO: 3232 - DNA, 20 bp, Artificial Sequence
  chemically synthesized
agccagcaactttccagagc

SEQ ID NO: 3233 - DNA, 20 bp, Artificial Sequence
  chemically synthesized
ggcagcttgcttacctgctc

SEQ ID NO: 3234 - DNA, 20 bp, Artificial Sequence
  chemically synthesized
agcaactttccagagcaggt

SEQ ID NO: 3235 - DNA, 20 bp, Artificial Sequence
  chemically synthesized
actttccagagcaggtaagc

SEQ ID NO: 3236 - DNA, 20 bp, Artificial Sequence
  chemically synthesized
agagcaggtaagcaagctgc

SEQ ID NO: 3237 - DNA, 20 bp, Artificial Sequence
  chemically synthesized
ggtaagcaagctgccagttc

SEQ ID NO: 3238 - DNA, 20 bp, Artificial Sequence
  chemically synthesized
atcctggccccttgaactgg

SEQ ID NO: 3239 - DNA, 20 bp, Artificial Sequence
  chemically synthesized
gtaagcaagctgccagttca

SEQ ID NO: 3240 - DNA, 20 bp, Artificial Sequence
  chemically synthesized
taagcaagctgccagttcaa

SEQ ID NO: 3241 - DNA, 20 bp, Artificial Sequence
  chemically synthesized
aagcaagctgccagttcaag

SEQ ID NO: 3242 - DNA, 20 bp, Artificial Sequence
  chemically synthesized
atgatcctggccccttgaac

SEQ ID NO: 3243 - DNA, 20 bp, Artificial Sequence
  chemically synthesized
aagctgccagttcaaggggc

SEQ ID NO: 3244 - DNA, 20 bp, Artificial Sequence
  chemically synthesized
agctgccagttcaaggggcc

SEQ ID NO: 3245 - DNA, 20 bp, Artificial Sequence
  chemically synthesized
cattgattactgtatgatcc

SEQ ID NO: 3246 - DNA, 20 bp, Artificial Sequence
  chemically synthesized
ttcaaggggccaggatcata

SEQ ID NO: 3247 - DNA, 20 bp, Artificial Sequence
  chemically synthesized
ctccaaagaaattcaaatca

SEQ ID NO: 3248 - DNA, 20 bp, Artificial Sequence
  chemically synthesized
tactgtgatttgaatttctt

SEQ ID NO: 3249 - DNA, 20 bp, Artificial Sequence
  chemically synthesized
ctgtgatttgaatttctttg

SEQ ID NO: 3250 - DNA, 20 bp, Artificial Sequence
  chemically synthesized
attgcagatacagaactcca

SEQ ID NO: 3251 - DNA, 20 bp, Artificial Sequence
  chemically synthesized
cttatggtcaattgcagata

SEQ ID NO: 3252 - DNA, 20 bp, Artificial Sequence
  chemically synthesized
aaggtacttatggtcaattg

SEQ ID NO: 3253 - DNA, 20 bp, Artificial Sequence
  chemically synthesized
ctgtatctgcaattgaccat

SEQ ID NO: 3254 - DNA, 20 bp, Artificial Sequence
  chemically synthesized
ccttgccttcaaggtactta

SEQ ID NO: 3255 - DNA, 20 bp, Artificial Sequence
  chemically synthesized
aattgaccataagtaccttg

SEQ ID NO: 3256 - DNA, 20 bp, Artificial Sequence
  chemically synthesized
attgaccataagtaccttga

SEQ ID NO: 3257 - DNA, 20 bp, Artificial Sequence
  chemically synthesized
accataagtaccttgaaggc

SEQ ID NO: 3258 - DNA, 20 bp, Artificial Sequence
  chemically synthesized
tgacaaattccttgccttca

SEQ ID NO: 3259 - DNA, 20 bp, Artificial Sequence
  chemically synthesized
ccataagtaccttgaaggca

SEQ ID NO: 3260 - DNA, 20 bp, Artificial Sequence
  chemically synthesized
atgacaaattccttgccttc

SEQ ID NO: 3261 - DNA, 20 bp, Artificial Sequence
  chemically synthesized
gaggtagtagggatggaaag

SEQ ID NO: 3262 - DNA, 20 bp, Artificial Sequence
  chemically synthesized
gtggaggtagtagggatgga

SEQ ID NO: 3263 - DNA, 20 bp, Artificial Sequence
  chemically synthesized
accagtggaggtagtaggga

SEQ ID NO: 3264 - DNA, 20 bp, Artificial Sequence
  chemically synthesized
acgtaccagtggaggtagta

SEQ ID NO: 3265 - DNA, 20 bp, Artificial Sequence
  chemically synthesized
tacgtaccagtggaggtagt

SEQ ID NO: 3266 - DNA, 20 bp, Artificial Sequence
  chemically synthesized
ctacgtaccagtggaggtag

SEQ ID NO: 3267 - DNA, 20 bp, Artificial Sequence
  chemically synthesized
tccatccctactacctccac

SEQ ID NO: 3268 - DNA, 20 bp, Artificial Sequence
  chemically synthesized
ctactacgtaccagtggagg

SEQ ID NO: 3269 - DNA, 20 bp, Artificial Sequence
  chemically synthesized
cacctactacgtaccagtgg

SEQ ID NO: 3270 - DNA, 20 bp, Artificial Sequence
  chemically synthesized
gcacctactacgtaccagtg

SEQ ID NO: 3271 - DNA, 20 bp, Artificial Sequence
  chemically synthesized
tagcacctactacgtaccag

SEQ ID NO: 3272 - DNA, 20 bp, Artificial Sequence
  chemically synthesized
ctactacctccactggtacg

SEQ ID NO: 3273 - DNA, 20 bp, Artificial Sequence
  chemically synthesized
tactagcacctactacgtac

SEQ ID NO: 3274 - DNA, 20 bp, Artificial Sequence
  chemically synthesized
ctacctccactggtacgtag

SEQ ID NO: 3275 - DNA, 20 bp, Artificial Sequence
  chemically synthesized
tacctccactggtacgtagt

SEQ ID NO: 3276 - DNA, 20 bp, Artificial Sequence
  chemically synthesized
cactggtacgtagtaggtgc

SEQ ID NO: 3277 - DNA, 20 bp, Artificial Sequence
  chemically synthesized
tacgtagtaggtgctagtaa

SEQ ID NO: 3278 - DNA, 20 bp, Artificial Sequence
  chemically synthesized
tttgtcctgcttgcttttac

SEQ ID NO: 3279 - DNA, 20 bp, Artificial Sequence
  chemically synthesized
tagtaggtgctagtaaaagc

SEQ ID NO: 3280 - DNA, 20 bp, Artificial Sequence
  chemically synthesized
taggtgctagtaaaagcaag

SEQ ID NO: 3281 - DNA, 20 bp, Artificial Sequence
  chemically synthesized
aggtgctagtaaaagcaagc

SEQ ID NO: 3282 - DNA, 20 bp, Artificial Sequence
  chemically synthesized
tagtaaaagcaagcaggaca

SEQ ID NO: 3283 - DNA, 20 bp, Artificial Sequence
  chemically synthesized
agcaagcaggacaaagtaat

SEQ ID NO: 3284 - DNA, 20 bp, Artificial Sequence
  chemically synthesized
gcaagcaggacaaagtaatg

SEQ ID NO: 3285 - DNA, 20 bp, Artificial Sequence
  chemically synthesized
aagcaggacaaagtaatgag

SEQ ID NO: 3286 - DNA, 20 bp, Artificial Sequence
  chemically synthesized
agtaatgaggagacacgtga

SEQ ID NO: 3287 - DNA, 20 bp, Artificial Sequence
  chemically synthesized
tacacaggcttgacagaatc

SEQ ID NO: 3288 - DNA, 20 bp, Artificial Sequence
  chemically synthesized
atacacaggcttgacagaat

SEQ ID NO: 3289 - DNA, 20 bp, Artificial Sequence
  chemically synthesized
tgaaagcacctgattctgtc

SEQ ID NO: 3290 - DNA, 20 bp, Artificial Sequence
  chemically synthesized
aagatcatacacaggcttga

SEQ ID NO: 3291 - DNA, 20 bp, Artificial Sequence
  chemically synthesized
ataatgagaagatcatacac

SEQ ID NO: 3292 - DNA, 20 bp, Artificial Sequence
  chemically synthesized
cataatgagaagatcataca

SEQ ID NO: 3293 - DNA, 20 bp, Artificial Sequence
  chemically synthesized
atgtcataattcataatgag

SEQ ID NO: 3294 - DNA, 20 bp, Artificial Sequence
  chemically synthesized
tagatgtcataattcataat

SEQ ID NO: 3295 - DNA, 20 bp, Artificial Sequence
  chemically synthesized
tcattatgaattatgacatc

SEQ ID NO: 3296 - DNA, 20 bp, Artificial Sequence
  chemically synthesized
ttatgaattatgacatctag

SEQ ID NO: 3297 - DNA, 20 bp, Artificial Sequence
  chemically synthesized
tgaattatgacatctagaag

SEQ ID NO: 3298 - DNA, 20 bp, Artificial Sequence
  chemically synthesized
gaattatgacatctagaaga

SEQ ID NO: 3299 - DNA, 20 bp, Artificial Sequence
  chemically synthesized
attatgacatctagaagaag

SEQ ID NO: 3300 - DNA, 20 bp, Artificial Sequence
  chemically synthesized
tcttaggtatctccttcttc

SEQ ID NO: 3301 - DNA, 20 bp, Artificial Sequence
  chemically synthesized
tctagaagaaggagatacct

SEQ ID NO: 3302 - DNA, 20 bp, Artificial Sequence
  chemically synthesized
gaagaaggagatacctaaga

SEQ ID NO: 3303 - DNA, 20 bp, Artificial Sequence
  chemically synthesized
atccccattctgactatctt

SEQ ID NO: 3304 - DNA, 20 bp, Artificial Sequence
  chemically synthesized
aaggagatacctaagatagt

SEQ ID NO: 3305 - DNA, 20 bp, Artificial Sequence
  chemically synthesized
catccccattctgactatct

SEQ ID NO: 3306 - DNA, 20 bp, Artificial Sequence
  chemically synthesized
gatacctaagatagtcagaa

SEQ ID NO: 3307 - DNA, 20 bp, Artificial Sequence
  chemically synthesized
atacctaagatagtcagaat

SEQ ID NO: 3308 - DNA, 20 bp, Artificial Sequence
  chemically synthesized
tacctaagatagtcagaatg

SEQ ID NO: 3309 - DNA, 20 bp, Artificial Sequence
  chemically synthesized
agatagtcagaatggggatg

SEQ ID NO: 3310 - DNA, 20 bp, Artificial Sequence
  chemically synthesized
gatagtcagaatggggatgc

SEQ ID NO: 3311 - DNA, 20 bp, Artificial Sequence
  chemically synthesized
agtcagaatggggatgcggg

SEQ ID NO: 3312 - DNA, 20 bp, Artificial Sequence
  chemically synthesized
cagaatggggatgcgggtgg

SEQ ID NO: 3313 - DNA, 20 bp, Artificial Sequence
  chemically synthesized
aatggggatgcgggtggcgg

SEQ ID NO: 3314 - DNA, 20 bp, Artificial Sequence
  chemically synthesized
atggggatgcgggtggcggt

SEQ ID NO: 3315 - DNA, 20 bp, Artificial Sequence
  chemically synthesized
tggggatgcgggtggcggtg

SEQ ID NO: 3316 - DNA, 20 bp, Artificial Sequence
  chemically synthesized
ggggatgcgggtggcggtgg

SEQ ID NO: 3317 - DNA, 20 bp, Artificial Sequence
  chemically synthesized
gcgggtggcggtgggggatg

SEQ ID NO: 3318 - DNA, 20 bp, Artificial Sequence
  chemically synthesized
gggtggcggtgggggatgtg

SEQ ID NO: 3319 - DNA, 20 bp, Artificial Sequence
  chemically synthesized
ggtggcggtgggggatgtgg

SEQ ID NO: 3320 - DNA, 20 bp, Artificial Sequence
  chemically synthesized
ggcggtgggggatgtggagg

SEQ ID NO: 3321 - DNA, 20 bp, Artificial Sequence
  chemically synthesized
gcggtgggggatgtggaggt

SEQ ID NO: 3322 - DNA, 20 bp, Artificial Sequence
  chemically synthesized
gtgggggatgtggaggtggg

SEQ ID NO: 3323 - DNA, 20 bp, Artificial Sequence
  chemically synthesized
ggggatgtggaggtgggtgg

SEQ ID NO: 3324 - DNA, 20 bp, Artificial Sequence
  chemically synthesized
atgtggaggtgggtggaaga

SEQ ID NO: 3325 - DNA, 20 bp, Artificial Sequence
  chemically synthesized
gaggtgggtggaagacagat

SEQ ID NO: 3326 - DNA, 20 bp, Artificial Sequence
  chemically synthesized
cactgaagtgatgattttaa

SEQ ID NO: 3327 - DNA, 20 bp, Artificial Sequence
  chemically synthesized
atctgttaaaatcatcactt

SEQ ID NO: 3328 - DNA, 20 bp, Artificial Sequence
  chemically synthesized
tgttaaaatcatcacttcag

SEQ ID NO: 3329 - DNA, 20 bp, Artificial Sequence
  chemically synthesized
ttcactgctgagcgccactg

SEQ ID NO: 3330 - DNA, 20 bp, Artificial Sequence
  chemically synthesized
atcatcacttcagtggcgct

SEQ ID NO: 3331 - DNA, 20 bp, Artificial Sequence
  chemically synthesized
atcacttcagtggcgctcag

SEQ ID NO: 3332 - DNA, 20 bp, Artificial Sequence
  chemically synthesized
ccagccatcttttcactgct

SEQ ID NO: 3333 - DNA, 20 bp, Artificial Sequence
  chemically synthesized
cagtggcgctcagcagtgaa

SEQ ID NO: 3334 - DNA, 20 bp, Artificial Sequence
  chemically synthesized
ggcgctcagcagtgaaaaga

SEQ ID NO: 3335 - DNA, 20 bp, Artificial Sequence
  chemically synthesized
ctcagcagtgaaaagatggc

SEQ ID NO: 3336 - DNA, 20 bp, Artificial Sequence
  chemically synthesized
cagtgaaaagatggctggtg

SEQ ID NO: 3337 - DNA, 20 bp, Artificial Sequence
  chemically synthesized
ctaattttaaatgtctgcac

SEQ ID NO: 3338 - DNA, 20 bp, Artificial Sequence
  chemically synthesized
ctggtgcagacatttaaaat

SEQ ID NO: 3339 - DNA, 20 bp, Artificial Sequence
  chemically synthesized
ttaaaattagcttcccctga

SEQ ID NO: 3340 - DNA, 20 bp, Artificial Sequence
  chemically synthesized
tgctaaggaaccgtcagggg

SEQ ID NO: 3341 - DNA, 20 bp, Artificial Sequence
  chemically synthesized
cgttgctaaggaaccgtcag

SEQ ID NO: 3342 - DNA, 20 bp, Artificial Sequence
  chemically synthesized
gcgttgctaaggaaccgtca

SEQ ID NO: 3343 - DNA, 20 bp, Artificial Sequence
  chemically synthesized
agcgttgctaaggaaccgtc

SEQ ID NO: 3344 - DNA, 20 bp, Artificial Sequence
  chemically synthesized
gagcgttgctaaggaaccgt

SEQ ID NO: 3345 - DNA, 20 bp, Artificial Sequence
  chemically synthesized
agcttcccctgacggttcct

SEQ ID NO: 3346 - DNA, 20 bp, Artificial Sequence
  chemically synthesized
gttctggtagagcgttgcta

SEQ ID NO: 3347 - DNA, 20 bp, Artificial Sequence
  chemically synthesized
tgttctggtagagcgttgct

SEQ ID NO: 3348 - DNA, 20 bp, Artificial Sequence
  chemically synthesized
gttccttagcaacgctctac

SEQ ID NO: 3349 - DNA, 20 bp, Artificial Sequence
  chemically synthesized
aaagcaataatgttctggta

SEQ ID NO: 3350 - DNA, 20 bp, Artificial Sequence
  chemically synthesized
taaaagcaataatgttctgg

SEQ ID NO: 3351 - DNA, 20 bp, Artificial Sequence
  chemically synthesized
cattaaaagcaataatgttc

SEQ ID NO: 3352 - DNA, 20 bp, Artificial Sequence
  chemically synthesized
cgttgtgcagtgcacattaa

SEQ ID NO: 3353 - DNA, 20 bp, Artificial Sequence
  chemically synthesized
atgtgcaagtaaacgttgtg

SEQ ID NO: 3354 - DNA, 20 bp, Artificial Sequence
  chemically synthesized
ttcctagctatttgatgtgc

SEQ ID NO: 3355 - DNA, 20 bp, Artificial Sequence
  chemically synthesized
acgtttacttgcacatcaaa

SEQ ID NO: 3356 - DNA, 20 bp, Artificial Sequence
  chemically synthesized
ttacttgcacatcaaatagc

SEQ ID NO: 3357 - DNA, 20 bp, Artificial Sequence
  chemically synthesized
tacttgcacatcaaatagct

SEQ ID NO: 3358 - DNA, 20 bp, Artificial Sequence
  chemically synthesized
cacatcaaatagctaggaaa

SEQ ID NO: 3359 - DNA, 20 bp, Artificial Sequence
  chemically synthesized
agttaacaatggccatttcc

SEQ ID NO: 3360 - DNA, 20 bp, Artificial Sequence
  chemically synthesized
tgttcagtgtcagttaacaa

SEQ ID NO: 3361 - DNA, 20 bp, Artificial Sequence
  chemically synthesized
cctatctttttgttcagtgt

SEQ ID NO: 3362 - DNA, 20 bp, Artificial Sequence
  chemically synthesized
gttaactgacactgaacaaa

SEQ ID NO: 3363 - DNA, 20 bp, Artificial Sequence
  chemically synthesized
gtttttcctatctttttgtt

SEQ ID NO: 3364 - DNA, 20 bp, Artificial Sequence
  chemically synthesized
actgacactgaacaaaaaga

SEQ ID NO: 3365 - DNA, 20 bp, Artificial Sequence
  chemically synthesized
ctgacactgaacaaaaagat

SEQ ID NO: 3366 - DNA, 20 bp, Artificial Sequence
  chemically synthesized
aatgaggagggtgtattgag

SEQ ID NO: 3367 - DNA, 20 bp, Artificial Sequence
  chemically synthesized
ggcaatgaggagggtgtatt

SEQ ID NO: 3368 - DNA, 20 bp, Artificial Sequence
  chemically synthesized
ctccataagggcaatgagga

SEQ ID NO: 3369 - DNA, 20 bp, Artificial Sequence
  chemically synthesized
tctccataagggcaatgagg

SEQ ID NO: 3370 - DNA, 20 bp, Artificial Sequence
  chemically synthesized
ctctccataagggcaatgag

SEQ ID NO: 3371 - DNA, 20 bp, Artificial Sequence
  chemically synthesized
tcctctccataagggcaatg

SEQ ID NO: 3372 - DNA, 20 bp, Artificial Sequence
  chemically synthesized
ttcctctccataagggcaat

SEQ ID NO: 3373 - DNA, 20 bp, Artificial Sequence
  chemically synthesized
caccctcctcattgccctta

SEQ ID NO: 3374 - DNA, 20 bp, Artificial Sequence
  chemically synthesized
ccctcctcattgcccttatg

SEQ ID NO: 3375 - DNA, 20 bp, Artificial Sequence
  chemically synthesized
ctcctcattgcccttatgga

SEQ ID NO: 3376 - DNA, 20 bp, Artificial Sequence
  chemically synthesized
ctgtttgttcctctccataa

SEQ ID NO: 3377 - DNA, 20 bp, Artificial Sequence
  chemically synthesized
tcctcattgcccttatggag

SEQ ID NO: 3378 - DNA, 20 bp, Artificial Sequence
  chemically synthesized
gctgtttgttcctctccata

SEQ ID NO: 3379 - DNA, 20 bp, Artificial Sequence
  chemically synthesized
ggctgtttgttcctctccat

SEQ ID NO: 3380 - DNA, 20 bp, Artificial Sequence
  chemically synthesized
cccttatggagaggaacaaa

SEQ ID NO: 3381 - DNA, 20 bp, Artificial Sequence
  chemically synthesized
atggagaggaacaaacagcc

SEQ ID NO: 3382 - DNA, 20 bp, Artificial Sequence
  chemically synthesized
ggacgggcagcaggaaatct

SEQ ID NO: 3383 - DNA, 20 bp, Artificial Sequence
  chemically synthesized
gggacgggcagcaggaaatc

SEQ ID NO: 3384 - DNA, 20 bp, Artificial Sequence
  chemically synthesized
gcctgggagggacgggcagc

SEQ ID NO: 3385 - DNA, 20 bp, Artificial Sequence
  chemically synthesized
agcctgggagggacgggcag

SEQ ID NO: 3386 - DNA, 20 bp, Artificial Sequence
  chemically synthesized
ggtagcctgggagggacggg

SEQ ID NO: 3387 - DNA, 20 bp, Artificial Sequence
  chemically synthesized
atgggtagcctgggagggac

SEQ ID NO: 3388 - DNA, 20 bp, Artificial Sequence
  chemically synthesized
ttcctgctgcccgtccctcc

SEQ ID NO: 3389 - DNA, 20 bp, Artificial Sequence
  chemically synthesized
aatgggtagcctgggaggga

SEQ ID NO: 3390 - DNA, 20 bp, Artificial Sequence
  chemically synthesized
tcctgctgcccgtccctccc

SEQ ID NO: 3391 - DNA, 20 bp, Artificial Sequence
  chemically synthesized
ctctaatgggtagcctggga

SEQ ID NO: 3392 - DNA, 20 bp, Artificial Sequence
  chemically synthesized
cctctaatgggtagcctggg

SEQ ID NO: 3393 - DNA, 20 bp, Artificial Sequence
  chemically synthesized
acctctaatgggtagcctgg

SEQ ID NO: 3394 - DNA, 20 bp, Artificial Sequence
  chemically synthesized
gcacctctaatgggtagcct

SEQ ID NO: 3395 - DNA, 20 bp, Artificial Sequence
  chemically synthesized
ggcacctctaatgggtagcc

SEQ ID NO: 3396 - DNA, 20 bp, Artificial Sequence
  chemically synthesized
gtccctcccaggctacccat

SEQ ID NO: 3397 - DNA, 20 bp, Artificial Sequence
  chemically synthesized
ccctcccaggctacccatta

SEQ ID NO: 3398 - DNA, 20 bp, Artificial Sequence
  chemically synthesized
tgattggcacctctaatggg

SEQ ID NO: 3399 - DNA, 20 bp, Artificial Sequence
  chemically synthesized
cctcccaggctacccattag

SEQ ID NO: 3400 - DNA, 20 bp, Artificial Sequence
  chemically synthesized
cagtgattggcacctctaat

SEQ ID NO: 3401 - DNA, 20 bp, Artificial Sequence
  chemically synthesized
ccagtgattggcacctctaa

SEQ ID NO: 3402 - DNA, 20 bp, Artificial Sequence
  chemically synthesized
ccattagaggtgccaatcac

SEQ ID NO: 3403 - DNA, 20 bp, Artificial Sequence
  chemically synthesized
aaggctttgtggccagtgat

SEQ ID NO: 3404 - DNA, 20 bp, Artificial Sequence
  chemically synthesized
ggtgccaatcactggccaca

SEQ ID NO: 3405 - DNA, 20 bp, Artificial Sequence
  chemically synthesized
aaaacacaaggctttgtggc

SEQ ID NO: 3406 - DNA, 20 bp, Artificial Sequence
  chemically synthesized
ggagaaaacacaaggctttg

SEQ ID NO: 3407 - DNA, 20 bp, Artificial Sequence
  chemically synthesized
aacaaaagggagaaaacaca

SEQ ID NO: 3408 - DNA, 20 bp, Artificial Sequence
  chemically synthesized
aaacaaaagggagaaaacac

SEQ ID NO: 3409 - DNA, 20 bp, Artificial Sequence
  chemically synthesized
aagcctagagaaacaaaagg

SEQ ID NO: 3410 - DNA, 20 bp, Artificial Sequence
  chemically synthesized
aaaagcctagagaaacaaaa

SEQ ID NO: 3411 - DNA, 20 bp, Artificial Sequence
  chemically synthesized
gaaaagcctagagaaacaaa

SEQ ID NO: 3412 - DNA, 20 bp, Artificial Sequence
  chemically synthesized
agaaaagcctagagaaacaa

SEQ ID NO: 3413 - DNA, 20 bp, Artificial Sequence
  chemically synthesized
ttttctcccttttgtttctc

SEQ ID NO: 3414 - DNA, 20 bp, Artificial Sequence
  chemically synthesized
tttctcccttttgtttctct

SEQ ID NO: 3415 - DNA, 20 bp, Artificial Sequence
  chemically synthesized
tcaaatagaagaaaagccta

SEQ ID NO: 3416 - DNA, 20 bp, Artificial Sequence
  chemically synthesized
gatcaaatagaagaaaagcc

SEQ ID NO: 3417 - DNA, 20 bp, Artificial Sequence
  chemically synthesized
cctgtgatcaaatagaagaa

SEQ ID NO: 3418 - DNA, 20 bp, Artificial Sequence
  chemically synthesized
agtcacctgtgatcaaatag

SEQ ID NO: 3419 - DNA, 20 bp, Artificial Sequence
  chemically synthesized
ggcagtcacctgtgatcaaa

SEQ ID NO: 3420 - DNA, 20 bp, Artificial Sequence
  chemically synthesized
gcttttcttctatttgatca

SEQ ID NO: 3421 - DNA, 20 bp, Artificial Sequence
  chemically synthesized
cttttcttctatttgatcac

SEQ ID NO: 3422 - DNA, 20 bp, Artificial Sequence
  chemically synthesized
acgaataaaaaggatggtgg

SEQ ID NO: 3423 - DNA, 20 bp, Artificial Sequence
  chemically synthesized
tcaacgaataaaaaggatgg

SEQ ID NO: 3424 - DNA, 20 bp, Artificial Sequence
  chemically synthesized
ccttcaacgaataaaaagga

SEQ ID NO: 3425 - DNA, 20 bp, Artificial Sequence
  chemically synthesized
ccttccttcaacgaataaaa

SEQ ID NO: 3426 - DNA, 20 bp, Artificial Sequence
  chemically synthesized
gccttccttcaacgaataaa

SEQ ID NO: 3427 - DNA, 20 bp, Artificial Sequence
  chemically synthesized
accatcctttttattcgttg

SEQ ID NO: 3428 - DNA, 20 bp, Artificial Sequence
  chemically synthesized
ccatcctttttattcgttga

SEQ ID NO: 3429 - DNA, 20 bp, Artificial Sequence
  chemically synthesized
tcctttttattcgttgaagg

SEQ ID NO: 3430 - DNA, 20 bp, Artificial Sequence
  chemically synthesized
cctttttattcgttgaagga

SEQ ID NO: 3431 - DNA, 20 bp, Artificial Sequence
  chemically synthesized
tttattcgttgaaggaaggc

SEQ ID NO: 3432 - DNA, 20 bp, Artificial Sequence
  chemically synthesized
tattcgttgaaggaaggcga

SEQ ID NO: 3433 - DNA, 20 bp, Artificial Sequence
  chemically synthesized
ttcgttgaaggaaggcgaga

SEQ ID NO: 3434 - DNA, 20 bp, Artificial Sequence
  chemically synthesized
tattgccctcacataaaaca

SEQ ID NO: 3435 - DNA, 20 bp, Artificial Sequence
  chemically synthesized
agagtgactttgttttatgt

SEQ ID NO: 3436 - DNA, 20 bp, Artificial Sequence
  chemically synthesized
gagtgactttgttttatgtg

SEQ ID NO: 3437 - DNA, 20 bp, Artificial Sequence
  chemically synthesized
agtgactttgttttatgtga

SEQ ID NO: 3438 - DNA, 20 bp, Artificial Sequence
  chemically synthesized
cgtttctgggggcatttatt

SEQ ID NO: 3439 - DNA, 20 bp, Artificial Sequence
  chemically synthesized
ataaaccaaataaatgcccc

SEQ ID NO: 3440 - DNA, 20 bp, Artificial Sequence
  chemically synthesized
ctgctactgttcgtttctgg

SEQ ID NO: 3441 - DNA, 20 bp, Artificial Sequence
  chemically synthesized
gctgctactgttcgtttctg

SEQ ID NO: 3442 - DNA, 20 bp, Artificial Sequence
  chemically synthesized
tgctgctactgttcgtttct

SEQ ID NO: 3443 - DNA, 20 bp, Artificial Sequence
  chemically synthesized
ttgctgctactgttcgtttc

SEQ ID NO: 3444 - DNA, 20 bp, Artificial Sequence
  chemically synthesized
taaatgcccccagaaacgaa

SEQ ID NO: 3445 - DNA, 20 bp, Artificial Sequence
  chemically synthesized
atgcccccagaaacgaacag

SEQ ID NO: 3446 - DNA, 20 bp, Artificial Sequence
  chemically synthesized
cccccagaaacgaacagtag

SEQ ID NO: 3447 - DNA, 20 bp, Artificial Sequence
  chemically synthesized
gtagcagcaaaacatcatct

SEQ ID NO: 3448 - DNA, 20 bp, Artificial Sequence
  chemically synthesized
gcaaaacatcatcttggatg

SEQ ID NO: 3449 - DNA, 20 bp, Artificial Sequence
  chemically synthesized
tcagatgtcttgcttcatcc

SEQ ID NO: 3450 - DNA, 20 bp, Artificial Sequence
  chemically synthesized
aacatcatcttggatgaagc

SEQ ID NO: 3451 - DNA, 20 bp, Artificial Sequence
  chemically synthesized
tggatgaagcaagacatctg

SEQ ID NO: 3452 - DNA, 20 bp, Artificial Sequence
  chemically synthesized
ccactggcttgcatgagctt

SEQ ID NO: 3453 - DNA, 20 bp, Artificial Sequence
  chemically synthesized
aagacatctgaagctcatgc

SEQ ID NO: 3454 - DNA, 20 bp, Artificial Sequence
  chemically synthesized
attttcccactggcttgcat

SEQ ID NO: 3455 - DNA, 20 bp, Artificial Sequence
  chemically synthesized
catctgaagctcatgcaagc

SEQ ID NO: 3456 - DNA, 20 bp, Artificial Sequence
  chemically synthesized
ctgaagctcatgcaagccag

SEQ ID NO: 3457 - DNA, 20 bp, Artificial Sequence
  chemically synthesized
tgaagctcatgcaagccagt

SEQ ID NO: 3458 - DNA, 20 bp, Artificial Sequence
  chemically synthesized
accctgcagaattttcccac

SEQ ID NO: 3459 - DNA, 20 bp, Artificial Sequence
  chemically synthesized
aagccagtgggaaaattctg

SEQ ID NO: 3460 - DNA, 20 bp, Artificial Sequence
  chemically synthesized
agccagtgggaaaattctgc

SEQ ID NO: 3461 - DNA, 20 bp, Artificial Sequence
  chemically synthesized
gccagtgggaaaattctgca

SEQ ID NO: 3462 - DNA, 20 bp, Artificial Sequence
  chemically synthesized
aaaaacagcattttaccctg

SEQ ID NO: 3463 - DNA, 20 bp, Artificial Sequence
  chemically synthesized
attttacccccatacaaaaa

SEQ ID NO: 3464 - DNA, 20 bp, Artificial Sequence
  chemically synthesized
ggtaaaatgctgtttttgta

SEQ ID NO: 3465 - DNA, 20 bp, Artificial Sequence
  chemically synthesized
gtaaaatgctgtttttgtat

SEQ ID NO: 3466 - DNA, 20 bp, Artificial Sequence
  chemically synthesized
taaaatgctgtttttgtatg

SEQ ID NO: 3467 - DNA, 20 bp, Artificial Sequence
  chemically synthesized
aaaatgctgtttttgtatgg

SEQ ID NO: 3468 - DNA, 20 bp, Artificial Sequence
  chemically synthesized
tgtatgggggtaaaatacgc

SEQ ID NO: 3469 - DNA, 20 bp, Artificial Sequence
  chemically synthesized
gtatgggggtaaaatacgca

SEQ ID NO: 3470 - DNA, 20 bp, Artificial Sequence
  chemically synthesized
gggtaaaatacgcaaggcca

SEQ ID NO: 3471 - DNA, 20 bp, Artificial Sequence
  chemically synthesized
tttctttttcttcatcactt

SEQ ID NO: 3472 - DNA, 20 bp, Artificial Sequence
  chemically synthesized
tacgcaaggccaaagtgatg

SEQ ID NO: 3473 - DNA, 20 bp, Artificial Sequence
  chemically synthesized
aggccaaagtgatgaagaaa

SEQ ID NO: 3474 - DNA, 20 bp, Artificial Sequence
  chemically synthesized
aaatacaggcttagcaaaga

SEQ ID NO: 3475 - DNA, 20 bp, Artificial Sequence
  chemically synthesized
tattaatgtctttctttgct

SEQ ID NO: 3476 - DNA, 20 bp, Artificial Sequence
  chemically synthesized
gaggaaatacaggcttagca

SEQ ID NO: 3477 - DNA, 20 bp, Artificial Sequence
  chemically synthesized
cgatagaggaaatacaggct

SEQ ID NO: 3478 - DNA, 20 bp, Artificial Sequence
  chemically synthesized
tacttcgatagaggaaatac

SEQ ID NO: 3479 - DNA, 20 bp, Artificial Sequence
  chemically synthesized
ttacttcgatagaggaaata

SEQ ID NO: 3480 - DNA, 20 bp, Artificial Sequence
  chemically synthesized
agcctgtatttcctctatcg

SEQ ID NO: 3481 - DNA, 20 bp, Artificial Sequence
  chemically synthesized
gttattttttacttcgatag

SEQ ID NO: 3482 - DNA, 20 bp, Artificial Sequence
  chemically synthesized
ggttattttttacttcgata

SEQ ID NO: 3483 - DNA, 20 bp, Artificial Sequence
  chemically synthesized
ttggttattttttacttcga

SEQ ID NO: 3484 - DNA, 20 bp, Artificial Sequence
  chemically synthesized
ttaaatcttcatagagtagt

SEQ ID NO: 3485 - DNA, 20 bp, Artificial Sequence
  chemically synthesized
aaataaccaactactctatg

SEQ ID NO: 3486 - DNA, 20 bp, Artificial Sequence
  chemically synthesized
acaattaaatcttcatagag

SEQ ID NO: 3487 - DNA, 20 bp, Artificial Sequence
  chemically synthesized
gggacaattaaatcttcata

SEQ ID NO: 3488 - DNA, 20 bp, Artificial Sequence
  chemically synthesized
tagggacaattaaatcttca

SEQ ID NO: 3489 - DNA, 20 bp, Artificial Sequence
  chemically synthesized
tactccatcatttaaatata

SEQ ID NO: 3490 - DNA, 20 bp, Artificial Sequence
  chemically synthesized
ttactccatcatttaaatat

SEQ ID NO: 3491 - DNA, 20 bp, Artificial Sequence
  chemically synthesized
cttactccatcatttaaata

SEQ ID NO: 3492 - DNA, 20 bp, Artificial Sequence
  chemically synthesized
ttgtccctatatttaaatga

SEQ ID NO: 3493 - DNA, 20 bp, Artificial Sequence
  chemically synthesized
gtccctatatttaaatgatg

SEQ ID NO: 3494 - DNA, 20 bp, Artificial Sequence
  chemically synthesized
ctatatttaaatgatggagt

SEQ ID NO: 3495 - DNA, 20 bp, Artificial Sequence
  chemically synthesized
agatacaatttttaaatata

SEQ ID NO: 3496 - DNA, 20 bp, Artificial Sequence
  chemically synthesized
gatacaatttttaaatataa

SEQ ID NO: 3497 - DNA, 20 bp, Artificial Sequence
  chemically synthesized
atacaatttttaaatataaa

SEQ ID NO: 3498 - DNA, 20 bp, Artificial Sequence
  chemically synthesized
tttttaaatataaagggcat

SEQ ID NO: 3499 - DNA, 20 bp, Artificial Sequence
  chemically synthesized
taaatataaagggcatcaga

SEQ ID NO: 3500 - DNA, 20 bp, Artificial Sequence
  chemically synthesized
tataaagggcatcagatggc

SEQ ID NO: 3501 - DNA, 20 bp, Artificial Sequence
  chemically synthesized
aagggcatcagatggcaagt

SEQ ID NO: 3502 - DNA, 20 bp, Artificial Sequence
  chemically synthesized
cctactgattggtagtggta

SEQ ID NO: 3503 - DNA, 20 bp, Artificial Sequence
  chemically synthesized
tgcctactgattggtagtgg

SEQ ID NO: 3504 - DNA, 20 bp, Artificial Sequence
  chemically synthesized
caatgcctactgattggtag

SEQ ID NO: 3505 - DNA, 20 bp, Artificial Sequence
  chemically synthesized
gaatctctaccactaccaat

SEQ ID NO: 3506 - DNA, 20 bp, Artificial Sequence
  chemically synthesized
gaacaatgcctactgattgg

SEQ ID NO: 3507 - DNA, 20 bp, Artificial Sequence
  chemically synthesized
tctctaccactaccaatcag

SEQ ID NO: 3508 - DNA, 20 bp, Artificial Sequence
  chemically synthesized
ctctaccactaccaatcagt

SEQ ID NO: 3509 - DNA, 20 bp, Artificial Sequence
  chemically synthesized
ctagaacaatgcctactgat

SEQ ID NO: 3510 - DNA, 20 bp, Artificial Sequence
  chemically synthesized
ccaatcagtaggcattgttc

SEQ ID NO: 3511 - DNA, 20 bp, Artificial Sequence
  chemically synthesized
caatcagtaggcattgttct

SEQ ID NO: 3512 - DNA, 20 bp, Artificial Sequence
  chemically synthesized
ctacgtgctacagcaaggcc

SEQ ID NO: 3513 - DNA, 20 bp, Artificial Sequence
  chemically synthesized
cattgttctaggccttgctg

SEQ ID NO: 3514 - DNA, 20 bp, Artificial Sequence
  chemically synthesized
ggctactacgtgctacagca

SEQ ID NO: 3515 - DNA, 20 bp, Artificial Sequence
  chemically synthesized
tggctactacgtgctacagc

SEQ ID NO: 3516 - DNA, 20 bp, Artificial Sequence
  chemically synthesized
ctaggccttgctgtagcacg

SEQ ID NO: 3517 - DNA, 20 bp, Artificial Sequence
  chemically synthesized
catatggctactacgtgcta

SEQ ID NO: 3518 - DNA, 20 bp, Artificial Sequence
  chemically synthesized
ggccttgctgtagcacgtag

SEQ ID NO: 3519 - DNA, 20 bp, Artificial Sequence
  chemically synthesized
gtgcctttgccagggacata

SEQ ID NO: 3520 - DNA, 20 bp, Artificial Sequence
  chemically synthesized
acgtagtagccatatgtccc

SEQ ID NO: 3521 - DNA, 20 bp, Artificial Sequence
  chemically synthesized
gtagccatatgtccctggca

SEQ ID NO: 3522 - DNA, 20 bp, Artificial Sequence
  chemically synthesized
tagccatatgtccctggcaa

SEQ ID NO: 3523 - DNA, 20 bp, Artificial Sequence
  chemically synthesized
ccctgatagtgcctttgcca

SEQ ID NO: 3524 - DNA, 20 bp, Artificial Sequence
  chemically synthesized
gccctgatagtgcctttgcc

SEQ ID NO: 3525 - DNA, 20 bp, Artificial Sequence
  chemically synthesized
tgccctgatagtgcctttgc

SEQ ID NO: 3526 - DNA, 20 bp, Artificial Sequence
  chemically synthesized
gtccctggcaaaggcactat

SEQ ID NO: 3527 - DNA, 20 bp, Artificial Sequence
  chemically synthesized
tccctggcaaaggcactatc

SEQ ID NO: 3528 - DNA, 20 bp, Artificial Sequence
  chemically synthesized
ccctggcaaaggcactatca

SEQ ID NO: 3529 - DNA, 20 bp, Artificial Sequence
  chemically synthesized
tgaggaaattaatgccctga

SEQ ID NO: 3530 - DNA, 20 bp, Artificial Sequence
  chemically synthesized
ttatgtgacttttacagatg

SEQ ID NO: 3531 - DNA, 20 bp, Artificial Sequence
  chemically synthesized
attatgtgacttttacagat

SEQ ID NO: 3532 - DNA, 20 bp, Artificial Sequence
  chemically synthesized
attaatttcctcatctgtaa

SEQ ID NO: 3533 - DNA, 20 bp, Artificial Sequence
  chemically synthesized
caattattatgtgactttta

SEQ ID NO: 3534 - DNA, 20 bp, Artificial Sequence
  chemically synthesized
gtcacataataattgctctt

SEQ ID NO: 3535 - DNA, 20 bp, Artificial Sequence
  chemically synthesized
ataataattgctcttcagta

SEQ ID NO: 3536 - DNA, 20 bp, Artificial Sequence
  chemically synthesized
atgaggtgccctttactgaa

SEQ ID NO: 3537 - DNA, 20 bp, Artificial Sequence
  chemically synthesized
taataattgctcttcagtaa

SEQ ID NO: 3538 - DNA, 20 bp, Artificial Sequence
  chemically synthesized
aataattgctcttcagtaaa

SEQ ID NO: 3539 - DNA, 20 bp, Artificial Sequence
  chemically synthesized
ttatgaggtgccctttactg

SEQ ID NO: 3540 - DNA, 20 bp, Artificial Sequence
  chemically synthesized
agtctgaagagttaattatg

SEQ ID NO: 3541 - DNA, 20 bp, Artificial Sequence
  chemically synthesized
tagtctgaagagttaattat

SEQ ID NO: 3542 - DNA, 20 bp, Artificial Sequence
  chemically synthesized
gcacctcataattaactctt

SEQ ID NO: 3543 - DNA, 20 bp, Artificial Sequence
  chemically synthesized
gcttcacacattagtctgaa

SEQ ID NO: 3544 - DNA, 20 bp, Artificial Sequence
  chemically synthesized
ttgcttcacacattagtctg

SEQ ID NO: 3545 - DNA, 20 bp, Artificial Sequence
  chemically synthesized
actcttcagactaatgtgtg

SEQ ID NO: 3546 - DNA, 20 bp, Artificial Sequence
  chemically synthesized
attttacttgcttcacacat

SEQ ID NO: 3547 - DNA, 20 bp, Artificial Sequence
  chemically synthesized
ttcagactaatgtgtgaagc

SEQ ID NO: 3548 - DNA, 20 bp, Artificial Sequence
  chemically synthesized
caagtaaaatacttgacaaa

SEQ ID NO: 3549 - DNA, 20 bp, Artificial Sequence
  chemically synthesized
aataccaccctctatttgtc

SEQ ID NO: 3550 - DNA, 20 bp, Artificial Sequence
  chemically synthesized
agtaaaatacttgacaaata

SEQ ID NO: 3551 - DNA, 20 bp, Artificial Sequence
  chemically synthesized
gtaaaatacttgacaaatag

SEQ ID NO: 3552 - DNA, 20 bp, Artificial Sequence
  chemically synthesized
taaaatacttgacaaataga

SEQ ID NO: 3553 - DNA, 20 bp, Artificial Sequence
  chemically synthesized
aatacttgacaaatagaggg

SEQ ID NO: 3554 - DNA, 20 bp, Artificial Sequence
  chemically synthesized
gagggtggtattcttatttt

SEQ ID NO: 3555 - DNA, 20 bp, Artificial Sequence
  chemically synthesized
ggcaacatgtttccaaaaat

SEQ ID NO: 3556 - DNA, 20 bp, Artificial Sequence
  chemically synthesized
ttggaaacatgttgccctca

SEQ ID NO: 3557 - DNA, 20 bp, Artificial Sequence
  chemically synthesized
tggaaacatgttgccctcac

SEQ ID NO: 3558 - DNA, 20 bp, Artificial Sequence
  chemically synthesized
ctgaattcaaatacccgtga

SEQ ID NO: 3559 - DNA, 20 bp, Artificial Sequence
  chemically synthesized
tctgaattcaaatacccgtg

SEQ ID NO: 3560 - DNA, 20 bp, Artificial Sequence
  chemically synthesized
ctctgaattcaaatacccgt

SEQ ID NO: 3561 - DNA, 20 bp, Artificial Sequence
  chemically synthesized
ccctcacgggtatttgaatt

SEQ ID NO: 3562 - DNA, 20 bp, Artificial Sequence
  chemically synthesized
ctcacgggtatttgaattca

SEQ ID NO: 3563 - DNA, 20 bp, Artificial Sequence
  chemically synthesized
aagtgtgaatttgtggttta

SEQ ID NO: 3564 - DNA, 20 bp, Artificial Sequence
  chemically synthesized
ttaagtgtgaatttgtggtt

SEQ ID NO: 3565 - DNA, 20 bp, Artificial Sequence
  chemically synthesized
gatttttaagtgtgaatttg

SEQ ID NO: 3566 - DNA, 20 bp, Artificial Sequence
  chemically synthesized
ggtgaaaagatttgattttt

SEQ ID NO: 3567 - DNA, 20 bp, Artificial Sequence
  chemically synthesized
aaaatcaaatcttttcacca

SEQ ID NO: 3568 - DNA, 20 bp, Artificial Sequence
  chemically synthesized
caatttgggtccatggtgaa

SEQ ID NO: 3569 - DNA, 20 bp, Artificial Sequence
  chemically synthesized
agaatggcaatttgggtcca

SEQ ID NO: 3570 - DNA, 20 bp, Artificial Sequence
  chemically synthesized
cagtatcagaatggcaattt

SEQ ID NO: 3571 - DNA, 20 bp, Artificial Sequence
  chemically synthesized
gcagtatcagaatggcaatt

SEQ ID NO: 3572 - DNA, 20 bp, Artificial Sequence
  chemically synthesized
gccaacacgcagtatcagaa

SEQ ID NO: 3573 - DNA, 20 bp, Artificial Sequence
  chemically synthesized
tggaagccaacacgcagtat

SEQ ID NO: 3574 - DNA, 20 bp, Artificial Sequence
  chemically synthesized
gccattctgatactgcgtgt

SEQ ID NO: 3575 - DNA, 20 bp, Artificial Sequence
  chemically synthesized
tccatatggaagccaacacg

SEQ ID NO: 3576 - DNA, 20 bp, Artificial Sequence
  chemically synthesized
actgcgtgttggcttccata

SEQ ID NO: 3577 - DNA, 20 bp, Artificial Sequence
  chemically synthesized
tgtgtgtattttccatatgg

SEQ ID NO: 3578 - DNA, 20 bp, Artificial Sequence
  chemically synthesized
tggtgtgtgtattttccata

SEQ ID NO: 3579 - DNA, 20 bp, Artificial Sequence
  chemically synthesized
catatggaaaatacacacac

SEQ ID NO: 3580 - DNA, 20 bp, Artificial Sequence
  chemically synthesized
tggaaaatacacacaccagt

SEQ ID NO: 3581 - DNA, 20 bp, Artificial Sequence
  chemically synthesized
ggaaaatacacacaccagtt

SEQ ID NO: 3582 - DNA, 20 bp, Artificial Sequence
  chemically synthesized
aaatacacacaccagttggg

SEQ ID NO: 3583 - DNA, 20 bp, Artificial Sequence
  chemically synthesized
aatacacacaccagttgggt

SEQ ID NO: 3584 - DNA, 20 bp, Artificial Sequence
  chemically synthesized
cactcgcttccctacccaac

SEQ ID NO: 3585 - DNA, 20 bp, Artificial Sequence
  chemically synthesized
atacacacaccagttgggta

SEQ ID NO: 3586 - DNA, 20 bp, Artificial Sequence
  chemically synthesized
cacacaccagttgggtaggg

SEQ ID NO: 3587 - DNA, 20 bp, Artificial Sequence
  chemically synthesized
caccagttgggtagggaagc

SEQ ID NO: 3588 - DNA, 20 bp, Artificial Sequence
  chemically synthesized
cagttgggtagggaagcgag

SEQ ID NO: 3589 - DNA, 20 bp, Artificial Sequence
  chemically synthesized
ggaagcgagtggcctgatcc

SEQ ID NO: 3590 - DNA, 20 bp, Artificial Sequence
  chemically synthesized
gactcagatttgctgggatc

SEQ ID NO: 3591 - DNA, 20 bp, Artificial Sequence
  chemically synthesized
ggactcagatttgctgggat

SEQ ID NO: 3592 - DNA, 20 bp, Artificial Sequence
  chemically synthesized
agaagggactcagatttgct

SEQ ID NO: 3593 - DNA, 20 bp, Artificial Sequence
  chemically synthesized
tagaagggactcagatttgc

SEQ ID NO: 3594 - DNA, 20 bp, Artificial Sequence
  chemically synthesized
ggcctgatcccagcaaatct

SEQ ID NO: 3595 - DNA, 20 bp, Artificial Sequence
  chemically synthesized
tccaatacctagaagggact

SEQ ID NO: 3596 - DNA, 20 bp, Artificial Sequence
  chemically synthesized
cagcaaatctgagtcccttc

SEQ ID NO: 3597 - DNA, 20 bp, Artificial Sequence
  chemically synthesized
agcaaatctgagtcccttct

SEQ ID NO: 3598 - DNA, 20 bp, Artificial Sequence
  chemically synthesized
gtaagctccaatacctagaa

SEQ ID NO: 3599 - DNA, 20 bp, Artificial Sequence
  chemically synthesized
ggtaagctccaatacctaga

SEQ ID NO: 3600 - DNA, 20 bp, Artificial Sequence
  chemically synthesized
aggtaagctccaatacctag

SEQ ID NO: 3601 - DNA, 20 bp, Artificial Sequence
  chemically synthesized
tctgagtcccttctaggtat

SEQ ID NO: 3602 - DNA, 20 bp, Artificial Sequence
  chemically synthesized
tgagtcccttctaggtattg

SEQ ID NO: 3603 - DNA, 20 bp, Artificial Sequence
  chemically synthesized
aagaggtaagctccaatacc

SEQ ID NO: 3604 - DNA, 20 bp, Artificial Sequence
  chemically synthesized
ccttccctagttcaagaggt

SEQ ID NO: 3605 - DNA, 20 bp, Artificial Sequence
  chemically synthesized
ttggagcttacctcttgaac

SEQ ID NO: 3606 - DNA, 20 bp, Artificial Sequence
  chemically synthesized
aactccttccctagttcaag

SEQ ID NO: 3607 - DNA, 20 bp, Artificial Sequence
  chemically synthesized
tggagcttacctcttgaact

SEQ ID NO: 3608 - DNA, 20 bp, Artificial Sequence
  chemically synthesized
caactccttccctagttcaa

SEQ ID NO: 3609 - DNA, 20 bp, Artificial Sequence
  chemically synthesized
ggagcttacctcttgaacta

SEQ ID NO: 3610 - DNA, 20 bp, Artificial Sequence
  chemically synthesized
aacaactccttccctagttc

SEQ ID NO: 3611 - DNA, 20 bp, Artificial Sequence
  chemically synthesized
gcttacctcttgaactaggg

SEQ ID NO: 3612 - DNA, 20 bp, Artificial Sequence
  chemically synthesized
cttacctcttgaactaggga

SEQ ID NO: 3613 - DNA, 20 bp, Artificial Sequence
  chemically synthesized
tacctcttgaactagggaag

SEQ ID NO: 3614 - DNA, 20 bp, Artificial Sequence
  chemically synthesized
caactcaacaactccttccc

SEQ ID NO: 3615 - DNA, 20 bp, Artificial Sequence
  chemically synthesized
gaactagggaaggagttgtt

SEQ ID NO: 3616 - DNA, 20 bp, Artificial Sequence
  chemically synthesized
cagggttagaggaggtgatg

SEQ ID NO: 3617 - DNA, 20 bp, Artificial Sequence
  chemically synthesized
cacagggttagaggaggtga

SEQ ID NO: 3618 - DNA, 20 bp, Artificial Sequence
  chemically synthesized
cacaagcacagggttagagg

SEQ ID NO: 3619 - DNA, 20 bp, Artificial Sequence
  chemically synthesized
acacaagcacagggttagag

SEQ ID NO: 3620 - DNA, 20 bp, Artificial Sequence
  chemically synthesized
ggacacaagcacagggttag

SEQ ID NO: 3621 - DNA, 20 bp, Artificial Sequence
  chemically synthesized
aggacacaagcacagggtta

SEQ ID NO: 3622 - DNA, 20 bp, Artificial Sequence
  chemically synthesized
ccaggacacaagcacagggt

SEQ ID NO: 3623 - DNA, 20 bp, Artificial Sequence
  chemically synthesized
ctccccaggacacaagcaca

SEQ ID NO: 3624 - DNA, 20 bp, Artificial Sequence
  chemically synthesized
cctccccaggacacaagcac

SEQ ID NO: 3625 - DNA, 20 bp, Artificial Sequence
  chemically synthesized
tcctccccaggacacaagca

SEQ ID NO: 3626 - DNA, 20 bp, Artificial Sequence
  chemically synthesized
ctaaccctgtgcttgtgtcc

SEQ ID NO: 3627 - DNA, 20 bp, Artificial Sequence
  chemically synthesized
taaccctgtgcttgtgtcct

SEQ ID NO: 3628 - DNA, 20 bp, Artificial Sequence
  chemically synthesized
ctcagtcctccccaggacac

SEQ ID NO: 3629 - DNA, 20 bp, Artificial Sequence
  chemically synthesized
aaccctgtgcttgtgtcctg

SEQ ID NO: 3630 - DNA, 20 bp, Artificial Sequence
  chemically synthesized
ccctgtgcttgtgtcctggg

SEQ ID NO: 3631 - DNA, 20 bp, Artificial Sequence
  chemically synthesized
cctgtgcttgtgtcctgggg

SEQ ID NO: 3632 - DNA, 20 bp, Artificial Sequence
  chemically synthesized
agatcttctcagtcctcccc

SEQ ID NO: 3633 - DNA, 20 bp, Artificial Sequence
  chemically synthesized
aagatcttctcagtcctccc

SEQ ID NO: 3634 - DNA, 20 bp, Artificial Sequence
  chemically synthesized
cttgtgtcctggggaggact

SEQ ID NO: 3635 - DNA, 20 bp, Artificial Sequence
  chemically synthesized
gtgtcctggggaggactgag

SEQ ID NO: 3636 - DNA, 20 bp, Artificial Sequence
  chemically synthesized
taaggtgaggaagatcttct

SEQ ID NO: 3637 - DNA, 20 bp, Artificial Sequence
  chemically synthesized
ttgcttttattaaggtgagg

SEQ ID NO: 3638 - DNA, 20 bp, Artificial Sequence
  chemically synthesized
tttttgcttttattaaggtg

SEQ ID NO: 3639 - DNA, 20 bp, Artificial Sequence
  chemically synthesized
gtttttgcttttattaaggt

SEQ ID NO: 3640 - DNA, 20 bp, Artificial Sequence
  chemically synthesized
gatcttcctcaccttaataa

SEQ ID NO: 3641 - DNA, 20 bp, Artificial Sequence
  chemically synthesized
atttgtttttgcttttatta

SEQ ID NO: 3642 - DNA, 20 bp, Artificial Sequence
  chemically synthesized
tatttgtttttgcttttatt

SEQ ID NO: 3643 - DNA, 20 bp, Artificial Sequence
  chemically synthesized
ataaaagcaaaaacaaataa

SEQ ID NO: 3644 - DNA, 20 bp, Artificial Sequence
  chemically synthesized
ataatggaaaattacattta

SEQ ID NO: 3645 - DNA, 20 bp, Artificial Sequence
  chemically synthesized
aaaattacatttatagaaaa

SEQ ID NO: 3646 - DNA, 20 bp, Artificial Sequence
  chemically synthesized
tttatagaaaacagatatta

SEQ ID NO: 3647 - DNA, 20 bp, Artificial Sequence
  chemically synthesized
ttatagaaaacagatattaa

SEQ ID NO: 3648 - DNA, 20 bp, Artificial Sequence
  chemically synthesized
tatagaaaacagatattaaa

SEQ ID NO: 3649 - DNA, 20 bp, Artificial Sequence
  chemically synthesized
tggtgttaaaaatgtaatca

SEQ ID NO: 3650 - DNA, 20 bp, Artificial Sequence
  chemically synthesized
caagtgaaatgaatttataa

SEQ ID NO: 3651 - DNA, 20 bp, Artificial Sequence
  chemically synthesized
tttctttgttatttatgagc

SEQ ID NO: 3652 - DNA, 20 bp, Artificial Sequence
  chemically synthesized
gggttttctttgttatttat

SEQ ID NO: 3653 - DNA, 20 bp, Artificial Sequence
  chemically synthesized
tcacttgctcataaataaca

SEQ ID NO: 3654 - DNA, 20 bp, Artificial Sequence
  chemically synthesized
aaataacaaagaaaaccctc

SEQ ID NO: 3655 - DNA, 20 bp, Artificial Sequence
  chemically synthesized
ttcctcattattaagcttga

SEQ ID NO: 3656 - DNA, 20 bp, Artificial Sequence
  chemically synthesized
cttcctcattattaagcttg

SEQ ID NO: 3657 - DNA, 20 bp, Artificial Sequence
  chemically synthesized
acttcctcattattaagctt

SEQ ID NO: 3658 - DNA, 20 bp, Artificial Sequence
  chemically synthesized
aaaccctcaagcttaataat

SEQ ID NO: 3659 - DNA, 20 bp, Artificial Sequence
  chemically synthesized
aaccctcaagcttaataatg

SEQ ID NO: 3660 - DNA, 20 bp, Artificial Sequence
  chemically synthesized
agaattacttcctcattatt

SEQ ID NO: 3661 - DNA, 20 bp, Artificial Sequence
  chemically synthesized
cctcaagcttaataatgagg

SEQ ID NO: 3662 - DNA, 20 bp, Artificial Sequence
  chemically synthesized
aatgaggaagtaattcttta

SEQ ID NO: 3663 - DNA, 20 bp, Artificial Sequence
  chemically synthesized
atgaggaagtaattctttaa

SEQ ID NO: 3664 - DNA, 20 bp, Artificial Sequence
  chemically synthesized
tgaggaagtaattctttaaa

SEQ ID NO: 3665 - DNA, 20 bp, Artificial Sequence
  chemically synthesized
ggaagtaattctttaaaggg

SEQ ID NO: 3666 - DNA, 20 bp, Artificial Sequence
  chemically synthesized
tggatttcttcttcccttta

SEQ ID NO: 3667 - DNA, 20 bp, Artificial Sequence
  chemically synthesized
agtaattctttaaagggaag

SEQ ID NO: 3668 - DNA, 20 bp, Artificial Sequence
  chemically synthesized
aagggaagaagaaatccata

SEQ ID NO: 3669 - DNA, 20 bp, Artificial Sequence
  chemically synthesized
ggaagaagaaatccatacag

SEQ ID NO: 3670 - DNA, 20 bp, Artificial Sequence
  chemically synthesized
gatatagataaactactgta

SEQ ID NO: 3671 - DNA, 20 bp, Artificial Sequence
  chemically synthesized
tttctccaagggtaatgata

SEQ ID NO: 3672 - DNA, 20 bp, Artificial Sequence
  chemically synthesized
tttatctatatcattaccct

SEQ ID NO: 3673 - DNA, 20 bp, Artificial Sequence
  chemically synthesized
tatctatatcattacccttg

SEQ ID NO: 3674 - DNA, 20 bp, Artificial Sequence
  chemically synthesized
tacagtttttttttctccaa

SEQ ID NO: 3675 - DNA, 20 bp, Artificial Sequence
  chemically synthesized
atacagtttttttttctcca

SEQ ID NO: 3676 - DNA, 20 bp, Artificial Sequence
  chemically synthesized
tatacagtttttttttctcc

SEQ ID NO: 3677 - DNA, 20 bp, Artificial Sequence
  chemically synthesized
aaaaaaaaaaaaaagatata

SEQ ID NO: 3678 - DNA, 20 bp, Artificial Sequence
  chemically synthesized
ctcaaaaaaaaaaaaaaaaa

SEQ ID NO: 3679 - DNA, 20 bp, Artificial Sequence
  chemically synthesized
cttttttttttttttttttt

SEQ ID NO: 3680 - DNA, 20 bp, Artificial Sequence
  chemically synthesized
ttttttttttttttttgaga

SEQ ID NO: 3681 - DNA, 20 bp, Artificial Sequence
  chemically synthesized
ttttttttttttttgagatg

SEQ ID NO: 3682 - DNA, 20 bp, Artificial Sequence
  chemically synthesized
tccagcctgggtgacagagc

SEQ ID NO: 3683 - DNA, 20 bp, Artificial Sequence
  chemically synthesized
tggagtcttgctctgtcacc

SEQ ID NO: 3684 - DNA, 20 bp, Artificial Sequence
  chemically synthesized
gcactccagcctgggtgaca

SEQ ID NO: 3685 - DNA, 20 bp, Artificial Sequence
  chemically synthesized
ggagtcttgctctgtcaccc

SEQ ID NO: 3686 - DNA, 20 bp, Artificial Sequence
  chemically synthesized
ctgcactccagcctgggtga

SEQ ID NO: 3687 - DNA, 20 bp, Artificial Sequence
  chemically synthesized
tcttgctctgtcacccaggc

SEQ ID NO: 3688 - DNA, 20 bp, Artificial Sequence
  chemically synthesized
ttgctctgtcacccaggctg

SEQ ID NO: 3689 - DNA, 20 bp, Artificial Sequence
  chemically synthesized
gtgccactgcactccagcct

SEQ ID NO: 3690 - DNA, 20 bp, Artificial Sequence
  chemically synthesized
cgtgccactgcactccagcc

SEQ ID NO: 3691 - DNA, 20 bp, Artificial Sequence
  chemically synthesized
ctgtcacccaggctggagtg

SEQ ID NO: 3692 - DNA, 20 bp, Artificial Sequence
  chemically synthesized
aagatcgtgccactgcactc

SEQ ID NO: 3693 - DNA, 20 bp, Artificial Sequence
  chemically synthesized
tcacccaggctggagtgcag

SEQ ID NO: 3694 - DNA, 20 bp, Artificial Sequence
  chemically synthesized
ggagtgcagtggcacgatct

SEQ ID NO: 3695 - DNA, 20 bp, Artificial Sequence
  chemically synthesized
ggcggaggttgcagtgagcc

SEQ ID NO: 3696 - DNA, 20 bp, Artificial Sequence
  chemically synthesized
tgggaggcggaggttgcagt

SEQ ID NO: 3697 - DNA, 20 bp, Artificial Sequence
  chemically synthesized
aacctgggaggcggaggttg

SEQ ID NO: 3698 - DNA, 20 bp, Artificial Sequence
  chemically synthesized
cgtttgaacctgggaggcgg

SEQ ID NO: 3699 - DNA, 20 bp, Artificial Sequence
  chemically synthesized
tcactgcaacctccgcctcc

SEQ ID NO: 3700 - DNA, 20 bp, Artificial Sequence
  chemically synthesized
tcgtttgaacctgggaggcg

SEQ ID NO: 3701 - DNA, 20 bp, Artificial Sequence
  chemically synthesized
cactgcaacctccgcctccc

SEQ ID NO: 3702 - DNA, 20 bp, Artificial Sequence
  chemically synthesized
aatcgtttgaacctgggagg

SEQ ID NO: 3703 - DNA, 20 bp, Artificial Sequence
  chemically synthesized
aagaatcgtttgaacctggg

SEQ ID NO: 3704 - DNA, 20 bp, Artificial Sequence
  chemically synthesized
gaagaatcgtttgaacctgg

SEQ ID NO: 3705 - DNA, 20 bp, Artificial Sequence
  chemically synthesized
cagaagaatcgtttgaacct

SEQ ID NO: 3706 - DNA, 20 bp, Artificial Sequence
  chemically synthesized
gcagaagaatcgtttgaacc

SEQ ID NO: 3707 - DNA, 20 bp, Artificial Sequence
  chemically synthesized
ttcaaacgattcttctgcct

SEQ ID NO: 3708 - DNA, 20 bp, Artificial Sequence
  chemically synthesized
tactcgggaggctgaggcag

SEQ ID NO: 3709 - DNA, 20 bp, Artificial Sequence
  chemically synthesized
agctactcgggaggctgagg

SEQ ID NO: 3710 - DNA, 20 bp, Artificial Sequence
  chemically synthesized
cccagctactcgggaggctg

SEQ ID NO: 3711 - DNA, 20 bp, Artificial Sequence
  chemically synthesized
tcccagctactcgggaggct

SEQ ID NO: 3712 - DNA, 20 bp, Artificial Sequence
  chemically synthesized
ttcttctgcctcagcctccc

SEQ ID NO: 3713 - DNA, 20 bp, Artificial Sequence
  chemically synthesized
ttctgcctcagcctcccgag

SEQ ID NO: 3714 - DNA, 20 bp, Artificial Sequence
  chemically synthesized
tgtagtcccagctactcggg

SEQ ID NO: 3715 - DNA, 20 bp, Artificial Sequence
  chemically synthesized
ctgtagtcccagctactcgg

SEQ ID NO: 3716 - DNA, 20 bp, Artificial Sequence
  chemically synthesized
gcctcagcctcccgagtagc

SEQ ID NO: 3717 - DNA, 20 bp, Artificial Sequence
  chemically synthesized
gcctgtagtcccagctactc

SEQ ID NO: 3718 - DNA, 20 bp, Artificial Sequence
  chemically synthesized
cctcagcctcccgagtagct

SEQ ID NO: 3719 - DNA, 20 bp, Artificial Sequence
  chemically synthesized
tgcctgtagtcccagctact

SEQ ID NO: 3720 - DNA, 20 bp, Artificial Sequence
  chemically synthesized
ctcccgagtagctgggacta

SEQ ID NO: 3721 - DNA, 20 bp, Artificial Sequence
  chemically synthesized
tcccgagtagctgggactac

SEQ ID NO: 3722 - DNA, 20 bp, Artificial Sequence
  chemically synthesized
ttggcgcatgcctgtagtcc

SEQ ID NO: 3723 - DNA, 20 bp, Artificial Sequence
  chemically synthesized
gacgtgttggcgcatgcctg

SEQ ID NO: 3724 - DNA, 20 bp, Artificial Sequence
  chemically synthesized
caggcatgcgccaacacgtc

SEQ ID NO: 3725 - DNA, 20 bp, Artificial Sequence
  chemically synthesized
caaaaattagctggacgtgt

SEQ ID NO: 3726 - DNA, 20 bp, Artificial Sequence
  chemically synthesized
ctaaaaatacaaaaattagc

SEQ ID NO: 3727 - DNA, 20 bp, Artificial Sequence
  chemically synthesized
tctactaaaaatacaaaaat

SEQ ID NO: 3728 - DNA, 20 bp, Artificial Sequence
  chemically synthesized
ccagctaatttttgtatttt

SEQ ID NO: 3729 - DNA, 20 bp, Artificial Sequence
  chemically synthesized
gctaatttttgtatttttag

SEQ ID NO: 3730 - DNA, 20 bp, Artificial Sequence
  chemically synthesized
taatttttgtatttttagta

SEQ ID NO: 3731 - DNA, 20 bp, Artificial Sequence
  chemically synthesized
ttttgtatttttagtagaga

SEQ ID NO: 3732 - DNA, 20 bp, Artificial Sequence
  chemically synthesized
tttgtatttttagtagagac

SEQ ID NO: 3733 - DNA, 20 bp, Artificial Sequence
  chemically synthesized
ttgtatttttagtagagaca

SEQ ID NO: 3734 - DNA, 20 bp, Artificial Sequence
  chemically synthesized
gagacagggtttcaccatat

SEQ ID NO: 3735 - DNA, 20 bp, Artificial Sequence
  chemically synthesized
cagggtttcaccatattggc

SEQ ID NO: 3736 - DNA, 20 bp, Artificial Sequence
  chemically synthesized
cgagaccagcctggccaata

SEQ ID NO: 3737 - DNA, 20 bp, Artificial Sequence
  chemically synthesized
agggtttcaccatattggcc

SEQ ID NO: 3738 - DNA, 20 bp, Artificial Sequence
  chemically synthesized
tttcaccatattggccaggc

SEQ ID NO: 3739 - DNA, 20 bp, Artificial Sequence
  chemically synthesized
tcaggagttcgagaccagcc

SEQ ID NO: 3740 - DNA, 20 bp, Artificial Sequence
  chemically synthesized
tgaggtcaggagttcgagac

SEQ ID NO: 3741 - DNA, 20 bp, Artificial Sequence
  chemically synthesized
gatcatgaggtcaggagttc

SEQ ID NO: 3742 - DNA, 20 bp, Artificial Sequence
  chemically synthesized
tgggcagatcatgaggtcag

SEQ ID NO: 3743 - DNA, 20 bp, Artificial Sequence
  chemically synthesized
ggtgggcagatcatgaggtc

SEQ ID NO: 3744 - DNA, 20 bp, Artificial Sequence
  chemically synthesized
aggtgggcagatcatgaggt

SEQ ID NO: 3745 - DNA, 20 bp, Artificial Sequence
  chemically synthesized
gctgaggtgggcagatcatg

SEQ ID NO: 3746 - DNA, 20 bp, Artificial Sequence
  chemically synthesized
ggctgaggtgggcagatcat

SEQ ID NO: 3747 - DNA, 20 bp, Artificial Sequence
  chemically synthesized
acctcatgatctgcccacct

SEQ ID NO: 3748 - DNA, 20 bp, Artificial Sequence
  chemically synthesized
ctttgggaggctgaggtggg

SEQ ID NO: 3749 - DNA, 20 bp, Artificial Sequence
  chemically synthesized
gcactttgggaggctgaggt

SEQ ID NO: 3750 - DNA, 20 bp, Artificial Sequence
  chemically synthesized
agcactttgggaggctgagg

SEQ ID NO: 3751 - DNA, 20 bp, Artificial Sequence
  chemically synthesized
cccagcactttgggaggctg

SEQ ID NO: 3752 - DNA, 20 bp, Artificial Sequence
  chemically synthesized
tcccagcactttgggaggct

SEQ ID NO: 3753 - DNA, 20 bp, Artificial Sequence
  chemically synthesized
ctgcccacctcagcctccca

SEQ ID NO: 3754 - DNA, 20 bp, Artificial Sequence
  chemically synthesized
tgtaatcccagcactttggg

SEQ ID NO: 3755 - DNA, 20 bp, Artificial Sequence
  chemically synthesized
ctgtaatcccagcactttgg

SEQ ID NO: 3756 - DNA, 20 bp, Artificial Sequence
  chemically synthesized
acctcagcctcccaaagtgc

SEQ ID NO: 3757 - DNA, 20 bp, Artificial Sequence
  chemically synthesized
gcctgtaatcccagcacttt

SEQ ID NO: 3758 - DNA, 20 bp, Artificial Sequence
  chemically synthesized
cctcagcctcccaaagtgct

SEQ ID NO: 3759 - DNA, 20 bp, Artificial Sequence
  chemically synthesized
cgcctgtaatcccagcactt

SEQ ID NO: 3760 - DNA, 20 bp, Artificial Sequence
  chemically synthesized
ctcccaaagtgctgggatta

SEQ ID NO: 3761 - DNA, 20 bp, Artificial Sequence
  chemically synthesized
tcccaaagtgctgggattac

SEQ ID NO: 3762 - DNA, 20 bp, Artificial Sequence
  chemically synthesized
ttggctcacgcctgtaatcc

SEQ ID NO: 3763 - DNA, 20 bp, Artificial Sequence
  chemically synthesized
agtgctgggattacaggcgt

SEQ ID NO: 3764 - DNA, 20 bp, Artificial Sequence
  chemically synthesized
caggcgtgagccaacacgcc

SEQ ID NO: 3765 - DNA, 20 bp, Artificial Sequence
  chemically synthesized
acgcagtaggctgggcgtgt

SEQ ID NO: 3766 - DNA, 20 bp, Artificial Sequence
  chemically synthesized
aaaaagatacgcagtaggct

SEQ ID NO: 3767 - DNA, 20 bp, Artificial Sequence
  chemically synthesized
taaaaagatacgcagtaggc

SEQ ID NO: 3768 - DNA, 20 bp, Artificial Sequence
  chemically synthesized
cttttaaaaagatacgcagt

SEQ ID NO: 3769 - DNA, 20 bp, Artificial Sequence
  chemically synthesized
acttttaaaaagatacgcag

SEQ ID NO: 3770 - DNA, 20 bp, Artificial Sequence
  chemically synthesized
tcaacttttaaaaagatacg

SEQ ID NO: 3771 - DNA, 20 bp, Artificial Sequence
  chemically synthesized
cctactgcgtatctttttaa

SEQ ID NO: 3772 - DNA, 20 bp, Artificial Sequence
  chemically synthesized
gtaactagtcaacttttaaa

SEQ ID NO: 3773 - DNA, 20 bp, Artificial Sequence
  chemically synthesized
gtatctttttaaaagttgac

SEQ ID NO: 3774 - DNA, 20 bp, Artificial Sequence
  chemically synthesized
cggggcacatttcaagtaac

SEQ ID NO: 3775 - DNA, 20 bp, Artificial Sequence
  chemically synthesized
ctatgtgcggggcacatttc

SEQ ID NO: 3776 - DNA, 20 bp, Artificial Sequence
  chemically synthesized
cttgaaatgtgccccgcaca

SEQ ID NO: 3777 - DNA, 20 bp, Artificial Sequence
  chemically synthesized
atttatcatttctatgtgcg

SEQ ID NO: 3778 - DNA, 20 bp, Artificial Sequence
  chemically synthesized
tatttatcatttctatgtgc

SEQ ID NO: 3779 - DNA, 20 bp, Artificial Sequence
  chemically synthesized
gtatttatcatttctatgtg

SEQ ID NO: 3780 - DNA, 20 bp, Artificial Sequence
  chemically synthesized
catagaaatgataaatacat

SEQ ID NO: 3781 - DNA, 20 bp, Artificial Sequence
  chemically synthesized
tgatcaagtcagggtattta

SEQ ID NO: 3782 - DNA, 20 bp, Artificial Sequence
  chemically synthesized
aatgatcaagtcagggtatt

SEQ ID NO: 3783 - DNA, 20 bp, Artificial Sequence
  chemically synthesized
atgtgttaatgatcaagtca

SEQ ID NO: 3784 - DNA, 20 bp, Artificial Sequence
  chemically synthesized
aatgtgttaatgatcaagtc

SEQ ID NO: 3785 - DNA, 20 bp, Artificial Sequence
  chemically synthesized
gaatgtgttaatgatcaagt

SEQ ID NO: 3786 - DNA, 20 bp, Artificial Sequence
  chemically synthesized
cacagaatgtgttaatgatc

SEQ ID NO: 3787 - DNA, 20 bp, Artificial Sequence
  chemically synthesized
ttgatattttgttgcataca

SEQ ID NO: 3788 - DNA, 20 bp, Artificial Sequence
  chemically synthesized
aatatttgtacatatttatg

SEQ ID NO: 3789 - DNA, 20 bp, Artificial Sequence
  chemically synthesized
ataatatttgtacatattta

SEQ ID NO: 3790 - DNA, 20 bp, Artificial Sequence
  chemically synthesized
tatgtacaaatattatacta

SEQ ID NO: 3791 - DNA, 20 bp, Artificial Sequence
  chemically synthesized
acccagcctgttttttactg

SEQ ID NO: 3792 - DNA, 20 bp, Artificial Sequence
  chemically synthesized
tattatactacagtaaaaaa

SEQ ID NO: 3793 - DNA, 20 bp, Artificial Sequence
  chemically synthesized
attatactacagtaaaaaac

SEQ ID NO: 3794 - DNA, 20 bp, Artificial Sequence
  chemically synthesized
tactacagtaaaaaacaggc

SEQ ID NO: 3795 - DNA, 20 bp, Artificial Sequence
  chemically synthesized
actacagtaaaaaacaggct

SEQ ID NO: 3796 - DNA, 20 bp, Artificial Sequence
  chemically synthesized
agtaaaaaacaggctgggtg

SEQ ID NO: 3797 - DNA, 20 bp, Artificial Sequence
  chemically synthesized
caggcatgagcgaccgcacc

SEQ ID NO: 3798 - DNA, 20 bp, Artificial Sequence
  chemically synthesized
agggctgggattacaggcat

SEQ ID NO: 3799 - DNA, 20 bp, Artificial Sequence
  chemically synthesized
gtcgctcatgcctgtaatcc

SEQ ID NO: 3800 - DNA, 20 bp, Artificial Sequence
  chemically synthesized
tcccaaagggctgggattac

SEQ ID NO: 3801 - DNA, 20 bp, Artificial Sequence
  chemically synthesized
ttcccaaagggctgggatta

SEQ ID NO: 3802 - DNA, 20 bp, Artificial Sequence
  chemically synthesized
tgcctgtaatcccagccctt

SEQ ID NO: 3803 - DNA, 20 bp, Artificial Sequence
  chemically synthesized
cctcggcttcccaaagggct

SEQ ID NO: 3804 - DNA, 20 bp, Artificial Sequence
  chemically synthesized
gcctgtaatcccagcccttt

SEQ ID NO: 3805 - DNA, 20 bp, Artificial Sequence
  chemically synthesized
acctcggcttcccaaagggc

SEQ ID NO: 3806 - DNA, 20 bp, Artificial Sequence
  chemically synthesized
tgtaatcccagccctttggg

SEQ ID NO: 3807 - DNA, 20 bp, Artificial Sequence
  chemically synthesized
tcccacctcggcttcccaaa

SEQ ID NO: 3808 - DNA, 20 bp, Artificial Sequence
  chemically synthesized
ctcccacctcggcttcccaa

SEQ ID NO: 3809 - DNA, 20 bp, Artificial Sequence
  chemically synthesized
cctcccacctcggcttccca

SEQ ID NO: 3810 - DNA, 20 bp, Artificial Sequence
  chemically synthesized
tcccagccctttgggaagcc

SEQ ID NO: 3811 - DNA, 20 bp, Artificial Sequence
  chemically synthesized
cccagccctttgggaagccg

SEQ ID NO: 3812 - DNA, 20 bp, Artificial Sequence
  chemically synthesized
agccctttgggaagccgagg

SEQ ID NO: 3813 - DNA, 20 bp, Artificial Sequence
  chemically synthesized
gccctttgggaagccgaggt

SEQ ID NO: 3814 - DNA, 20 bp, Artificial Sequence
  chemically synthesized
cctttgggaagccgaggtgg

SEQ ID NO: 3815 - DNA, 20 bp, Artificial Sequence
  chemically synthesized
ctttgggaagccgaggtggg

SEQ ID NO: 3816 - DNA, 20 bp, Artificial Sequence
  chemically synthesized
agcaaacaatcctcccacct

SEQ ID NO: 3817 - DNA, 20 bp, Artificial Sequence
  chemically synthesized
gtgggaggattgtttgctgc

SEQ ID NO: 3818 - DNA, 20 bp, Artificial Sequence
  chemically synthesized
tgggaggattgtttgctgcc

SEQ ID NO: 3819 - DNA, 20 bp, Artificial Sequence
  chemically synthesized
agctgctctcaaattcctgg

SEQ ID NO: 3820 - DNA, 20 bp, Artificial Sequence
  chemically synthesized
ttgtttgctgccaggaattt

SEQ ID NO: 3821 - DNA, 20 bp, Artificial Sequence
  chemically synthesized
ccaagctgctctcaaattcc

SEQ ID NO: 3822 - DNA, 20 bp, Artificial Sequence
  chemically synthesized
gtttgctgccaggaatttga

SEQ ID NO: 3823 - DNA, 20 bp, Artificial Sequence
  chemically synthesized
tgctgccaggaatttgagag

SEQ ID NO: 3824 - DNA, 20 bp, Artificial Sequence
  chemically synthesized
ccaggaatttgagagcagct

SEQ ID NO: 3825 - DNA, 20 bp, Artificial Sequence
  chemically synthesized
caggaatttgagagcagctt

SEQ ID NO: 3826 - DNA, 20 bp, Artificial Sequence
  chemically synthesized
agggtctcactatgttgccc

SEQ ID NO: 3827 - DNA, 20 bp, Artificial Sequence
  chemically synthesized
tgagagcagcttgggcaaca

SEQ ID NO: 3828 - DNA, 20 bp, Artificial Sequence
  chemically synthesized
agcagcttgggcaacatagt

SEQ ID NO: 3829 - DNA, 20 bp, Artificial Sequence
  chemically synthesized
tttgtttttaaatagagaca

SEQ ID NO: 3830 - DNA, 20 bp, Artificial Sequence
  chemically synthesized
ttttgtttttaaatagagac

SEQ ID NO: 3831 - DNA, 20 bp, Artificial Sequence
  chemically synthesized
tttttgtttttaaatagaga

SEQ ID NO: 3832 - DNA, 20 bp, Artificial Sequence
  chemically synthesized
tgtttttttgtttttaaata

SEQ ID NO: 3833 - DNA, 20 bp, Artificial Sequence
  chemically synthesized
tttgtttttttgtttttaaa

SEQ ID NO: 3834 - DNA, 20 bp, Artificial Sequence
  chemically synthesized
aaaacaaaaaataaatttaa

SEQ ID NO: 3835 - DNA, 20 bp, Artificial Sequence
  chemically synthesized
aaataaatttaaaagttaaa

SEQ ID NO: 3836 - DNA, 20 bp, Artificial Sequence
  chemically synthesized
ttaaaagttaaaaagaataa

SEQ ID NO: 3837 - DNA, 20 bp, Artificial Sequence
  chemically synthesized
gttaaaaagaataaaagaaa

SEQ ID NO: 3838 - DNA, 20 bp, Artificial Sequence
  chemically synthesized
aaagaaaaagtcaattgaaa

SEQ ID NO: 3839 - DNA, 20 bp, Artificial Sequence
  chemically synthesized
aagaaaaagtcaattgaaaa

SEQ ID NO: 3840 - DNA, 20 bp, Artificial Sequence
  chemically synthesized
ttgaaaaaggtaaaactgac

SEQ ID NO: 3841 - DNA, 20 bp, Artificial Sequence
  chemically synthesized
gggcacaaaagagagcttgt

SEQ ID NO: 3842 - DNA, 20 bp, Artificial Sequence
  chemically synthesized
tgtgaatggggcacaaaaga

SEQ ID NO: 3843 - DNA, 20 bp, Artificial Sequence
  chemically synthesized
tttgtgaatggggcacaaaa

SEQ ID NO: 3844 - DNA, 20 bp, Artificial Sequence
  chemically synthesized
catttgtgaatggggcacaa

SEQ ID NO: 3845 - DNA, 20 bp, Artificial Sequence
  chemically synthesized
aagtttcacatttgtgaatg

SEQ ID NO: 3846 - DNA, 20 bp, Artificial Sequence
  chemically synthesized
aaagtttcacatttgtgaat

SEQ ID NO: 3847 - DNA, 20 bp, Artificial Sequence
  chemically synthesized
caaagtttcacatttgtgaa

SEQ ID NO: 3848 - DNA, 20 bp, Artificial Sequence
  chemically synthesized
ttattttattacatagaaca

SEQ ID NO: 3849 - DNA, 20 bp, Artificial Sequence
  chemically synthesized
gtaatacttattttattaca

SEQ ID NO: 3850 - DNA, 20 bp, Artificial Sequence
  chemically synthesized
tttgttctatgtaataaaat

SEQ ID NO: 3851 - DNA, 20 bp, Artificial Sequence
  chemically synthesized
gagacagcactgcaagtgtg

SEQ ID NO: 3852 - DNA, 20 bp, Artificial Sequence
  chemically synthesized
taagtattactgcacacttg

SEQ ID NO: 3853 - DNA, 20 bp, Artificial Sequence
  chemically synthesized
tgttgaggagacagcactgc

SEQ ID NO: 3854 - DNA, 20 bp, Artificial Sequence
  chemically synthesized
actcttttgtgttgaggaga

SEQ ID NO: 3855 - DNA, 20 bp, Artificial Sequence
  chemically synthesized
tcttactcttttgtgttgag

SEQ ID NO: 3856 - DNA, 20 bp, Artificial Sequence
  chemically synthesized
attcttactcttttgtgttg

SEQ ID NO: 3857 - DNA, 20 bp, Artificial Sequence
  chemically synthesized
gtgctgtctcctcaacacaa

SEQ ID NO: 3858 - DNA, 20 bp, Artificial Sequence
  chemically synthesized
aattcttactcttttgtgtt

SEQ ID NO: 3859 - DNA, 20 bp, Artificial Sequence
  chemically synthesized
gctgtctcctcaacacaaaa

SEQ ID NO: 3860 - DNA, 20 bp, Artificial Sequence
  chemically synthesized
tctcctcaacacaaaagagt

SEQ ID NO: 3861 - DNA, 20 bp, Artificial Sequence
  chemically synthesized
agtaagaattgaacactttg

SEQ ID NO: 3862 - DNA, 20 bp, Artificial Sequence
  chemically synthesized
accttcatgaagtgactgca

SEQ ID NO: 3863 - DNA, 20 bp, Artificial Sequence
  chemically synthesized
cactttgcagtcacttcatg

SEQ ID NO: 3864 - DNA, 20 bp, Artificial Sequence
  chemically synthesized
actttgcagtcacttcatga

SEQ ID NO: 3865 - DNA, 20 bp, Artificial Sequence
  chemically synthesized
actcccttcttaccttcatg

SEQ ID NO: 3866 - DNA, 20 bp, Artificial Sequence
  chemically synthesized
tgcagtcacttcatgaaggt

SEQ ID NO: 3867 - DNA, 20 bp, Artificial Sequence
  chemically synthesized
agtcacttcatgaaggtaag

SEQ ID NO: 3868 - DNA, 20 bp, Artificial Sequence
  chemically synthesized
gtcacttcatgaaggtaaga

SEQ ID NO: 3869 - DNA, 20 bp, Artificial Sequence
  chemically synthesized
tcacttcatgaaggtaagaa

SEQ ID NO: 3870 - DNA, 20 bp, Artificial Sequence
  chemically synthesized
acttcatgaaggtaagaagg

SEQ ID NO: 3871 - DNA, 20 bp, Artificial Sequence
  chemically synthesized
atgaaggtaagaagggagtt

SEQ ID NO: 3872 - DNA, 20 bp, Artificial Sequence
  chemically synthesized
aagaagggagttgagacact

SEQ ID NO: 3873 - DNA, 20 bp, Artificial Sequence
  chemically synthesized
agaagggagttgagacactg

SEQ ID NO: 3874 - DNA, 20 bp, Artificial Sequence
  chemically synthesized
aaagagtgaaaaaaagacct

SEQ ID NO: 3875 - DNA, 20 bp, Artificial Sequence
  chemically synthesized
tcaaaacaaagagtgaaaaa

SEQ ID NO: 3876 - DNA, 20 bp, Artificial Sequence
  chemically synthesized
tggttaaatgtcaaaacaaa

SEQ ID NO: 3877 - DNA, 20 bp, Artificial Sequence
  chemically synthesized
tttggttaaatgtcaaaaca

SEQ ID NO: 3878 - DNA, 20 bp, Artificial Sequence
  chemically synthesized
ttgagtttcgtttgtatttt

SEQ ID NO: 3879 - DNA, 20 bp, Artificial Sequence
  chemically synthesized
caaaaatacaaacgaaactc

SEQ ID NO: 3880 - DNA, 20 bp, Artificial Sequence
  chemically synthesized
attggagtttaaaggtactt

SEQ ID NO: 3881 - DNA, 20 bp, Artificial Sequence
  chemically synthesized
tctattacattggagtttaa

SEQ ID NO: 3882 - DNA, 20 bp, Artificial Sequence
  chemically synthesized
ttctattacattggagttta

SEQ ID NO: 3883 - DNA, 20 bp, Artificial Sequence
  chemically synthesized
tttttatttctattacattg

SEQ ID NO: 3884 - DNA, 20 bp, Artificial Sequence
  chemically synthesized
acctttaaactccaatgtaa

SEQ ID NO: 3885 - DNA, 20 bp, Artificial Sequence
  chemically synthesized
tatttttatttctattacat

SEQ ID NO: 3886 - DNA, 20 bp, Artificial Sequence
  chemically synthesized
caatgtaatagaaataaaaa

SEQ ID NO: 3887 - DNA, 20 bp, Artificial Sequence
  chemically synthesized
aaaatagtatatatcctata

SEQ ID NO: 3888 - DNA, 20 bp, Artificial Sequence
  chemically synthesized
aaatagtatatatcctatat

SEQ ID NO: 3889 - DNA, 20 bp, Artificial Sequence
  chemically synthesized
tcatatttcattacctatat

SEQ ID NO: 3890 - DNA, 20 bp, Artificial Sequence
  chemically synthesized
ttcatatttcattacctata

SEQ ID NO: 3891 - DNA, 20 bp, Artificial Sequence
  chemically synthesized
tatgaatattctaaaaactg

SEQ ID NO: 3892 - DNA, 20 bp, Artificial Sequence
  chemically synthesized
tatgccatatctacagtttt

SEQ ID NO: 3893 - DNA, 20 bp, Artificial Sequence
  chemically synthesized
tattctaaaaactgtagata

SEQ ID NO: 3894 - DNA, 20 bp, Artificial Sequence
  chemically synthesized
tccaatatatgccatatcta

SEQ ID NO: 3895 - DNA, 20 bp, Artificial Sequence
  chemically synthesized
actgtagatatggcatatat

SEQ ID NO: 3896 - DNA, 20 bp, Artificial Sequence
  chemically synthesized
tgtagatatggcatatattg

SEQ ID NO: 3897 - DNA, 20 bp, Artificial Sequence
  chemically synthesized
tagatatggcatatattgga

SEQ ID NO: 3898 - DNA, 20 bp, Artificial Sequence
  chemically synthesized
tggcatatattggagagtta

SEQ ID NO: 3899 - DNA, 20 bp, Artificial Sequence
  chemically synthesized
agtcccaagtaacagaggaa

SEQ ID NO: 3900 - DNA, 20 bp, Artificial Sequence
  chemically synthesized
tagtcccaagtaacagagga

SEQ ID NO: 3901 - DNA, 20 bp, Artificial Sequence
  chemically synthesized
aaagtagtcccaagtaacag

SEQ ID NO: 3902 - DNA, 20 bp, Artificial Sequence
  chemically synthesized
tggtcctttcctctgttact

SEQ ID NO: 3903 - DNA, 20 bp, Artificial Sequence
  chemically synthesized
taaagtagtcccaagtaaca

SEQ ID NO: 3904 - DNA, 20 bp, Artificial Sequence
  chemically synthesized
ggtcctttcctctgttactt

SEQ ID NO: 3905 - DNA, 20 bp, Artificial Sequence
  chemically synthesized
gataaagtagtcccaagtaa

SEQ ID NO: 3906 - DNA, 20 bp, Artificial Sequence
  chemically synthesized
aattatgataaagtagtccc

SEQ ID NO: 3907 - DNA, 20 bp, Artificial Sequence
  chemically synthesized
aaaacataattatgataaag

SEQ ID NO: 3908 - DNA, 20 bp, Artificial Sequence
  chemically synthesized
cccaaaacataattatgata

SEQ ID NO: 3909 - DNA, 20 bp, Artificial Sequence
  chemically synthesized
actttatcataattatgttt

SEQ ID NO: 3910 - DNA, 20 bp, Artificial Sequence
  chemically synthesized
ctttatcataattatgtttt

SEQ ID NO: 3911 - DNA, 20 bp, Artificial Sequence
  chemically synthesized
attatgttttgggttttata

SEQ ID NO: 3912 - DNA, 20 bp, Artificial Sequence
  chemically synthesized
atgttttgggttttataaag

SEQ ID NO: 3913 - DNA, 20 bp, Artificial Sequence
  chemically synthesized
aacattttgactgtttatgt

SEQ ID NO: 3914 - DNA, 20 bp, Artificial Sequence
  chemically synthesized
tcattctctcctcacataaa

SEQ ID NO: 3915 - DNA, 20 bp, Artificial Sequence
  chemically synthesized
acattttgactgtttatgtg

SEQ ID NO: 3916 - DNA, 20 bp, Artificial Sequence
  chemically synthesized
attttgactgtttatgtgag

SEQ ID NO: 3917 - DNA, 20 bp, Artificial Sequence
  chemically synthesized
tttgactgtttatgtgagga

SEQ ID NO: 3918 - DNA, 20 bp, Artificial Sequence
  chemically synthesized
gtgaggagagaatgatgatc

SEQ ID NO: 3919 - DNA, 20 bp, Artificial Sequence
  chemically synthesized
aggagagaatgatgatctgg

SEQ ID NO: 3920 - DNA, 20 bp, Artificial Sequence
  chemically synthesized
agaatgatgatctggaagca

SEQ ID NO: 3921 - DNA, 20 bp, Artificial Sequence
  chemically synthesized
tccataggtttctttgcttc

SEQ ID NO: 3922 - DNA, 20 bp, Artificial Sequence
  chemically synthesized
tctggaagcaaagaaaccta

SEQ ID NO: 3923 - DNA, 20 bp, Artificial Sequence
  chemically synthesized
gaagcaaagaaacctatgga

SEQ ID NO: 3924 - DNA, 20 bp, Artificial Sequence
  chemically synthesized
agtgaatatcatccatccat

SEQ ID NO: 3925 - DNA, 20 bp, Artificial Sequence
  chemically synthesized
cagtgaatatcatccatcca

SEQ ID NO: 3926 - DNA, 20 bp, Artificial Sequence
  chemically synthesized
tatggatggatgatattcac

SEQ ID NO: 3927 - DNA, 20 bp, Artificial Sequence
  chemically synthesized
atggatggatgatattcact

SEQ ID NO: 3928 - DNA, 20 bp, Artificial Sequence
  chemically synthesized
tggatgatattcactgggaa

SEQ ID NO: 3929 - DNA, 20 bp, Artificial Sequence
  chemically synthesized
tacaaggagatttccattcc

SEQ ID NO: 3930 - DNA, 20 bp, Artificial Sequence
  chemically synthesized
tgggaatggaaatctccttg

SEQ ID NO: 3931 - DNA, 20 bp, Artificial Sequence
  chemically synthesized
agattcacaaaatctacaag

SEQ ID NO: 3932 - DNA, 20 bp, Artificial Sequence
  chemically synthesized
acagattcacaaaatctaca

SEQ ID NO: 3933 - DNA, 20 bp, Artificial Sequence
  chemically synthesized
cacagattcacaaaatctac

SEQ ID NO: 3934 - DNA, 20 bp, Artificial Sequence
  chemically synthesized
atgaacaaacaatacagaca

SEQ ID NO: 3935 - DNA, 20 bp, Artificial Sequence
  chemically synthesized
taacacatgaacaaacaata

SEQ ID NO: 3936 - DNA, 20 bp, Artificial Sequence
  chemically synthesized
tattgtttgttcatgtgtta

SEQ ID NO: 3937 - DNA, 20 bp, Artificial Sequence
  chemically synthesized
ttaaagaaatacacttcaaa

SEQ ID NO: 3938 - DNA, 20 bp, Artificial Sequence
  chemically synthesized
taacttgcaaatgctgtttg

SEQ ID NO: 3939 - DNA, 20 bp, Artificial Sequence
  chemically synthesized
acacttcaaacagcatttgc

SEQ ID NO: 3940 - DNA, 20 bp, Artificial Sequence
  chemically synthesized
caaacagcatttgcaagtta

SEQ ID NO: 3941 - DNA, 20 bp, Artificial Sequence
  chemically synthesized
aaacagcatttgcaagttaa

SEQ ID NO: 3942 - DNA, 20 bp, Artificial Sequence
  chemically synthesized
aacagcatttgcaagttaaa

SEQ ID NO: 3943 - DNA, 20 bp, Artificial Sequence
  chemically synthesized
caagttaaagggaaatttct

SEQ ID NO: 3944 - DNA, 20 bp, Artificial Sequence
  chemically synthesized
aagttaaagggaaatttctt

SEQ ID NO: 3945 - DNA, 20 bp, Artificial Sequence
  chemically synthesized
gtttaattttgtttgcacct

SEQ ID NO: 3946 - DNA, 20 bp, Artificial Sequence
  chemically synthesized
gcaaacaaaattaaacttta

SEQ ID NO: 3947 - DNA, 20 bp, Artificial Sequence
  chemically synthesized
caaacaaaattaaactttaa

SEQ ID NO: 3948 - DNA, 20 bp, Artificial Sequence
  chemically synthesized
ttagtttcaaaggaccttta

SEQ ID NO: 3949 - DNA, 20 bp, Artificial Sequence
  chemically synthesized
ttatgaaaagttagtttcaa

SEQ ID NO: 3950 - DNA, 20 bp, Artificial Sequence
  chemically synthesized
attatgaaaagttagtttca

SEQ ID NO: 3951 - DNA, 20 bp, Artificial Sequence
  chemically synthesized
gattgtatattatgaaaagt

SEQ ID NO: 3952 - DNA, 20 bp, Artificial Sequence
  chemically synthesized
ggaagattgtatattatgaa

SEQ ID NO: 3953 - DNA, 20 bp, Artificial Sequence
  chemically synthesized
cataatatacaatcttccaa

SEQ ID NO: 3954 - DNA, 20 bp, Artificial Sequence
  chemically synthesized
gaagttattttcactattgg

SEQ ID NO: 3955 - DNA, 20 bp, Artificial Sequence
  chemically synthesized
atagaagttattttcactat

SEQ ID NO: 3956 - DNA, 20 bp, Artificial Sequence
  chemically synthesized
agtgaaaataacttctattc

SEQ ID NO: 3957 - DNA, 20 bp, Artificial Sequence
  chemically synthesized
aacaaacagagcttgaatag

SEQ ID NO: 3958 - DNA, 20 bp, Artificial Sequence
  chemically synthesized
caaaacaaacagagcttgaa

SEQ ID NO: 3959 - DNA, 20 bp, Artificial Sequence
  chemically synthesized
gacaatgtgcaaaacaaaca

SEQ ID NO: 3960 - DNA, 20 bp, Artificial Sequence
  chemically synthesized
gtgacaatgtgcaaaacaaa

SEQ ID NO: 3961 - DNA, 20 bp, Artificial Sequence
  chemically synthesized
caaggtcttgttttagatgg

SEQ ID NO: 3962 - DNA, 20 bp, Artificial Sequence
  chemically synthesized
aagcaaggtcttgttttaga

SEQ ID NO: 3963 - DNA, 20 bp, Artificial Sequence
  chemically synthesized
ttgtcacttccatctaaaac

SEQ ID NO: 3964 - DNA, 20 bp, Artificial Sequence
  chemically synthesized
gctaaagcaaggtcttgttt

SEQ ID NO: 3965 - DNA, 20 bp, Artificial Sequence
  chemically synthesized
tctaaaacaagaccttgctt

SEQ ID NO: 3966 - DNA, 20 bp, Artificial Sequence
  chemically synthesized
atggttgacttgctaaagca

SEQ ID NO: 3967 - DNA, 20 bp, Artificial Sequence
  chemically synthesized
tatggttgacttgctaaagc

SEQ ID NO: 3968 - DNA, 20 bp, Artificial Sequence
  chemically synthesized
aaacaagaccttgctttagc

SEQ ID NO: 3969 - DNA, 20 bp, Artificial Sequence
  chemically synthesized
tcattatggttgacttgcta

SEQ ID NO: 3970 - DNA, 20 bp, Artificial Sequence
  chemically synthesized
gtccctaattaagttcatta

SEQ ID NO: 3971 - DNA, 20 bp, Artificial Sequence
  chemically synthesized
tcaaccataatgaacttaat

SEQ ID NO: 3972 - DNA, 20 bp, Artificial Sequence
  chemically synthesized
caaccataatgaacttaatt

SEQ ID NO: 3973 - DNA, 20 bp, Artificial Sequence
  chemically synthesized
aaccataatgaacttaatta

SEQ ID NO: 3974 - DNA, 20 bp, Artificial Sequence
  chemically synthesized
acctgaggttgtccctaatt

SEQ ID NO: 3975 - DNA, 20 bp, Artificial Sequence
  chemically synthesized
aacttaattagggacaacct

SEQ ID NO: 3976 - DNA, 20 bp, Artificial Sequence
  chemically synthesized
acttaattagggacaacctc

SEQ ID NO: 3977 - DNA, 20 bp, Artificial Sequence
  chemically synthesized
ccaagtcagatgtaaacctg

SEQ ID NO: 3978 - DNA, 20 bp, Artificial Sequence
  chemically synthesized
tccaagtcagatgtaaacct

SEQ ID NO: 3979 - DNA, 20 bp, Artificial Sequence
  chemically synthesized
cctcaggtttacatctgact

SEQ ID NO: 3980 - DNA, 20 bp, Artificial Sequence
  chemically synthesized
cttccgaagcagttccaagt

SEQ ID NO: 3981 - DNA, 20 bp, Artificial Sequence
  chemically synthesized
ctggcttccgaagcagttcc

SEQ ID NO: 3982 - DNA, 20 bp, Artificial Sequence
  chemically synthesized
catctgacttggaactgctt

SEQ ID NO: 3983 - DNA, 20 bp, Artificial Sequence
  chemically synthesized
ctgacttggaactgcttcgg

SEQ ID NO: 3984 - DNA, 20 bp, Artificial Sequence
  chemically synthesized
ttagtcactggcttccgaag

SEQ ID NO: 3985 - DNA, 20 bp, Artificial Sequence
  chemically synthesized
cttggaactgcttcggaagc

SEQ ID NO: 3986 - DNA, 20 bp, Artificial Sequence
  chemically synthesized
catttagtcactggcttccg

SEQ ID NO: 3987 - DNA, 20 bp, Artificial Sequence
  chemically synthesized
tatttaagtcatttagtcac

SEQ ID NO: 3988 - DNA, 20 bp, Artificial Sequence
  chemically synthesized
agaagcatatttaagtcatt

SEQ ID NO: 3989 - DNA, 20 bp, Artificial Sequence
  chemically synthesized
agggaatgagaagcatattt

SEQ ID NO: 3990 - DNA, 20 bp, Artificial Sequence
  chemically synthesized
catagaccaaagggaatgag

SEQ ID NO: 3991 - DNA, 20 bp, Artificial Sequence
  chemically synthesized
tggcatagaccaaagggaat

SEQ ID NO: 3992 - DNA, 20 bp, Artificial Sequence
  chemically synthesized
aatatgcttctcattccctt

SEQ ID NO: 3993 - DNA, 20 bp, Artificial Sequence
  chemically synthesized
tccaagtggcatagaccaaa

SEQ ID NO: 3994 - DNA, 20 bp, Artificial Sequence
  chemically synthesized
atccaagtggcatagaccaa

SEQ ID NO: 3995 - DNA, 20 bp, Artificial Sequence
  chemically synthesized
aatccaagtggcatagacca

SEQ ID NO: 3996 - DNA, 20 bp, Artificial Sequence
  chemically synthesized
tccctttggtctatgccact

SEQ ID NO: 3997 - DNA, 20 bp, Artificial Sequence
  chemically synthesized
acatgaaaatccaagtggca

SEQ ID NO: 3998 - DNA, 20 bp, Artificial Sequence
  chemically synthesized
atcaaacatgaaaatccaag

SEQ ID NO: 3999 - DNA, 20 bp, Artificial Sequence
  chemically synthesized
ctaatcaaacatgaaaatcc

SEQ ID NO: 4000 - DNA, 20 bp, Artificial Sequence
  chemically synthesized
cttggattttcatgtttgat

SEQ ID NO: 4001 - DNA, 20 bp, Artificial Sequence
  chemically synthesized
aaaaaaaaaggaataaatgc

SEQ ID NO: 4002 - DNA, 20 bp, Artificial Sequence
  chemically synthesized
aaaaaaaaaaggaataaatg

SEQ ID NO: 4003 - DNA, 20 bp, Artificial Sequence
  chemically synthesized
ctgctgttaaaaaaaaaaaa

SEQ ID NO: 4004 - DNA, 20 bp, Artificial Sequence
  chemically synthesized
tctgctgttaaaaaaaaaaa

SEQ ID NO: 4005 - DNA, 20 bp, Artificial Sequence
  chemically synthesized
attcctttttttttttttaa

SEQ ID NO: 4006 - DNA, 20 bp, Artificial Sequence
  chemically synthesized
cctttttttttttttaacag

SEQ ID NO: 4007 - DNA, 20 bp, Artificial Sequence
  chemically synthesized
ttttttttttttaacagcag

SEQ ID NO: 4008 - DNA, 20 bp, Artificial Sequence
  chemically synthesized
tttttaacagcagaagctaa

SEQ ID NO: 4009 - DNA, 20 bp, Artificial Sequence
  chemically synthesized
agcattggcaatgattcttt

SEQ ID NO: 4010 - DNA, 20 bp, Artificial Sequence
  chemically synthesized
tttgtcttaatggttagcat

SEQ ID NO: 4011 - DNA, 20 bp, Artificial Sequence
  chemically synthesized
cattgccaatgctaaccatt

SEQ ID NO: 4012 - DNA, 20 bp, Artificial Sequence
  chemically synthesized
tatgattttgtcttaatggt

SEQ ID NO: 4013 - DNA, 20 bp, Artificial Sequence
  chemically synthesized
agaatatgattttgtcttaa

SEQ ID NO: 4014 - DNA, 20 bp, Artificial Sequence
  chemically synthesized
attaagacaaaatcatattc

SEQ ID NO: 4015 - DNA, 20 bp, Artificial Sequence
  chemically synthesized
ttaagacaaaatcatattct

SEQ ID NO: 4016 - DNA, 20 bp, Artificial Sequence
  chemically synthesized
agacaaaatcatattctagg

SEQ ID NO: 4017 - DNA, 20 bp, Artificial Sequence
  chemically synthesized
tatgaagcctcacatccacc

SEQ ID NO: 4018 - DNA, 20 bp, Artificial Sequence
  chemically synthesized
atcatattctaggtggatgt

SEQ ID NO: 4019 - DNA, 20 bp, Artificial Sequence
  chemically synthesized
tcatattctaggtggatgtg

SEQ ID NO: 4020 - DNA, 20 bp, Artificial Sequence
  chemically synthesized
tccattctaataaaaatatg

SEQ ID NO: 4021 - DNA, 20 bp, Artificial Sequence
  chemically synthesized
gtgaggcttcatatttttat

SEQ ID NO: 4022 - DNA, 20 bp, Artificial Sequence
  chemically synthesized
gcttcatatttttattagaa

SEQ ID NO: 4023 - DNA, 20 bp, Artificial Sequence
  chemically synthesized
ttcatatttttattagaatg

SEQ ID NO: 4024 - DNA, 20 bp, Artificial Sequence
  chemically synthesized
tcatatttttattagaatgg

SEQ ID NO: 4025 - DNA, 20 bp, Artificial Sequence
  chemically synthesized
catatttttattagaatgga

SEQ ID NO: 4026 - DNA, 20 bp, Artificial Sequence
  chemically synthesized
ttttattagaatggagggat

SEQ ID NO: 4027 - DNA, 20 bp, Artificial Sequence
  chemically synthesized
gaatggagggataagaacgt

SEQ ID NO: 4028 - DNA, 20 bp, Artificial Sequence
  chemically synthesized
aatggagggataagaacgta

SEQ ID NO: 4029 - DNA, 20 bp, Artificial Sequence
  chemically synthesized
ggagggataagaacgtaagg

SEQ ID NO: 4030 - DNA, 20 bp, Artificial Sequence
  chemically synthesized
aagaacgtaaggtagataaa

SEQ ID NO: 4031 - DNA, 20 bp, Artificial Sequence
  chemically synthesized
gtaaggtagataaaaagcct

SEQ ID NO: 4032 - DNA, 20 bp, Artificial Sequence
  chemically synthesized
caggagactcatgtagtctg

SEQ ID NO: 4033 - DNA, 20 bp, Artificial Sequence
  chemically synthesized
ccaggagactcatgtagtct

SEQ ID NO: 4034 - DNA, 20 bp, Artificial Sequence
  chemically synthesized
taaaaagcctcagactacat

SEQ ID NO: 4035 - DNA, 20 bp, Artificial Sequence
  chemically synthesized
atgttaccaggagactcatg

SEQ ID NO: 4036 - DNA, 20 bp, Artificial Sequence
  chemically synthesized
ctcagactacatgagtctcc

SEQ ID NO: 4037 - DNA, 20 bp, Artificial Sequence
  chemically synthesized
ttcctgtggtatgttaccag

SEQ ID NO: 4038 - DNA, 20 bp, Artificial Sequence
  chemically synthesized
gtttcctgtggtatgttacc

SEQ ID NO: 4039 - DNA, 20 bp, Artificial Sequence
  chemically synthesized
ggtttcctgtggtatgttac

SEQ ID NO: 4040 - DNA, 20 bp, Artificial Sequence
  chemically synthesized
agtctcctggtaacatacca

SEQ ID NO: 4041 - DNA, 20 bp, Artificial Sequence
  chemically synthesized
gtctcctggtaacataccac

SEQ ID NO: 4042 - DNA, 20 bp, Artificial Sequence
  chemically synthesized
tattgcaaagaggtttcctg

SEQ ID NO: 4043 - DNA, 20 bp, Artificial Sequence
  chemically synthesized
ctgtacttaatattgcaaag

SEQ ID NO: 4044 - DNA, 20 bp, Artificial Sequence
  chemically synthesized
cctgtacttaatattgcaaa

SEQ ID NO: 4045 - DNA, 20 bp, Artificial Sequence
  chemically synthesized
ttcctgtacttaatattgca

SEQ ID NO: 4046 - DNA, 20 bp, Artificial Sequence
  chemically synthesized
ggaaacctctttgcaatatt

SEQ ID NO: 4047 - DNA, 20 bp, Artificial Sequence
  chemically synthesized
cctctttgcaatattaagta

SEQ ID NO: 4048 - DNA, 20 bp, Artificial Sequence
  chemically synthesized
ctctttgcaatattaagtac

SEQ ID NO: 4049 - DNA, 20 bp, Artificial Sequence
  chemically synthesized
gcaatattaagtacaggaaa

SEQ ID NO: 4050 - DNA, 20 bp, Artificial Sequence
  chemically synthesized
caatattaagtacaggaaat

SEQ ID NO: 4051 - DNA, 20 bp, Artificial Sequence
  chemically synthesized
agtacaggaaatgggtgctg

SEQ ID NO: 4052 - DNA, 20 bp, Artificial Sequence
  chemically synthesized
gaaatgggtgctgaagaatt

SEQ ID NO: 4053 - DNA, 20 bp, Artificial Sequence
  chemically synthesized
gctttgtgaccttaattctt

SEQ ID NO: 4054 - DNA, 20 bp, Artificial Sequence
  chemically synthesized
aaatgggtgctgaagaatta

SEQ ID NO: 4055 - DNA, 20 bp, Artificial Sequence
  chemically synthesized
gctgaagaattaaggtcaca

SEQ ID NO: 4056 - DNA, 20 bp, Artificial Sequence
  chemically synthesized
gaagaattaaggtcacaaag

SEQ ID NO: 4057 - DNA, 20 bp, Artificial Sequence
  chemically synthesized
attaaggtcacaaagcagaa

SEQ ID NO: 4058 - DNA, 20 bp, Artificial Sequence
  chemically synthesized
ttaaggtcacaaagcagaaa

SEQ ID NO: 4059 - DNA, 20 bp, Artificial Sequence
  chemically synthesized
gtcacaaagcagaaaaggaa

SEQ ID NO: 4060 - DNA, 20 bp, Artificial Sequence
  chemically synthesized
agagagaaagaggagagaga

SEQ ID NO: 4061 - DNA, 20 bp, Artificial Sequence
  chemically synthesized
agagagagaaagaggagaga

SEQ ID NO: 4062 - DNA, 20 bp, Artificial Sequence
  chemically synthesized
agagagagagaaagaggaga

SEQ ID NO: 4063 - DNA, 20 bp, Artificial Sequence
  chemically synthesized
gaagagagagagaaagagga

SEQ ID NO: 4064 - DNA, 20 bp, Artificial Sequence
  chemically synthesized
aggaagagagagagaaagag

SEQ ID NO: 4065 - DNA, 20 bp, Artificial Sequence
  chemically synthesized
ggaggaagagagagagaaag

SEQ ID NO: 4066 - DNA, 20 bp, Artificial Sequence
  chemically synthesized
gggaggaagagagagagaaa

SEQ ID NO: 4067 - DNA, 20 bp, Artificial Sequence
  chemically synthesized
gggggaggaagagagagaga

SEQ ID NO: 4068 - DNA, 20 bp, Artificial Sequence
  chemically synthesized
tgaggggggaggaagagaga

SEQ ID NO: 4069 - DNA, 20 bp, Artificial Sequence
  chemically synthesized
tgtgaggggggaggaagaga

SEQ ID NO: 4070 - DNA, 20 bp, Artificial Sequence
  chemically synthesized
tgtgtgaggggggaggaaga

SEQ ID NO: 4071 - DNA, 20 bp, Artificial Sequence
  chemically synthesized
tgtgtgtgaggggggaggaa

SEQ ID NO: 4072 - DNA, 20 bp, Artificial Sequence
  chemically synthesized
catgtgtgtgaggggggagg

SEQ ID NO: 4073 - DNA, 20 bp, Artificial Sequence
  chemically synthesized
gtgcatgtgtgtgagggggg

SEQ ID NO: 4074 - DNA, 20 bp, Artificial Sequence
  chemically synthesized
agtgcatgtgtgtgaggggg

SEQ ID NO: 4075 - DNA, 20 bp, Artificial Sequence
  chemically synthesized
atagtgcatgtgtgtgaggg

SEQ ID NO: 4076 - DNA, 20 bp, Artificial Sequence
  chemically synthesized
aatagtgcatgtgtgtgagg

SEQ ID NO: 4077 - DNA, 20 bp, Artificial Sequence
  chemically synthesized
aaatagtgcatgtgtgtgag

SEQ ID NO: 4078 - DNA, 20 bp, Artificial Sequence
  chemically synthesized
caaatagtgcatgtgtgtga

SEQ ID NO: 4079 - DNA, 20 bp, Artificial Sequence
  chemically synthesized
gcaaatagtgcatgtgtgtg

SEQ ID NO: 4080 - DNA, 20 bp, Artificial Sequence
  chemically synthesized
agcaaatagtgcatgtgtgt

SEQ ID NO: 4081 - DNA, 20 bp, Artificial Sequence
  chemically synthesized
cacacatgcactatttgctt

SEQ ID NO: 4082 - DNA, 20 bp, Artificial Sequence
  chemically synthesized
aaggcataaacttaagcaaa

SEQ ID NO: 4083 - DNA, 20 bp, Artificial Sequence
  chemically synthesized
ttttctaaaggcataaactt

SEQ ID NO: 4084 - DNA, 20 bp, Artificial Sequence
  chemically synthesized
tttgcttaagtttatgcctt

SEQ ID NO: 4085 - DNA, 20 bp, Artificial Sequence
  chemically synthesized
taagtttatgcctttagaaa

SEQ ID NO: 4086 - DNA, 20 bp, Artificial Sequence
  chemically synthesized
aatttcacttctttttctaa

SEQ ID NO: 4087 - DNA, 20 bp, Artificial Sequence
  chemically synthesized
gaatttcacttctttttcta

SEQ ID NO: 4088 - DNA, 20 bp, Artificial Sequence
  chemically synthesized
gtttatgcctttagaaaaag

SEQ ID NO: 4089 - DNA, 20 bp, Artificial Sequence
  chemically synthesized
gaagtgaaattcactatttt

SEQ ID NO: 4090 - DNA, 20 bp, Artificial Sequence
  chemically synthesized
aagaaaaatgaaactaaaaa

SEQ ID NO: 4091 - DNA, 20 bp, Artificial Sequence
  chemically synthesized
ttttagtttcatttttcttg

SEQ ID NO: 4092 - DNA, 20 bp, Artificial Sequence
  chemically synthesized
taatggtagtttaaaaccgc

SEQ ID NO: 4093 - DNA, 20 bp, Artificial Sequence
  chemically synthesized
tcatcttcaccagataatgg

SEQ ID NO: 4094 - DNA, 20 bp, Artificial Sequence
  chemically synthesized
ggttttaaactaccattatc

SEQ ID NO: 4095 - DNA, 20 bp, Artificial Sequence
  chemically synthesized
atttcatcttcaccagataa

SEQ ID NO: 4096 - DNA, 20 bp, Artificial Sequence
  chemically synthesized
taaactaccattatctggtg

SEQ ID NO: 4097 - DNA, 20 bp, Artificial Sequence
  chemically synthesized
ttcattcatttcatcttcac

SEQ ID NO: 4098 - DNA, 20 bp, Artificial Sequence
  chemically synthesized
gaaatgaatgaaatactacc

SEQ ID NO: 4099 - DNA, 20 bp, Artificial Sequence
  chemically synthesized
aatgaatgaaatactaccaa

SEQ ID NO: 4100 - DNA, 20 bp, Artificial Sequence
  chemically synthesized
atgaatgaaatactaccaag

SEQ ID NO: 4101 - DNA, 20 bp, Artificial Sequence
  chemically synthesized
caggatcttgatcctcttgg

SEQ ID NO: 4102 - DNA, 20 bp, Artificial Sequence
  chemically synthesized
tgtcaggatcttgatcctct

SEQ ID NO: 4103 - DNA, 20 bp, Artificial Sequence
  chemically synthesized
gaaatactaccaagaggatc

SEQ ID NO: 4104 - DNA, 20 bp, Artificial Sequence
  chemically synthesized
taatcagccctgcagttgtc

SEQ ID NO: 4105 - DNA, 20 bp, Artificial Sequence
  chemically synthesized
gatcaagatcctgacaactg

SEQ ID NO: 4106 - DNA, 20 bp, Artificial Sequence
  chemically synthesized
gtaatcagccctgcagttgt

SEQ ID NO: 4107 - DNA, 20 bp, Artificial Sequence
  chemically synthesized
atcaagatcctgacaactgc

SEQ ID NO: 4108 - DNA, 20 bp, Artificial Sequence
  chemically synthesized
tcaagatcctgacaactgca

SEQ ID NO: 4109 - DNA, 20 bp, Artificial Sequence
  chemically synthesized
gagagatgtaatcagccctg

SEQ ID NO: 4110 - DNA, 20 bp, Artificial Sequence
  chemically synthesized
atgaaacagagagatgtaat

SEQ ID NO: 4111 - DNA, 20 bp, Artificial Sequence
  chemically synthesized
tgcatcagtaatgaaacaga

SEQ ID NO: 4112 - DNA, 20 bp, Artificial Sequence
  chemically synthesized
tttgcatcagtaatgaaaca

SEQ ID NO: 4113 - DNA, 20 bp, Artificial Sequence
  chemically synthesized
aatttgcatcagtaatgaaa

SEQ ID NO: 4114 - DNA, 20 bp, Artificial Sequence
  chemically synthesized
agttccgcaaaaatttgcat

SEQ ID NO: 4115 - DNA, 20 bp, Artificial Sequence
  chemically synthesized
attactgatgcaaatttttg

SEQ ID NO: 4116 - DNA, 20 bp, Artificial Sequence
  chemically synthesized
gatgcaaatttttgcggaac

SEQ ID NO: 4117 - DNA, 20 bp, Artificial Sequence
  chemically synthesized
atgcaaatttttgcggaact

SEQ ID NO: 4118 - DNA, 20 bp, Artificial Sequence
  chemically synthesized
taaaaatgcctcatgtttcc

SEQ ID NO: 4119 - DNA, 20 bp, Artificial Sequence
  chemically synthesized
tttgcggaactgggaaacat

SEQ ID NO: 4120 - DNA, 20 bp, Artificial Sequence
  chemically synthesized
ttgcggaactgggaaacatg

SEQ ID NO: 4121 - DNA, 20 bp, Artificial Sequence
  chemically synthesized
gaaacatgaggcatttttaa

SEQ ID NO: 4122 - DNA, 20 bp, Artificial Sequence
  chemically synthesized
acatgaggcatttttaatgg

SEQ ID NO: 4123 - DNA, 20 bp, Artificial Sequence
  chemically synthesized
gaggcatttttaatggcagt

SEQ ID NO: 4124 - DNA, 20 bp, Artificial Sequence
  chemically synthesized
taatggcagtaagtccactt

SEQ ID NO: 4125 - DNA, 20 bp, Artificial Sequence
  chemically synthesized
gaggcatactgtcactgaag

SEQ ID NO: 4126 - DNA, 20 bp, Artificial Sequence
  chemically synthesized
cagtaagtccacttcagtga

SEQ ID NO: 4127 - DNA, 20 bp, Artificial Sequence
  chemically synthesized
agtgaggcatactgtcactg

SEQ ID NO: 4128 - DNA, 20 bp, Artificial Sequence
  chemically synthesized
tggttctgatttattcagtg

SEQ ID NO: 4129 - DNA, 20 bp, Artificial Sequence
  chemically synthesized
ttggttctgatttattcagt

SEQ ID NO: 4130 - DNA, 20 bp, Artificial Sequence
  chemically synthesized
gtatgcctcactgaataaat

SEQ ID NO: 4131 - DNA, 20 bp, Artificial Sequence
  chemically synthesized
tctcttggttctgatttatt

SEQ ID NO: 4132 - DNA, 20 bp, Artificial Sequence
  chemically synthesized
tcactgaataaatcagaacc

SEQ ID NO: 4133 - DNA, 20 bp, Artificial Sequence
  chemically synthesized
actgaataaatcagaaccaa

SEQ ID NO: 4134 - DNA, 20 bp, Artificial Sequence
  chemically synthesized
cgtcgttcatgatgttctct

SEQ ID NO: 4135 - DNA, 20 bp, Artificial Sequence
  chemically synthesized
atattaacatcgatgttcat

SEQ ID NO: 4136 - DNA, 20 bp, Artificial Sequence
  chemically synthesized
atcgatgttaatatttctga

SEQ ID NO: 4137 - DNA, 20 bp, Artificial Sequence
  chemically synthesized
atatgatgtaattaaactgt

SEQ ID NO: 4138 - DNA, 20 bp, Artificial Sequence
  chemically synthesized
acagtttaattacatcatat

SEQ ID NO: 4139 - DNA, 20 bp, Artificial Sequence
  chemically synthesized
agtttaattacatcatattg

SEQ ID NO: 4140 - DNA, 20 bp, Artificial Sequence
  chemically synthesized
attacatcatattggagctc

SEQ ID NO: 4141 - DNA, 20 bp, Artificial Sequence
  chemically synthesized
ttacatcatattggagctct

SEQ ID NO: 4142 - DNA, 20 bp, Artificial Sequence
  chemically synthesized
acagtacaattgagttccta

SEQ ID NO: 4143 - DNA, 20 bp, Artificial Sequence
  chemically synthesized
acacagtacaattgagttcc

SEQ ID NO: 4144 - DNA, 20 bp, Artificial Sequence
  chemically synthesized
aattttaacacagtacaatt

SEQ ID NO: 4145 - DNA, 20 bp, Artificial Sequence
  chemically synthesized
actgtacctgaattttaaca

SEQ ID NO: 4146 - DNA, 20 bp, Artificial Sequence
  chemically synthesized
aattgtactgtgttaaaatt

SEQ ID NO: 4147 - DNA, 20 bp, Artificial Sequence
  chemically synthesized
attgtactgtgttaaaattc

SEQ ID NO: 4148 - DNA, 20 bp, Artificial Sequence
  chemically synthesized
actgtgttaaaattcaggta

SEQ ID NO: 4149 - DNA, 20 bp, Artificial Sequence
  chemically synthesized
aattcaggtacagttcaatg

SEQ ID NO: 4150 - DNA, 20 bp, Artificial Sequence
  chemically synthesized
gtacagttcaatgaagtgac

SEQ ID NO: 4151 - DNA, 20 bp, Artificial Sequence
  chemically synthesized
taattcaggaacaggaatgc

SEQ ID NO: 4152 - DNA, 20 bp, Artificial Sequence
  chemically synthesized
ctttgaaataattcaggaac

SEQ ID NO: 4153 - DNA, 20 bp, Artificial Sequence
  chemically synthesized
tctttgaaataattcaggaa

SEQ ID NO: 4154 - DNA, 20 bp, Artificial Sequence
  chemically synthesized
tttgatctttgaaataattc

SEQ ID NO: 4155 - DNA, 20 bp, Artificial Sequence
  chemically synthesized
atttgatctttgaaataatt

SEQ ID NO: 4156 - DNA, 20 bp, Artificial Sequence
  chemically synthesized
cctgttcctgaattatttca

SEQ ID NO: 4157 - DNA, 20 bp, Artificial Sequence
  chemically synthesized
atttcaaagatcaaattata

SEQ ID NO: 4158 - DNA, 20 bp, Artificial Sequence
  chemically synthesized
taaacttggctgacatcatt

SEQ ID NO: 4159 - DNA, 20 bp, Artificial Sequence
  chemically synthesized
aagtataaacctaatgatgt

SEQ ID NO: 4160 - DNA, 20 bp, Artificial Sequence
  chemically synthesized
ataaacttggctgacatcat

SEQ ID NO: 4161 - DNA, 20 bp, Artificial Sequence
  chemically synthesized
taaacctaatgatgtcagcc

SEQ ID NO: 4162 - DNA, 20 bp, Artificial Sequence
  chemically synthesized
tttatctggaaaaataaact

SEQ ID NO: 4163 - DNA, 20 bp, Artificial Sequence
  chemically synthesized
gtcagccaagtttatttttc

SEQ ID NO: 4164 - DNA, 20 bp, Artificial Sequence
  chemically synthesized
agactcacagagagtttatc

SEQ ID NO: 4165 - DNA, 20 bp, Artificial Sequence
  chemically synthesized
tttccagataaactctctgt

SEQ ID NO: 4166 - DNA, 20 bp, Artificial Sequence
  chemically synthesized
tcatattaaagactcacaga

SEQ ID NO: 4167 - DNA, 20 bp, Artificial Sequence
  chemically synthesized
actcatattaaagactcaca

SEQ ID NO: 4168 - DNA, 20 bp, Artificial Sequence
  chemically synthesized
acactcatattaaagactca

SEQ ID NO: 4169 - DNA, 20 bp, Artificial Sequence
  chemically synthesized
tctctgtgagtctttaatat

SEQ ID NO: 4170 - DNA, 20 bp, Artificial Sequence
  chemically synthesized
atacttggacactcatatta

SEQ ID NO: 4171 - DNA, 20 bp, Artificial Sequence
  chemically synthesized
agtctttaatatgagtgtcc

SEQ ID NO: 4172 - DNA, 20 bp, Artificial Sequence
  chemically synthesized
ttttacatttgtattatact

SEQ ID NO: 4173 - DNA, 20 bp, Artificial Sequence
  chemically synthesized
gtataatacaaatgtaaaat

SEQ ID NO: 4174 - DNA, 20 bp, Artificial Sequence
  chemically synthesized
agttttccattaaagcaaag

SEQ ID NO: 4175 - DNA, 20 bp, Artificial Sequence
  chemically synthesized
aaaagttttccattaaagca

SEQ ID NO: 4176 - DNA, 20 bp, Artificial Sequence
  chemically synthesized
aattggcttctttgctttaa

SEQ ID NO: 4177 - DNA, 20 bp, Artificial Sequence
  chemically synthesized
gccttaaaagttttccatta

SEQ ID NO: 4178 - DNA, 20 bp, Artificial Sequence
  chemically synthesized
tgctttaatggaaaactttt

SEQ ID NO: 4179 - DNA, 20 bp, Artificial Sequence
  chemically synthesized
gctttaatggaaaactttta

SEQ ID NO: 4180 - DNA, 20 bp, Artificial Sequence
  chemically synthesized
ttaatggaaaacttttaagg

SEQ ID NO: 4181 - DNA, 20 bp, Artificial Sequence
  chemically synthesized
tacaattatcactgccttaa

SEQ ID NO: 4182 - DNA, 20 bp, Artificial Sequence
  chemically synthesized
cagtgataattgtatccatt

SEQ ID NO: 4183 - DNA, 20 bp, Artificial Sequence
  chemically synthesized
cactcaaaaaaatgtctgaa

SEQ ID NO: 4184 - DNA, 20 bp, Artificial Sequence
  chemically synthesized
atccattcagacattttttt

SEQ ID NO: 4185 - DNA, 20 bp, Artificial Sequence
  chemically synthesized
tatactacctagaatgtaat

SEQ ID NO: 4186 - DNA, 20 bp, Artificial Sequence
  chemically synthesized
ttatactacctagaatgtaa

SEQ ID NO: 4187 - DNA, 20 bp, Artificial Sequence
  chemically synthesized
tttgagtgcctattacattc

SEQ ID NO: 4188 - DNA, 20 bp, Artificial Sequence
  chemically synthesized
ttgagtgcctattacattct

SEQ ID NO: 4189 - DNA, 20 bp, Artificial Sequence
  chemically synthesized
agtgcctattacattctagg

SEQ ID NO: 4190 - DNA, 20 bp, Artificial Sequence
  chemically synthesized
ctacttgtttttatactacc

SEQ ID NO: 4191 - DNA, 20 bp, Artificial Sequence
  chemically synthesized
attctaggtagtataaaaac

SEQ ID NO: 4192 - DNA, 20 bp, Artificial Sequence
  chemically synthesized
ctaggtagtataaaaacaag

SEQ ID NO: 4193 - DNA, 20 bp, Artificial Sequence
  chemically synthesized
aggtagtataaaaacaagta

SEQ ID NO: 4194 - DNA, 20 bp, Artificial Sequence
  chemically synthesized
tatggagaaaagaagaaaac

SEQ ID NO: 4195 - DNA, 20 bp, Artificial Sequence
  chemically synthesized
catgaaaatatggagaaaag

SEQ ID NO: 4196 - DNA, 20 bp, Artificial Sequence
  chemically synthesized
aatcatgaaaatatggagaa

SEQ ID NO: 4197 - DNA, 20 bp, Artificial Sequence
  chemically synthesized
tgagaaatcatgaaaatatg

SEQ ID NO: 4198 - DNA, 20 bp, Artificial Sequence
  chemically synthesized
cttgagaaatcatgaaaata

SEQ ID NO: 4199 - DNA, 20 bp, Artificial Sequence
  chemically synthesized
ccatattttcatgatttctc

SEQ ID NO: 4200 - DNA, 20 bp, Artificial Sequence
  chemically synthesized
attttcatgatttctcaaga

SEQ ID NO: 4201 - DNA, 20 bp, Artificial Sequence
  chemically synthesized
caatgcattaaaaccatctt

SEQ ID NO: 4202 - DNA, 20 bp, Artificial Sequence
  chemically synthesized
aaaaaagaaaaagagaaaaa

SEQ ID NO: 4203 - DNA, 20 bp, Artificial Sequence
  chemically synthesized
atctcaaaaaaaaagaaaaa

SEQ ID NO: 4204 - DNA, 20 bp, Artificial Sequence
  chemically synthesized
ccatctcaaaaaaaaagaaa

SEQ ID NO: 4205 - DNA, 20 bp, Artificial Sequence
  chemically synthesized
ttctctttttcttttttttt

SEQ ID NO: 4206 - DNA, 20 bp, Artificial Sequence
  chemically synthesized
aagactccatctcaaaaaaa

SEQ ID NO: 4207 - DNA, 20 bp, Artificial Sequence
  chemically synthesized
ctttttctttttttttgaga

SEQ ID NO: 4208 - DNA, 20 bp, Artificial Sequence
  chemically synthesized
ttttctttttttttgagatg

SEQ ID NO: 4209 - DNA, 20 bp, Artificial Sequence
  chemically synthesized
tccagcctgggtgacagagc

SEQ ID NO: 4210 - DNA, 20 bp, Artificial Sequence
  chemically synthesized
tggagtcttgctctgtcacc

SEQ ID NO: 4211 - DNA, 20 bp, Artificial Sequence
  chemically synthesized
gcactccagcctgggtgaca

SEQ ID NO: 4212 - DNA, 20 bp, Artificial Sequence
  chemically synthesized
ggagtcttgctctgtcaccc

SEQ ID NO: 4213 - DNA, 20 bp, Artificial Sequence
  chemically synthesized
ctgcactccagcctgggtga

SEQ ID NO: 4214 - DNA, 20 bp, Artificial Sequence
  chemically synthesized
tcttgctctgtcacccaggc

SEQ ID NO: 4215 - DNA, 20 bp, Artificial Sequence
  chemically synthesized
ttgctctgtcacccaggctg

SEQ ID NO: 4216 - DNA, 20 bp, Artificial Sequence
  chemically synthesized
ccaccactgcactccagcct

SEQ ID NO: 4217 - DNA, 20 bp, Artificial Sequence
  chemically synthesized
tccaccactgcactccagcc

SEQ ID NO: 4218 - DNA, 20 bp, Artificial Sequence
  chemically synthesized
ctgtcacccaggctggagtg

SEQ ID NO: 4219 - DNA, 20 bp, Artificial Sequence
  chemically synthesized
gagattccaccactgcactc

SEQ ID NO: 4220 - DNA, 20 bp, Artificial Sequence
  chemically synthesized
tcacccaggctggagtgcag

SEQ ID NO: 4221 - DNA, 20 bp, Artificial Sequence
  chemically synthesized
cccaggctggagtgcagtgg

SEQ ID NO: 4222 - DNA, 20 bp, Artificial Sequence
  chemically synthesized
ggagtgcagtggtggaatct

SEQ ID NO: 4223 - DNA, 20 bp, Artificial Sequence
  chemically synthesized
tgcagtggtggaatctcggc

SEQ ID NO: 4224 - DNA, 20 bp, Artificial Sequence
  chemically synthesized
ggcagaggttgcagctagcc

SEQ ID NO: 4225 - DNA, 20 bp, Artificial Sequence
  chemically synthesized
cggaaggcagaggttgcagc

SEQ ID NO: 4226 - DNA, 20 bp, Artificial Sequence
  chemically synthesized
aacccggaaggcagaggttg

SEQ ID NO: 4227 - DNA, 20 bp, Artificial Sequence
  chemically synthesized
cacttgaacccggaaggcag

SEQ ID NO: 4228 - DNA, 20 bp, Artificial Sequence
  chemically synthesized
tagctgcaacctctgccttc

SEQ ID NO: 4229 - DNA, 20 bp, Artificial Sequence
  chemically synthesized
tcacttgaacccggaaggca

SEQ ID NO: 4230 - DNA, 20 bp, Artificial Sequence
  chemically synthesized
agctgcaacctctgccttcc

SEQ ID NO: 4231 - DNA, 20 bp, Artificial Sequence
  chemically synthesized
aatcacttgaacccggaagg

SEQ ID NO: 4232 - DNA, 20 bp, Artificial Sequence
  chemically synthesized
gagaatcacttgaacccgga

SEQ ID NO: 4233 - DNA, 20 bp, Artificial Sequence
  chemically synthesized
ggagaatcacttgaacccgg

SEQ ID NO: 4234 - DNA, 20 bp, Artificial Sequence
  chemically synthesized
aacctctgccttccgggttc

SEQ ID NO: 4235 - DNA, 20 bp, Artificial Sequence
  chemically synthesized
gcaggagaatcacttgaacc

SEQ ID NO: 4236 - DNA, 20 bp, Artificial Sequence
  chemically synthesized
ttcaagtgattctcctgcct

SEQ ID NO: 4237 - DNA, 20 bp, Artificial Sequence
  chemically synthesized
tactcaggaggctgaggcag

SEQ ID NO: 4238 - DNA, 20 bp, Artificial Sequence
  chemically synthesized
gctactcaggaggctgaggc

SEQ ID NO: 4239 - DNA, 20 bp, Artificial Sequence
  chemically synthesized
agctactcaggaggctgagg

SEQ ID NO: 4240 - DNA, 20 bp, Artificial Sequence
  chemically synthesized
cccagctactcaggaggctg

SEQ ID NO: 4241 - DNA, 20 bp, Artificial Sequence
  chemically synthesized
tcccagctactcaggaggct

SEQ ID NO: 4242 - DNA, 20 bp, Artificial Sequence
  chemically synthesized
ttctcctgcctcagcctcct

SEQ ID NO: 4243 - DNA, 20 bp, Artificial Sequence
  chemically synthesized
tcctgcctcagcctcctgag

SEQ ID NO: 4244 - DNA, 20 bp, Artificial Sequence
  chemically synthesized
tgtagtcccagctactcagg

SEQ ID NO: 4245 - DNA, 20 bp, Artificial Sequence
  chemically synthesized
ctgtagtcccagctactcag

SEQ ID NO: 4246 - DNA, 20 bp, Artificial Sequence
  chemically synthesized
gcctcagcctcctgagtagc

SEQ ID NO: 4247 - DNA, 20 bp, Artificial Sequence
  chemically synthesized
gcctgtagtcccagctactc

SEQ ID NO: 4248 - DNA, 20 bp, Artificial Sequence
  chemically synthesized
cctcagcctcctgagtagct

SEQ ID NO: 4249 - DNA, 20 bp, Artificial Sequence
  chemically synthesized
cgcctgtagtcccagctact

SEQ ID NO: 4250 - DNA, 20 bp, Artificial Sequence
  chemically synthesized
ctcctgagtagctgggacta

SEQ ID NO: 4251 - DNA, 20 bp, Artificial Sequence
  chemically synthesized
tcctgagtagctgggactac

SEQ ID NO: 4252 - DNA, 20 bp, Artificial Sequence
  chemically synthesized
gtggcacgcgcctgtagtcc

SEQ ID NO: 4253 - DNA, 20 bp, Artificial Sequence
  chemically synthesized
ggcgtggtggcacgcgcctg

SEQ ID NO: 4254 - DNA, 20 bp, Artificial Sequence
  chemically synthesized
caggcgcgtgccaccacgcc

SEQ ID NO: 4255 - DNA, 20 bp, Artificial Sequence
  chemically synthesized
aaaaaattagccaggcgtgg

SEQ ID NO: 4256 - DNA, 20 bp, Artificial Sequence
  chemically synthesized
tataaaaaattagccaggcg

SEQ ID NO: 4257 - DNA, 20 bp, Artificial Sequence
  chemically synthesized
aaaaatataaaaaattagcc

SEQ ID NO: 4258 - DNA, 20 bp, Artificial Sequence
  chemically synthesized
aaaaaatataaaaaattagc

SEQ ID NO: 4259 - DNA, 20 bp, Artificial Sequence
  chemically synthesized
tactaaaaaatataaaaaat

SEQ ID NO: 4260 - DNA, 20 bp, Artificial Sequence
  chemically synthesized
ggctaattttttatattttt

SEQ ID NO: 4261 - DNA, 20 bp, Artificial Sequence
  chemically synthesized
taattttttatattttttag

SEQ ID NO: 4262 - DNA, 20 bp, Artificial Sequence
  chemically synthesized
attttttatattttttagta

SEQ ID NO: 4263 - DNA, 20 bp, Artificial Sequence
  chemically synthesized
tttatattttttagtagaga

SEQ ID NO: 4264 - DNA, 20 bp, Artificial Sequence
  chemically synthesized
ttatattttttagtagagac

SEQ ID NO: 4265 - DNA, 20 bp, Artificial Sequence
  chemically synthesized
tatattttttagtagagaca

SEQ ID NO: 4266 - DNA, 20 bp, Artificial Sequence
  chemically synthesized
gagacagggtttcaccgtgt

SEQ ID NO: 4267 - DNA, 20 bp, Artificial Sequence
  chemically synthesized
cagggtttcaccgtgttagc

SEQ ID NO: 4268 - DNA, 20 bp, Artificial Sequence
  chemically synthesized
tgagactattctggctaaca

SEQ ID NO: 4269 - DNA, 20 bp, Artificial Sequence
  chemically synthesized
tttcaccgtgttagccagaa

SEQ ID NO: 4270 - DNA, 20 bp, Artificial Sequence
  chemically synthesized
tcaggagattgagactattc

SEQ ID NO: 4271 - DNA, 20 bp, Artificial Sequence
  chemically synthesized
gatcacgaggtcaggagatt

SEQ ID NO: 4272 - DNA, 20 bp, Artificial Sequence
  chemically synthesized
caggtggatcacgaggtcag

SEQ ID NO: 4273 - DNA, 20 bp, Artificial Sequence
  chemically synthesized
ggcaggtggatcacgaggtc

SEQ ID NO: 4274 - DNA, 20 bp, Artificial Sequence
  chemically synthesized
aggcaggtggatcacgaggt

SEQ ID NO: 4275 - DNA, 20 bp, Artificial Sequence
  chemically synthesized
gccgaggcaggtggatcacg

SEQ ID NO: 4276 - DNA, 20 bp, Artificial Sequence
  chemically synthesized
ggccgaggcaggtggatcac

SEQ ID NO: 4277 - DNA, 20 bp, Artificial Sequence
  chemically synthesized
acctcgtgatccacctgcct

SEQ ID NO: 4278 - DNA, 20 bp, Artificial Sequence
  chemically synthesized
ctttgggaggccgaggcagg

SEQ ID NO: 4279 - DNA, 20 bp, Artificial Sequence
  chemically synthesized
gcactttgggaggccgaggc

SEQ ID NO: 4280 - DNA, 20 bp, Artificial Sequence
  chemically synthesized
agcactttgggaggccgagg

SEQ ID NO: 4281 - DNA, 20 bp, Artificial Sequence
  chemically synthesized
cccagcactttgggaggccg

SEQ ID NO: 4282 - DNA, 20 bp, Artificial Sequence
  chemically synthesized
tcccagcactttgggaggcc

SEQ ID NO: 4283 - DNA, 20 bp, Artificial Sequence
  chemically synthesized
ccacctgcctcggcctccca

SEQ ID NO: 4284 - DNA, 20 bp, Artificial Sequence
  chemically synthesized
tgtaatcccagcactttggg

SEQ ID NO: 4285 - DNA, 20 bp, Artificial Sequence
  chemically synthesized
ctgtaatcccagcactttgg

SEQ ID NO: 4286 - DNA, 20 bp, Artificial Sequence
  chemically synthesized
gcctcggcctcccaaagtgc

SEQ ID NO: 4287 - DNA, 20 bp, Artificial Sequence
  chemically synthesized
gcctgtaatcccagcacttt

SEQ ID NO: 4288 - DNA, 20 bp, Artificial Sequence
  chemically synthesized
cctcggcctcccaaagtgct

SEQ ID NO: 4289 - DNA, 20 bp, Artificial Sequence
  chemically synthesized
cgcctgtaatcccagcactt

SEQ ID NO: 4290 - DNA, 20 bp, Artificial Sequence
  chemically synthesized
ctcccaaagtgctgggatta

SEQ ID NO: 4291 - DNA, 20 bp, Artificial Sequence
  chemically synthesized
tcccaaagtgctgggattac

SEQ ID NO: 4292 - DNA, 20 bp, Artificial Sequence
  chemically synthesized
gtggctcacgcctgtaatcc

SEQ ID NO: 4293 - DNA, 20 bp, Artificial Sequence
  chemically synthesized
agtgctgggattacaggcgt

SEQ ID NO: 4294 - DNA, 20 bp, Artificial Sequence
  chemically synthesized
caggcgtgagccaccacgcc

SEQ ID NO: 4295 - DNA, 20 bp, Artificial Sequence
  chemically synthesized
agagatgagcctgggcgtgg

SEQ ID NO: 4296 - DNA, 20 bp, Artificial Sequence
  chemically synthesized
aggcgtgagccaccacgccc

SEQ ID NO: 4297 - DNA, 20 bp, Artificial Sequence
  chemically synthesized
aaaagagatgagcctgggcg

SEQ ID NO: 4298 - DNA, 20 bp, Artificial Sequence
  chemically synthesized
tcttaaaaagagatgagcct

SEQ ID NO: 4299 - DNA, 20 bp, Artificial Sequence
  chemically synthesized
ttcttaaaaagagatgagcc

SEQ ID NO: 4300 - DNA, 20 bp, Artificial Sequence
  chemically synthesized
ttcgattcttaaaaagagat

SEQ ID NO: 4301 - DNA, 20 bp, Artificial Sequence
  chemically synthesized
gcccaggctcatctcttttt

SEQ ID NO: 4302 - DNA, 20 bp, Artificial Sequence
  chemically synthesized
ctgatttcgattcttaaaaa

SEQ ID NO: 4303 - DNA, 20 bp, Artificial Sequence
  chemically synthesized
gtctgatttcgattcttaaa

SEQ ID NO: 4304 - DNA, 20 bp, Artificial Sequence
  chemically synthesized
ctctttttaagaatcgaaat

SEQ ID NO: 4305 - DNA, 20 bp, Artificial Sequence
  chemically synthesized
cagacatcacatatgtgcat

SEQ ID NO: 4306 - DNA, 20 bp, Artificial Sequence
  chemically synthesized
acatcacatatgtgcatgag

SEQ ID NO: 4307 - DNA, 20 bp, Artificial Sequence
  chemically synthesized
tcacatatgtgcatgagtag

SEQ ID NO: 4308 - DNA, 20 bp, Artificial Sequence
  chemically synthesized
ggcattaagcatttttcaat

SEQ ID NO: 4309 - DNA, 20 bp, Artificial Sequence
  chemically synthesized
cacagaaaatattaggcatt

SEQ ID NO: 4310 - DNA, 20 bp, Artificial Sequence
  chemically synthesized
attctgacacagaaaatatt

SEQ ID NO: 4311 - DNA, 20 bp, Artificial Sequence
  chemically synthesized
tattctgacacagaaaatat

SEQ ID NO: 4312 - DNA, 20 bp, Artificial Sequence
  chemically synthesized
atgcctaatattttctgtgt

SEQ ID NO: 4313 - DNA, 20 bp, Artificial Sequence
  chemically synthesized
ttttacaatatattctgaca

SEQ ID NO: 4314 - DNA, 20 bp, Artificial Sequence
  chemically synthesized
tgtgtcagaatatattgtaa

SEQ ID NO: 4315 - DNA, 20 bp, Artificial Sequence
  chemically synthesized
atatattgtaaaagttaaaa

SEQ ID NO: 4316 - DNA, 20 bp, Artificial Sequence
  chemically synthesized
ctttaacttcaggtttcatt

SEQ ID NO: 4317 - DNA, 20 bp, Artificial Sequence
  chemically synthesized
aaacagctaaatgaaacctg

SEQ ID NO: 4318 - DNA, 20 bp, Artificial Sequence
  chemically synthesized
ctaaatgaaacctgaagtta

SEQ ID NO: 4319 - DNA, 20 bp, Artificial Sequence
  chemically synthesized
aatggtattactttaacttc

SEQ ID NO: 4320 - DNA, 20 bp, Artificial Sequence
  chemically synthesized
caatggtattactttaactt

SEQ ID NO: 4321 - DNA, 20 bp, Artificial Sequence
  chemically synthesized
gttagtatcaaatattacaa

SEQ ID NO: 4322 - DNA, 20 bp, Artificial Sequence
  chemically synthesized
tgtaatatttgatactaacc

SEQ ID NO: 4323 - DNA, 20 bp, Artificial Sequence
  chemically synthesized
ggcattttaaaaatctgggt

SEQ ID NO: 4324 - DNA, 20 bp, Artificial Sequence
  chemically synthesized
aaaaggcattttaaaaatct

SEQ ID NO: 4325 - DNA, 20 bp, Artificial Sequence
  chemically synthesized
taaaaggcattttaaaaatc

SEQ ID NO: 4326 - DNA, 20 bp, Artificial Sequence
  chemically synthesized
aaacttttgtggtttttaaa

SEQ ID NO: 4327 - DNA, 20 bp, Artificial Sequence
  chemically synthesized
taaacttttgtggtttttaa

SEQ ID NO: 4328 - DNA, 20 bp, Artificial Sequence
  chemically synthesized
atgccttttaaaaaccacaa

SEQ ID NO: 4329 - DNA, 20 bp, Artificial Sequence
  chemically synthesized
ttactgtttttaaacttttg

SEQ ID NO: 4330 - DNA, 20 bp, Artificial Sequence
  chemically synthesized
aaaccacaaaagtttaaaaa

SEQ ID NO: 4331 - DNA, 20 bp, Artificial Sequence
  chemically synthesized
cacaaaagtttaaaaacagt

SEQ ID NO: 4332 - DNA, 20 bp, Artificial Sequence
  chemically synthesized
cagtgcctggcatatatagt

SEQ ID NO: 4333 - DNA, 20 bp, Artificial Sequence
  chemically synthesized
taaaatccaactatatatgc

SEQ ID NO: 4334 - DNA, 20 bp, Artificial Sequence
  chemically synthesized
tgaacagtgcctggcatata

SEQ ID NO: 4335 - DNA, 20 bp, Artificial Sequence
  chemically synthesized
aaaatccaactatatatgcc

SEQ ID NO: 4336 - DNA, 20 bp, Artificial Sequence
  chemically synthesized
tcaaccatttgaacagtgcc

SEQ ID NO: 4337 - DNA, 20 bp, Artificial Sequence
  chemically synthesized
tatgccaggcactgttcaaa

SEQ ID NO: 4338 - DNA, 20 bp, Artificial Sequence
  chemically synthesized
gcactgttcaaccatttgaa

SEQ ID NO: 4339 - DNA, 20 bp, Artificial Sequence
  chemically synthesized
gcactgttcaaatggttgaa

SEQ ID NO: 4340 - DNA, 20 bp, Artificial Sequence
  chemically synthesized
tcaaatggttgaacagtgcc

SEQ ID NO: 4341 - DNA, 20 bp, Artificial Sequence
  chemically synthesized
tcttcagtgaacaatatgcc

SEQ ID NO: 4342 - DNA, 20 bp, Artificial Sequence
  chemically synthesized
atcttcagtgaacaatatgc

SEQ ID NO: 4343 - DNA, 20 bp, Artificial Sequence
  chemically synthesized
gcctggcatattgttcactg

SEQ ID NO: 4344 - DNA, 20 bp, Artificial Sequence
  chemically synthesized
catattgttcactgaagata

SEQ ID NO: 4345 - DNA, 20 bp, Artificial Sequence
  chemically synthesized
tttgcttattgctatatctt

SEQ ID NO: 4346 - DNA, 20 bp, Artificial Sequence
  chemically synthesized
ttcactgaagatatagcaat

SEQ ID NO: 4347 - DNA, 20 bp, Artificial Sequence
  chemically synthesized
acagagagagtgtgtgggtg

SEQ ID NO: 4348 - DNA, 20 bp, Artificial Sequence
  chemically synthesized
cacagagagagtgtgtgggt

SEQ ID NO: 4349 - DNA, 20 bp, Artificial Sequence
  chemically synthesized
tcacagagagagtgtgtggg

SEQ ID NO: 4350 - DNA, 20 bp, Artificial Sequence
  chemically synthesized
gtttcacagagagagtgtgt

SEQ ID NO: 4351 - DNA, 20 bp, Artificial Sequence
  chemically synthesized
agtttcacagagagagtgtg

SEQ ID NO: 4352 - DNA, 20 bp, Artificial Sequence
  chemically synthesized
gaatgcgagtttcacagaga

SEQ ID NO: 4353 - DNA, 20 bp, Artificial Sequence
  chemically synthesized
atgaatgcgagtttcacaga

SEQ ID NO: 4354 - DNA, 20 bp, Artificial Sequence
  chemically synthesized
ttatgaatgcgagtttcaca

SEQ ID NO: 4355 - DNA, 20 bp, Artificial Sequence
  chemically synthesized
ccttatgaatgcgagtttca

SEQ ID NO: 4356 - DNA, 20 bp, Artificial Sequence
  chemically synthesized
gtgtgcctccttatgaatgc

SEQ ID NO: 4357 - DNA, 20 bp, Artificial Sequence
  chemically synthesized
tctgtgaaactcgcattcat

SEQ ID NO: 4358 - DNA, 20 bp, Artificial Sequence
  chemically synthesized
ctgtgaaactcgcattcata

SEQ ID NO: 4359 - DNA, 20 bp, Artificial Sequence
  chemically synthesized
gtgaaactcgcattcataag

SEQ ID NO: 4360 - DNA, 20 bp, Artificial Sequence
  chemically synthesized
tgaaactcgcattcataagg

SEQ ID NO: 4361 - DNA, 20 bp, Artificial Sequence
  chemically synthesized
cgcattcataaggaggcaca

SEQ ID NO: 4362 - DNA, 20 bp, Artificial Sequence
  chemically synthesized
gcattcataaggaggcacac

SEQ ID NO: 4363 - DNA, 20 bp, Artificial Sequence
  chemically synthesized
aggaggcacacaggcttaac

SEQ ID NO: 4364 - DNA, 20 bp, Artificial Sequence
  chemically synthesized
agtttacttatttacttgtt

SEQ ID NO: 4365 - DNA, 20 bp, Artificial Sequence
  chemically synthesized
cacaggcttaacaagtaaat

SEQ ID NO: 4366 - DNA, 20 bp, Artificial Sequence
  chemically synthesized
aagtaaataagtaaactata

SEQ ID NO: 4367 - DNA, 20 bp, Artificial Sequence
  chemically synthesized
agtaaataagtaaactatat

SEQ ID NO: 4368 - DNA, 20 bp, Artificial Sequence
  chemically synthesized
caccactcaagatacctata

SEQ ID NO: 4369 - DNA, 20 bp, Artificial Sequence
  chemically synthesized
gtaaactatataggtatctt

SEQ ID NO: 4370 - DNA, 20 bp, Artificial Sequence
  chemically synthesized
aactatataggtatcttgag

SEQ ID NO: 4371 - DNA, 20 bp, Artificial Sequence
  chemically synthesized
cagagtgttcatcaccactc

SEQ ID NO: 4372 - DNA, 20 bp, Artificial Sequence
  chemically synthesized
tgagtggtgatgaacactct

SEQ ID NO: 4373 - DNA, 20 bp, Artificial Sequence
  chemically synthesized
gagtggtgatgaacactctg

SEQ ID NO: 4374 - DNA, 20 bp, Artificial Sequence
  chemically synthesized
gtggtgatgaacactctgag

SEQ ID NO: 4375 - DNA, 20 bp, Artificial Sequence
  chemically synthesized
ggtgatgaacactctgagga

SEQ ID NO: 4376 - DNA, 20 bp, Artificial Sequence
  chemically synthesized
gtgatgaacactctgaggag

SEQ ID NO: 4377 - DNA, 20 bp, Artificial Sequence
  chemically synthesized
ccttgctagccctctcctca

SEQ ID NO: 4378 - DNA, 20 bp, Artificial Sequence
  chemically synthesized
tgatgaacactctgaggaga

SEQ ID NO: 4379 - DNA, 20 bp, Artificial Sequence
  chemically synthesized
tcccttgctagccctctcct

SEQ ID NO: 4380 - DNA, 20 bp, Artificial Sequence
  chemically synthesized
gaacactctgaggagagggc

SEQ ID NO: 4381 - DNA, 20 bp, Artificial Sequence
  chemically synthesized
actctgaggagagggctagc

SEQ ID NO: 4382 - DNA, 20 bp, Artificial Sequence
  chemically synthesized
ctctgaggagagggctagca

SEQ ID NO: 4383 - DNA, 20 bp, Artificial Sequence
  chemically synthesized
tctgaggagagggctagcaa

SEQ ID NO: 4384 - DNA, 20 bp, Artificial Sequence
  chemically synthesized
tgactctcattgtcccttgc

SEQ ID NO: 4385 - DNA, 20 bp, Artificial Sequence
  chemically synthesized
gagggctagcaagggacaat

SEQ ID NO: 4386 - DNA, 20 bp, Artificial Sequence
  chemically synthesized
gggctagcaagggacaatga

SEQ ID NO: 4387 - DNA, 20 bp, Artificial Sequence
  chemically synthesized
caagggacaatgagagtcat

SEQ ID NO: 4388 - DNA, 20 bp, Artificial Sequence
  chemically synthesized
ggacaatgagagtcatcaga

SEQ ID NO: 4389 - DNA, 20 bp, Artificial Sequence
  chemically synthesized
caatgagagtcatcagaaag

SEQ ID NO: 4390 - DNA, 20 bp, Artificial Sequence
  chemically synthesized
atgagagtcatcagaaagtg

SEQ ID NO: 4391 - DNA, 20 bp, Artificial Sequence
  chemically synthesized
gtcatcagaaagtggagtct

SEQ ID NO: 4392 - DNA, 20 bp, Artificial Sequence
  chemically synthesized
atcagaaagtggagtcttgg

SEQ ID NO: 4393 - DNA, 20 bp, Artificial Sequence
  chemically synthesized
tctcatcaatgaggacttcc

SEQ ID NO: 4394 - DNA, 20 bp, Artificial Sequence
  chemically synthesized
tcttggaagtcctcattgat

SEQ ID NO: 4395 - DNA, 20 bp, Artificial Sequence
  chemically synthesized
tcaactgcatctcatcaatg

SEQ ID NO: 4396 - DNA, 20 bp, Artificial Sequence
  chemically synthesized
ctcaactgcatctcatcaat

SEQ ID NO: 4397 - DNA, 20 bp, Artificial Sequence
  chemically synthesized
aagtcctcattgatgagatg

SEQ ID NO: 4398 - DNA, 20 bp, Artificial Sequence
  chemically synthesized
ctcattgatgagatgcagtt

SEQ ID NO: 4399 - DNA, 20 bp, Artificial Sequence
  chemically synthesized
gatgagatgcagttgagcaa

SEQ ID NO: 4400 - DNA, 20 bp, Artificial Sequence
  chemically synthesized
tgcagttgagcaaaagcttt

SEQ ID NO: 4401 - DNA, 20 bp, Artificial Sequence
  chemically synthesized
tgagcaaaagctttaagaac

SEQ ID NO: 4402 - DNA, 20 bp, Artificial Sequence
  chemically synthesized
ctcataccctccagttctta

SEQ ID NO: 4403 - DNA, 20 bp, Artificial Sequence
  chemically synthesized
agcaaaagctttaagaactg

SEQ ID NO: 4404 - DNA, 20 bp, Artificial Sequence
  chemically synthesized
gcaaaagctttaagaactgg

SEQ ID NO: 4405 - DNA, 20 bp, Artificial Sequence
  chemically synthesized
caaaagctttaagaactgga

SEQ ID NO: 4406 - DNA, 20 bp, Artificial Sequence
  chemically synthesized
cttgtgcaactcataccctc

SEQ ID NO: 4407 - DNA, 20 bp, Artificial Sequence
  chemically synthesized
ctttaagaactggagggtat

SEQ ID NO: 4408 - DNA, 20 bp, Artificial Sequence
  chemically synthesized
ctggagggtatgagttgcac

SEQ ID NO: 4409 - DNA, 20 bp, Artificial Sequence
  chemically synthesized
tatgagttgcacaagtattt

SEQ ID NO: 4410 - DNA, 20 bp, Artificial Sequence
  chemically synthesized
atgagttgcacaagtatttg

SEQ ID NO: 4411 - DNA, 20 bp, Artificial Sequence
  chemically synthesized
tgagttgcacaagtatttga

SEQ ID NO: 4412 - DNA, 20 bp, Artificial Sequence
  chemically synthesized
tgcacaagtatttgagggaa

SEQ ID NO: 4413 - DNA, 20 bp, Artificial Sequence
  chemically synthesized
tatttgagggaaaagtgctc

SEQ ID NO: 4414 - DNA, 20 bp, Artificial Sequence
  chemically synthesized
tgagggaaaagtgctccaga

SEQ ID NO: 4415 - DNA, 20 bp, Artificial Sequence
  chemically synthesized
gggaaaagtgctccagacag

SEQ ID NO: 4416 - DNA, 20 bp, Artificial Sequence
  chemically synthesized
tttgccaatccttctgtctg

SEQ ID NO: 4417 - DNA, 20 bp, Artificial Sequence
  chemically synthesized
ggaaaagtgctccagacaga

SEQ ID NO: 4418 - DNA, 20 bp, Artificial Sequence
  chemically synthesized
catttgccaatccttctgtc

SEQ ID NO: 4419 - DNA, 20 bp, Artificial Sequence
  chemically synthesized
agtgctccagacagaaggat

SEQ ID NO: 4420 - DNA, 20 bp, Artificial Sequence
  chemically synthesized
cagaaggattggcaaatgca

SEQ ID NO: 4421 - DNA, 20 bp, Artificial Sequence
  chemically synthesized
ttggcaaatgcaaagactct

SEQ ID NO: 4422 - DNA, 20 bp, Artificial Sequence
  chemically synthesized
ggcaaatgcaaagactctga

SEQ ID NO: 4423 - DNA, 20 bp, Artificial Sequence
  chemically synthesized
gcaaatgcaaagactctgag

SEQ ID NO: 4424 - DNA, 20 bp, Artificial Sequence
  chemically synthesized
aaatgcaaagactctgagag

SEQ ID NO: 4425 - DNA, 20 bp, Artificial Sequence
  chemically synthesized
ccagtcacactctcctctca

SEQ ID NO: 4426 - DNA, 20 bp, Artificial Sequence
  chemically synthesized
atgcaaagactctgagagga

SEQ ID NO: 4427 - DNA, 20 bp, Artificial Sequence
  chemically synthesized
agccagtcacactctcctct

SEQ ID NO: 4428 - DNA, 20 bp, Artificial Sequence
  chemically synthesized
ctctgagaggagagtgtgac

SEQ ID NO: 4429 - DNA, 20 bp, Artificial Sequence
  chemically synthesized
cttgctgtgcttgaggaagc

SEQ ID NO: 4430 - DNA, 20 bp, Artificial Sequence
  chemically synthesized
agagtgtgactggcttcctc

SEQ ID NO: 4431 - DNA, 20 bp, Artificial Sequence
  chemically synthesized
acttcttgctgtgcttgagg

SEQ ID NO: 4432 - DNA, 20 bp, Artificial Sequence
  chemically synthesized
gtgactggcttcctcaagca

SEQ ID NO: 4433 - DNA, 20 bp, Artificial Sequence
  chemically synthesized
tagacttcttgctgtgcttg

SEQ ID NO: 4434 - DNA, 20 bp, Artificial Sequence
  chemically synthesized
ttagacttcttgctgtgctt

SEQ ID NO: 4435 - DNA, 20 bp, Artificial Sequence
  chemically synthesized
ctggcttcctcaagcacagc

SEQ ID NO: 4436 - DNA, 20 bp, Artificial Sequence
  chemically synthesized
gcttcctcaagcacagcaag

SEQ ID NO: 4437 - DNA, 20 bp, Artificial Sequence
  chemically synthesized
gcacagcaagaagtctaatg

SEQ ID NO: 4438 - DNA, 20 bp, Artificial Sequence
  chemically synthesized
tcactctgctttatctacat

SEQ ID NO: 4439 - DNA, 20 bp, Artificial Sequence
  chemically synthesized
caagaagtctaatgtagata

SEQ ID NO: 4440 - DNA, 20 bp, Artificial Sequence
  chemically synthesized
gaagtctaatgtagataaag

SEQ ID NO: 4441 - DNA, 20 bp, Artificial Sequence
  chemically synthesized
agtctaatgtagataaagca

SEQ ID NO: 4442 - DNA, 20 bp, Artificial Sequence
  chemically synthesized
gtagataaagcagagtgaac

SEQ ID NO: 4443 - DNA, 20 bp, Artificial Sequence
  chemically synthesized
agataaagcagagtgaacaa

SEQ ID NO: 4444 - DNA, 20 bp, Artificial Sequence
  chemically synthesized
aaagcagagtgaacaagagc

SEQ ID NO: 4445 - DNA, 20 bp, Artificial Sequence
  chemically synthesized
aagcagagtgaacaagagct

SEQ ID NO: 4446 - DNA, 20 bp, Artificial Sequence
  chemically synthesized
gtgaacaagagctgggaaaa

SEQ ID NO: 4447 - DNA, 20 bp, Artificial Sequence
  chemically synthesized
ccagggaagtactgttttcc

SEQ ID NO: 4448 - DNA, 20 bp, Artificial Sequence
  chemically synthesized
ctgggaaaacagtacttccc

SEQ ID NO: 4449 - DNA, 20 bp, Artificial Sequence
  chemically synthesized
tccgaatccccaggccaggg

SEQ ID NO: 4450 - DNA, 20 bp, Artificial Sequence
  chemically synthesized
aaaacagtacttccctggcc

SEQ ID NO: 4451 - DNA, 20 bp, Artificial Sequence
  chemically synthesized
aaacagtacttccctggcct

SEQ ID NO: 4452 - DNA, 20 bp, Artificial Sequence
  chemically synthesized
aacagtacttccctggcctg

SEQ ID NO: 4453 - DNA, 20 bp, Artificial Sequence
  chemically synthesized
aaatccgaatccccaggcca

SEQ ID NO: 4454 - DNA, 20 bp, Artificial Sequence
  chemically synthesized
caaatccgaatccccaggcc

SEQ ID NO: 4455 - DNA, 20 bp, Artificial Sequence
  chemically synthesized
ccaaatccgaatccccaggc

SEQ ID NO: 4456 - DNA, 20 bp, Artificial Sequence
  chemically synthesized
acttccctggcctggggatt

SEQ ID NO: 4457 - DNA, 20 bp, Artificial Sequence
  chemically synthesized
gtggccaaatccgaatcccc

SEQ ID NO: 4458 - DNA, 20 bp, Artificial Sequence
  chemically synthesized
tgtggccaaatccgaatccc

SEQ ID NO: 4459 - DNA, 20 bp, Artificial Sequence
  chemically synthesized
ctggcctggggattcggatt

SEQ ID NO: 4460 - DNA, 20 bp, Artificial Sequence
  chemically synthesized
attttccaaagcaggttatg

SEQ ID NO: 4461 - DNA, 20 bp, Artificial Sequence
  chemically synthesized
tttggccacataacctgctt

SEQ ID NO: 4462 - DNA, 20 bp, Artificial Sequence
  chemically synthesized
tacattccattttccaaagc

SEQ ID NO: 4463 - DNA, 20 bp, Artificial Sequence
  chemically synthesized
ttacattccattttccaaag

SEQ ID NO: 4464 - DNA, 20 bp, Artificial Sequence
  chemically synthesized
acataacctgctttggaaaa

SEQ ID NO: 4465 - DNA, 20 bp, Artificial Sequence
  chemically synthesized
cgcttacattccattttcca

SEQ ID NO: 4466 - DNA, 20 bp, Artificial Sequence
  chemically synthesized
tgctttggaaaatggaatgt

SEQ ID NO: 4467 - DNA, 20 bp, Artificial Sequence
  chemically synthesized
tttggaaaatggaatgtaag

SEQ ID NO: 4468 - DNA, 20 bp, Artificial Sequence
  chemically synthesized
ttggaaaatggaatgtaagc

SEQ ID NO: 4469 - DNA, 20 bp, Artificial Sequence
  chemically synthesized
aatgtaagcgggcatgacaa

SEQ ID NO: 4470 - DNA, 20 bp, Artificial Sequence
  chemically synthesized
gtaagcgggcatgacaaaag

SEQ ID NO: 4471 - DNA, 20 bp, Artificial Sequence
  chemically synthesized
aagcgggcatgacaaaagta

SEQ ID NO: 4472 - DNA, 20 bp, Artificial Sequence
  chemically synthesized
agcgggcatgacaaaagtag

SEQ ID NO: 4473 - DNA, 20 bp, Artificial Sequence
  chemically synthesized
gcatgacaaaagtagaggct

SEQ ID NO: 4474 - DNA, 20 bp, Artificial Sequence
  chemically synthesized
caaccagtcaaagacattct

SEQ ID NO: 4475 - DNA, 20 bp, Artificial Sequence
  chemically synthesized
aggcttagaatgtctttgac

SEQ ID NO: 4476 - DNA, 20 bp, Artificial Sequence
  chemically synthesized
cgggcaaccccaaccagtca

SEQ ID NO: 4477 - DNA, 20 bp, Artificial Sequence
  chemically synthesized
ttagaatgtctttgactggt

SEQ ID NO: 4478 - DNA, 20 bp, Artificial Sequence
  chemically synthesized
tagaatgtctttgactggtt

SEQ ID NO: 4479 - DNA, 20 bp, Artificial Sequence
  chemically synthesized
agaatgtctttgactggttg

SEQ ID NO: 4480 - DNA, 20 bp, Artificial Sequence
  chemically synthesized
cacaagcgggcaaccccaac

SEQ ID NO: 4481 - DNA, 20 bp, Artificial Sequence
  chemically synthesized
ttgtgcacataaacacaagc

SEQ ID NO: 4482 - DNA, 20 bp, Artificial Sequence
  chemically synthesized
cttgtgcacataaacacaag

SEQ ID NO: 4483 - DNA, 20 bp, Artificial Sequence
  chemically synthesized
cttcttgtgcacataaacac

SEQ ID NO: 4484 - DNA, 20 bp, Artificial Sequence
  chemically synthesized
ccgcttgtgtttatgtgcac

SEQ ID NO: 4485 - DNA, 20 bp, Artificial Sequence
  chemically synthesized
cttgtgtttatgtgcacaag

SEQ ID NO: 4486 - DNA, 20 bp, Artificial Sequence
  chemically synthesized
ttatgtgcacaagaagcata

SEQ ID NO: 4487 - DNA, 20 bp, Artificial Sequence
  chemically synthesized
tgcacaagaagcatatggcc

SEQ ID NO: 4488 - DNA, 20 bp, Artificial Sequence
  chemically synthesized
gcacaagaagcatatggccc

SEQ ID NO: 4489 - DNA, 20 bp, Artificial Sequence
  chemically synthesized
caagaagcatatggcccagg

SEQ ID NO: 4490 - DNA, 20 bp, Artificial Sequence
  chemically synthesized
cttgggctagcaagctacct

SEQ ID NO: 4491 - DNA, 20 bp, Artificial Sequence
  chemically synthesized
tcttgggctagcaagctacc

SEQ ID NO: 4492 - DNA, 20 bp, Artificial Sequence
  chemically synthesized
atatggcccaggtagcttgc

SEQ ID NO: 4493 - DNA, 20 bp, Artificial Sequence
  chemically synthesized
ctcatccttcttgggctagc

SEQ ID NO: 4494 - DNA, 20 bp, Artificial Sequence
  chemically synthesized
cccaggtagcttgctagccc

SEQ ID NO: 4495 - DNA, 20 bp, Artificial Sequence
  chemically synthesized
aggtagcttgctagcccaag

SEQ ID NO: 4496 - DNA, 20 bp, Artificial Sequence
  chemically synthesized
gtctctcatccttcttgggc

SEQ ID NO: 4497 - DNA, 20 bp, Artificial Sequence
  chemically synthesized
ggtagcttgctagcccaaga

SEQ ID NO: 4498 - DNA, 20 bp, Artificial Sequence
  chemically synthesized
acatgtctctcatccttctt

SEQ ID NO: 4499 - DNA, 20 bp, Artificial Sequence
  chemically synthesized
aacatgtctctcatccttct

SEQ ID NO: 4500 - DNA, 20 bp, Artificial Sequence
  chemically synthesized
cttgctagcccaagaaggat

SEQ ID NO: 4501 - DNA, 20 bp, Artificial Sequence
  chemically synthesized
tgctagcccaagaaggatga

SEQ ID NO: 4502 - DNA, 20 bp, Artificial Sequence
  chemically synthesized
aggatgagagacatgttgaa

SEQ ID NO: 4503 - DNA, 20 bp, Artificial Sequence
  chemically synthesized
ccaagttgtggtttgggttc

SEQ ID NO: 4504 - DNA, 20 bp, Artificial Sequence
  chemically synthesized
accaagttgtggtttgggtt

SEQ ID NO: 4505 - DNA, 20 bp, Artificial Sequence
  chemically synthesized
ttgacaccaagttgtggttt

SEQ ID NO: 4506 - DNA, 20 bp, Artificial Sequence
  chemically synthesized
cttgacaccaagttgtggtt

SEQ ID NO: 4507 - DNA, 20 bp, Artificial Sequence
  chemically synthesized
cctgaacccaaaccacaact

SEQ ID NO: 4508 - DNA, 20 bp, Artificial Sequence
  chemically synthesized
ctggacttgacaccaagttg

SEQ ID NO: 4509 - DNA, 20 bp, Artificial Sequence
  chemically synthesized
ccaaaccacaacttggtgtc

SEQ ID NO: 4510 - DNA, 20 bp, Artificial Sequence
  chemically synthesized
aatcagctggacttgacacc

SEQ ID NO: 4511 - DNA, 20 bp, Artificial Sequence
  chemically synthesized
ccacaacttggtgtcaagtc

SEQ ID NO: 4512 - DNA, 20 bp, Artificial Sequence
  chemically synthesized
aacttttgctggcaatcagc

SEQ ID NO: 4513 - DNA, 20 bp, Artificial Sequence
  chemically synthesized
tgtcaagtccagctgattgc

SEQ ID NO: 4514 - DNA, 20 bp, Artificial Sequence
  chemically synthesized
gctgaacttttgctggcaat

SEQ ID NO: 4515 - DNA, 20 bp, Artificial Sequence
  chemically synthesized
gtccagctgattgccagcaa

SEQ ID NO: 4516 - DNA, 20 bp, Artificial Sequence
  chemically synthesized
ttgtttggctgaacttttgc

SEQ ID NO: 4517 - DNA, 20 bp, Artificial Sequence
  chemically synthesized
gctgattgccagcaaaagtt

SEQ ID NO: 4518 - DNA, 20 bp, Artificial Sequence
  chemically synthesized
gcaaaagttcagccaaacaa

SEQ ID NO: 4519 - DNA, 20 bp, Artificial Sequence
  chemically synthesized
tcattcacgcatctgttgtt

SEQ ID NO: 4520 - DNA, 20 bp, Artificial Sequence
  chemically synthesized
caaacaacagatgcgtgaat

SEQ ID NO: 4521 - DNA, 20 bp, Artificial Sequence
  chemically synthesized
gaatgagaaatatgcaactt

SEQ ID NO: 4522 - DNA, 20 bp, Artificial Sequence
  chemically synthesized
caaataaccacaaaattctc

SEQ ID NO: 4523 - DNA, 20 bp, Artificial Sequence
  chemically synthesized
tatgcaacttgagaattttg

SEQ ID NO: 4524 - DNA, 20 bp, Artificial Sequence
  chemically synthesized
ttttgtggttatttgttatg

SEQ ID NO: 4525 - DNA, 20 bp, Artificial Sequence
  chemically synthesized
ggttatttgttatgcagcaa

SEQ ID NO: 4526 - DNA, 20 bp, Artificial Sequence
  chemically synthesized
gcccataatagtgtatcagt

SEQ ID NO: 4527 - DNA, 20 bp, Artificial Sequence
  chemically synthesized
tcatgcccataatagtgtat

SEQ ID NO: 4528 - DNA, 20 bp, Artificial Sequence
  chemically synthesized
agctgactgatacactatta

SEQ ID NO: 4529 - DNA, 20 bp, Artificial Sequence
  chemically synthesized
gctgactgatacactattat

SEQ ID NO: 4530 - DNA, 20 bp, Artificial Sequence
  chemically synthesized
ggcttgtttcatgcccataa

SEQ ID NO: 4531 - DNA, 20 bp, Artificial Sequence
  chemically synthesized
cactattatgggcatgaaac

SEQ ID NO: 4532 - DNA, 20 bp, Artificial Sequence
  chemically synthesized
attatgggcatgaaacaagc

SEQ ID NO: 4533 - DNA, 20 bp, Artificial Sequence
  chemically synthesized
caagccataaatattatatc

SEQ ID NO: 4534 - DNA, 20 bp, Artificial Sequence
  chemically synthesized
caagccagatataatattta

SEQ ID NO: 4535 - DNA, 20 bp, Artificial Sequence
  chemically synthesized
tacatagtgtatgattagac

SEQ ID NO: 4536 - DNA, 20 bp, Artificial Sequence
  chemically synthesized
gtagctacatagtgtatgat

SEQ ID NO: 4537 - DNA, 20 bp, Artificial Sequence
  chemically synthesized
ttgtctaatcatacactatg

SEQ ID NO: 4538 - DNA, 20 bp, Artificial Sequence
  chemically synthesized
cctattatgttgtagctaca

SEQ ID NO: 4539 - DNA, 20 bp, Artificial Sequence
  chemically synthesized
ttaatacacctattatgttg

SEQ ID NO: 4540 - DNA, 20 bp, Artificial Sequence
  chemically synthesized
actatgtagctacaacataa

SEQ ID NO: 4541 - DNA, 20 bp, Artificial Sequence
  chemically synthesized
ctatgtagctacaacataat

SEQ ID NO: 4542 - DNA, 20 bp, Artificial Sequence
  chemically synthesized
tctctatagcagtgtgaaaa

SEQ ID NO: 4543 - DNA, 20 bp, Artificial Sequence
  chemically synthesized
aatccattttcacactgcta

SEQ ID NO: 4544 - DNA, 20 bp, Artificial Sequence
  chemically synthesized
tccattttcacactgctata

SEQ ID NO: 4545 - DNA, 20 bp, Artificial Sequence
  chemically synthesized
ctcaggtagtatctctatag

SEQ ID NO: 4546 - DNA, 20 bp, Artificial Sequence
  chemically synthesized
agtctcaggtagtatctcta

SEQ ID NO: 4547 - DNA, 20 bp, Artificial Sequence
  chemically synthesized
ctgctatagagatactacct

SEQ ID NO: 4548 - DNA, 20 bp, Artificial Sequence
  chemically synthesized
ataaattacccagtctcagg

SEQ ID NO: 4549 - DNA, 20 bp, Artificial Sequence
  chemically synthesized
atagagatactacctgagac

SEQ ID NO: 4550 - DNA, 20 bp, Artificial Sequence
  chemically synthesized
tagagatactacctgagact

SEQ ID NO: 4551 - DNA, 20 bp, Artificial Sequence
  chemically synthesized
tttataaattacccagtctc

SEQ ID NO: 4552 - DNA, 20 bp, Artificial Sequence
  chemically synthesized
ctttataaattacccagtct

SEQ ID NO: 4553 - DNA, 20 bp, Artificial Sequence
  chemically synthesized
tctttcctttataaattacc

SEQ ID NO: 4554 - DNA, 20 bp, Artificial Sequence
  chemically synthesized
ctgagactgggtaatttata

SEQ ID NO: 4555 - DNA, 20 bp, Artificial Sequence
  chemically synthesized
tgagactgggtaatttataa

SEQ ID NO: 4556 - DNA, 20 bp, Artificial Sequence
  chemically synthesized
actgggtaatttataaagga

SEQ ID NO: 4557 - DNA, 20 bp, Artificial Sequence
  chemically synthesized
tgggtaatttataaaggaaa

SEQ ID NO: 4558 - DNA, 20 bp, Artificial Sequence
  chemically synthesized
gggtaatttataaaggaaag

SEQ ID NO: 4559 - DNA, 20 bp, Artificial Sequence
  chemically synthesized
aaagaggtttaattgactca

SEQ ID NO: 4560 - DNA, 20 bp, Artificial Sequence
  chemically synthesized
gtttaattgactcacagttc

SEQ ID NO: 4561 - DNA, 20 bp, Artificial Sequence
  chemically synthesized
cctcacgcatctggaactgt

SEQ ID NO: 4562 - DNA, 20 bp, Artificial Sequence
  chemically synthesized
actcacagttccagatgcgt

SEQ ID NO: 4563 - DNA, 20 bp, Artificial Sequence
  chemically synthesized
ctgaggcctcctcacgcatc

SEQ ID NO: 4564 - DNA, 20 bp, Artificial Sequence
  chemically synthesized
ctcacagttccagatgcgtg

SEQ ID NO: 4565 - DNA, 20 bp, Artificial Sequence
  chemically synthesized
cacagttccagatgcgtgag

SEQ ID NO: 4566 - DNA, 20 bp, Artificial Sequence
  chemically synthesized
acagttccagatgcgtgagg

SEQ ID NO: 4567 - DNA, 20 bp, Artificial Sequence
  chemically synthesized
ccagatgcgtgaggaggcct

SEQ ID NO: 4568 - DNA, 20 bp, Artificial Sequence
  chemically synthesized
cagatgcgtgaggaggcctc

SEQ ID NO: 4569 - DNA, 20 bp, Artificial Sequence
  chemically synthesized
gatgcgtgaggaggcctcag

SEQ ID NO: 4570 - DNA, 20 bp, Artificial Sequence
  chemically synthesized
atgcgtgaggaggcctcagg

SEQ ID NO: 4571 - DNA, 20 bp, Artificial Sequence
  chemically synthesized
tataatcatgaggcctcctg

SEQ ID NO: 4572 - DNA, 20 bp, Artificial Sequence
  chemically synthesized
ttataatcatgaggcctcct

SEQ ID NO: 4573 - DNA, 20 bp, Artificial Sequence
  chemically synthesized
attctaaacttataatcatg

SEQ ID NO: 4574 - DNA, 20 bp, Artificial Sequence
  chemically synthesized
gattctaaacttataatcat

SEQ ID NO: 4575 - DNA, 20 bp, Artificial Sequence
  chemically synthesized
tcaggaggcctcatgattat

SEQ ID NO: 4576 - DNA, 20 bp, Artificial Sequence
  chemically synthesized
aggcctcatgattataagtt

SEQ ID NO: 4577 - DNA, 20 bp, Artificial Sequence
  chemically synthesized
tgattataagtttagaatca

SEQ ID NO: 4578 - DNA, 20 bp, Artificial Sequence
  chemically synthesized
ttataagtttagaatcatgg

SEQ ID NO: 4579 - DNA, 20 bp, Artificial Sequence
  chemically synthesized
taagtttagaatcatggtgg

SEQ ID NO: 4580 - DNA, 20 bp, Artificial Sequence
  chemically synthesized
aagtttagaatcatggtgga

SEQ ID NO: 4581 - DNA, 20 bp, Artificial Sequence
  chemically synthesized
tagaatcatggtggaaggca

SEQ ID NO: 4582 - DNA, 20 bp, Artificial Sequence
  chemically synthesized
agaatcatggtggaaggcaa

SEQ ID NO: 4583 - DNA, 20 bp, Artificial Sequence
  chemically synthesized
gaatcatggtggaaggcaaa

SEQ ID NO: 4584 - DNA, 20 bp, Artificial Sequence
  chemically synthesized
aatcatggtggaaggcaaag

SEQ ID NO: 4585 - DNA, 20 bp, Artificial Sequence
  chemically synthesized
catggtggaaggcaaagggg

SEQ ID NO: 4586 - DNA, 20 bp, Artificial Sequence
  chemically synthesized
gtggaaggcaaaggggaagc

SEQ ID NO: 4587 - DNA, 20 bp, Artificial Sequence
  chemically synthesized
tggaaggcaaaggggaagca

SEQ ID NO: 4588 - DNA, 20 bp, Artificial Sequence
  chemically synthesized
gaagcaaggcacctcttaca

SEQ ID NO: 4589 - DNA, 20 bp, Artificial Sequence
  chemically synthesized
ctctcctgctgccatgtaag

SEQ ID NO: 4590 - DNA, 20 bp, Artificial Sequence
  chemically synthesized
tctctcctgctgccatgtaa

SEQ ID NO: 4591 - DNA, 20 bp, Artificial Sequence
  chemically synthesized
gcaaggcacctcttacatgg

SEQ ID NO: 4592 - DNA, 20 bp, Artificial Sequence
  chemically synthesized
tctctctcctgctgccatgt

SEQ ID NO: 4593 - DNA, 20 bp, Artificial Sequence
  chemically synthesized
aggcacctcttacatggcag

SEQ ID NO: 4594 - DNA, 20 bp, Artificial Sequence
  chemically synthesized
ggcacctcttacatggcagc

SEQ ID NO: 4595 - DNA, 20 bp, Artificial Sequence
  chemically synthesized
cacctcttacatggcagcag

SEQ ID NO: 4596 - DNA, 20 bp, Artificial Sequence
  chemically synthesized
cctcttacatggcagcagga

SEQ ID NO: 4597 - DNA, 20 bp, Artificial Sequence
  chemically synthesized
tcttacatggcagcaggaga

SEQ ID NO: 4598 - DNA, 20 bp, Artificial Sequence
  chemically synthesized
ttacatggcagcaggagaga

SEQ ID NO: 4599 - DNA, 20 bp, Artificial Sequence
  chemically synthesized
acatggcagcaggagagaga

SEQ ID NO: 4600 - DNA, 20 bp, Artificial Sequence
  chemically synthesized
atggcagcaggagagagaga

SEQ ID NO: 4601 - DNA, 20 bp, Artificial Sequence
  chemically synthesized
ggcagcaggagagagagaga

SEQ ID NO: 4602 - DNA, 20 bp, Artificial Sequence
  chemically synthesized
cagcaggagagagagagaga

SEQ ID NO: 4603 - DNA, 20 bp, Artificial Sequence
  chemically synthesized
gcaggagagagagagagaga

SEQ ID NO: 4604 - DNA, 20 bp, Artificial Sequence
  chemically synthesized
aggagagagagagagagaga

SEQ ID NO: 4605 - DNA, 20 bp, Artificial Sequence
  chemically synthesized
gagagagagagagagagaga

SEQ ID NO: 4606 - DNA, 20 bp, Artificial Sequence
  chemically synthesized
gagagagagagagagagaga

SEQ ID NO: 4607 - DNA, 20 bp, Artificial Sequence
  chemically synthesized
gagagagagagagagagaga

SEQ ID NO: 4608 - DNA, 20 bp, Artificial Sequence
  chemically synthesized
gagagagagagagagagaga

SEQ ID NO: 4609 - DNA, 20 bp, Artificial Sequence
  chemically synthesized
gagagagagagagagagaga

SEQ ID NO: 4610 - DNA, 20 bp, Artificial Sequence
  chemically synthesized
gagagagagagagagagaga

SEQ ID NO: 4611 - DNA, 20 bp, Artificial Sequence
  chemically synthesized
gagagagagagagagagaga

SEQ ID NO: 4612 - DNA, 20 bp, Artificial Sequence
  chemically synthesized
gagagagagagagagagaga

SEQ ID NO: 4613 - DNA, 20 bp, Artificial Sequence
  chemically synthesized
gagagagagagagagagaga

SEQ ID NO: 4614 - DNA, 20 bp, Artificial Sequence
  chemically synthesized
gagagagagagagagagaga

SEQ ID NO: 4615 - DNA, 20 bp, Artificial Sequence
  chemically synthesized
gagagagagagagagagaga

SEQ ID NO: 4616 - DNA, 20 bp, Artificial Sequence
  chemically synthesized
gagagagagagagagagaga

SEQ ID NO: 4617 - DNA, 20 bp, Artificial Sequence
  chemically synthesized
gagagagagagagagagaga

SEQ ID NO: 4618 - DNA, 20 bp, Artificial Sequence
  chemically synthesized
gagagagagagagagagaga

SEQ ID NO: 4619 - DNA, 20 bp, Artificial Sequence
  chemically synthesized
gagagagagagagagagaga

SEQ ID NO: 4620 - DNA, 20 bp, Artificial Sequence
  chemically synthesized
gagagagagagagagagaga

SEQ ID NO: 4621 - DNA, 20 bp, Artificial Sequence
  chemically synthesized
gagagagagagagagagaga

SEQ ID NO: 4622 - DNA, 20 bp, Artificial Sequence
  chemically synthesized
gagagagagagagagagaga

SEQ ID NO: 4623 - DNA, 20 bp, Artificial Sequence
  chemically synthesized
gagagagagagagagagaga

SEQ ID NO: 4624 - DNA, 20 bp, Artificial Sequence
  chemically synthesized
gagagagagagagagagaga

SEQ ID NO: 4625 - DNA, 20 bp, Artificial Sequence
  chemically synthesized
gagagagagagagagagaga

SEQ ID NO: 4626 - DNA, 20 bp, Artificial Sequence
  chemically synthesized
agagagagagagagagagag

SEQ ID NO: 4627 - DNA, 20 bp, Artificial Sequence
  chemically synthesized
gagagagagagagagagaga

SEQ ID NO: 4628 - DNA, 20 bp, Artificial Sequence
  chemically synthesized
agagagagagagagagagaa

SEQ ID NO: 4629 - DNA, 20 bp, Artificial Sequence
  chemically synthesized
gagagagagagagagagaag

SEQ ID NO: 4630 - DNA, 20 bp, Artificial Sequence
  chemically synthesized
agagagagagagagagaagg

SEQ ID NO: 4631 - DNA, 20 bp, Artificial Sequence
  chemically synthesized
gagagagagagagaaggggg

SEQ ID NO: 4632 - DNA, 20 bp, Artificial Sequence
  chemically synthesized
ctgatggtttttaaagtgtg

SEQ ID NO: 4633 - DNA, 20 bp, Artificial Sequence
  chemically synthesized
aggagagctgatggttttta

SEQ ID NO: 4634 - DNA, 20 bp, Artificial Sequence
  chemically synthesized
ccacacactttaaaaaccat

SEQ ID NO: 4635 - DNA, 20 bp, Artificial Sequence
  chemically synthesized
tgagttctcaggagagctga

SEQ ID NO: 4636 - DNA, 20 bp, Artificial Sequence
  chemically synthesized
taaaaaccatcagctctcct

SEQ ID NO: 4637 - DNA, 20 bp, Artificial Sequence
  chemically synthesized
tagtgagtgagttctcagga

SEQ ID NO: 4638 - DNA, 20 bp, Artificial Sequence
  chemically synthesized
gatagtgagtgagttctcag

SEQ ID NO: 4639 - DNA, 20 bp, Artificial Sequence
  chemically synthesized
gtgatagtgagtgagttctc

SEQ ID NO: 4640 - DNA, 20 bp, Artificial Sequence
  chemically synthesized
cgtgatagtgagtgagttct

SEQ ID NO: 4641 - DNA, 20 bp, Artificial Sequence
  chemically synthesized
ctgttctcgtgatagtgagt

SEQ ID NO: 4642 - DNA, 20 bp, Artificial Sequence
  chemically synthesized
catgctgttctcgtgatagt

SEQ ID NO: 4643 - DNA, 20 bp, Artificial Sequence
  chemically synthesized
gagaactcactcactatcac

SEQ ID NO: 4644 - DNA, 20 bp, Artificial Sequence
  chemically synthesized
cccccatgctgttctcgtga

SEQ ID NO: 4645 - DNA, 20 bp, Artificial Sequence
  chemically synthesized
ctcactcactatcacgagaa

SEQ ID NO: 4646 - DNA, 20 bp, Artificial Sequence
  chemically synthesized
tcactatcacgagaacagca

SEQ ID NO: 4647 - DNA, 20 bp, Artificial Sequence
  chemically synthesized
cactatcacgagaacagcat

SEQ ID NO: 4648 - DNA, 20 bp, Artificial Sequence
  chemically synthesized
actatcacgagaacagcatg

SEQ ID NO: 4649 - DNA, 20 bp, Artificial Sequence
  chemically synthesized
ctatcacgagaacagcatgg

SEQ ID NO: 4650 - DNA, 20 bp, Artificial Sequence
  chemically synthesized
gaggtgactggatcatgaag

SEQ ID NO: 4651 - DNA, 20 bp, Artificial Sequence
  chemically synthesized
gggaaaacttcttcatgatc

SEQ ID NO: 4652 - DNA, 20 bp, Artificial Sequence
  chemically synthesized
tgggaggtgactggatcatg

SEQ ID NO: 4653 - DNA, 20 bp, Artificial Sequence
  chemically synthesized
gggacctgatgggaggtgac

SEQ ID NO: 4654 - DNA, 20 bp, Artificial Sequence
  chemically synthesized
atgatccagtcacctcccat

SEQ ID NO: 4655 - DNA, 20 bp, Artificial Sequence
  chemically synthesized
tgatccagtcacctcccatc

SEQ ID NO: 4656 - DNA, 20 bp, Artificial Sequence
  chemically synthesized
caggggagggacctgatggg

SEQ ID NO: 4657 - DNA, 20 bp, Artificial Sequence
  chemically synthesized
tcaggggagggacctgatgg

SEQ ID NO: 4658 - DNA, 20 bp, Artificial Sequence
  chemically synthesized
tgtcaggggagggacctgat

SEQ ID NO: 4659 - DNA, 20 bp, Artificial Sequence
  chemically synthesized
gtgtcaggggagggacctga

SEQ ID NO: 4660 - DNA, 20 bp, Artificial Sequence
  chemically synthesized
aatccccacgtgtcagggga

SEQ ID NO: 4661 - DNA, 20 bp, Artificial Sequence
  chemically synthesized
taatccccacgtgtcagggg

SEQ ID NO: 4662 - DNA, 20 bp, Artificial Sequence
  chemically synthesized
gtaatccccacgtgtcaggg

SEQ ID NO: 4663 - DNA, 20 bp, Artificial Sequence
  chemically synthesized
ttgtaatccccacgtgtcag

SEQ ID NO: 4664 - DNA, 20 bp, Artificial Sequence
  chemically synthesized
caggtccctcccctgacacg

SEQ ID NO: 4665 - DNA, 20 bp, Artificial Sequence
  chemically synthesized
attgtaatccccacgtgtca

SEQ ID NO: 4666 - DNA, 20 bp, Artificial Sequence
  chemically synthesized
aggtccctcccctgacacgt

SEQ ID NO: 4667 - DNA, 20 bp, Artificial Sequence
  chemically synthesized
aattgtaatccccacgtgtc

SEQ ID NO: 4668 - DNA, 20 bp, Artificial Sequence
  chemically synthesized
ggtccctcccctgacacgtg

SEQ ID NO: 4669 - DNA, 20 bp, Artificial Sequence
  chemically synthesized
aaattgtaatccccacgtgt

SEQ ID NO: 4670 - DNA, 20 bp, Artificial Sequence
  chemically synthesized
acacgtggggattacaattt

SEQ ID NO: 4671 - DNA, 20 bp, Artificial Sequence
  chemically synthesized
tggggattacaatttgagat

SEQ ID NO: 4672 - DNA, 20 bp, Artificial Sequence
  chemically synthesized
ttacaatttgagatgagatt

SEQ ID NO: 4673 - DNA, 20 bp, Artificial Sequence
  chemically synthesized
tacaatttgagatgagattt

SEQ ID NO: 4674 - DNA, 20 bp, Artificial Sequence
  chemically synthesized
aatttgagatgagatttagg

SEQ ID NO: 4675 - DNA, 20 bp, Artificial Sequence
  chemically synthesized
atttgagatgagatttaggt

SEQ ID NO: 4676 - DNA, 20 bp, Artificial Sequence
  chemically synthesized
atgagatttaggtgggaaca

SEQ ID NO: 4677 - DNA, 20 bp, Artificial Sequence
  chemically synthesized
gagatttaggtgggaacaca

SEQ ID NO: 4678 - DNA, 20 bp, Artificial Sequence
  chemically synthesized
ggttgcctattaatatggtt

SEQ ID NO: 4679 - DNA, 20 bp, Artificial Sequence
  chemically synthesized
acagagccaaaccatattaa

SEQ ID NO: 4680 - DNA, 20 bp, Artificial Sequence
  chemically synthesized
cagagccaaaccatattaat

SEQ ID NO: 4681 - DNA, 20 bp, Artificial Sequence
  chemically synthesized
tttgaggttgcctattaata

SEQ ID NO: 4682 - DNA, 20 bp, Artificial Sequence
  chemically synthesized
ttagagtcagaaatattttg

SEQ ID NO: 4683 - DNA, 20 bp, Artificial Sequence
  chemically synthesized
gttagagtcagaaatatttt

SEQ ID NO: 4684 - DNA, 20 bp, Artificial Sequence
  chemically synthesized
acaggtattattgttagagt

SEQ ID NO: 4685 - DNA, 20 bp, Artificial Sequence
  chemically synthesized
gatgacaggtattattgtta

SEQ ID NO: 4686 - DNA, 20 bp, Artificial Sequence
  chemically synthesized
gtgatgacaggtattattgt

SEQ ID NO: 4687 - DNA, 20 bp, Artificial Sequence
  chemically synthesized
gatgaggggcttgtgatgac

SEQ ID NO: 4688 - DNA, 20 bp, Artificial Sequence
  chemically synthesized
acaataatacctgtcatcac

SEQ ID NO: 4689 - DNA, 20 bp, Artificial Sequence
  chemically synthesized
tgatgaggggcttgtgatga

SEQ ID NO: 4690 - DNA, 20 bp, Artificial Sequence
  chemically synthesized
tttttgtttttggtgatgag

SEQ ID NO: 4691 - DNA, 20 bp, Artificial Sequence
  chemically synthesized
gtttttgtttttggtgatga

SEQ ID NO: 4692 - DNA, 20 bp, Artificial Sequence
  chemically synthesized
tgtttttgtttttggtgatg

SEQ ID NO: 4693 - DNA, 20 bp, Artificial Sequence
  chemically synthesized
gtgtttttgtttttggtgat

SEQ ID NO: 4694 - DNA, 20 bp, Artificial Sequence
  chemically synthesized
tgaaaaggtgtttttgtttt

SEQ ID NO: 4695 - DNA, 20 bp, Artificial Sequence
  chemically synthesized
aataagtgaaaaaagtgaaa

SEQ ID NO: 4696 - DNA, 20 bp, Artificial Sequence
  chemically synthesized
gaataagtgaaaaaagtgaa

SEQ ID NO: 4697 - DNA, 20 bp, Artificial Sequence
  chemically synthesized
tcttgttgaataagtgaaaa

SEQ ID NO: 4698 - DNA, 20 bp, Artificial Sequence
  chemically synthesized
acttttttcacttattcaac

SEQ ID NO: 4699 - DNA, 20 bp, Artificial Sequence
  chemically synthesized
tcagtattttcttgttgaat

SEQ ID NO: 4700 - DNA, 20 bp, Artificial Sequence
  chemically synthesized
ttattcaacaagaaaatact

SEQ ID NO: 4701 - DNA, 20 bp, Artificial Sequence
  chemically synthesized
aacaagaaaatactgagttc

SEQ ID NO: 4702 - DNA, 20 bp, Artificial Sequence
  chemically synthesized
tctagtgtgcaactggaact

SEQ ID NO: 4703 - DNA, 20 bp, Artificial Sequence
  chemically synthesized
gcaggtctctagtgtgcaac

SEQ ID NO: 4704 - DNA, 20 bp, Artificial Sequence
  chemically synthesized
actgagttccagttgcacac

SEQ ID NO: 4705 - DNA, 20 bp, Artificial Sequence
  chemically synthesized
tgagttccagttgcacacta

SEQ ID NO: 4706 - DNA, 20 bp, Artificial Sequence
  chemically synthesized
ataagggctgtgcaggtctc

SEQ ID NO: 4707 - DNA, 20 bp, Artificial Sequence
  chemically synthesized
ttgcacactagagacctgca

SEQ ID NO: 4708 - DNA, 20 bp, Artificial Sequence
  chemically synthesized
agtagggataagggctgtgc

SEQ ID NO: 4709 - DNA, 20 bp, Artificial Sequence
  chemically synthesized
aagtagggataagggctgtg

SEQ ID NO: 4710 - DNA, 20 bp, Artificial Sequence
  chemically synthesized
aatctgtgaagtagggataa

SEQ ID NO: 4711 - DNA, 20 bp, Artificial Sequence
  chemically synthesized
gaatctgtgaagtagggata

SEQ ID NO: 4712 - DNA, 20 bp, Artificial Sequence
  chemically synthesized
tgaatctgtgaagtagggat

SEQ ID NO: 4713 - DNA, 20 bp, Artificial Sequence
  chemically synthesized
cagcccttatccctacttca

SEQ ID NO: 4714 - DNA, 20 bp, Artificial Sequence
  chemically synthesized
ggcaatgaatctgtgaagta

SEQ ID NO: 4715 - DNA, 20 bp, Artificial Sequence
  chemically synthesized
aggcaatgaatctgtgaagt

SEQ ID NO: 4716 - DNA, 20 bp, Artificial Sequence
  chemically synthesized
caggcaatgaatctgtgaag

SEQ ID NO: 4717 - DNA, 20 bp, Artificial Sequence
  chemically synthesized
gagcaggcaatgaatctgtg

SEQ ID NO: 4718 - DNA, 20 bp, Artificial Sequence
  chemically synthesized
agattcattgcctgctcaaa

SEQ ID NO: 4719 - DNA, 20 bp, Artificial Sequence
  chemically synthesized
tagcaatatgctatttgagc

SEQ ID NO: 4720 - DNA, 20 bp, Artificial Sequence
  chemically synthesized
ctagcaatatgctatttgag

SEQ ID NO: 4721 - DNA, 20 bp, Artificial Sequence
  chemically synthesized
agactagcaatatgctattt

SEQ ID NO: 4722 - DNA, 20 bp, Artificial Sequence
  chemically synthesized
ctgctcaaatagcatattgc

SEQ ID NO: 4723 - DNA, 20 bp, Artificial Sequence
  chemically synthesized
aatagcatattgctagtctt

SEQ ID NO: 4724 - DNA, 20 bp, Artificial Sequence
  chemically synthesized
atagcatattgctagtcttt

SEQ ID NO: 4725 - DNA, 20 bp, Artificial Sequence
  chemically synthesized
tagcatattgctagtctttg

SEQ ID NO: 4726 - DNA, 20 bp, Artificial Sequence
  chemically synthesized
gtttaaaatcccccaaagac

SEQ ID NO: 4727 - DNA, 20 bp, Artificial Sequence
  chemically synthesized
agcatattgctagtctttgg

SEQ ID NO: 4728 - DNA, 20 bp, Artificial Sequence
  chemically synthesized
actaagtttaaaatccccca

SEQ ID NO: 4729 - DNA, 20 bp, Artificial Sequence
  chemically synthesized
tctttgggggattttaaact

SEQ ID NO: 4730 - DNA, 20 bp, Artificial Sequence
  chemically synthesized
gggattttaaacttagttga

SEQ ID NO: 4731 - DNA, 20 bp, Artificial Sequence
  chemically synthesized
ttaaagcattgccatcaact

SEQ ID NO: 4732 - DNA, 20 bp, Artificial Sequence
  chemically synthesized
agagtcaagtttaagtgtta

SEQ ID NO: 4733 - DNA, 20 bp, Artificial Sequence
  chemically synthesized
cttggagtagagtcaagttt

SEQ ID NO: 4734 - DNA, 20 bp, Artificial Sequence
  chemically synthesized
aatcaccttggagtagagtc

SEQ ID NO: 4735 - DNA, 20 bp, Artificial Sequence
  chemically synthesized
cttaaacttgactctactcc

SEQ ID NO: 4736 - DNA, 20 bp, Artificial Sequence
  chemically synthesized
ttaaacttgactctactcca

SEQ ID NO: 4737 - DNA, 20 bp, Artificial Sequence
  chemically synthesized
gtggaaatcaccttggagta

SEQ ID NO: 4738 - DNA, 20 bp, Artificial Sequence
  chemically synthesized
ttgtggaaatcaccttggag

SEQ ID NO: 4739 - DNA, 20 bp, Artificial Sequence
  chemically synthesized
tgtttgtggaaatcaccttg

SEQ ID NO: 4740 - DNA, 20 bp, Artificial Sequence
  chemically synthesized
catgtttgtggaaatcacct

SEQ ID NO: 4741 - DNA, 20 bp, Artificial Sequence
  chemically synthesized
ctattatttatgcatgtttg

SEQ ID NO: 4742 - DNA, 20 bp, Artificial Sequence
  chemically synthesized
ccacaaacatgcataaataa

SEQ ID NO: 4743 - DNA, 20 bp, Artificial Sequence
  chemically synthesized
catgcataaataatagatgt

SEQ ID NO: 4744 - DNA, 20 bp, Artificial Sequence
  chemically synthesized
ataaataatagatgtcagtg

SEQ ID NO: 4745 - DNA, 20 bp, Artificial Sequence
  chemically synthesized
aatagatgtcagtgtggatg

SEQ ID NO: 4746 - DNA, 20 bp, Artificial Sequence
  chemically synthesized
cagtgtggatgtggtgaaaa

SEQ ID NO: 4747 - DNA, 20 bp, Artificial Sequence
  chemically synthesized
cattcccaccagcagtgtaa

SEQ ID NO: 4748 - DNA, 20 bp, Artificial Sequence
  chemically synthesized
acagaacacttttacactgc

SEQ ID NO: 4749 - DNA, 20 bp, Artificial Sequence
  chemically synthesized
gaacacttttacactgctgg

SEQ ID NO: 4750 - DNA, 20 bp, Artificial Sequence
  chemically synthesized
aacacttttacactgctggt

SEQ ID NO: 4751 - DNA, 20 bp, Artificial Sequence
  chemically synthesized
ctagtttacattcccaccag

SEQ ID NO: 4752 - DNA, 20 bp, Artificial Sequence
  chemically synthesized
gtcctagtttacattcccac

SEQ ID NO: 4753 - DNA, 20 bp, Artificial Sequence
  chemically synthesized
ctgctggtgggaatgtaaac

SEQ ID NO: 4754 - DNA, 20 bp, Artificial Sequence
  chemically synthesized
tgctggtgggaatgtaaact

SEQ ID NO: 4755 - DNA, 20 bp, Artificial Sequence
  chemically synthesized
gttttccatagtggttgtcc

SEQ ID NO: 4756 - DNA, 20 bp, Artificial Sequence
  chemically synthesized
gtaaactaggacaaccacta

SEQ ID NO: 4757 - DNA, 20 bp, Artificial Sequence
  chemically synthesized
ctccatagtgttttccatag

SEQ ID NO: 4758 - DNA, 20 bp, Artificial Sequence
  chemically synthesized
agcctccatagtgttttcca

SEQ ID NO: 4759 - DNA, 20 bp, Artificial Sequence
  chemically synthesized
aaccactatggaaaacacta

SEQ ID NO: 4760 - DNA, 20 bp, Artificial Sequence
  chemically synthesized
ccactatggaaaacactatg

SEQ ID NO: 4761 - DNA, 20 bp, Artificial Sequence
  chemically synthesized
cactatggaaaacactatgg

SEQ ID NO: 4762 - DNA, 20 bp, Artificial Sequence
  chemically synthesized
agttctttaaggagcctcca

SEQ ID NO: 4763 - DNA, 20 bp, Artificial Sequence
  chemically synthesized
aacactatggaggctcctta

SEQ ID NO: 4764 - DNA, 20 bp, Artificial Sequence
  chemically synthesized
ctacattttagttctttaag

SEQ ID NO: 4765 - DNA, 20 bp, Artificial Sequence
  chemically synthesized
ttctacattttagttcttta

SEQ ID NO: 4766 - DNA, 20 bp, Artificial Sequence
  chemically synthesized
gttctacattttagttcttt

SEQ ID NO: 4767 - DNA, 20 bp, Artificial Sequence
  chemically synthesized
ctccttaaagaactaaaatg

SEQ ID NO: 4768 - DNA, 20 bp, Artificial Sequence
  chemically synthesized
caaatggtagttctacattt

SEQ ID NO: 4769 - DNA, 20 bp, Artificial Sequence
  chemically synthesized
gggactgctggatcaaatgg

SEQ ID NO: 4770 - DNA, 20 bp, Artificial Sequence
  chemically synthesized
tgtagaactaccatttgatc

SEQ ID NO: 4771 - DNA, 20 bp, Artificial Sequence
  chemically synthesized
agtgggactgctggatcaaa

SEQ ID NO: 4772 - DNA, 20 bp, Artificial Sequence
  chemically synthesized
agaactaccatttgatccag

SEQ ID NO: 4773 - DNA, 20 bp, Artificial Sequence
  chemically synthesized
atatccagtagtgggactgc

SEQ ID NO: 4774 - DNA, 20 bp, Artificial Sequence
  chemically synthesized
tgatccagcagtcccactac

SEQ ID NO: 4775 - DNA, 20 bp, Artificial Sequence
  chemically synthesized
ttgggtagatatccagtagt

SEQ ID NO: 4776 - DNA, 20 bp, Artificial Sequence
  chemically synthesized
tttgggtagatatccagtag

SEQ ID NO: 4777 - DNA, 20 bp, Artificial Sequence
  chemically synthesized
tcctttgggtagatatccag

SEQ ID NO: 4778 - DNA, 20 bp, Artificial Sequence
  chemically synthesized
ctttcctttgggtagatatc

SEQ ID NO: 4779 - DNA, 20 bp, Artificial Sequence
  chemically synthesized
cactactggatatctaccca

SEQ ID NO: 4780 - DNA, 20 bp, Artificial Sequence
  chemically synthesized
actactggatatctacccaa

SEQ ID NO: 4781 - DNA, 20 bp, Artificial Sequence
  chemically synthesized
atgacttcctttcctttggg

SEQ ID NO: 4782 - DNA, 20 bp, Artificial Sequence
  chemically synthesized
ctggatatctacccaaagga

SEQ ID NO: 4783 - DNA, 20 bp, Artificial Sequence
  chemically synthesized
tggatatctacccaaaggaa

SEQ ID NO: 4784 - DNA, 20 bp, Artificial Sequence
  chemically synthesized
ataatgacttcctttccttt

SEQ ID NO: 4785 - DNA, 20 bp, Artificial Sequence
  chemically synthesized
cataatgacttcctttcctt

SEQ ID NO: 4786 - DNA, 20 bp, Artificial Sequence
  chemically synthesized
atatctacccaaaggaaagg

SEQ ID NO: 4787 - DNA, 20 bp, Artificial Sequence
  chemically synthesized
gaaaaatatacttgcatacc

SEQ ID NO: 4788 - DNA, 20 bp, Artificial Sequence
  chemically synthesized
ctgctataatcttggtatgc

SEQ ID NO: 4789 - DNA, 20 bp, Artificial Sequence
  chemically synthesized
atacttgcataccaagatta

SEQ ID NO: 4790 - DNA, 20 bp, Artificial Sequence
  chemically synthesized
gaattgcgctgctataatct

SEQ ID NO: 4791 - DNA, 20 bp, Artificial Sequence
  chemically synthesized
cttgcataccaagattatag

SEQ ID NO: 4792 - DNA, 20 bp, Artificial Sequence
  chemically synthesized
agcagcgcaattcataattg

SEQ ID NO: 4793 - DNA, 20 bp, Artificial Sequence
  chemically synthesized
aattcataattgcagaaata

SEQ ID NO: 4794 - DNA, 20 bp, Artificial Sequence
  chemically synthesized
taattgcagaaatacggaac

SEQ ID NO: 4795 - DNA, 20 bp, Artificial Sequence
  chemically synthesized
tggttgatgggcatttaagc

SEQ ID NO: 4796 - DNA, 20 bp, Artificial Sequence
  chemically synthesized
tcgttggttgatgggcattt

SEQ ID NO: 4797 - DNA, 20 bp, Artificial Sequence
  chemically synthesized
ttatccactcgttggttgat

SEQ ID NO: 4798 - DNA, 20 bp, Artificial Sequence
  chemically synthesized
tttatccactcgttggttga

SEQ ID NO: 4799 - DNA, 20 bp, Artificial Sequence
  chemically synthesized
ttaaatgcccatcaaccaac

SEQ ID NO: 4800 - DNA, 20 bp, Artificial Sequence
  chemically synthesized
aatgcccatcaaccaacgag

SEQ ID NO: 4801 - DNA, 20 bp, Artificial Sequence
  chemically synthesized
cattttctttatccactcgt

SEQ ID NO: 4802 - DNA, 20 bp, Artificial Sequence
  chemically synthesized
catcaaccaacgagtggata

SEQ ID NO: 4803 - DNA, 20 bp, Artificial Sequence
  chemically synthesized
acgagtggataaagaaaatg

SEQ ID NO: 4804 - DNA, 20 bp, Artificial Sequence
  chemically synthesized
aagaaaatgcagtatgtacg

SEQ ID NO: 4805 - DNA, 20 bp, Artificial Sequence
  chemically synthesized
acacacacacacacacgcca

SEQ ID NO: 4806 - DNA, 20 bp, Artificial Sequence
  chemically synthesized
ctttcatgactaatattcca

SEQ ID NO: 4807 - DNA, 20 bp, Artificial Sequence
  chemically synthesized
acacacacgccatggaatat

SEQ ID NO: 4808 - DNA, 20 bp, Artificial Sequence
  chemically synthesized
ccatggaatattagtcatga

SEQ ID NO: 4809 - DNA, 20 bp, Artificial Sequence
  chemically synthesized
catggaatattagtcatgaa

SEQ ID NO: 4810 - DNA, 20 bp, Artificial Sequence
  chemically synthesized
tcatgaaaggaatgaaataa

SEQ ID NO: 4811 - DNA, 20 bp, Artificial Sequence
  chemically synthesized
gaatgaaataatggcattca

SEQ ID NO: 4812 - DNA, 20 bp, Artificial Sequence
  chemically synthesized
taatggcattcacagcaacc

SEQ ID NO: 4813 - DNA, 20 bp, Artificial Sequence
  chemically synthesized
ggcattcacagcaacctgga

SEQ ID NO: 4814 - DNA, 20 bp, Artificial Sequence
  chemically synthesized
cattcacagcaacctggatg

SEQ ID NO: 4815 - DNA, 20 bp, Artificial Sequence
  chemically synthesized
aatggtctccaactccatcc

SEQ ID NO: 4816 - DNA, 20 bp, Artificial Sequence
  chemically synthesized
taatggtctccaactccatc

SEQ ID NO: 4817 - DNA, 20 bp, Artificial Sequence
  chemically synthesized
cacagcaacctggatggagt

SEQ ID NO: 4818 - DNA, 20 bp, Artificial Sequence
  chemically synthesized
cagcaacctggatggagttg

SEQ ID NO: 4819 - DNA, 20 bp, Artificial Sequence
  chemically synthesized
gagttggagaccattactct

SEQ ID NO: 4820 - DNA, 20 bp, Artificial Sequence
  chemically synthesized
agttactttacttagagtaa

SEQ ID NO: 4821 - DNA, 20 bp, Artificial Sequence
  chemically synthesized
ggagaccattactctaagta

SEQ ID NO: 4822 - DNA, 20 bp, Artificial Sequence
  chemically synthesized
ttcctgagttactttactta

SEQ ID NO: 4823 - DNA, 20 bp, Artificial Sequence
  chemically synthesized
tattcctgagttactttact

SEQ ID NO: 4824 - DNA, 20 bp, Artificial Sequence
  chemically synthesized
ttactctaagtaaagtaact

SEQ ID NO: 4825 - DNA, 20 bp, Artificial Sequence
  chemically synthesized
tactctaagtaaagtaactc

SEQ ID NO: 4826 - DNA, 20 bp, Artificial Sequence
  chemically synthesized
taagtaaagtaactcaggaa

SEQ ID NO: 4827 - DNA, 20 bp, Artificial Sequence
  chemically synthesized
atgtttggttgtctattcct

SEQ ID NO: 4828 - DNA, 20 bp, Artificial Sequence
  chemically synthesized
aagtgagaaagtacaatgtt

SEQ ID NO: 4829 - DNA, 20 bp, Artificial Sequence
  chemically synthesized
gctcccacttataagtgaga

SEQ ID NO: 4830 - DNA, 20 bp, Artificial Sequence
  chemically synthesized
cattgtactttctcacttat

SEQ ID NO: 4831 - DNA, 20 bp, Artificial Sequence
  chemically synthesized
cttagctcccacttataagt

SEQ ID NO: 4832 - DNA, 20 bp, Artificial Sequence
  chemically synthesized
tgtactttctcacttataag

SEQ ID NO: 4833 - DNA, 20 bp, Artificial Sequence
  chemically synthesized
gtactttctcacttataagt

SEQ ID NO: 4834 - DNA, 20 bp, Artificial Sequence
  chemically synthesized
atagcttagctcccacttat

SEQ ID NO: 4835 - DNA, 20 bp, Artificial Sequence
  chemically synthesized
actttctcacttataagtgg

SEQ ID NO: 4836 - DNA, 20 bp, Artificial Sequence
  chemically synthesized
ctcacttataagtgggagct

SEQ ID NO: 4837 - DNA, 20 bp, Artificial Sequence
  chemically synthesized
taagtgggagctaagctatg

SEQ ID NO: 4838 - DNA, 20 bp, Artificial Sequence
  chemically synthesized
gcctttgcatccgcatagct

SEQ ID NO: 4839 - DNA, 20 bp, Artificial Sequence
  chemically synthesized
ctcatgcctttgcatccgca

SEQ ID NO: 4840 - DNA, 20 bp, Artificial Sequence
  chemically synthesized
agctaagctatgcggatgca

SEQ ID NO: 4841 - DNA, 20 bp, Artificial Sequence
  chemically synthesized
gctaagctatgcggatgcaa

SEQ ID NO: 4842 - DNA, 20 bp, Artificial Sequence
  chemically synthesized
ctatgcggatgcaaaggcat

SEQ ID NO: 4843 - DNA, 20 bp, Artificial Sequence
  chemically synthesized
aaggcatgagaatgatacca

SEQ ID NO: 4844 - DNA, 20 bp, Artificial Sequence
  chemically synthesized
gagaatgataccatggactc

SEQ ID NO: 4845 - DNA, 20 bp, Artificial Sequence
  chemically synthesized
ccccaagtccccagagtcca

SEQ ID NO: 4846 - DNA, 20 bp, Artificial Sequence
  chemically synthesized
agaatgataccatggactct

SEQ ID NO: 4847 - DNA, 20 bp, Artificial Sequence
  chemically synthesized
gaatgataccatggactctg

SEQ ID NO: 4848 - DNA, 20 bp, Artificial Sequence
  chemically synthesized
cccttccccccaagtcccca

SEQ ID NO: 4849 - DNA, 20 bp, Artificial Sequence
  chemically synthesized
taccatggactctggggact

SEQ ID NO: 4850 - DNA, 20 bp, Artificial Sequence
  chemically synthesized
accatggactctggggactt

SEQ ID NO: 4851 - DNA, 20 bp, Artificial Sequence
  chemically synthesized
cacccttccccccaagtccc

SEQ ID NO: 4852 - DNA, 20 bp, Artificial Sequence
  chemically synthesized
ccatggactctggggacttg

SEQ ID NO: 4853 - DNA, 20 bp, Artificial Sequence
  chemically synthesized
catggactctggggacttgg

SEQ ID NO: 4854 - DNA, 20 bp, Artificial Sequence
  chemically synthesized
atggactctggggacttggg

SEQ ID NO: 4855 - DNA, 20 bp, Artificial Sequence
  chemically synthesized
gactctggggacttgggggg

SEQ ID NO: 4856 - DNA, 20 bp, Artificial Sequence
  chemically synthesized
actctggggacttgggggga

SEQ ID NO: 4857 - DNA, 20 bp, Artificial Sequence
  chemically synthesized
cccctcccacccttcccccc

SEQ ID NO: 4858 - DNA, 20 bp, Artificial Sequence
  chemically synthesized
ctctggggacttggggggaa

SEQ ID NO: 4859 - DNA, 20 bp, Artificial Sequence
  chemically synthesized
tggggacttggggggaaggg

SEQ ID NO: 4860 - DNA, 20 bp, Artificial Sequence
  chemically synthesized
ggggacttggggggaagggt

SEQ ID NO: 4861 - DNA, 20 bp, Artificial Sequence
  chemically synthesized
ggacttggggggaagggtgg

SEQ ID NO: 4862 - DNA, 20 bp, Artificial Sequence
  chemically synthesized
gacttggggggaagggtggg

SEQ ID NO: 4863 - DNA, 20 bp, Artificial Sequence
  chemically synthesized
acttggggggaagggtggga

SEQ ID NO: 4864 - DNA, 20 bp, Artificial Sequence
  chemically synthesized
cttggggggaagggtgggag

SEQ ID NO: 4865 - DNA, 20 bp, Artificial Sequence
  chemically synthesized
ttggggggaagggtgggagg

SEQ ID NO: 4866 - DNA, 20 bp, Artificial Sequence
  chemically synthesized
tggggggaagggtgggaggg

SEQ ID NO: 4867 - DNA, 20 bp, Artificial Sequence
  chemically synthesized
ggaagggtgggaggggggtg

SEQ ID NO: 4868 - DNA, 20 bp, Artificial Sequence
  chemically synthesized
gaagggtgggaggggggtga

SEQ ID NO: 4869 - DNA, 20 bp, Artificial Sequence
  chemically synthesized
gggaggggggtgaaggataa

SEQ ID NO: 4870 - DNA, 20 bp, Artificial Sequence
  chemically synthesized
aaggataaaagactacacgt

SEQ ID NO: 4871 - DNA, 20 bp, Artificial Sequence
  chemically synthesized
aggataaaagactacacgtt

SEQ ID NO: 4872 - DNA, 20 bp, Artificial Sequence
  chemically synthesized
tgtacactgtacccaacgtg

SEQ ID NO: 4873 - DNA, 20 bp, Artificial Sequence
  chemically synthesized
aaaagactacacgttgggta

SEQ ID NO: 4874 - DNA, 20 bp, Artificial Sequence
  chemically synthesized
tgggtacagtgtacactgct

SEQ ID NO: 4875 - DNA, 20 bp, Artificial Sequence
  chemically synthesized
gggtacagtgtacactgctc

SEQ ID NO: 4876 - DNA, 20 bp, Artificial Sequence
  chemically synthesized
gggtgcatccatcacctgag

SEQ ID NO: 4877 - DNA, 20 bp, Artificial Sequence
  chemically synthesized
agtgtacactgctcaggtga

SEQ ID NO: 4878 - DNA, 20 bp, Artificial Sequence
  chemically synthesized
tttgggtgcatccatcacct

SEQ ID NO: 4879 - DNA, 20 bp, Artificial Sequence
  chemically synthesized
tgatggatgcacccaaatgt

SEQ ID NO: 4880 - DNA, 20 bp, Artificial Sequence
  chemically synthesized
ggtggtgatttctgacattt

SEQ ID NO: 4881 - DNA, 20 bp, Artificial Sequence
  chemically synthesized
cggtggtgatttctgacatt

SEQ ID NO: 4882 - DNA, 20 bp, Artificial Sequence
  chemically synthesized
aatgtcagaaatcaccaccg

SEQ ID NO: 4883 - DNA, 20 bp, Artificial Sequence
  chemically synthesized
tacatgaataagttcttcgg

SEQ ID NO: 4884 - DNA, 20 bp, Artificial Sequence
  chemically synthesized
ggttacatgaataagttctt

SEQ ID NO: 4885 - DNA, 20 bp, Artificial Sequence
  chemically synthesized
tggtgtttggttacatgaat

SEQ ID NO: 4886 - DNA, 20 bp, Artificial Sequence
  chemically synthesized
cagggaacccaggtggtgtt

SEQ ID NO: 4887 - DNA, 20 bp, Artificial Sequence
  chemically synthesized
tcatgtaaccaaacaccacc

SEQ ID NO: 4888 - DNA, 20 bp, Artificial Sequence
  chemically synthesized
catgtaaccaaacaccacct

SEQ ID NO: 4889 - DNA, 20 bp, Artificial Sequence
  chemically synthesized
tagttttcagggaacccagg

SEQ ID NO: 4890 - DNA, 20 bp, Artificial Sequence
  chemically synthesized
cagtagttttcagggaaccc

SEQ ID NO: 4891 - DNA, 20 bp, Artificial Sequence
  chemically synthesized
tcagtagttttcagggaacc

SEQ ID NO: 4892 - DNA, 20 bp, Artificial Sequence
  chemically synthesized
tattatttcagtagttttca

SEQ ID NO: 4893 - DNA, 20 bp, Artificial Sequence
  chemically synthesized
ttattatttcagtagttttc

SEQ ID NO: 4894 - DNA, 20 bp, Artificial Sequence
  chemically synthesized
tttattatttcagtagtttt

SEQ ID NO: 4895 - DNA, 20 bp, Artificial Sequence
  chemically synthesized
ttctctttttattatttcag

SEQ ID NO: 4896 - DNA, 20 bp, Artificial Sequence
  chemically synthesized
tttttctctttttattattt

SEQ ID NO: 4897 - DNA, 20 bp, Artificial Sequence
  chemically synthesized
aaaactactgaaataataaa

SEQ ID NO: 4898 - DNA, 20 bp, Artificial Sequence
  chemically synthesized
aactactgaaataataaaaa

SEQ ID NO: 4899 - DNA, 20 bp, Artificial Sequence
  chemically synthesized
aagagaaaaataatgttttt

SEQ ID NO: 4900 - DNA, 20 bp, Artificial Sequence
  chemically synthesized
aataatgttttttggattat

SEQ ID NO: 4901 - DNA, 20 bp, Artificial Sequence
  chemically synthesized
tttttggattattagctatt

SEQ ID NO: 4902 - DNA, 20 bp, Artificial Sequence
  chemically synthesized
gacaagccaggaagaccaaa

SEQ ID NO: 4903 - DNA, 20 bp, Artificial Sequence
  chemically synthesized
tattagctatttggtcttcc

SEQ ID NO: 4904 - DNA, 20 bp, Artificial Sequence
  chemically synthesized
ccacaatcagacaagccagg

SEQ ID NO: 4905 - DNA, 20 bp, Artificial Sequence
  chemically synthesized
ggaccacaatcagacaagcc

SEQ ID NO: 4906 - DNA, 20 bp, Artificial Sequence
  chemically synthesized
tggaccacaatcagacaagc

SEQ ID NO: 4907 - DNA, 20 bp, Artificial Sequence
  chemically synthesized
tatttggaccacaatcagac

SEQ ID NO: 4908 - DNA, 20 bp, Artificial Sequence
  chemically synthesized
cttcctggcttgtctgattg

SEQ ID NO: 4909 - DNA, 20 bp, Artificial Sequence
  chemically synthesized
tgatttatttggaccacaat

SEQ ID NO: 4910 - DNA, 20 bp, Artificial Sequence
  chemically synthesized
aaatgtttcagtgatttatt

SEQ ID NO: 4911 - DNA, 20 bp, Artificial Sequence
  chemically synthesized
ccttattttaaaaaatgttt

SEQ ID NO: 4912 - DNA, 20 bp, Artificial Sequence
  chemically synthesized
actgaaacattttttaaaat

SEQ ID NO: 4913 - DNA, 20 bp, Artificial Sequence
  chemically synthesized
ctgaaacattttttaaaata

SEQ ID NO: 4914 - DNA, 20 bp, Artificial Sequence
  chemically synthesized
aacattttttaaaataagga

SEQ ID NO: 4915 - DNA, 20 bp, Artificial Sequence
  chemically synthesized
ttttaaaataaggaaagaca

SEQ ID NO: 4916 - DNA, 20 bp, Artificial Sequence
  chemically synthesized
aataaggaaagacatagtca

SEQ ID NO: 4917 - DNA, 20 bp, Artificial Sequence
  chemically synthesized
aagacatagtcaaagttaaa

SEQ ID NO: 4918 - DNA, 20 bp, Artificial Sequence
  chemically synthesized
agttaaatagtaccgtgata

SEQ ID NO: 4919 - DNA, 20 bp, Artificial Sequence
  chemically synthesized
tatcatattttgctatatca

SEQ ID NO: 4920 - DNA, 20 bp, Artificial Sequence
  chemically synthesized
cgtgatatagcaaaatatga

SEQ ID NO: 4921 - DNA, 20 bp, Artificial Sequence
  chemically synthesized
cacttcagcagtgattaaag

SEQ ID NO: 4922 - DNA, 20 bp, Artificial Sequence
  chemically synthesized
ttcacttcagcagtgattaa

SEQ ID NO: 4923 - DNA, 20 bp, Artificial Sequence
  chemically synthesized
cttcacttcagcagtgatta

SEQ ID NO: 4924 - DNA, 20 bp, Artificial Sequence
  chemically synthesized
gtctcctttaatcactgctg

SEQ ID NO: 4925 - DNA, 20 bp, Artificial Sequence
  chemically synthesized
ttcttttttcttcacttcag

SEQ ID NO: 4926 - DNA, 20 bp, Artificial Sequence
  chemically synthesized
ctttaatcactgctgaagtg

SEQ ID NO: 4927 - DNA, 20 bp, Artificial Sequence
  chemically synthesized
cacttcttttttcttcactt

SEQ ID NO: 4928 - DNA, 20 bp, Artificial Sequence
  chemically synthesized
cactgctgaagtgaagaaaa

SEQ ID NO: 4929 - DNA, 20 bp, Artificial Sequence
  chemically synthesized
tgctgaagtgaagaaaaaag

SEQ ID NO: 4930 - DNA, 20 bp, Artificial Sequence
  chemically synthesized
tgaagtgaagaaaaaagaag

SEQ ID NO: 4931 - DNA, 20 bp, Artificial Sequence
  chemically synthesized
gaagtgaagaaaaaagaagt

SEQ ID NO: 4932 - DNA, 20 bp, Artificial Sequence
  chemically synthesized
cttttttctcggattaaatt

SEQ ID NO: 4933 - DNA, 20 bp, Artificial Sequence
  chemically synthesized
gggatgactcaatttaatcc

SEQ ID NO: 4934 - DNA, 20 bp, Artificial Sequence
  chemically synthesized
ctcaatttaatccgagaaaa

SEQ ID NO: 4935 - DNA, 20 bp, Artificial Sequence
  chemically synthesized
gcattccttttcttttttct

SEQ ID NO: 4936 - DNA, 20 bp, Artificial Sequence
  chemically synthesized
tttaatccgagaaaaaagaa

SEQ ID NO: 4937 - DNA, 20 bp, Artificial Sequence
  chemically synthesized
ttaatccgagaaaaaagaaa

SEQ ID NO: 4938 - DNA, 20 bp, Artificial Sequence
  chemically synthesized
agaaaaggaatgctttgcca

SEQ ID NO: 4939 - DNA, 20 bp, Artificial Sequence
  chemically synthesized
aagaatatcttgccatggca

SEQ ID NO: 4940 - DNA, 20 bp, Artificial Sequence
  chemically synthesized
aaggaatgctttgccatggc

SEQ ID NO: 4941 - DNA, 20 bp, Artificial Sequence
  chemically synthesized
gactgaagaatatcttgcca

SEQ ID NO: 4942 - DNA, 20 bp, Artificial Sequence
  chemically synthesized
tgccatggcaagatattctt

SEQ ID NO: 4943 - DNA, 20 bp, Artificial Sequence
  chemically synthesized
cgttatatttcagaagactg

SEQ ID NO: 4944 - DNA, 20 bp, Artificial Sequence
  chemically synthesized
aaaccatcgttatatttcag

SEQ ID NO: 4945 - DNA, 20 bp, Artificial Sequence
  chemically synthesized
ctgaaaccatcgttatattt

SEQ ID NO: 4946 - DNA, 20 bp, Artificial Sequence
  chemically synthesized
agtcttctgaaatataacga

SEQ ID NO: 4947 - DNA, 20 bp, Artificial Sequence
  chemically synthesized
ctgaaatataacgatggttt

SEQ ID NO: 4948 - DNA, 20 bp, Artificial Sequence
  chemically synthesized
ggtttcagatccctttcttg

SEQ ID NO: 4949 - DNA, 20 bp, Artificial Sequence
  chemically synthesized
gatatcttcccttcaagaaa

SEQ ID NO: 4950 - DNA, 20 bp, Artificial Sequence
  chemically synthesized
gtttcagatccctttcttga

SEQ ID NO: 4951 - DNA, 20 bp, Artificial Sequence
  chemically synthesized
ggatatcttcccttcaagaa

SEQ ID NO: 4952 - DNA, 20 bp, Artificial Sequence
  chemically synthesized
tttcagatccctttcttgaa

SEQ ID NO: 4953 - DNA, 20 bp, Artificial Sequence
  chemically synthesized
gggatatcttcccttcaaga

SEQ ID NO: 4954 - DNA, 20 bp, Artificial Sequence
  chemically synthesized
cagatccctttcttgaaggg

SEQ ID NO: 4955 - DNA, 20 bp, Artificial Sequence
  chemically synthesized
agatgggatatcttcccttc

SEQ ID NO: 4956 - DNA, 20 bp, Artificial Sequence
  chemically synthesized
caaagggaagtgagtcagat

SEQ ID NO: 4957 - DNA, 20 bp, Artificial Sequence
  chemically synthesized
tcaaagggaagtgagtcaga

SEQ ID NO: 4958 - DNA, 20 bp, Artificial Sequence
  chemically synthesized
tgaatcaaagggaagtgagt

SEQ ID NO: 4959 - DNA, 20 bp, Artificial Sequence
  chemically synthesized
cgtttgaatcaaagggaagt

SEQ ID NO: 4960 - DNA, 20 bp, Artificial Sequence
  chemically synthesized
tcagcgtttgaatcaaaggg

SEQ ID NO: 4961 - DNA, 20 bp, Artificial Sequence
  chemically synthesized
ttatcagcgtttgaatcaaa

SEQ ID NO: 4962 - DNA, 20 bp, Artificial Sequence
  chemically synthesized
attatcagcgtttgaatcaa

SEQ ID NO: 4963 - DNA, 20 bp, Artificial Sequence
  chemically synthesized
cattatcagcgtttgaatca

SEQ ID NO: 4964 - DNA, 20 bp, Artificial Sequence
  chemically synthesized
tttgattcaaacgctgataa

SEQ ID NO: 4965 - DNA, 20 bp, Artificial Sequence
  chemically synthesized
taagcagatagaaccattat

SEQ ID NO: 4966 - DNA, 20 bp, Artificial Sequence
  chemically synthesized
aaaatcactttttaagcaga

SEQ ID NO: 4967 - DNA, 20 bp, Artificial Sequence
  chemically synthesized
aatggttctatctgcttaaa

SEQ ID NO: 4968 - DNA, 20 bp, Artificial Sequence
  chemically synthesized
ggctaaaatcactttttaag

SEQ ID NO: 4969 - DNA, 20 bp, Artificial Sequence
  chemically synthesized
tctggctaaaatcacttttt

SEQ ID NO: 4970 - DNA, 20 bp, Artificial Sequence
  chemically synthesized
atctgcttaaaaagtgattt

SEQ ID NO: 4971 - DNA, 20 bp, Artificial Sequence
  chemically synthesized
gcttaaaaagtgattttagc

SEQ ID NO: 4972 - DNA, 20 bp, Artificial Sequence
  chemically synthesized
tgcataggctgcgtaggttc

SEQ ID NO: 4973 - DNA, 20 bp, Artificial Sequence
  chemically synthesized
gattttagccagaacctacg

SEQ ID NO: 4974 - DNA, 20 bp, Artificial Sequence
  chemically synthesized
ctattctgcataggctgcgt

SEQ ID NO: 4975 - DNA, 20 bp, Artificial Sequence
  chemically synthesized
tctattctgcataggctgcg

SEQ ID NO: 4976 - DNA, 20 bp, Artificial Sequence
  chemically synthesized
cagaacctacgcagcctatg

SEQ ID NO: 4977 - DNA, 20 bp, Artificial Sequence
  chemically synthesized
ttcttgtgtctattctgcat

SEQ ID NO: 4978 - DNA, 20 bp, Artificial Sequence
  chemically synthesized
cctacgcagcctatgcagaa

SEQ ID NO: 4979 - DNA, 20 bp, Artificial Sequence
  chemically synthesized
attcttgtgtctattctgca

SEQ ID NO: 4980 - DNA, 20 bp, Artificial Sequence
  chemically synthesized
agcctatgcagaatagacac

SEQ ID NO: 4981 - DNA, 20 bp, Artificial Sequence
  chemically synthesized
agattcagacaaaaacacag

SEQ ID NO: 4982 - DNA, 20 bp, Artificial Sequence
  chemically synthesized
ttagattcagacaaaaacac

SEQ ID NO: 4983 - DNA, 20 bp, Artificial Sequence
  chemically synthesized
tttagattcagacaaaaaca

SEQ ID NO: 4984 - DNA, 20 bp, Artificial Sequence
  chemically synthesized
gaaaataatttgtttagatt

SEQ ID NO: 4985 - DNA, 20 bp, Artificial Sequence
  chemically synthesized
aaaagagaaaataatttgtt

SEQ ID NO: 4986 - DNA, 20 bp, Artificial Sequence
  chemically synthesized
cagctcctttttaaaaaaaa

SEQ ID NO: 4987 - DNA, 20 bp, Artificial Sequence
  chemically synthesized
cacagctcctttttaaaaaa

SEQ ID NO: 4988 - DNA, 20 bp, Artificial Sequence
  chemically synthesized
tattttctcttttttttaaa

SEQ ID NO: 4989 - DNA, 20 bp, Artificial Sequence
  chemically synthesized
attttctcttttttttaaaa

SEQ ID NO: 4990 - DNA, 20 bp, Artificial Sequence
  chemically synthesized
tttctcttttttttaaaaag

SEQ ID NO: 4991 - DNA, 20 bp, Artificial Sequence
  chemically synthesized
tttaaaaaggagctgtgtac

SEQ ID NO: 4992 - DNA, 20 bp, Artificial Sequence
  chemically synthesized
aaaaaataatttcttgtaca

SEQ ID NO: 4993 - DNA, 20 bp, Artificial Sequence
  chemically synthesized
agaaattattttttctcata

SEQ ID NO: 4994 - DNA, 20 bp, Artificial Sequence
  chemically synthesized
gaaattattttttctcataa

SEQ ID NO: 4995 - DNA, 20 bp, Artificial Sequence
  chemically synthesized
aaattattttttctcataaa

SEQ ID NO: 4996 - DNA, 20 bp, Artificial Sequence
  chemically synthesized
aattattttttctcataaag

SEQ ID NO: 4997 - DNA, 20 bp, Artificial Sequence
  chemically synthesized
attattttttctcataaagg

SEQ ID NO: 4998 - DNA, 20 bp, Artificial Sequence
  chemically synthesized
tcatacacagccccctttat

SEQ ID NO: 4999 - DNA, 20 bp, Artificial Sequence
  chemically synthesized
tgggcgtatttgttcataca

SEQ ID NO: 5000 - DNA, 20 bp, Artificial Sequence
  chemically synthesized
atccaaagaaaaatgttggt

SEQ ID NO: 5001 - DNA, 20 bp, Artificial Sequence
  chemically synthesized
aatccaaagaaaaatgttgg

SEQ ID NO: 5002 - DNA, 20 bp, Artificial Sequence
  chemically synthesized
taaaatccaaagaaaaatgt

SEQ ID NO: 5003 - DNA, 20 bp, Artificial Sequence
  chemically synthesized
cgcccaccaacatttttctt

SEQ ID NO: 5004 - DNA, 20 bp, Artificial Sequence
  chemically synthesized
cggaaactggttaaaatcca

SEQ ID NO: 5005 - DNA, 20 bp, Artificial Sequence
  chemically synthesized
atttttctttggattttaac

SEQ ID NO: 5006 - DNA, 20 bp, Artificial Sequence
  chemically synthesized
taacacatcaagtcggaaac

SEQ ID NO: 5007 - DNA, 20 bp, Artificial Sequence
  chemically synthesized
aagataataacacatcaagt

SEQ ID NO: 5008 - DNA, 20 bp, Artificial Sequence
  chemically synthesized
tactaagataataacacatc

SEQ ID NO: 5009 - DNA, 20 bp, Artificial Sequence
  chemically synthesized
gacttgatgtgttattatct

SEQ ID NO: 5010 - DNA, 20 bp, Artificial Sequence
  chemically synthesized
gcaggaaatacacaagtact

SEQ ID NO: 5011 - DNA, 20 bp, Artificial Sequence
  chemically synthesized
gagaaaggcaggaaatacac

SEQ ID NO: 5012 - DNA, 20 bp, Artificial Sequence
  chemically synthesized
aaaaaatactggagaaaggc

SEQ ID NO: 5013 - DNA, 20 bp, Artificial Sequence
  chemically synthesized
taaaaaatactggagaaagg

SEQ ID NO: 5014 - DNA, 20 bp, Artificial Sequence
  chemically synthesized
gtgtatttcctgcctttctc

SEQ ID NO: 5015 - DNA, 20 bp, Artificial Sequence
  chemically synthesized
ttctaaaaaatactggagaa

SEQ ID NO: 5016 - DNA, 20 bp, Artificial Sequence
  chemically synthesized
cttctaaaaaatactggaga

SEQ ID NO: 5017 - DNA, 20 bp, Artificial Sequence
  chemically synthesized
ttttcttctaaaaaatactg

SEQ ID NO: 5018 - DNA, 20 bp, Artificial Sequence
  chemically synthesized
ctttttcttctaaaaaatac

SEQ ID NO: 5019 - DNA, 20 bp, Artificial Sequence
  chemically synthesized
tgcctttctccagtattttt

SEQ ID NO: 5020 - DNA, 20 bp, Artificial Sequence
  chemically synthesized
ctttctccagtattttttag

SEQ ID NO: 5021 - DNA, 20 bp, Artificial Sequence
  chemically synthesized
ccagtattttttagaagaaa

SEQ ID NO: 5022 - DNA, 20 bp, Artificial Sequence
  chemically synthesized
atgttgggtattggatacat

SEQ ID NO: 5023 - DNA, 20 bp, Artificial Sequence
  chemically synthesized
tgtagccaaatgttgggtat

SEQ ID NO: 5024 - DNA, 20 bp, Artificial Sequence
  chemically synthesized
tgtatccaatacccaacatt

SEQ ID NO: 5025 - DNA, 20 bp, Artificial Sequence
  chemically synthesized
attaattgtagccaaatgtt

SEQ ID NO: 5026 - DNA, 20 bp, Artificial Sequence
  chemically synthesized
aattaattgtagccaaatgt

SEQ ID NO: 5027 - DNA, 20 bp, Artificial Sequence
  chemically synthesized
atatggaaaaaaattaattg

SEQ ID NO: 5028 - DNA, 20 bp, Artificial Sequence
  chemically synthesized
taatttttttccatatgata

SEQ ID NO: 5029 - DNA, 20 bp, Artificial Sequence
  chemically synthesized
agcatcggtcctatatcata

SEQ ID NO: 5030 - DNA, 20 bp, Artificial Sequence
  chemically synthesized
aatttttttccatatgatat

SEQ ID NO: 5031 - DNA, 20 bp, Artificial Sequence
  chemically synthesized
atgtgtgaaattgaaagcat

SEQ ID NO: 5032 - DNA, 20 bp, Artificial Sequence
  chemically synthesized
gaatttatgtgtgaaattga

SEQ ID NO: 5033 - DNA, 20 bp, Artificial Sequence
  chemically synthesized
tatgttaaaggtgttacaca

SEQ ID NO: 5034 - DNA, 20 bp, Artificial Sequence
  chemically synthesized
tgtacaccataatatgttaa

SEQ ID NO: 5035 - DNA, 20 bp, Artificial Sequence
  chemically synthesized
ttgtacaccataatatgtta

SEQ ID NO: 5036 - DNA, 20 bp, Artificial Sequence
  chemically synthesized
gtaacacctttaacatatta

SEQ ID NO: 5037 - DNA, 20 bp, Artificial Sequence
  chemically synthesized
acaatgttgttgctgattat

SEQ ID NO: 5038 - DNA, 20 bp, Artificial Sequence
  chemically synthesized
acaactgatcagctaataat

SEQ ID NO: 5039 - DNA, 20 bp, Artificial Sequence
  chemically synthesized
gttgctgattattagctgat

SEQ ID NO: 5040 - DNA, 20 bp, Artificial Sequence
  chemically synthesized
caccaccattcacaactgat

SEQ ID NO: 5041 - DNA, 20 bp, Artificial Sequence
  chemically synthesized
attagctgatcagttgtgaa

SEQ ID NO: 5042 - DNA, 20 bp, Artificial Sequence
  chemically synthesized
agctgatcagttgtgaatgg

SEQ ID NO: 5043 - DNA, 20 bp, Artificial Sequence
  chemically synthesized
tcagttgtgaatggtggtga

SEQ ID NO: 5044 - DNA, 20 bp, Artificial Sequence
  chemically synthesized
gtggtgaaagatactgaaac

SEQ ID NO: 5045 - DNA, 20 bp, Artificial Sequence
  chemically synthesized
gtgaaagatactgaaactag

SEQ ID NO: 5046 - DNA, 20 bp, Artificial Sequence
  chemically synthesized
ggaaatttagctactagttt

SEQ ID NO: 5047 - DNA, 20 bp, Artificial Sequence
  chemically synthesized
cgtttaggaaatttagctac

SEQ ID NO: 5048 - DNA, 20 bp, Artificial Sequence
  chemically synthesized
gcccacacgtttaggaaatt

SEQ ID NO: 5049 - DNA, 20 bp, Artificial Sequence
  chemically synthesized
agctaaatttcctaaacgtg

SEQ ID NO: 5050 - DNA, 20 bp, Artificial Sequence
  chemically synthesized
atggaacagcccacacgttt

SEQ ID NO: 5051 - DNA, 20 bp, Artificial Sequence
  chemically synthesized
gctaaatttcctaaacgtgt

SEQ ID NO: 5052 - DNA, 20 bp, Artificial Sequence
  chemically synthesized
catggaacagcccacacgtt

SEQ ID NO: 5053 - DNA, 20 bp, Artificial Sequence
  chemically synthesized
attcttgtgtacacatggaa

SEQ ID NO: 5054 - DNA, 20 bp, Artificial Sequence
  chemically synthesized
aatacattcttgtgtacaca

SEQ ID NO: 5055 - DNA, 20 bp, Artificial Sequence
  chemically synthesized
gggctgttccatgtgtacac

SEQ ID NO: 5056 - DNA, 20 bp, Artificial Sequence
  chemically synthesized
gagttaatattttagaaatc

SEQ ID NO: 5057 - DNA, 20 bp, Artificial Sequence
  chemically synthesized
tgcttgttgagttaatattt

SEQ ID NO: 5058 - DNA, 20 bp, Artificial Sequence
  chemically synthesized
ttctaaaatattaactcaac

SEQ ID NO: 5059 - DNA, 20 bp, Artificial Sequence
  chemically synthesized
caatcagtaaagtgcttgtt

SEQ ID NO: 5060 - DNA, 20 bp, Artificial Sequence
  chemically synthesized
tgtgcaacaaacaatcagta

SEQ ID NO: 5061 - DNA, 20 bp, Artificial Sequence
  chemically synthesized
tactctgtgcaacaaacaat

SEQ ID NO: 5062 - DNA, 20 bp, Artificial Sequence
  chemically synthesized
tttactgattgtttgttgca

SEQ ID NO: 5063 - DNA, 20 bp, Artificial Sequence
  chemically synthesized
tactgattgtttgttgcaca

SEQ ID NO: 5064 - DNA, 20 bp, Artificial Sequence
  chemically synthesized
ttgcacagagtatcctcata

SEQ ID NO: 5065 - DNA, 20 bp, Artificial Sequence
  chemically synthesized
ctcattgtcgttactgtatg

SEQ ID NO: 5066 - DNA, 20 bp, Artificial Sequence
  chemically synthesized
gctcattgtcgttactgtat

SEQ ID NO: 5067 - DNA, 20 bp, Artificial Sequence
  chemically synthesized
cctcatacagtaacgacaat

SEQ ID NO: 5068 - DNA, 20 bp, Artificial Sequence
  chemically synthesized
atacagtaacgacaatgagc

SEQ ID NO: 5069 - DNA, 20 bp, Artificial Sequence
  chemically synthesized
gctccttaaggacaggatgt

SEQ ID NO: 5070 - DNA, 20 bp, Artificial Sequence
  chemically synthesized
aagacttacatcctgtcctt

SEQ ID NO: 5071 - DNA, 20 bp, Artificial Sequence
  chemically synthesized
agacttacatcctgtcctta

SEQ ID NO: 5072 - DNA, 20 bp, Artificial Sequence
  chemically synthesized
aacttaagctccttaaggac

SEQ ID NO: 5073 - DNA, 20 bp, Artificial Sequence
  chemically synthesized
gaacttaagctccttaagga

SEQ ID NO: 5074 - DNA, 20 bp, Artificial Sequence
  chemically synthesized
acttacatcctgtccttaag

SEQ ID NO: 5075 - DNA, 20 bp, Artificial Sequence
  chemically synthesized
cctagaacttaagctcctta

SEQ ID NO: 5076 - DNA, 20 bp, Artificial Sequence
  chemically synthesized
ccctagaacttaagctcctt

SEQ ID NO: 5077 - DNA, 20 bp, Artificial Sequence
  chemically synthesized
atcctgtccttaaggagctt

SEQ ID NO: 5078 - DNA, 20 bp, Artificial Sequence
  chemically synthesized
tccttaaggagcttaagttc

SEQ ID NO: 5079 - DNA, 20 bp, Artificial Sequence
  chemically synthesized
ccttaaggagcttaagttct

SEQ ID NO: 5080 - DNA, 20 bp, Artificial Sequence
  chemically synthesized
cctacaactccctagaactt

SEQ ID NO: 5081 - DNA, 20 bp, Artificial Sequence
  chemically synthesized
cttaaggagcttaagttcta

SEQ ID NO: 5082 - DNA, 20 bp, Artificial Sequence
  chemically synthesized
taaggagcttaagttctagg

SEQ ID NO: 5083 - DNA, 20 bp, Artificial Sequence
  chemically synthesized
ttcttctgcctacaactccc

SEQ ID NO: 5084 - DNA, 20 bp, Artificial Sequence
  chemically synthesized
gcttaagttctagggagttg

SEQ ID NO: 5085 - DNA, 20 bp, Artificial Sequence
  chemically synthesized
cttaagttctagggagttgt

SEQ ID NO: 5086 - DNA, 20 bp, Artificial Sequence
  chemically synthesized
aagttctagggagttgtagg

SEQ ID NO: 5087 - DNA, 20 bp, Artificial Sequence
  chemically synthesized
ttctagggagttgtaggcag

SEQ ID NO: 5088 - DNA, 20 bp, Artificial Sequence
  chemically synthesized
agggagttgtaggcagaaga

SEQ ID NO: 5089 - DNA, 20 bp, Artificial Sequence
  chemically synthesized
gagttgtaggcagaagaaag

SEQ ID NO: 5090 - DNA, 20 bp, Artificial Sequence
  chemically synthesized
taggcagaagaaagaagtac

SEQ ID NO: 5091 - DNA, 20 bp, Artificial Sequence
  chemically synthesized
aagaaagaagtactagtaac

SEQ ID NO: 5092 - DNA, 20 bp, Artificial Sequence
  chemically synthesized
ccatgttttcagccagttac

SEQ ID NO: 5093 - DNA, 20 bp, Artificial Sequence
  chemically synthesized
cacccagccatgttttcagc

SEQ ID NO: 5094 - DNA, 20 bp, Artificial Sequence
  chemically synthesized
ctagtaactggctgaaaaca

SEQ ID NO: 5095 - DNA, 20 bp, Artificial Sequence
  chemically synthesized
accacacccagccatgtttt

SEQ ID NO: 5096 - DNA, 20 bp, Artificial Sequence
  chemically synthesized
taactggctgaaaacatggc

SEQ ID NO: 5097 - DNA, 20 bp, Artificial Sequence
  chemically synthesized
aactggctgaaaacatggct

SEQ ID NO: 5098 - DNA, 20 bp, Artificial Sequence
  chemically synthesized
gctgaaaacatggctgggtg

SEQ ID NO: 5099 - DNA, 20 bp, Artificial Sequence
  chemically synthesized
gaaaacatggctgggtgtgg

SEQ ID NO: 5100 - DNA, 20 bp, Artificial Sequence
  chemically synthesized
aaggcatgagccaccacacc

SEQ ID NO: 5101 - DNA, 20 bp, Artificial Sequence
  chemically synthesized
agtgctgggattaaaggcat

SEQ ID NO: 5102 - DNA, 20 bp, Artificial Sequence
  chemically synthesized
gtggctcatgcctttaatcc

SEQ ID NO: 5103 - DNA, 20 bp, Artificial Sequence
  chemically synthesized
tcccaaagtgctgggattaa

SEQ ID NO: 5104 - DNA, 20 bp, Artificial Sequence
  chemically synthesized
ctcccaaagtgctgggatta

SEQ ID NO: 5105 - DNA, 20 bp, Artificial Sequence
  chemically synthesized
tgcctttaatcccagcactt

SEQ ID NO: 5106 - DNA, 20 bp, Artificial Sequence
  chemically synthesized
cctcagcctcccaaagtgct

SEQ ID NO: 5107 - DNA, 20 bp, Artificial Sequence
  chemically synthesized
gcctttaatcccagcacttt

SEQ ID NO: 5108 - DNA, 20 bp, Artificial Sequence
  chemically synthesized
gcctcagcctcccaaagtgc

SEQ ID NO: 5109 - DNA, 20 bp, Artificial Sequence
  chemically synthesized
ctttaatcccagcactttgg

SEQ ID NO: 5110 - DNA, 20 bp, Artificial Sequence
  chemically synthesized
tttaatcccagcactttggg

SEQ ID NO: 5111 - DNA, 20 bp, Artificial Sequence
  chemically synthesized
ccacccgcctcagcctccca

SEQ ID NO: 5112 - DNA, 20 bp, Artificial Sequence
  chemically synthesized
tcccagcactttgggaggct

SEQ ID NO: 5113 - DNA, 20 bp, Artificial Sequence
  chemically synthesized
cccagcactttgggaggctg

SEQ ID NO: 5114 - DNA, 20 bp, Artificial Sequence
  chemically synthesized
agcactttgggaggctgagg

SEQ ID NO: 5115 - DNA, 20 bp, Artificial Sequence
  chemically synthesized
gcactttgggaggctgaggc

SEQ ID NO: 5116 - DNA, 20 bp, Artificial Sequence
  chemically synthesized
ctttgggaggctgaggcggg

SEQ ID NO: 5117 - DNA, 20 bp, Artificial Sequence
  chemically synthesized
ctcaagcaatccacccgcct

SEQ ID NO: 5118 - DNA, 20 bp, Artificial Sequence
  chemically synthesized
ctgaggcgggtggattgctt

SEQ ID NO: 5119 - DNA, 20 bp, Artificial Sequence
  chemically synthesized
tgaggcgggtggattgcttg

SEQ ID NO: 5120 - DNA, 20 bp, Artificial Sequence
  chemically synthesized
gcgggtggattgcttgaggt

SEQ ID NO: 5121 - DNA, 20 bp, Artificial Sequence
  chemically synthesized
cgggtggattgcttgaggtt

SEQ ID NO: 5122 - DNA, 20 bp, Artificial Sequence
  chemically synthesized
gttcttgaactcccaacctc

SEQ ID NO: 5123 - DNA, 20 bp, Artificial Sequence
  chemically synthesized
ggtggattgcttgaggttgg

SEQ ID NO: 5124 - DNA, 20 bp, Artificial Sequence
  chemically synthesized
ttgcttgaggttgggagttc

SEQ ID NO: 5125 - DNA, 20 bp, Artificial Sequence
  chemically synthesized
tgaggttgggagttcaagaa

SEQ ID NO: 5126 - DNA, 20 bp, Artificial Sequence
  chemically synthesized
ttgggagttcaagaacagcc

SEQ ID NO: 5127 - DNA, 20 bp, Artificial Sequence
  chemically synthesized
agggtttcaccatgttggcc

SEQ ID NO: 5128 - DNA, 20 bp, Artificial Sequence
  chemically synthesized
caagaacagcctggccaaca

SEQ ID NO: 5129 - DNA, 20 bp, Artificial Sequence
  chemically synthesized
cagggtttcaccatgttggc

SEQ ID NO: 5130 - DNA, 20 bp, Artificial Sequence
  chemically synthesized
gagacagggtttcaccatgt

SEQ ID NO: 5131 - DNA, 20 bp, Artificial Sequence
  chemically synthesized
ttgtatttttagtagagaca

SEQ ID NO: 5132 - DNA, 20 bp, Artificial Sequence
  chemically synthesized
cttgtatttttagtagagac

SEQ ID NO: 5133 - DNA, 20 bp, Artificial Sequence
  chemically synthesized
tcttgtatttttagtagaga

SEQ ID NO: 5134 - DNA, 20 bp, Artificial Sequence
  chemically synthesized
tttttcttgtatttttagta

SEQ ID NO: 5135 - DNA, 20 bp, Artificial Sequence
  chemically synthesized
actttttcttgtatttttag

SEQ ID NO: 5136 - DNA, 20 bp, Artificial Sequence
  chemically synthesized
cctgtctctactaaaaatac

SEQ ID NO: 5137 - DNA, 20 bp, Artificial Sequence
  chemically synthesized
gctactttttcttgtatttt

SEQ ID NO: 5138 - DNA, 20 bp, Artificial Sequence
  chemically synthesized
tctactaaaaatacaagaaa

SEQ ID NO: 5139 - DNA, 20 bp, Artificial Sequence
  chemically synthesized
actaaaaatacaagaaaaag

SEQ ID NO: 5140 - DNA, 20 bp, Artificial Sequence
  chemically synthesized
aaaatacaagaaaaagtagc

SEQ ID NO: 5141 - DNA, 20 bp, Artificial Sequence
  chemically synthesized
aaatacaagaaaaagtagcc

SEQ ID NO: 5142 - DNA, 20 bp, Artificial Sequence
  chemically synthesized
caagaaaaagtagccaggca

SEQ ID NO: 5143 - DNA, 20 bp, Artificial Sequence
  chemically synthesized
gaaaaagtagccaggcatgg

SEQ ID NO: 5144 - DNA, 20 bp, Artificial Sequence
  chemically synthesized
tacaggctcgccaccatgcc

SEQ ID NO: 5145 - DNA, 20 bp, Artificial Sequence
  chemically synthesized
aagtagccaggcatggtggc

SEQ ID NO: 5146 - DNA, 20 bp, Artificial Sequence
  chemically synthesized
tggtggcgagcctgtaatcc

SEQ ID NO: 5147 - DNA, 20 bp, Artificial Sequence
  chemically synthesized
tcctgagtagctgggattac

SEQ ID NO: 5148 - DNA, 20 bp, Artificial Sequence
  chemically synthesized
ctcctgagtagctgggatta

SEQ ID NO: 5149 - DNA, 20 bp, Artificial Sequence
  chemically synthesized
agcctgtaatcccagctact

SEQ ID NO: 5150 - DNA, 20 bp, Artificial Sequence
  chemically synthesized
cctcaccctcctgagtagct

SEQ ID NO: 5151 - DNA, 20 bp, Artificial Sequence
  chemically synthesized
gcctgtaatcccagctactc

SEQ ID NO: 5152 - DNA, 20 bp, Artificial Sequence
  chemically synthesized
gcctcaccctcctgagtagc

SEQ ID NO: 5153 - DNA, 20 bp, Artificial Sequence
  chemically synthesized
ctgtaatcccagctactcag

SEQ ID NO: 5154 - DNA, 20 bp, Artificial Sequence
  chemically synthesized
tgtaatcccagctactcagg

SEQ ID NO: 5155 - DNA, 20 bp, Artificial Sequence
  chemically synthesized
gtaatcccagctactcagga

SEQ ID NO: 5156 - DNA, 20 bp, Artificial Sequence
  chemically synthesized
tcctgcctcaccctcctgag

SEQ ID NO: 5157 - DNA, 20 bp, Artificial Sequence
  chemically synthesized
ttctcctgcctcaccctcct

SEQ ID NO: 5158 - DNA, 20 bp, Artificial Sequence
  chemically synthesized
tcccagctactcaggagggt

SEQ ID NO: 5159 - DNA, 20 bp, Artificial Sequence
  chemically synthesized
cccagctactcaggagggtg

SEQ ID NO: 5160 - DNA, 20 bp, Artificial Sequence
  chemically synthesized
agctactcaggagggtgagg

SEQ ID NO: 5161 - DNA, 20 bp, Artificial Sequence
  chemically synthesized
gctactcaggagggtgaggc

SEQ ID NO: 5162 - DNA, 20 bp, Artificial Sequence
  chemically synthesized
tactcaggagggtgaggcag

SEQ ID NO: 5163 - DNA, 20 bp, Artificial Sequence
  chemically synthesized
gcaggagaatcgcttgaacc

SEQ ID NO: 5164 - DNA, 20 bp, Artificial Sequence
  chemically synthesized
caggagaatcgcttgaaccc

SEQ ID NO: 5165 - DNA, 20 bp, Artificial Sequence
  chemically synthesized
aacctccacctcctgggttc

SEQ ID NO: 5166 - DNA, 20 bp, Artificial Sequence
  chemically synthesized
ggagaatcgcttgaacccag

SEQ ID NO: 5167 - DNA, 20 bp, Artificial Sequence
  chemically synthesized
gagaatcgcttgaacccagg

SEQ ID NO: 5168 - DNA, 20 bp, Artificial Sequence
  chemically synthesized
aatcgcttgaacccaggagg

SEQ ID NO: 5169 - DNA, 20 bp, Artificial Sequence
  chemically synthesized
cattgcaacctccacctcct

SEQ ID NO: 5170 - DNA, 20 bp, Artificial Sequence
  chemically synthesized
tcgcttgaacccaggaggtg

SEQ ID NO: 5171 - DNA, 20 bp, Artificial Sequence
  chemically synthesized
tcattgcaacctccacctcc

SEQ ID NO: 5172 - DNA, 20 bp, Artificial Sequence
  chemically synthesized
cgcttgaacccaggaggtgg

SEQ ID NO: 5173 - DNA, 20 bp, Artificial Sequence
  chemically synthesized
caggaggtggaggttgcaat

SEQ ID NO: 5174 - DNA, 20 bp, Artificial Sequence
  chemically synthesized
ggtggaggttgcaatgagct

SEQ ID NO: 5175 - DNA, 20 bp, Artificial Sequence
  chemically synthesized
ggagtgcagtggtgcgatct

SEQ ID NO: 5176 - DNA, 20 bp, Artificial Sequence
  chemically synthesized
ttgcccaggctggagtgcag

SEQ ID NO: 5177 - DNA, 20 bp, Artificial Sequence
  chemically synthesized
gagatcgcaccactgcactc

SEQ ID NO: 5178 - DNA, 20 bp, Artificial Sequence
  chemically synthesized
ttattgcccaggctggagtg

SEQ ID NO: 5179 - DNA, 20 bp, Artificial Sequence
  chemically synthesized
cgcaccactgcactccagcc

SEQ ID NO: 5180 - DNA, 20 bp, Artificial Sequence
  chemically synthesized
gcaccactgcactccagcct

SEQ ID NO: 5181 - DNA, 20 bp, Artificial Sequence
  chemically synthesized
tcgctttattgcccaggctg

SEQ ID NO: 5182 - DNA, 20 bp, Artificial Sequence
  chemically synthesized
tctcgctttattgcccaggc

SEQ ID NO: 5183 - DNA, 20 bp, Artificial Sequence
  chemically synthesized
ggagtctcgctttattgccc

SEQ ID NO: 5184 - DNA, 20 bp, Artificial Sequence
  chemically synthesized
gcactccagcctgggcaata

SEQ ID NO: 5185 - DNA, 20 bp, Artificial Sequence
  chemically synthesized
cggagtctcgctttattgcc

SEQ ID NO: 5186 - DNA, 20 bp, Artificial Sequence
  chemically synthesized
tccagcctgggcaataaagc

SEQ ID NO: 5187 - DNA, 20 bp, Artificial Sequence
  chemically synthesized
tgtttcttttgtgtgagacg

SEQ ID NO: 5188 - DNA, 20 bp, Artificial Sequence
  chemically synthesized
gttgtttcttttgtgtgaga

SEQ ID NO: 5189 - DNA, 20 bp, Artificial Sequence
  chemically synthesized
cgagactccgtctcacacaa

SEQ ID NO: 5190 - DNA, 20 bp, Artificial Sequence
  chemically synthesized
tgttgttgtttcttttgtgt

SEQ ID NO: 5191 - DNA, 20 bp, Artificial Sequence
  chemically synthesized
aacaacaacaacaacaaaac

SEQ ID NO: 5192 - DNA, 20 bp, Artificial Sequence
  chemically synthesized
aatcatgcattatatcattc

SEQ ID NO: 5193 - DNA, 20 bp, Artificial Sequence
  chemically synthesized
gaatgatataatgcatgatt

SEQ ID NO: 5194 - DNA, 20 bp, Artificial Sequence
  chemically synthesized
aatgcatgattaagttccaa

SEQ ID NO: 5195 - DNA, 20 bp, Artificial Sequence
  chemically synthesized
tcactcagtgagttttcttt

SEQ ID NO: 5196 - DNA, 20 bp, Artificial Sequence
  chemically synthesized
gttccaaaagaaaactcact

SEQ ID NO: 5197 - DNA, 20 bp, Artificial Sequence
  chemically synthesized
atcctttcttttcactcagt

SEQ ID NO: 5198 - DNA, 20 bp, Artificial Sequence
  chemically synthesized
aagaaaactcactgagtgaa

SEQ ID NO: 5199 - DNA, 20 bp, Artificial Sequence
  chemically synthesized
tagcatcctttcttttcact

SEQ ID NO: 5200 - DNA, 20 bp, Artificial Sequence
  chemically synthesized
aaactcactgagtgaaaaga

SEQ ID NO: 5201 - DNA, 20 bp, Artificial Sequence
  chemically synthesized
aactcactgagtgaaaagaa

SEQ ID NO: 5202 - DNA, 20 bp, Artificial Sequence
  chemically synthesized
aaagaaaggatgctatattt

SEQ ID NO: 5203 - DNA, 20 bp, Artificial Sequence
  chemically synthesized
aagaaaggatgctatatttc

SEQ ID NO: 5204 - DNA, 20 bp, Artificial Sequence
  chemically synthesized
tatgttcttaacctgaaata

SEQ ID NO: 5205 - DNA, 20 bp, Artificial Sequence
  chemically synthesized
aggatgctatatttcaggtt

SEQ ID NO: 5206 - DNA, 20 bp, Artificial Sequence
  chemically synthesized
gttaagaacataatgtactc

SEQ ID NO: 5207 - DNA, 20 bp, Artificial Sequence
  chemically synthesized
ttaagaacataatgtactca

SEQ ID NO: 5208 - DNA, 20 bp, Artificial Sequence
  chemically synthesized
acataatgtactcaaggcca

SEQ ID NO: 5209 - DNA, 20 bp, Artificial Sequence
  chemically synthesized
taaatgtgctctttggcctt

SEQ ID NO: 5210 - DNA, 20 bp, Artificial Sequence
  chemically synthesized
ataatgtactcaaggccaaa

SEQ ID NO: 5211 - DNA, 20 bp, Artificial Sequence
  chemically synthesized
aacagaataaatgtgctctt

SEQ ID NO: 5212 - DNA, 20 bp, Artificial Sequence
  chemically synthesized
ttatgccttctgtttgacaa

SEQ ID NO: 5213 - DNA, 20 bp, Artificial Sequence
  chemically synthesized
acatttattctgttgtcaaa

SEQ ID NO: 5214 - DNA, 20 bp, Artificial Sequence
  chemically synthesized
tttattctgttgtcaaacag

SEQ ID NO: 5215 - DNA, 20 bp, Artificial Sequence
  chemically synthesized
ttattctgttgtcaaacaga

SEQ ID NO: 5216 - DNA, 20 bp, Artificial Sequence
  chemically synthesized
cagaaggcataaaatgctta

SEQ ID NO: 5217 - DNA, 20 bp, Artificial Sequence
  chemically synthesized
gaaggcataaaatgcttaaa

SEQ ID NO: 5218 - DNA, 20 bp, Artificial Sequence
  chemically synthesized
aaggcataaaatgcttaaag

SEQ ID NO: 5219 - DNA, 20 bp, Artificial Sequence
  chemically synthesized
aggcataaaatgcttaaaga

SEQ ID NO: 5220 - DNA, 20 bp, Artificial Sequence
  chemically synthesized
ggcataaaatgcttaaagag

SEQ ID NO: 5221 - DNA, 20 bp, Artificial Sequence
  chemically synthesized
atcatattattcccctcttt

SEQ ID NO: 5222 - DNA, 20 bp, Artificial Sequence
  chemically synthesized
ataatatgatataatttgaa

SEQ ID NO: 5223 - DNA, 20 bp, Artificial Sequence
  chemically synthesized
atatgatataatttgaatgg

SEQ ID NO: 5224 - DNA, 20 bp, Artificial Sequence
  chemically synthesized
tgatataatttgaatggtag

SEQ ID NO: 5225 - DNA, 20 bp, Artificial Sequence
  chemically synthesized
atataatttgaatggtagaa

SEQ ID NO: 5226 - DNA, 20 bp, Artificial Sequence
  chemically synthesized
tataatttgaatggtagaag

SEQ ID NO: 5227 - DNA, 20 bp, Artificial Sequence
  chemically synthesized
gaatggtagaagaggaactg

SEQ ID NO: 5228 - DNA, 20 bp, Artificial Sequence
  chemically synthesized
agaagaggaactgaagtttc

SEQ ID NO: 5229 - DNA, 20 bp, Artificial Sequence
  chemically synthesized
aagctatcttccagaaactt

SEQ ID NO: 5230 - DNA, 20 bp, Artificial Sequence
  chemically synthesized
agaggaactgaagtttctgg

SEQ ID NO: 5231 - DNA, 20 bp, Artificial Sequence
  chemically synthesized
gaactgaagtttctggaaga

SEQ ID NO: 5232 - DNA, 20 bp, Artificial Sequence
  chemically synthesized
tccctttctaagctatcttc

SEQ ID NO: 5233 - DNA, 20 bp, Artificial Sequence
  chemically synthesized
gaagtttctggaagatagct

SEQ ID NO: 5234 - DNA, 20 bp, Artificial Sequence
  chemically synthesized
tttctggaagatagcttaga

SEQ ID NO: 5235 - DNA, 20 bp, Artificial Sequence
  chemically synthesized
ttctggaagatagcttagaa

SEQ ID NO: 5236 - DNA, 20 bp, Artificial Sequence
  chemically synthesized
tctggaagatagcttagaaa

SEQ ID NO: 5237 - DNA, 20 bp, Artificial Sequence
  chemically synthesized
tggaagatagcttagaaagg

SEQ ID NO: 5238 - DNA, 20 bp, Artificial Sequence
  chemically synthesized
tttggtctctctccctttct

SEQ ID NO: 5239 - DNA, 20 bp, Artificial Sequence
  chemically synthesized
gaagatagcttagaaaggga

SEQ ID NO: 5240 - DNA, 20 bp, Artificial Sequence
  chemically synthesized
agatagcttagaaagggaga

SEQ ID NO: 5241 - DNA, 20 bp, Artificial Sequence
  chemically synthesized
ttagaaagggagagagacca

SEQ ID NO: 5242 - DNA, 20 bp, Artificial Sequence
  chemically synthesized
tagaaagggagagagaccaa

SEQ ID NO: 5243 - DNA, 20 bp, Artificial Sequence
  chemically synthesized
aaagggagagagaccaaagg

SEQ ID NO: 5244 - DNA, 20 bp, Artificial Sequence
  chemically synthesized
agggagagagaccaaaggca

SEQ ID NO: 5245 - DNA, 20 bp, Artificial Sequence
  chemically synthesized
gggagagagaccaaaggcag

SEQ ID NO: 5246 - DNA, 20 bp, Artificial Sequence
  chemically synthesized
ctaattggttcctctgcctt

SEQ ID NO: 5247 - DNA, 20 bp, Artificial Sequence
  chemically synthesized
ccaaaggcagaggaaccaat

SEQ ID NO: 5248 - DNA, 20 bp, Artificial Sequence
  chemically synthesized
caaaggcagaggaaccaatt

SEQ ID NO: 5249 - DNA, 20 bp, Artificial Sequence
  chemically synthesized
ggcagaggaaccaattagga

SEQ ID NO: 5250 - DNA, 20 bp, Artificial Sequence
  chemically synthesized
aatatgaatactttcctaat

SEQ ID NO: 5251 - DNA, 20 bp, Artificial Sequence
  chemically synthesized
aagtattcatattgtctgtt

SEQ ID NO: 5252 - DNA, 20 bp, Artificial Sequence
  chemically synthesized
agtattcatattgtctgttc

SEQ ID NO: 5253 - DNA, 20 bp, Artificial Sequence
  chemically synthesized
ctcatcatgtgttacctgaa

SEQ ID NO: 5254 - DNA, 20 bp, Artificial Sequence
  chemically synthesized
ctgttcaggtaacacatgat

SEQ ID NO: 5255 - DNA, 20 bp, Artificial Sequence
  chemically synthesized
tgttcaggtaacacatgatg

SEQ ID NO: 5256 - DNA, 20 bp, Artificial Sequence
  chemically synthesized
gttcaggtaacacatgatga

SEQ ID NO: 5257 - DNA, 20 bp, Artificial Sequence
  chemically synthesized
cacatgatgagggctaaatt

SEQ ID NO: 5258 - DNA, 20 bp, Artificial Sequence
  chemically synthesized
acatgatgagggctaaattt

SEQ ID NO: 5259 - DNA, 20 bp, Artificial Sequence
  chemically synthesized
cagctacttctgcccaaatt

SEQ ID NO: 5260 - DNA, 20 bp, Artificial Sequence
  chemically synthesized
tgatgagggctaaatttggg

SEQ ID NO: 5261 - DNA, 20 bp, Artificial Sequence
  chemically synthesized
tgagggctaaatttgggcag

SEQ ID NO: 5262 - DNA, 20 bp, Artificial Sequence
  chemically synthesized
gggctaaatttgggcagaag

SEQ ID NO: 5263 - DNA, 20 bp, Artificial Sequence
  chemically synthesized
gggcagaagtagctgaattg

SEQ ID NO: 5264 - DNA, 20 bp, Artificial Sequence
  chemically synthesized
aagagcaaaattcttcaatt

SEQ ID NO: 5265 - DNA, 20 bp, Artificial Sequence
  chemically synthesized
gttttgctacttatgaaaaa

SEQ ID NO: 5266 - DNA, 20 bp, Artificial Sequence
  chemically synthesized
agaattttgctctttttcat

SEQ ID NO: 5267 - DNA, 20 bp, Artificial Sequence
  chemically synthesized
gtgttttgctacttatgaaa

SEQ ID NO: 5268 - DNA, 20 bp, Artificial Sequence
  chemically synthesized
attttgctctttttcataag

SEQ ID NO: 5269 - DNA, 20 bp, Artificial Sequence
  chemically synthesized
gtagcaaaacacactgacct

SEQ ID NO: 5270 - DNA, 20 bp, Artificial Sequence
  chemically synthesized
atcaatccagtcaccaaggt

SEQ ID NO: 5271 - DNA, 20 bp, Artificial Sequence
  chemically synthesized
aacacactgaccttggtgac

SEQ ID NO: 5272 - DNA, 20 bp, Artificial Sequence
  chemically synthesized
caccatcaatccagtcacca

SEQ ID NO: 5273 - DNA, 20 bp, Artificial Sequence
  chemically synthesized
ccaccatcaatccagtcacc

SEQ ID NO: 5274 - DNA, 20 bp, Artificial Sequence
  chemically synthesized
gaccttggtgactggattga

SEQ ID NO: 5275 - DNA, 20 bp, Artificial Sequence
  chemically synthesized
atgttccaccaccatcaatc

SEQ ID NO: 5276 - DNA, 20 bp, Artificial Sequence
  chemically synthesized
cttggtgactggattgatgg

SEQ ID NO: 5277 - DNA, 20 bp, Artificial Sequence
  chemically synthesized
ggtgactggattgatggtgg

SEQ ID NO: 5278 - DNA, 20 bp, Artificial Sequence
  chemically synthesized
ggattgatggtggtggaaca

SEQ ID NO: 5279 - DNA, 20 bp, Artificial Sequence
  chemically synthesized
gatggtggtggaacatagct

SEQ ID NO: 5280 - DNA, 20 bp, Artificial Sequence
  chemically synthesized
atggtggtggaacatagcta

SEQ ID NO: 5281 - DNA, 20 bp, Artificial Sequence
  chemically synthesized
gtggtggaacatagctaagg

SEQ ID NO: 5282 - DNA, 20 bp, Artificial Sequence
  chemically synthesized
tggtggaacatagctaagga

SEQ ID NO: 5283 - DNA, 20 bp, Artificial Sequence
  chemically synthesized
tggaacatagctaaggaagg

SEQ ID NO: 5284 - DNA, 20 bp, Artificial Sequence
  chemically synthesized
cttcctttacctgccttcct

SEQ ID NO: 5285 - DNA, 20 bp, Artificial Sequence
  chemically synthesized
ggaacatagctaaggaaggc

SEQ ID NO: 5286 - DNA, 20 bp, Artificial Sequence
  chemically synthesized
atagctaaggaaggcaggta

SEQ ID NO: 5287 - DNA, 20 bp, Artificial Sequence
  chemically synthesized
tagctaaggaaggcaggtaa

SEQ ID NO: 5288 - DNA, 20 bp, Artificial Sequence
  chemically synthesized
ctaaggaaggcaggtaaagg

SEQ ID NO: 5289 - DNA, 20 bp, Artificial Sequence
  chemically synthesized
aggaaggcaggtaaaggaag

SEQ ID NO: 5290 - DNA, 20 bp, Artificial Sequence
  chemically synthesized
ggaaggcaggtaaaggaaga

SEQ ID NO: 5291 - DNA, 20 bp, Artificial Sequence
  chemically synthesized
gaaggcaggtaaaggaagaa

SEQ ID NO: 5292 - DNA, 20 bp, Artificial Sequence
  chemically synthesized
aaggcaggtaaaggaagaag

SEQ ID NO: 5293 - DNA, 20 bp, Artificial Sequence
  chemically synthesized
gcaggtaaaggaagaagggg

SEQ ID NO: 5294 - DNA, 20 bp, Artificial Sequence
  chemically synthesized
gggtagaaaatgactttgta

SEQ ID NO: 5295 - DNA, 20 bp, Artificial Sequence
  chemically synthesized
ccaatttcccaatctataca

SEQ ID NO: 5296 - DNA, 20 bp, Artificial Sequence
  chemically synthesized
gaaaatgactttgtatagat

SEQ ID NO: 5297 - DNA, 20 bp, Artificial Sequence
  chemically synthesized
aaaatgactttgtatagatt

SEQ ID NO: 5298 - DNA, 20 bp, Artificial Sequence
  chemically synthesized
ctttgtatagattgggaaat

SEQ ID NO: 5299 - DNA, 20 bp, Artificial Sequence
  chemically synthesized
tgtatagattgggaaattgg

SEQ ID NO: 5300 - DNA, 20 bp, Artificial Sequence
  chemically synthesized
tatagattgggaaattggaa

SEQ ID NO: 5301 - DNA, 20 bp, Artificial Sequence
  chemically synthesized
aaattggaagagatgctcca

SEQ ID NO: 5302 - DNA, 20 bp, Artificial Sequence
  chemically synthesized
aattggaagagatgctccaa

SEQ ID NO: 5303 - DNA, 20 bp, Artificial Sequence
  chemically synthesized
gaaatcatgatcaacctttg

SEQ ID NO: 5304 - DNA, 20 bp, Artificial Sequence
  chemically synthesized
ctgaaatcatgatcaacctt

SEQ ID NO: 5305 - DNA, 20 bp, Artificial Sequence
  chemically synthesized
ccaaaggttgatcatgattt

SEQ ID NO: 5306 - DNA, 20 bp, Artificial Sequence
  chemically synthesized
ggttgatcatgatttcagat

SEQ ID NO: 5307 - DNA, 20 bp, Artificial Sequence
  chemically synthesized
gttgatcatgatttcagatt

SEQ ID NO: 5308 - DNA, 20 bp, Artificial Sequence
  chemically synthesized
taaaattataaataaaaata

SEQ ID NO: 5309 - DNA, 20 bp, Artificial Sequence
  chemically synthesized
tttttatttataattttatc

SEQ ID NO: 5310 - DNA, 20 bp, Artificial Sequence
  chemically synthesized
ttatttataattttatccag

SEQ ID NO: 5311 - DNA, 20 bp, Artificial Sequence
  chemically synthesized
cctcccacctgagcatcttc

SEQ ID NO: 5312 - DNA, 20 bp, Artificial Sequence
  chemically synthesized
aattttatccagaagatgct

SEQ ID NO: 5313 - DNA, 20 bp, Artificial Sequence
  chemically synthesized
attttatccagaagatgctc

SEQ ID NO: 5314 - DNA, 20 bp, Artificial Sequence
  chemically synthesized
ttatccagaagatgctcagg

SEQ ID NO: 5315 - DNA, 20 bp, Artificial Sequence
  chemically synthesized
tatccagaagatgctcaggt

SEQ ID NO: 5316 - DNA, 20 bp, Artificial Sequence
  chemically synthesized
tccagaagatgctcaggtgg

SEQ ID NO: 5317 - DNA, 20 bp, Artificial Sequence
  chemically synthesized
ccagaagatgctcaggtggg

SEQ ID NO: 5318 - DNA, 20 bp, Artificial Sequence
  chemically synthesized
ccagcccagacctcccacct

SEQ ID NO: 5319 - DNA, 20 bp, Artificial Sequence
  chemically synthesized
agatgctcaggtgggaggtc

SEQ ID NO: 5320 - DNA, 20 bp, Artificial Sequence
  chemically synthesized
gatgctcaggtgggaggtct

SEQ ID NO: 5321 - DNA, 20 bp, Artificial Sequence
  chemically synthesized
ctcaggtgggaggtctgggc

SEQ ID NO: 5322 - DNA, 20 bp, Artificial Sequence
  chemically synthesized
ttaagtcaagatttccagcc

SEQ ID NO: 5323 - DNA, 20 bp, Artificial Sequence
  chemically synthesized
aactcttaagtcaagatttc

SEQ ID NO: 5324 - DNA, 20 bp, Artificial Sequence
  chemically synthesized
tgggctggaaatcttgactt

SEQ ID NO: 5325 - DNA, 20 bp, Artificial Sequence
  chemically synthesized
ggctggaaatcttgacttaa

SEQ ID NO: 5326 - DNA, 20 bp, Artificial Sequence
  chemically synthesized
atgctgacaactcttaagtc

SEQ ID NO: 5327 - DNA, 20 bp, Artificial Sequence
  chemically synthesized
ctgctatgctgacaactctt

SEQ ID NO: 5328 - DNA, 20 bp, Artificial Sequence
  chemically synthesized
aatcttgacttaagagttgt

SEQ ID NO: 5329 - DNA, 20 bp, Artificial Sequence
  chemically synthesized
tgacttaagagttgtcagca

SEQ ID NO: 5330 - DNA, 20 bp, Artificial Sequence
  chemically synthesized
cttaagagttgtcagcatag

SEQ ID NO: 5331 - DNA, 20 bp, Artificial Sequence
  chemically synthesized
aagagttgtcagcatagcag

SEQ ID NO: 5332 - DNA, 20 bp, Artificial Sequence
  chemically synthesized
tgtcagcatagcagaagcca

SEQ ID NO: 5333 - DNA, 20 bp, Artificial Sequence
  chemically synthesized
gcatagcagaagccaaagta

SEQ ID NO: 5334 - DNA, 20 bp, Artificial Sequence
  chemically synthesized
tgggcgctccttccatactt

SEQ ID NO: 5335 - DNA, 20 bp, Artificial Sequence
  chemically synthesized
tagcagaagccaaagtatgg

SEQ ID NO: 5336 - DNA, 20 bp, Artificial Sequence
  chemically synthesized
agcagaagccaaagtatgga

SEQ ID NO: 5337 - DNA, 20 bp, Artificial Sequence
  chemically synthesized
cagaagccaaagtatggaag

SEQ ID NO: 5338 - DNA, 20 bp, Artificial Sequence
  chemically synthesized
caaagtatggaaggagcgcc

SEQ ID NO: 5339 - DNA, 20 bp, Artificial Sequence
  chemically synthesized
aaagtatggaaggagcgccc

SEQ ID NO: 5340 - DNA, 20 bp, Artificial Sequence
  chemically synthesized
aagtatggaaggagcgccca

SEQ ID NO: 5341 - DNA, 20 bp, Artificial Sequence
  chemically synthesized
gtatggaaggagcgcccagg

SEQ ID NO: 5342 - DNA, 20 bp, Artificial Sequence
  chemically synthesized
atggaaggagcgcccaggga

SEQ ID NO: 5343 - DNA, 20 bp, Artificial Sequence
  chemically synthesized
caccgttcttcactctccct

SEQ ID NO: 5344 - DNA, 20 bp, Artificial Sequence
  chemically synthesized
tcaccgttcttcactctccc

SEQ ID NO: 5345 - DNA, 20 bp, Artificial Sequence
  chemically synthesized
aggagcgcccagggagagtg

SEQ ID NO: 5346 - DNA, 20 bp, Artificial Sequence
  chemically synthesized
cgcccagggagagtgaagaa

SEQ ID NO: 5347 - DNA, 20 bp, Artificial Sequence
  chemically synthesized
agggagagtgaagaacggtg

SEQ ID NO: 5348 - DNA, 20 bp, Artificial Sequence
  chemically synthesized
gggagagtgaagaacggtga

SEQ ID NO: 5349 - DNA, 20 bp, Artificial Sequence
  chemically synthesized
ggagagtgaagaacggtgaa

SEQ ID NO: 5350 - DNA, 20 bp, Artificial Sequence
  chemically synthesized
gagagtgaagaacggtgaag

SEQ ID NO: 5351 - DNA, 20 bp, Artificial Sequence
  chemically synthesized
gtgaagaacggtgaagggga

SEQ ID NO: 5352 - DNA, 20 bp, Artificial Sequence
  chemically synthesized
gaagaacggtgaaggggatg

SEQ ID NO: 5353 - DNA, 20 bp, Artificial Sequence
  chemically synthesized
tgaaggggatggagaatctt

SEQ ID NO: 5354 - DNA, 20 bp, Artificial Sequence
  chemically synthesized
gaaggggatggagaatcttg

SEQ ID NO: 5355 - DNA, 20 bp, Artificial Sequence
  chemically synthesized
atcacatcaaggttttcctc

SEQ ID NO: 5356 - DNA, 20 bp, Artificial Sequence
  chemically synthesized
atcctcagtacatcacatca

SEQ ID NO: 5357 - DNA, 20 bp, Artificial Sequence
  chemically synthesized
tatcctcagtacatcacatc

SEQ ID NO: 5358 - DNA, 20 bp, Artificial Sequence
  chemically synthesized
aaaccttgatgtgatgtact

SEQ ID NO: 5359 - DNA, 20 bp, Artificial Sequence
  chemically synthesized
aaccttgatgtgatgtactg

SEQ ID NO: 5360 - DNA, 20 bp, Artificial Sequence
  chemically synthesized
ccatataggtaaggtatcct

SEQ ID NO: 5361 - DNA, 20 bp, Artificial Sequence
  chemically synthesized
gccagattaccatataggta

SEQ ID NO: 5362 - DNA, 20 bp, Artificial Sequence
  chemically synthesized
ctgaggataccttacctata

SEQ ID NO: 5363 - DNA, 20 bp, Artificial Sequence
  chemically synthesized
tgccagattaccatataggt

SEQ ID NO: 5364 - DNA, 20 bp, Artificial Sequence
  chemically synthesized
tttatgccagattaccatat

SEQ ID NO: 5365 - DNA, 20 bp, Artificial Sequence
  chemically synthesized
ttttatgccagattaccata

SEQ ID NO: 5366 - DNA, 20 bp, Artificial Sequence
  chemically synthesized
accttacctatatggtaatc

SEQ ID NO: 5367 - DNA, 20 bp, Artificial Sequence
  chemically synthesized
tcgggttaaatgttttatgc

SEQ ID NO: 5368 - DNA, 20 bp, Artificial Sequence
  chemically synthesized
gtatccaagtgattgggttc

SEQ ID NO: 5369 - DNA, 20 bp, Artificial Sequence
  chemically synthesized
tgtatccaagtgattgggtt

SEQ ID NO: 5370 - DNA, 20 bp, Artificial Sequence
  chemically synthesized
ttaacccgaacccaatcact

SEQ ID NO: 5371 - DNA, 20 bp, Artificial Sequence
  chemically synthesized
ctgcttgtatccaagtgatt

SEQ ID NO: 5372 - DNA, 20 bp, Artificial Sequence
  chemically synthesized
tctgcttgtatccaagtgat

SEQ ID NO: 5373 - DNA, 20 bp, Artificial Sequence
  chemically synthesized
gaacccaatcacttggatac

SEQ ID NO: 5374 - DNA, 20 bp, Artificial Sequence
  chemically synthesized
gaatttgtctgcttgtatcc

SEQ ID NO: 5375 - DNA, 20 bp, Artificial Sequence
  chemically synthesized
cccaatcacttggatacaag

SEQ ID NO: 5376 - DNA, 20 bp, Artificial Sequence
  chemically synthesized
acaagcagacaaattcaaat

SEQ ID NO: 5377 - DNA, 20 bp, Artificial Sequence
  chemically synthesized
caagcagacaaattcaaatt

SEQ ID NO: 5378 - DNA, 20 bp, Artificial Sequence
  chemically synthesized
aagcagacaaattcaaattg

SEQ ID NO: 5379 - DNA, 20 bp, Artificial Sequence
  chemically synthesized
agcagacaaattcaaattgg

SEQ ID NO: 5380 - DNA, 20 bp, Artificial Sequence
  chemically synthesized
aggtcgggctagatgttttg

SEQ ID NO: 5381 - DNA, 20 bp, Artificial Sequence
  chemically synthesized
gggacattctacaaaacatc

SEQ ID NO: 5382 - DNA, 20 bp, Artificial Sequence
  chemically synthesized
tatattagaagaggtcgggc

SEQ ID NO: 5383 - DNA, 20 bp, Artificial Sequence
  chemically synthesized
ttgatatattagaagaggtc

SEQ ID NO: 5384 - DNA, 20 bp, Artificial Sequence
  chemically synthesized
attgatatattagaagaggt

SEQ ID NO: 5385 - DNA, 20 bp, Artificial Sequence
  chemically synthesized
tgacattgatatattagaag

SEQ ID NO: 5386 - DNA, 20 bp, Artificial Sequence
  chemically synthesized
atgacattgatatattagaa

SEQ ID NO: 5387 - DNA, 20 bp, Artificial Sequence
  chemically synthesized
tcatgacattgatatattag

SEQ ID NO: 5388 - DNA, 20 bp, Artificial Sequence
  chemically synthesized
ctttcatgacattgatatat

SEQ ID NO: 5389 - DNA, 20 bp, Artificial Sequence
  chemically synthesized
ctaatatatcaatgtcatga

SEQ ID NO: 5390 - DNA, 20 bp, Artificial Sequence
  chemically synthesized
tcaatgtcatgaaagattta

SEQ ID NO: 5391 - DNA, 20 bp, Artificial Sequence
  chemically synthesized
aatgtcatgaaagatttaaa

SEQ ID NO: 5392 - DNA, 20 bp, Artificial Sequence
  chemically synthesized
atgtcatgaaagatttaaag

SEQ ID NO: 5393 - DNA, 20 bp, Artificial Sequence
  chemically synthesized
catgaaagatttaaagaggc

SEQ ID NO: 5394 - DNA, 20 bp, Artificial Sequence
  chemically synthesized
atgaaagatttaaagaggct

SEQ ID NO: 5395 - DNA, 20 bp, Artificial Sequence
  chemically synthesized
aagatttaaagaggctggga

SEQ ID NO: 5396 - DNA, 20 bp, Artificial Sequence
  chemically synthesized
tttaatctgaagcactttcc

SEQ ID NO: 5397 - DNA, 20 bp, Artificial Sequence
  chemically synthesized
aagaggctgggaaagtgctt

SEQ ID NO: 5398 - DNA, 20 bp, Artificial Sequence
  chemically synthesized
tgggaaagtgcttcagatta

SEQ ID NO: 5399 - DNA, 20 bp, Artificial Sequence
  chemically synthesized
ctgtagtctcctttaatctg

SEQ ID NO: 5400 - DNA, 20 bp, Artificial Sequence
  chemically synthesized
gggaaagtgcttcagattaa

SEQ ID NO: 5401 - DNA, 20 bp, Artificial Sequence
  chemically synthesized
gaaagtgcttcagattaaag

SEQ ID NO: 5402 - DNA, 20 bp, Artificial Sequence
  chemically synthesized
cttcagattaaaggagacta

SEQ ID NO: 5403 - DNA, 20 bp, Artificial Sequence
  chemically synthesized
ttcagattaaaggagactac

SEQ ID NO: 5404 - DNA, 20 bp, Artificial Sequence
  chemically synthesized
tcagattaaaggagactaca

SEQ ID NO: 5405 - DNA, 20 bp, Artificial Sequence
  chemically synthesized
caggatcagtgatgtccctg

SEQ ID NO: 5406 - DNA, 20 bp, Artificial Sequence
  chemically synthesized
cgatattttacattcaggat

SEQ ID NO: 5407 - DNA, 20 bp, Artificial Sequence
  chemically synthesized
catagcgatattttacattc

SEQ ID NO: 5408 - DNA, 20 bp, Artificial Sequence
  chemically synthesized
tcatagcgatattttacatt

SEQ ID NO: 5409 - DNA, 20 bp, Artificial Sequence
  chemically synthesized
gaatgtaaaatatcgctatg

SEQ ID NO: 5410 - DNA, 20 bp, Artificial Sequence
  chemically synthesized
ctgccaattaatattcttca

SEQ ID NO: 5411 - DNA, 20 bp, Artificial Sequence
  chemically synthesized
tcgctatgaagaatattaat

SEQ ID NO: 5412 - DNA, 20 bp, Artificial Sequence
  chemically synthesized
ctatgaagaatattaattgg

SEQ ID NO: 5413 - DNA, 20 bp, Artificial Sequence
  chemically synthesized
agaatattaattggcagaat

SEQ ID NO: 5414 - DNA, 20 bp, Artificial Sequence
  chemically synthesized
aatattaattggcagaattg

SEQ ID NO: 5415 - DNA, 20 bp, Artificial Sequence
  chemically synthesized
atattaattggcagaattgg

SEQ ID NO: 5416 - DNA, 20 bp, Artificial Sequence
  chemically synthesized
aacaatactgttatataatg

SEQ ID NO: 5417 - DNA, 20 bp, Artificial Sequence
  chemically synthesized
ttaaattctacattatataa

SEQ ID NO: 5418 - DNA, 20 bp, Artificial Sequence
  chemically synthesized
ataacagtattgttcttttt

SEQ ID NO: 5419 - DNA, 20 bp, Artificial Sequence
  chemically synthesized
gcacaattatcatgctcaaa

SEQ ID NO: 5420 - DNA, 20 bp, Artificial Sequence
  chemically synthesized
catgataattgtgcttatgc

SEQ ID NO: 5421 - DNA, 20 bp, Artificial Sequence
  chemically synthesized
aatgaaagatattcttgcat

SEQ ID NO: 5422 - DNA, 20 bp, Artificial Sequence
  chemically synthesized
tgcaagaatatctttcattt

SEQ ID NO: 5423 - DNA, 20 bp, Artificial Sequence
  chemically synthesized
acacgtgccttctaaaatga

SEQ ID NO: 5424 - DNA, 20 bp, Artificial Sequence
  chemically synthesized
aagaatatctttcattttag

SEQ ID NO: 5425 - DNA, 20 bp, Artificial Sequence
  chemically synthesized
agaatatctttcattttaga

SEQ ID NO: 5426 - DNA, 20 bp, Artificial Sequence
  chemically synthesized
attttagaaggcacgtgttc

SEQ ID NO: 5427 - DNA, 20 bp, Artificial Sequence
  chemically synthesized
aaggcacgtgttcaagtgtt

SEQ ID NO: 5428 - DNA, 20 bp, Artificial Sequence
  chemically synthesized
aggcacgtgttcaagtgttt

SEQ ID NO: 5429 - DNA, 20 bp, Artificial Sequence
  chemically synthesized
ggcacgtgttcaagtgttta

SEQ ID NO: 5430 - DNA, 20 bp, Artificial Sequence
  chemically synthesized
gcacgtgttcaagtgtttag

SEQ ID NO: 5431 - DNA, 20 bp, Artificial Sequence
  chemically synthesized
tgttcaagtgtttaggggtg

SEQ ID NO: 5432 - DNA, 20 bp, Artificial Sequence
  chemically synthesized
atgtatgaaacctaaccatt

SEQ ID NO: 5433 - DNA, 20 bp, Artificial Sequence
  chemically synthesized
cactgatccactcaatggtt

SEQ ID NO: 5434 - DNA, 20 bp, Artificial Sequence
  chemically synthesized
tcactgatccactcaatggt

SEQ ID NO: 5435 - DNA, 20 bp, Artificial Sequence
  chemically synthesized
tatgaaacctaaccattgag

SEQ ID NO: 5436 - DNA, 20 bp, Artificial Sequence
  chemically synthesized
tttttcactgatccactcaa

SEQ ID NO: 5437 - DNA, 20 bp, Artificial Sequence
  chemically synthesized
aacctaaccattgagtggat

SEQ ID NO: 5438 - DNA, 20 bp, Artificial Sequence
  chemically synthesized
tcatgcgtgtatatagtttg

SEQ ID NO: 5439 - DNA, 20 bp, Artificial Sequence
  chemically synthesized
atcatattcatgcgtgtata

SEQ ID NO: 5440 - DNA, 20 bp, Artificial Sequence
  chemically synthesized
acataaaatataaacatata

SEQ ID NO: 5441 - DNA, 20 bp, Artificial Sequence
  chemically synthesized
tataaaaatatgttaacata

SEQ ID NO: 5442 - DNA, 20 bp, Artificial Sequence
  chemically synthesized
ttaaatggattgcatatatt

SEQ ID NO: 5443 - DNA, 20 bp, Artificial Sequence
  chemically synthesized
tacattcatgtgttgttaaa

SEQ ID NO: 5444 - DNA, 20 bp, Artificial Sequence
  chemically synthesized
ttaacaacacatgaatgtaa

SEQ ID NO: 5445 - DNA, 20 bp, Artificial Sequence
  chemically synthesized
tgtaaaagtacataaataaa

SEQ ID NO: 5446 - DNA, 20 bp, Artificial Sequence
  chemically synthesized
tacataaataaatagctata

SEQ ID NO: 5447 - DNA, 20 bp, Artificial Sequence
  chemically synthesized
agtttgccacatttgcttta

SEQ ID NO: 5448 - DNA, 20 bp, Artificial Sequence
  chemically synthesized
aaatagctataaagcaaatg

SEQ ID NO: 5449 - DNA, 20 bp, Artificial Sequence
  chemically synthesized
caaaactgcaattaattcaa

SEQ ID NO: 5450 - DNA, 20 bp, Artificial Sequence
  chemically synthesized
gcaaactgttgaattaattg

SEQ ID NO: 5451 - DNA, 20 bp, Artificial Sequence
  chemically synthesized
attaattgcagttttgccat

SEQ ID NO: 5452 - DNA, 20 bp, Artificial Sequence
  chemically synthesized
ttagaacaatttcaaactta

SEQ ID NO: 5453 - DNA, 20 bp, Artificial Sequence
  chemically synthesized
ttgaaattgttctaaataaa

SEQ ID NO: 5454 - DNA, 20 bp, Artificial Sequence
  chemically synthesized
tggctccctagctttttatt

SEQ ID NO: 5455 - DNA, 20 bp, Artificial Sequence
  chemically synthesized
aattgttctaaataaaaagc

SEQ ID NO: 5456 - DNA, 20 bp, Artificial Sequence
  chemically synthesized
attgttctaaataaaaagct

SEQ ID NO: 5457 - DNA, 20 bp, Artificial Sequence
  chemically synthesized
ttgttctaaataaaaagcta

SEQ ID NO: 5458 - DNA, 20 bp, Artificial Sequence
  chemically synthesized
gttctaaataaaaagctagg

SEQ ID NO: 5459 - DNA, 20 bp, Artificial Sequence
  chemically synthesized
tttatgacataatggctccc

SEQ ID NO: 5460 - DNA, 20 bp, Artificial Sequence
  chemically synthesized
atttgaggtttatgacataa

SEQ ID NO: 5461 - DNA, 20 bp, Artificial Sequence
  chemically synthesized
aaatttatcatgtacatttg

SEQ ID NO: 5462 - DNA, 20 bp, Artificial Sequence
  chemically synthesized
aaaatttatcatgtacattt

SEQ ID NO: 5463 - DNA, 20 bp, Artificial Sequence
  chemically synthesized
tacatgataaattttttaaa

SEQ ID NO: 5464 - DNA, 20 bp, Artificial Sequence
  chemically synthesized
gataaattttttaaaaagca

SEQ ID NO: 5465 - DNA, 20 bp, Artificial Sequence
  chemically synthesized
ataaattttttaaaaagcaa

SEQ ID NO: 5466 - DNA, 20 bp, Artificial Sequence
  chemically synthesized
ttttttaaaaagcaaaggaa

SEQ ID NO: 5467 - DNA, 20 bp, Artificial Sequence
  chemically synthesized
atataaaatgcttcaaaaaa

SEQ ID NO: 5468 - DNA, 20 bp, Artificial Sequence
  chemically synthesized
caccagattactgttttttg

SEQ ID NO: 5469 - DNA, 20 bp, Artificial Sequence
  chemically synthesized
tgcttcaaaaaacagtaatc

SEQ ID NO: 5470 - DNA, 20 bp, Artificial Sequence
  chemically synthesized
ttcaaaaaacagtaatctgg

SEQ ID NO: 5471 - DNA, 20 bp, Artificial Sequence
  chemically synthesized
aaaaacagtaatctggtgga

SEQ ID NO: 5472 - DNA, 20 bp, Artificial Sequence
  chemically synthesized
gatgactcctaactttccac

SEQ ID NO: 5473 - DNA, 20 bp, Artificial Sequence
  chemically synthesized
acagtaatctggtggaaagt

SEQ ID NO: 5474 - DNA, 20 bp, Artificial Sequence
  chemically synthesized
cagtaatctggtggaaagtt

SEQ ID NO: 5475 - DNA, 20 bp, Artificial Sequence
  chemically synthesized
gtaatctggtggaaagttag

SEQ ID NO: 5476 - DNA, 20 bp, Artificial Sequence
  chemically synthesized
ggtggaaagttaggagtcat

SEQ ID NO: 5477 - DNA, 20 bp, Artificial Sequence
  chemically synthesized
tggaaagttaggagtcatca

SEQ ID NO: 5478 - DNA, 20 bp, Artificial Sequence
  chemically synthesized
agttaggagtcatcagagat

SEQ ID NO: 5479 - DNA, 20 bp, Artificial Sequence
  chemically synthesized
gttaggagtcatcagagata

SEQ ID NO: 5480 - DNA, 20 bp, Artificial Sequence
  chemically synthesized
taggagtcatcagagataag

SEQ ID NO: 5481 - DNA, 20 bp, Artificial Sequence
  chemically synthesized
atcagagataaggagttgtc

SEQ ID NO: 5482 - DNA, 20 bp, Artificial Sequence
  chemically synthesized
aaggagttgtctggacatca

SEQ ID NO: 5483 - DNA, 20 bp, Artificial Sequence
  chemically synthesized
atatacaaatctgtgatgtc

SEQ ID NO: 5484 - DNA, 20 bp, Artificial Sequence
  chemically synthesized
ggacatcacagatttgtata

SEQ ID NO: 5485 - DNA, 20 bp, Artificial Sequence
  chemically synthesized
acatcacagatttgtatatg

SEQ ID NO: 5486 - DNA, 20 bp, Artificial Sequence
  chemically synthesized
gatttgtatatggagcccat

SEQ ID NO: 5487 - DNA, 20 bp, Artificial Sequence
  chemically synthesized
tttgtatatggagcccatga

SEQ ID NO: 5488 - DNA, 20 bp, Artificial Sequence
  chemically synthesized
tatcccctattggctctcat

SEQ ID NO: 5489 - DNA, 20 bp, Artificial Sequence
  chemically synthesized
ttatcccctattggctctca

SEQ ID NO: 5490 - DNA, 20 bp, Artificial Sequence
  chemically synthesized
atggagcccatgagagccaa

SEQ ID NO: 5491 - DNA, 20 bp, Artificial Sequence
  chemically synthesized
tggagcccatgagagccaat

SEQ ID NO: 5492 - DNA, 20 bp, Artificial Sequence
  chemically synthesized
ggagcccatgagagccaata

SEQ ID NO: 5493 - DNA, 20 bp, Artificial Sequence
  chemically synthesized
gagcccatgagagccaatag

SEQ ID NO: 5494 - DNA, 20 bp, Artificial Sequence
  chemically synthesized
taacaatgtttatcccctat

SEQ ID NO: 5495 - DNA, 20 bp, Artificial Sequence
  chemically synthesized
gaagcaaatacagaacaaaa

SEQ ID NO: 5496 - DNA, 20 bp, Artificial Sequence
  chemically synthesized
tctattggaggaagcaaata

SEQ ID NO: 5497 - DNA, 20 bp, Artificial Sequence
  chemically synthesized
tctgtatttgcttcctccaa

SEQ ID NO: 5498 - DNA, 20 bp, Artificial Sequence
  chemically synthesized
aacgtacattctattggagg

SEQ ID NO: 5499 - DNA, 20 bp, Artificial Sequence
  chemically synthesized
tgaaacgtacattctattgg

SEQ ID NO: 5500 - DNA, 20 bp, Artificial Sequence
  chemically synthesized
atgaaacgtacattctattg

SEQ ID NO: 5501 - DNA, 20 bp, Artificial Sequence
  chemically synthesized
taatgaaacgtacattctat

SEQ ID NO: 5502 - DNA, 20 bp, Artificial Sequence
  chemically synthesized
caatagaatgtacgtttcat

SEQ ID NO: 5503 - DNA, 20 bp, Artificial Sequence
  chemically synthesized
gtttcattagcacattgtct

SEQ ID NO: 5504 - DNA, 20 bp, Artificial Sequence
  chemically synthesized
cattagcacattgtctcagt

SEQ ID NO: 5505 - DNA, 20 bp, Artificial Sequence
  chemically synthesized
tattctgtacagttcttact

SEQ ID NO: 5506 - DNA, 20 bp, Artificial Sequence
  chemically synthesized
ttgtctcagtaagaactgta

SEQ ID NO: 5507 - DNA, 20 bp, Artificial Sequence
  chemically synthesized
tgtaccatttgtattctgta

SEQ ID NO: 5508 - DNA, 20 bp, Artificial Sequence
  chemically synthesized
agaactgtacagaatacaaa

SEQ ID NO: 5509 - DNA, 20 bp, Artificial Sequence
  chemically synthesized
tacagaatacaaatggtaca

SEQ ID NO: 5510 - DNA, 20 bp, Artificial Sequence
  chemically synthesized
cagaatacaaatggtacata

SEQ ID NO: 5511 - DNA, 20 bp, Artificial Sequence
  chemically synthesized
acaaatggtacatagagact

SEQ ID NO: 5512 - DNA, 20 bp, Artificial Sequence
  chemically synthesized
gtacatagagactcagtgat

SEQ ID NO: 5513 - DNA, 20 bp, Artificial Sequence
  chemically synthesized
gccatgaaatacttatcact

SEQ ID NO: 5514 - DNA, 20 bp, Artificial Sequence
  chemically synthesized
actcagtgataagtatttca

SEQ ID NO: 5515 - DNA, 20 bp, Artificial Sequence
  chemically synthesized
tgataagtatttcatggctt

SEQ ID NO: 5516 - DNA, 20 bp, Artificial Sequence
  chemically synthesized
gataagtatttcatggcttg

SEQ ID NO: 5517 - DNA, 20 bp, Artificial Sequence
  chemically synthesized
aagagtcaacatatttcctc

SEQ ID NO: 5518 - DNA, 20 bp, Artificial Sequence
  chemically synthesized
gaggaaatatgttgactctt

SEQ ID NO: 5519 - DNA, 20 bp, Artificial Sequence
  chemically synthesized
tattaggtgatgtgtctaaa

SEQ ID NO: 5520 - DNA, 20 bp, Artificial Sequence
  chemically synthesized
catattaggtgatgtgtcta

SEQ ID NO: 5521 - DNA, 20 bp, Artificial Sequence
  chemically synthesized
aacatgagacaagtcatatt

SEQ ID NO: 5522 - DNA, 20 bp, Artificial Sequence
  chemically synthesized
aaacatgagacaagtcatat

SEQ ID NO: 5523 - DNA, 20 bp, Artificial Sequence
  chemically synthesized
ttttaagtgaaacatgagac

SEQ ID NO: 5524 - DNA, 20 bp, Artificial Sequence
  chemically synthesized
ttttcttttaagtgaaacat

SEQ ID NO: 5525 - DNA, 20 bp, Artificial Sequence
  chemically synthesized
ttgtctcatgtttcacttaa

SEQ ID NO: 5526 - DNA, 20 bp, Artificial Sequence
  chemically synthesized
ccgatgactgattttctttt

SEQ ID NO: 5527 - DNA, 20 bp, Artificial Sequence
  chemically synthesized
tgtttcacttaaaagaaaat

SEQ ID NO: 5528 - DNA, 20 bp, Artificial Sequence
  chemically synthesized
cttaaaagaaaatcagtcat

SEQ ID NO: 5529 - DNA, 20 bp, Artificial Sequence
  chemically synthesized
ttaaaagaaaatcagtcatc

SEQ ID NO: 5530 - DNA, 20 bp, Artificial Sequence
  chemically synthesized
taaaagaaaatcagtcatcg

SEQ ID NO: 5531 - DNA, 20 bp, Artificial Sequence
  chemically synthesized
tcatcggggttgcatattta

SEQ ID NO: 5532 - DNA, 20 bp, Artificial Sequence
  chemically synthesized
ggttgcatatttaaagaatg

SEQ ID NO: 5533 - DNA, 20 bp, Artificial Sequence
  chemically synthesized
ttaaagaatgcagctctatc

SEQ ID NO: 5534 - DNA, 20 bp, Artificial Sequence
  chemically synthesized
gctgaaccacattctggata

SEQ ID NO: 5535 - DNA, 20 bp, Artificial Sequence
  chemically synthesized
ctgctgaaccacattctgga

SEQ ID NO: 5536 - DNA, 20 bp, Artificial Sequence
  chemically synthesized
atgcagctctatccagaatg

SEQ ID NO: 5537 - DNA, 20 bp, Artificial Sequence
  chemically synthesized
ggatctgctgaaccacattc

SEQ ID NO: 5538 - DNA, 20 bp, Artificial Sequence
  chemically synthesized
gctctatccagaatgtggtt

SEQ ID NO: 5539 - DNA, 20 bp, Artificial Sequence
  chemically synthesized
ctatccagaatgtggttcag

SEQ ID NO: 5540 - DNA, 20 bp, Artificial Sequence
  chemically synthesized
gaatgtggttcagcagatcc

SEQ ID NO: 5541 - DNA, 20 bp, Artificial Sequence
  chemically synthesized
aaggtttgagatacaaggct

SEQ ID NO: 5542 - DNA, 20 bp, Artificial Sequence
  chemically synthesized
gaaggtttgagatacaaggc

SEQ ID NO: 5543 - DNA, 20 bp, Artificial Sequence
  chemically synthesized
ctttgaaggtttgagataca

SEQ ID NO: 5544 - DNA, 20 bp, Artificial Sequence
  chemically synthesized
gctttgaaggtttgagatac

SEQ ID NO: 5545 - DNA, 20 bp, Artificial Sequence
  chemically synthesized
tacttgggctttgaaggttt

SEQ ID NO: 5546 - DNA, 20 bp, Artificial Sequence
  chemically synthesized
ccttgtatctcaaaccttca

SEQ ID NO: 5547 - DNA, 20 bp, Artificial Sequence
  chemically synthesized
tgtatatacttgggctttga

SEQ ID NO: 5548 - DNA, 20 bp, Artificial Sequence
  chemically synthesized
gtgtatatacttgggctttg

SEQ ID NO: 5549 - DNA, 20 bp, Artificial Sequence
  chemically synthesized
atctcaaaccttcaaagccc

SEQ ID NO: 5550 - DNA, 20 bp, Artificial Sequence
  chemically synthesized
taaatgcagtgtatatactt

SEQ ID NO: 5551 - DNA, 20 bp, Artificial Sequence
  chemically synthesized
ataaatgcagtgtatatact

SEQ ID NO: 5552 - DNA, 20 bp, Artificial Sequence
  chemically synthesized
cacaggtgtttaaataaatg

SEQ ID NO: 5553 - DNA, 20 bp, Artificial Sequence
  chemically synthesized
tcttcttgaaggatgcacac

SEQ ID NO: 5554 - DNA, 20 bp, Artificial Sequence
  chemically synthesized
gtcttcttgaaggatgcaca

SEQ ID NO: 5555 - DNA, 20 bp, Artificial Sequence
  chemically synthesized
aacacctgtgtgcatccttc

SEQ ID NO: 5556 - DNA, 20 bp, Artificial Sequence
  chemically synthesized
acctgtgtgcatccttcaag

SEQ ID NO: 5557 - DNA, 20 bp, Artificial Sequence
  chemically synthesized
aagccttaccgtcttcttga

SEQ ID NO: 5558 - DNA, 20 bp, Artificial Sequence
  chemically synthesized
aaagccttaccgtcttcttg

SEQ ID NO: 5559 - DNA, 20 bp, Artificial Sequence
  chemically synthesized
gtgtgcatccttcaagaaga

SEQ ID NO: 5560 - DNA, 20 bp, Artificial Sequence
  chemically synthesized
gcatccttcaagaagacggt

SEQ ID NO: 5561 - DNA, 20 bp, Artificial Sequence
  chemically synthesized
catccttcaagaagacggta

SEQ ID NO: 5562 - DNA, 20 bp, Artificial Sequence
  chemically synthesized
acttcatttaaaaaggaaaa

SEQ ID NO: 5563 - DNA, 20 bp, Artificial Sequence
  chemically synthesized
taagctaacttcatttaaaa

SEQ ID NO: 5564 - DNA, 20 bp, Artificial Sequence
  chemically synthesized
ataagctaacttcatttaaa

SEQ ID NO: 5565 - DNA, 20 bp, Artificial Sequence
  chemically synthesized
gcttttttcctttttaaatg

SEQ ID NO: 5566 - DNA, 20 bp, Artificial Sequence
  chemically synthesized
ttttcctttttaaatgaagt

SEQ ID NO: 5567 - DNA, 20 bp, Artificial Sequence
  chemically synthesized
ttaaatgaagttagcttatg

SEQ ID NO: 5568 - DNA, 20 bp, Artificial Sequence
  chemically synthesized
caaaccatatcgaactgcat

SEQ ID NO: 5569 - DNA, 20 bp, Artificial Sequence
  chemically synthesized
ttagcttatgcagttcgata

SEQ ID NO: 5570 - DNA, 20 bp, Artificial Sequence
  chemically synthesized
ttatgcagttcgatatggtt

SEQ ID NO: 5571 - DNA, 20 bp, Artificial Sequence
  chemically synthesized
atgagatttggatggggaca

SEQ ID NO: 5572 - DNA, 20 bp, Artificial Sequence
  chemically synthesized
ttcaacatgagatttggatg

SEQ ID NO: 5573 - DNA, 20 bp, Artificial Sequence
  chemically synthesized
attcaacatgagatttggat

SEQ ID NO: 5574 - DNA, 20 bp, Artificial Sequence
  chemically synthesized
aattcaacatgagatttgga

SEQ ID NO: 5575 - DNA, 20 bp, Artificial Sequence
  chemically synthesized
ttacaattcaacatgagatt

SEQ ID NO: 5576 - DNA, 20 bp, Artificial Sequence
  chemically synthesized
tggggattacaattcaacat

SEQ ID NO: 5577 - DNA, 20 bp, Artificial Sequence
  chemically synthesized
gacccctcccgcagcacatg

SEQ ID NO: 5578 - DNA, 20 bp, Artificial Sequence
  chemically synthesized
ggacccctcccgcagcacat

SEQ ID NO: 5579 - DNA, 20 bp, Artificial Sequence
  chemically synthesized
attgtaatccccatgtgctg

SEQ ID NO: 5580 - DNA, 20 bp, Artificial Sequence
  chemically synthesized
cggacccctcccgcagcaca

SEQ ID NO: 5581 - DNA, 20 bp, Artificial Sequence
  chemically synthesized
ttgtaatccccatgtgctgc

SEQ ID NO: 5582 - DNA, 20 bp, Artificial Sequence
  chemically synthesized
gtaatccccatgtgctgcgg

SEQ ID NO: 5583 - DNA, 20 bp, Artificial Sequence
  chemically synthesized
taatccccatgtgctgcggg

SEQ ID NO: 5584 - DNA, 20 bp, Artificial Sequence
  chemically synthesized
aatccccatgtgctgcggga

SEQ ID NO: 5585 - DNA, 20 bp, Artificial Sequence
  chemically synthesized
atccccatgtgctgcgggag

SEQ ID NO: 5586 - DNA, 20 bp, Artificial Sequence
  chemically synthesized
ctcccaccggacccctcccg

SEQ ID NO: 5587 - DNA, 20 bp, Artificial Sequence
  chemically synthesized
catgtgctgcgggaggggtc

SEQ ID NO: 5588 - DNA, 20 bp, Artificial Sequence
  chemically synthesized
gtgctgcgggaggggtccgg

SEQ ID NO: 5589 - DNA, 20 bp, Artificial Sequence
  chemically synthesized
tgctgcgggaggggtccggt

SEQ ID NO: 5590 - DNA, 20 bp, Artificial Sequence
  chemically synthesized
ctgcgggaggggtccggtgg

SEQ ID NO: 5591 - DNA, 20 bp, Artificial Sequence
  chemically synthesized
tgcgggaggggtccggtggg

SEQ ID NO: 5592 - DNA, 20 bp, Artificial Sequence
  chemically synthesized
atgatccagtcacctcccac

SEQ ID NO: 5593 - DNA, 20 bp, Artificial Sequence
  chemically synthesized
ggggtccggtgggaggtgac

SEQ ID NO: 5594 - DNA, 20 bp, Artificial Sequence
  chemically synthesized
ggtgggaggtgactggatca

SEQ ID NO: 5595 - DNA, 20 bp, Artificial Sequence
  chemically synthesized
gggaaaccgccgccatgatc

SEQ ID NO: 5596 - DNA, 20 bp, Artificial Sequence
  chemically synthesized
gggaggtgactggatcatgg

SEQ ID NO: 5597 - DNA, 20 bp, Artificial Sequence
  chemically synthesized
aggtgactggatcatggcgg

SEQ ID NO: 5598 - DNA, 20 bp, Artificial Sequence
  chemically synthesized
ctatcatgagaacagcatgg

SEQ ID NO: 5599 - DNA, 20 bp, Artificial Sequence
  chemically synthesized
actatcatgagaacagcatg

SEQ ID NO: 5600 - DNA, 20 bp, Artificial Sequence
  chemically synthesized
cactatcatgagaacagcat

SEQ ID NO: 5601 - DNA, 20 bp, Artificial Sequence
  chemically synthesized
tcactatcatgagaacagca

SEQ ID NO: 5602 - DNA, 20 bp, Artificial Sequence
  chemically synthesized
cgaactcactatcatgagaa

SEQ ID NO: 5603 - DNA, 20 bp, Artificial Sequence
  chemically synthesized
cccccatgctgttctcatga

SEQ ID NO: 5604 - DNA, 20 bp, Artificial Sequence
  chemically synthesized
ttatgcgaactcactatcat

SEQ ID NO: 5605 - DNA, 20 bp, Artificial Sequence
  chemically synthesized
catgctgttctcatgatagt

SEQ ID NO: 5606 - DNA, 20 bp, Artificial Sequence
  chemically synthesized
tcatgatagtgagttcgcat

SEQ ID NO: 5607 - DNA, 20 bp, Artificial Sequence
  chemically synthesized
tgagttcgcataagatctga

SEQ ID NO: 5608 - DNA, 20 bp, Artificial Sequence
  chemically synthesized
ctgccacacttttaaaccat

SEQ ID NO: 5609 - DNA, 20 bp, Artificial Sequence
  chemically synthesized
cataagatctgatggtttaa

SEQ ID NO: 5610 - DNA, 20 bp, Artificial Sequence
  chemically synthesized
gatctgatggtttaaaagtg

SEQ ID NO: 5611 - DNA, 20 bp, Artificial Sequence
  chemically synthesized
ctgatggtttaaaagtgtgg

SEQ ID NO: 5612 - DNA, 20 bp, Artificial Sequence
  chemically synthesized
caggagagagaaagcgaggg

SEQ ID NO: 5613 - DNA, 20 bp, Artificial Sequence
  chemically synthesized
ggcaggagagagaaagcgag

SEQ ID NO: 5614 - DNA, 20 bp, Artificial Sequence
  chemically synthesized
cggcaggagagagaaagcga

SEQ ID NO: 5615 - DNA, 20 bp, Artificial Sequence
  chemically synthesized
gcggcaggagagagaaagcg

SEQ ID NO: 5616 - DNA, 20 bp, Artificial Sequence
  chemically synthesized
agcggcaggagagagaaagc

SEQ ID NO: 5617 - DNA, 20 bp, Artificial Sequence
  chemically synthesized
acatagcggcaggagagaga

SEQ ID NO: 5618 - DNA, 20 bp, Artificial Sequence
  chemically synthesized
tgctacatagcggcaggaga

SEQ ID NO: 5619 - DNA, 20 bp, Artificial Sequence
  chemically synthesized
tgtgctacatagcggcagga

SEQ ID NO: 5620 - DNA, 20 bp, Artificial Sequence
  chemically synthesized
catgtgctacatagcggcag

SEQ ID NO: 5621 - DNA, 20 bp, Artificial Sequence
  chemically synthesized
ggcatgtgctacatagcggc

SEQ ID NO: 5622 - DNA, 20 bp, Artificial Sequence
  chemically synthesized
aggcatgtgctacatagcgg

SEQ ID NO: 5623 - DNA, 20 bp, Artificial Sequence
  chemically synthesized
ttctctctcctgccgctatg

SEQ ID NO: 5624 - DNA, 20 bp, Artificial Sequence
  chemically synthesized
gcaaggcatgtgctacatag

SEQ ID NO: 5625 - DNA, 20 bp, Artificial Sequence
  chemically synthesized
gaagcaaggcatgtgctaca

SEQ ID NO: 5626 - DNA, 20 bp, Artificial Sequence
  chemically synthesized
gggaaggtgaaggggaagca

SEQ ID NO: 5627 - DNA, 20 bp, Artificial Sequence
  chemically synthesized
ggggaaggtgaaggggaagc

SEQ ID NO: 5628 - DNA, 20 bp, Artificial Sequence
  chemically synthesized
catgggggaaggtgaagggg

SEQ ID NO: 5629 - DNA, 20 bp, Artificial Sequence
  chemically synthesized
aatcatgggggaaggtgaag

SEQ ID NO: 5630 - DNA, 20 bp, Artificial Sequence
  chemically synthesized
caatcatgggggaaggtgaa

SEQ ID NO: 5631 - DNA, 20 bp, Artificial Sequence
  chemically synthesized
acaatcatgggggaaggtga

SEQ ID NO: 5632 - DNA, 20 bp, Artificial Sequence
  chemically synthesized
tacaatcatgggggaaggtg

SEQ ID NO: 5633 - DNA, 20 bp, Artificial Sequence
  chemically synthesized
aaacttacaatcatggggga

SEQ ID NO: 5634 - DNA, 20 bp, Artificial Sequence
  chemically synthesized
gaaacttacaatcatggggg

SEQ ID NO: 5635 - DNA, 20 bp, Artificial Sequence
  chemically synthesized
caggaaacttacaatcatgg

SEQ ID NO: 5636 - DNA, 20 bp, Artificial Sequence
  chemically synthesized
tcaggaaacttacaatcatg

SEQ ID NO: 5637 - DNA, 20 bp, Artificial Sequence
  chemically synthesized
ctcaggaaacttacaatcat

SEQ ID NO: 5638 - DNA, 20 bp, Artificial Sequence
  chemically synthesized
tcaccttcccccatgattgt

SEQ ID NO: 5639 - DNA, 20 bp, Artificial Sequence
  chemically synthesized
cctcaggaaacttacaatca

SEQ ID NO: 5640 - DNA, 20 bp, Artificial Sequence
  chemically synthesized
cccatgattgtaagtttcct

SEQ ID NO: 5641 - DNA, 20 bp, Artificial Sequence
  chemically synthesized
ccatgattgtaagtttcctg

SEQ ID NO: 5642 - DNA, 20 bp, Artificial Sequence
  chemically synthesized
cacaaggctggggaggcctc

SEQ ID NO: 5643 - DNA, 20 bp, Artificial Sequence
  chemically synthesized
ccacaaggctggggaggcct

SEQ ID NO: 5644 - DNA, 20 bp, Artificial Sequence
  chemically synthesized
taagtttcctgaggcctccc

SEQ ID NO: 5645 - DNA, 20 bp, Artificial Sequence
  chemically synthesized
tcagttccacaaggctgggg

SEQ ID NO: 5646 - DNA, 20 bp, Artificial Sequence
  chemically synthesized
ctcagttccacaaggctggg

SEQ ID NO: 5647 - DNA, 20 bp, Artificial Sequence
  chemically synthesized
gactcagttccacaaggctg

SEQ ID NO: 5648 - DNA, 20 bp, Artificial Sequence
  chemically synthesized
ctgaggcctccccagccttg

SEQ ID NO: 5649 - DNA, 20 bp, Artificial Sequence
  chemically synthesized
tgactcagttccacaaggct

SEQ ID NO: 5650 - DNA, 20 bp, Artificial Sequence
  chemically synthesized
ttgactcagttccacaaggc

SEQ ID NO: 5651 - DNA, 20 bp, Artificial Sequence
  chemically synthesized
tttattgactcagttccaca

SEQ ID NO: 5652 - DNA, 20 bp, Artificial Sequence
  chemically synthesized
gtttattgactcagttccac

SEQ ID NO: 5653 - DNA, 20 bp, Artificial Sequence
  chemically synthesized
ctccccagccttgtggaact

SEQ ID NO: 5654 - DNA, 20 bp, Artificial Sequence
  chemically synthesized
aagaaagaggtttattgact

SEQ ID NO: 5655 - DNA, 20 bp, Artificial Sequence
  chemically synthesized
tgggtaatttatgaagaaag

SEQ ID NO: 5656 - DNA, 20 bp, Artificial Sequence
  chemically synthesized
ctgggtaatttatgaagaaa

SEQ ID NO: 5657 - DNA, 20 bp, Artificial Sequence
  chemically synthesized
gactgggtaatttatgaaga

SEQ ID NO: 5658 - DNA, 20 bp, Artificial Sequence
  chemically synthesized
ctgagactgggtaatttatg

SEQ ID NO: 5659 - DNA, 20 bp, Artificial Sequence
  chemically synthesized
ctctttcttcataaattacc

SEQ ID NO: 5660 - DNA, 20 bp, Artificial Sequence
  chemically synthesized
cttcataaattacccagtct

SEQ ID NO: 5661 - DNA, 20 bp, Artificial Sequence
  chemically synthesized
ttcataaattacccagtctc

SEQ ID NO: 5662 - DNA, 20 bp, Artificial Sequence
  chemically synthesized
ataaagaactacctgagact

SEQ ID NO: 5663 - DNA, 20 bp, Artificial Sequence
  chemically synthesized
tataaagaactacctgagac

SEQ ID NO: 5664 - DNA, 20 bp, Artificial Sequence
  chemically synthesized
ataaattacccagtctcagg

SEQ ID NO: 5665 - DNA, 20 bp, Artificial Sequence
  chemically synthesized
actgctataaagaactacct

SEQ ID NO: 5666 - DNA, 20 bp, Artificial Sequence
  chemically synthesized
cagtctcaggtagttcttta

SEQ ID NO: 5667 - DNA, 20 bp, Artificial Sequence
  chemically synthesized
tctcaggtagttctttatag

SEQ ID NO: 5668 - DNA, 20 bp, Artificial Sequence
  chemically synthesized
tctgttttcacactgctata

SEQ ID NO: 5669 - DNA, 20 bp, Artificial Sequence
  chemically synthesized
tctttatagcagtgtgaaaa

SEQ ID NO: 5670 - DNA, 20 bp, Artificial Sequence
  chemically synthesized
tgtgaaaacagattaataca

SEQ ID NO: 5671 - DNA, 20 bp, Artificial Sequence
  chemically synthesized
aacagattaatacacagttc

SEQ ID NO: 5672 - DNA, 20 bp, Artificial Sequence
  chemically synthesized
ttaatacacagttcaagaaa

SEQ ID NO: 5673 - DNA, 20 bp, Artificial Sequence
  chemically synthesized
agaaaaagtacccttgaatt

SEQ ID NO: 5674 - DNA, 20 bp, Artificial Sequence
  chemically synthesized
aaagaaaagactgaattcaa

SEQ ID NO: 5675 - DNA, 20 bp, Artificial Sequence
  chemically synthesized
gaaagaaaagactgaattca

SEQ ID NO: 5676 - DNA, 20 bp, Artificial Sequence
  chemically synthesized
tgaaagaaaagactgaattc

SEQ ID NO: 5677 - DNA, 20 bp, Artificial Sequence
  chemically synthesized
ttgaattcagtcttttcttt

SEQ ID NO: 5678 - DNA, 20 bp, Artificial Sequence
  chemically synthesized
aaatttgtcctctgaaagaa

SEQ ID NO: 5679 - DNA, 20 bp, Artificial Sequence
  chemically synthesized
gaattcagtcttttctttca

SEQ ID NO: 5680 - DNA, 20 bp, Artificial Sequence
  chemically synthesized
aattcagtcttttctttcag

SEQ ID NO: 5681 - DNA, 20 bp, Artificial Sequence
  chemically synthesized
gtgttaaatttgtcctctga

SEQ ID NO: 5682 - DNA, 20 bp, Artificial Sequence
  chemically synthesized
ttcagaggacaaatttaaca

SEQ ID NO: 5683 - DNA, 20 bp, Artificial Sequence
  chemically synthesized
cttgctggcataaaatggat

SEQ ID NO: 5684 - DNA, 20 bp, Artificial Sequence
  chemically synthesized
gataacttgctggcataaaa

SEQ ID NO: 5685 - DNA, 20 bp, Artificial Sequence
  chemically synthesized
acagcttatccattttatgc

SEQ ID NO: 5686 - DNA, 20 bp, Artificial Sequence
  chemically synthesized
cttatccattttatgccagc

SEQ ID NO: 5687 - DNA, 20 bp, Artificial Sequence
  chemically synthesized
taagctaagagataacttgc

SEQ ID NO: 5688 - DNA, 20 bp, Artificial Sequence
  chemically synthesized
tatgccagcaagttatctct

SEQ ID NO: 5689 - DNA, 20 bp, Artificial Sequence
  chemically synthesized
cagcaagttatctcttagct

SEQ ID NO: 5690 - DNA, 20 bp, Artificial Sequence
  chemically synthesized
tattccaatggctaagctaa

SEQ ID NO: 5691 - DNA, 20 bp, Artificial Sequence
  chemically synthesized
tatattccaatggctaagct

SEQ ID NO: 5692 - DNA, 20 bp, Artificial Sequence
  chemically synthesized
ttatctcttagcttagccat

SEQ ID NO: 5693 - DNA, 20 bp, Artificial Sequence
  chemically synthesized
agtgctatattccaatggct

SEQ ID NO: 5694 - DNA, 20 bp, Artificial Sequence
  chemically synthesized
acaaaagtgctatattccaa

SEQ ID NO: 5695 - DNA, 20 bp, Artificial Sequence
  chemically synthesized
ttagcttagccattggaata

SEQ ID NO: 5696 - DNA, 20 bp, Artificial Sequence
  chemically synthesized
ggaatatagcacttttgtcc

SEQ ID NO: 5697 - DNA, 20 bp, Artificial Sequence
  chemically synthesized
agaactgaataccaggacaa

SEQ ID NO: 5698 - DNA, 20 bp, Artificial Sequence
  chemically synthesized
agcacttttgtcctggtatt

SEQ ID NO: 5699 - DNA, 20 bp, Artificial Sequence
  chemically synthesized
tcatggtagaactgaatacc

SEQ ID NO: 5700 - DNA, 20 bp, Artificial Sequence
  chemically synthesized
atcatggtagaactgaatac

SEQ ID NO: 5701 - DNA, 20 bp, Artificial Sequence
  chemically synthesized
tggagctaaaaagatcatgg

SEQ ID NO: 5702 - DNA, 20 bp, Artificial Sequence
  chemically synthesized
ctgtggagctaaaaagatca

SEQ ID NO: 5703 - DNA, 20 bp, Artificial Sequence
  chemically synthesized
cagttctaccatgatctttt

SEQ ID NO: 5704 - DNA, 20 bp, Artificial Sequence
  chemically synthesized
tgatgatctgtggagctaaa

SEQ ID NO: 5705 - DNA, 20 bp, Artificial Sequence
  chemically synthesized
ccatgatctttttagctcca

SEQ ID NO: 5706 - DNA, 20 bp, Artificial Sequence
  chemically synthesized
tgtggtcctgatgatctgtg

SEQ ID NO: 5707 - DNA, 20 bp, Artificial Sequence
  chemically synthesized
gatgtggtcctgatgatctg

SEQ ID NO: 5708 - DNA, 20 bp, Artificial Sequence
  chemically synthesized
tttttagctccacagatcat

SEQ ID NO: 5709 - DNA, 20 bp, Artificial Sequence
  chemically synthesized
ttttagctccacagatcatc

SEQ ID NO: 5710 - DNA, 20 bp, Artificial Sequence
  chemically synthesized
ttaaagtgcacattaggatg

SEQ ID NO: 5711 - DNA, 20 bp, Artificial Sequence
  chemically synthesized
ctcaaattaaagtgcacatt

SEQ ID NO: 5712 - DNA, 20 bp, Artificial Sequence
  chemically synthesized
actcaaattaaagtgcacat

SEQ ID NO: 5713 - DNA, 20 bp, Artificial Sequence
  chemically synthesized
cctaatgtgcactttaattt

SEQ ID NO: 5714 - DNA, 20 bp, Artificial Sequence
  chemically synthesized
tcgttaaagcactcaaatta

SEQ ID NO: 5715 - DNA, 20 bp, Artificial Sequence
  chemically synthesized
tttaatttgagtgctttaac

SEQ ID NO: 5716 - DNA, 20 bp, Artificial Sequence
  chemically synthesized
aataggcagcatactcgtta

SEQ ID NO: 5717 - DNA, 20 bp, Artificial Sequence
  chemically synthesized
cgttgacaatggcgaatagg

SEQ ID NO: 5718 - DNA, 20 bp, Artificial Sequence
  chemically synthesized
ggtcgttgacaatggcgaat

SEQ ID NO: 5719 - DNA, 20 bp, Artificial Sequence
  chemically synthesized
aggtcgttgacaatggcgaa

SEQ ID NO: 5720 - DNA, 20 bp, Artificial Sequence
  chemically synthesized
attatttaggtcgttgacaa

SEQ ID NO: 5721 - DNA, 20 bp, Artificial Sequence
  chemically synthesized
agaagcattaataattattt

SEQ ID NO: 5722 - DNA, 20 bp, Artificial Sequence
  chemically synthesized
tagaagcattaataattatt

SEQ ID NO: 5723 - DNA, 20 bp, Artificial Sequence
  chemically synthesized
aaataattattaatgcttct

SEQ ID NO: 5724 - DNA, 20 bp, Artificial Sequence
  chemically synthesized
tcagagccctgggtgcttag

SEQ ID NO: 5725 - DNA, 20 bp, Artificial Sequence
  chemically synthesized
tattaatgcttctaagcacc

SEQ ID NO: 5726 - DNA, 20 bp, Artificial Sequence
  chemically synthesized
attaatgcttctaagcaccc

SEQ ID NO: 5727 - DNA, 20 bp, Artificial Sequence
  chemically synthesized
gattcagagccctgggtgct

SEQ ID NO: 5728 - DNA, 20 bp, Artificial Sequence
  chemically synthesized
ttaatgcttctaagcaccca

SEQ ID NO: 5729 - DNA, 20 bp, Artificial Sequence
  chemically synthesized
gtggtcagattcagagccct

SEQ ID NO: 5730 - DNA, 20 bp, Artificial Sequence
  chemically synthesized
agtggtcagattcagagccc

SEQ ID NO: 5731 - DNA, 20 bp, Artificial Sequence
  chemically synthesized
tattttagtggtcagattca

SEQ ID NO: 5732 - DNA, 20 bp, Artificial Sequence
  chemically synthesized
catattttagtggtcagatt

SEQ ID NO: 5733 - DNA, 20 bp, Artificial Sequence
  chemically synthesized
aagttacatattttagtggt

SEQ ID NO: 5734 - DNA, 20 bp, Artificial Sequence
  chemically synthesized
aactaagttacatattttag

SEQ ID NO: 5735 - DNA, 20 bp, Artificial Sequence
  chemically synthesized
tgaaactaagttacatattt

SEQ ID NO: 5736 - DNA, 20 bp, Artificial Sequence
  chemically synthesized
gaccactaaaatatgtaact

SEQ ID NO: 5737 - DNA, 20 bp, Artificial Sequence
  chemically synthesized
taagtaaagcatatgaaact

SEQ ID NO: 5738 - DNA, 20 bp, Artificial Sequence
  chemically synthesized
cccccttttttaagtaagta

SEQ ID NO: 5739 - DNA, 20 bp, Artificial Sequence
  chemically synthesized
attttcccccttttttaagt

SEQ ID NO: 5740 - DNA, 20 bp, Artificial Sequence
  chemically synthesized
tatgctttacttacttaaaa

SEQ ID NO: 5741 - DNA, 20 bp, Artificial Sequence
  chemically synthesized
atgctttacttacttaaaaa

SEQ ID NO: 5742 - DNA, 20 bp, Artificial Sequence
  chemically synthesized
tgctttacttacttaaaaaa

SEQ ID NO: 5743 - DNA, 20 bp, Artificial Sequence
  chemically synthesized
gctttacttacttaaaaaag

SEQ ID NO: 5744 - DNA, 20 bp, Artificial Sequence
  chemically synthesized
caggattttccccctttttt

SEQ ID NO: 5745 - DNA, 20 bp, Artificial Sequence
  chemically synthesized
ctttacttacttaaaaaagg

SEQ ID NO: 5746 - DNA, 20 bp, Artificial Sequence
  chemically synthesized
aaaaaagggggaaaatcctg

SEQ ID NO: 5747 - DNA, 20 bp, Artificial Sequence
  chemically synthesized
aaagggggaaaatcctgaag

SEQ ID NO: 5748 - DNA, 20 bp, Artificial Sequence
  chemically synthesized
ctcttatttttttctacttc

SEQ ID NO: 5749 - DNA, 20 bp, Artificial Sequence
  chemically synthesized
cctcttatttttttctactt

SEQ ID NO: 5750 - DNA, 20 bp, Artificial Sequence
  chemically synthesized
atcctgaagtagaaaaaaat

SEQ ID NO: 5751 - DNA, 20 bp, Artificial Sequence
  chemically synthesized
cctgaagtagaaaaaaataa

SEQ ID NO: 5752 - DNA, 20 bp, Artificial Sequence
  chemically synthesized
ctgaagtagaaaaaaataag

SEQ ID NO: 5753 - DNA, 20 bp, Artificial Sequence
  chemically synthesized
gaaaaaaataagaggtacta

SEQ ID NO: 5754 - DNA, 20 bp, Artificial Sequence
  chemically synthesized
aaataagaggtactaaagct

SEQ ID NO: 5755 - DNA, 20 bp, Artificial Sequence
  chemically synthesized
ttctgaaaacaactgagctt

SEQ ID NO: 5756 - DNA, 20 bp, Artificial Sequence
  chemically synthesized
tgtaaattctgaaaacaact

SEQ ID NO: 5757 - DNA, 20 bp, Artificial Sequence
  chemically synthesized
tactaaagctcagttgtttt

SEQ ID NO: 5758 - DNA, 20 bp, Artificial Sequence
  chemically synthesized
tcagttgttttcagaattta

SEQ ID NO: 5759 - DNA, 20 bp, Artificial Sequence
  chemically synthesized
aacaactgtatgcatttgca

SEQ ID NO: 5760 - DNA, 20 bp, Artificial Sequence
  chemically synthesized
acagactttgcaaatgcata

SEQ ID NO: 5761 - DNA, 20 bp, Artificial Sequence
  chemically synthesized
gcatacagttgtttttcatg

SEQ ID NO: 5762 - DNA, 20 bp, Artificial Sequence
  chemically synthesized
gttgtcatttacaatcccaa

SEQ ID NO: 5763 - DNA, 20 bp, Artificial Sequence
  chemically synthesized
aatatagctaataaactgtt

SEQ ID NO: 5764 - DNA, 20 bp, Artificial Sequence
  chemically synthesized
gaatatagctaataaactgt

SEQ ID NO: 5765 - DNA, 20 bp, Artificial Sequence
  chemically synthesized
ttacaatcccaacagtttat

SEQ ID NO: 5766 - DNA, 20 bp, Artificial Sequence
  chemically synthesized
aacagtttattagctatatt

SEQ ID NO: 5767 - DNA, 20 bp, Artificial Sequence
  chemically synthesized
ctccacctgagatctgaata

SEQ ID NO: 5768 - DNA, 20 bp, Artificial Sequence
  chemically synthesized
tattagctatattcagatct

SEQ ID NO: 5769 - DNA, 20 bp, Artificial Sequence
  chemically synthesized
attagctatattcagatctc

SEQ ID NO: 5770 - DNA, 20 bp, Artificial Sequence
  chemically synthesized
agctatattcagatctcagg

SEQ ID NO: 5771 - DNA, 20 bp, Artificial Sequence
  chemically synthesized
ctatattcagatctcaggtg

SEQ ID NO: 5772 - DNA, 20 bp, Artificial Sequence
  chemically synthesized
tatattcagatctcaggtgg

SEQ ID NO: 5773 - DNA, 20 bp, Artificial Sequence
  chemically synthesized
atattcagatctcaggtgga

SEQ ID NO: 5774 - DNA, 20 bp, Artificial Sequence
  chemically synthesized
cagattatctccctccacct

SEQ ID NO: 5775 - DNA, 20 bp, Artificial Sequence
  chemically synthesized
attcagatctcaggtggagg

SEQ ID NO: 5776 - DNA, 20 bp, Artificial Sequence
  chemically synthesized
tggagggagataatctgaca

SEQ ID NO: 5777 - DNA, 20 bp, Artificial Sequence
  chemically synthesized
gagggagataatctgacaca

SEQ ID NO: 5778 - DNA, 20 bp, Artificial Sequence
  chemically synthesized
atttaaggcaatctctgtgt

SEQ ID NO: 5779 - DNA, 20 bp, Artificial Sequence
  chemically synthesized
acagagattgccttaaatca

SEQ ID NO: 5780 - DNA, 20 bp, Artificial Sequence
  chemically synthesized
tactacacctccatgattta

SEQ ID NO: 5781 - DNA, 20 bp, Artificial Sequence
  chemically synthesized
ttactacacctccatgattt

SEQ ID NO: 5782 - DNA, 20 bp, Artificial Sequence
  chemically synthesized
agagattgccttaaatcatg

SEQ ID NO: 5783 - DNA, 20 bp, Artificial Sequence
  chemically synthesized
gagattgccttaaatcatgg

SEQ ID NO: 5784 - DNA, 20 bp, Artificial Sequence
  chemically synthesized
tgccttaaatcatggaggtg

SEQ ID NO: 5785 - DNA, 20 bp, Artificial Sequence
  chemically synthesized
tcatggaggtgtagtaaatt

SEQ ID NO: 5786 - DNA, 20 bp, Artificial Sequence
  chemically synthesized
catggaggtgtagtaaattc

SEQ ID NO: 5787 - DNA, 20 bp, Artificial Sequence
  chemically synthesized
gaaggaaaaggatatgtttg

SEQ ID NO: 5788 - DNA, 20 bp, Artificial Sequence
  chemically synthesized
agaaggaaaaggatatgttt

SEQ ID NO: 5789 - DNA, 20 bp, Artificial Sequence
  chemically synthesized
tgatttttttgagaaggaaa

SEQ ID NO: 5790 - DNA, 20 bp, Artificial Sequence
  chemically synthesized
ttgatttttttgagaaggaa

SEQ ID NO: 5791 - DNA, 20 bp, Artificial Sequence
  chemically synthesized
aggttttgatttttttgaga

SEQ ID NO: 5792 - DNA, 20 bp, Artificial Sequence
  chemically synthesized
caggttttgatttttttgag

SEQ ID NO: 5793 - DNA, 20 bp, Artificial Sequence
  chemically synthesized
agccaggttttgattttttt

SEQ ID NO: 5794 - DNA, 20 bp, Artificial Sequence
  chemically synthesized
ttctcaaaaaaatcaaaacc

SEQ ID NO: 5795 - DNA, 20 bp, Artificial Sequence
  chemically synthesized
ccaaatcttgtaggaaagcc

SEQ ID NO: 5796 - DNA, 20 bp, Artificial Sequence
  chemically synthesized
gccaaatcttgtaggaaagc

SEQ ID NO: 5797 - DNA, 20 bp, Artificial Sequence
  chemically synthesized
tcaaaacctggctttcctac

SEQ ID NO: 5798 - DNA, 20 bp, Artificial Sequence
  chemically synthesized
agaagccaaatcttgtagga

SEQ ID NO: 5799 - DNA, 20 bp, Artificial Sequence
  chemically synthesized
ctggagaagccaaatcttgt

SEQ ID NO: 5800 - DNA, 20 bp, Artificial Sequence
  chemically synthesized
cctggctttcctacaagatt

SEQ ID NO: 5801 - DNA, 20 bp, Artificial Sequence
  chemically synthesized
tctggagaagccaaatcttg

SEQ ID NO: 5802 - DNA, 20 bp, Artificial Sequence
  chemically synthesized
cctacaagatttggcttctc

SEQ ID NO: 5803 - DNA, 20 bp, Artificial Sequence
  chemically synthesized
tacaagatttggcttctcca

SEQ ID NO: 5804 - DNA, 20 bp, Artificial Sequence
  chemically synthesized
acaagatttggcttctccag

SEQ ID NO: 5805 - DNA, 20 bp, Artificial Sequence
  chemically synthesized
aggcacatcctcctctggag

SEQ ID NO: 5806 - DNA, 20 bp, Artificial Sequence
  chemically synthesized
aagatttggcttctccagag

SEQ ID NO: 5807 - DNA, 20 bp, Artificial Sequence
  chemically synthesized
agatttggcttctccagagg

SEQ ID NO: 5808 - DNA, 20 bp, Artificial Sequence
  chemically synthesized
aagaggcacatcctcctctg

SEQ ID NO: 5809 - DNA, 20 bp, Artificial Sequence
  chemically synthesized
ggaagaggcacatcctcctc

SEQ ID NO: 5810 - DNA, 20 bp, Artificial Sequence
  chemically synthesized
gaacctggagcagtgggaag

SEQ ID NO: 5811 - DNA, 20 bp, Artificial Sequence
  chemically synthesized
agaacctggagcagtgggaa

SEQ ID NO: 5812 - DNA, 20 bp, Artificial Sequence
  chemically synthesized
caagaacctggagcagtggg

SEQ ID NO: 5813 - DNA, 20 bp, Artificial Sequence
  chemically synthesized
tgtgcctcttcccactgctc

SEQ ID NO: 5814 - DNA, 20 bp, Artificial Sequence
  chemically synthesized
gttcaagaacctggagcagt

SEQ ID NO: 5815 - DNA, 20 bp, Artificial Sequence
  chemically synthesized
gtgcctcttcccactgctcc

SEQ ID NO: 5816 - DNA, 20 bp, Artificial Sequence
  chemically synthesized
agttcaagaacctggagcag

SEQ ID NO: 5817 - DNA, 20 bp, Artificial Sequence
  chemically synthesized
tgaagttcaagaacctggag

SEQ ID NO: 5818 - DNA, 20 bp, Artificial Sequence
  chemically synthesized
tgatgaagttcaagaacctg

SEQ ID NO: 5819 - DNA, 20 bp, Artificial Sequence
  chemically synthesized
tgtgatgaagttcaagaacc

SEQ ID NO: 5820 - DNA, 20 bp, Artificial Sequence
  chemically synthesized
aaataaatgtgatgaagttc

SEQ ID NO: 5821 - DNA, 20 bp, Artificial Sequence
  chemically synthesized
tagttgaaataaatgtgatg

SEQ ID NO: 5822 - DNA, 20 bp, Artificial Sequence
  chemically synthesized
ttctgaggaaagagacaggg

SEQ ID NO: 5823 - DNA, 20 bp, Artificial Sequence
  chemically synthesized
catttctgaggaaagagaca

SEQ ID NO: 5824 - DNA, 20 bp, Artificial Sequence
  chemically synthesized
acatttctgaggaaagagac

SEQ ID NO: 5825 - DNA, 20 bp, Artificial Sequence
  chemically synthesized
aacatttctgaggaaagaga

SEQ ID NO: 5826 - DNA, 20 bp, Artificial Sequence
  chemically synthesized
aactaccctgtctctttcct

SEQ ID NO: 5827 - DNA, 20 bp, Artificial Sequence
  chemically synthesized
gatgaacatttctgaggaaa

SEQ ID NO: 5828 - DNA, 20 bp, Artificial Sequence
  chemically synthesized
gagatgaacatttctgagga

SEQ ID NO: 5829 - DNA, 20 bp, Artificial Sequence
  chemically synthesized
tgaggagatgaacatttctg

SEQ ID NO: 5830 - DNA, 20 bp, Artificial Sequence
  chemically synthesized
ctgaggagatgaacatttct

SEQ ID NO: 5831 - DNA, 20 bp, Artificial Sequence
  chemically synthesized
ctcagaaatgttcatctcct

SEQ ID NO: 5832 - DNA, 20 bp, Artificial Sequence
  chemically synthesized
cagaaatgttcatctcctca

SEQ ID NO: 5833 - DNA, 20 bp, Artificial Sequence
  chemically synthesized
agatggacgagggctctgag

SEQ ID NO: 5834 - DNA, 20 bp, Artificial Sequence
  chemically synthesized
gaagatggacgagggctctg

SEQ ID NO: 5835 - DNA, 20 bp, Artificial Sequence
  chemically synthesized
agaagatggacgagggctct

SEQ ID NO: 5836 - DNA, 20 bp, Artificial Sequence
  chemically synthesized
atgttgaagaagatggacga

SEQ ID NO: 5837 - DNA, 20 bp, Artificial Sequence
  chemically synthesized
gatgttgaagaagatggacg

SEQ ID NO: 5838 - DNA, 20 bp, Artificial Sequence
  chemically synthesized
agatgttgaagaagatggac

SEQ ID NO: 5839 - DNA, 20 bp, Artificial Sequence
  chemically synthesized
ggaaaagatgttgaagaaga

SEQ ID NO: 5840 - DNA, 20 bp, Artificial Sequence
  chemically synthesized
ggatggaaaagatgttgaag

SEQ ID NO: 5841 - DNA, 20 bp, Artificial Sequence
  chemically synthesized
tcaggatggaaaagatgttg

SEQ ID NO: 5842 - DNA, 20 bp, Artificial Sequence
  chemically synthesized
agtggtagatcaggatggaa

SEQ ID NO: 5843 - DNA, 20 bp, Artificial Sequence
  chemically synthesized
acgacagtggtagatcagga

SEQ ID NO: 5844 - DNA, 20 bp, Artificial Sequence
  chemically synthesized
cctgacgacagtggtagatc

SEQ ID NO: 5845 - DNA, 20 bp, Artificial Sequence
  chemically synthesized
tcctgacgacagtggtagat

SEQ ID NO: 5846 - DNA, 20 bp, Artificial Sequence
  chemically synthesized
ccagatcctgacgacagtgg

SEQ ID NO: 5847 - DNA, 20 bp, Artificial Sequence
  chemically synthesized
tcctgatctaccactgtcgt

SEQ ID NO: 5848 - DNA, 20 bp, Artificial Sequence
  chemically synthesized
ggtccagatcctgacgacag

SEQ ID NO: 5849 - DNA, 20 bp, Artificial Sequence
  chemically synthesized
cctgatctaccactgtcgtc

SEQ ID NO: 5850 - DNA, 20 bp, Artificial Sequence
  chemically synthesized
tgaggtccagatcctgacga

SEQ ID NO: 5851 - DNA, 20 bp, Artificial Sequence
  chemically synthesized
ctaccactgtcgtcaggatc

SEQ ID NO: 5852 - DNA, 20 bp, Artificial Sequence
  chemically synthesized
atcagcagaggggtgaggtc

SEQ ID NO: 5853 - DNA, 20 bp, Artificial Sequence
  chemically synthesized
agcttatcagcagaggggtg

SEQ ID NO: 5854 - DNA, 20 bp, Artificial Sequence
  chemically synthesized
gagcttatcagcagaggggt

SEQ ID NO: 5855 - DNA, 20 bp, Artificial Sequence
  chemically synthesized
tgctgagcttatcagcagag

SEQ ID NO: 5856 - DNA, 20 bp, Artificial Sequence
  chemically synthesized
ttgctgagcttatcagcaga

SEQ ID NO: 5857 - DNA, 20 bp, Artificial Sequence
  chemically synthesized
gttgctgagcttatcagcag

SEQ ID NO: 5858 - DNA, 20 bp, Artificial Sequence
  chemically synthesized
gacctcacccctctgctgat

SEQ ID NO: 5859 - DNA, 20 bp, Artificial Sequence
  chemically synthesized
cgttgctgagcttatcagca

SEQ ID NO: 5860 - DNA, 20 bp, Artificial Sequence
  chemically synthesized
aacgttgctgagcttatcag

SEQ ID NO: 5861 - DNA, 20 bp, Artificial Sequence
  chemically synthesized
cacccctctgctgataagct

SEQ ID NO: 5862 - DNA, 20 bp, Artificial Sequence
  chemically synthesized
accaacgttgctgagcttat

SEQ ID NO: 5863 - DNA, 20 bp, Artificial Sequence
  chemically synthesized
ttgatgagaccaacgttgct

SEQ ID NO: 5864 - DNA, 20 bp, Artificial Sequence
  chemically synthesized
gctgataagctcagcaacgt

SEQ ID NO: 5865 - DNA, 20 bp, Artificial Sequence
  chemically synthesized
gtacagttcatggagttgat

SEQ ID NO: 5866 - DNA, 20 bp, Artificial Sequence
  chemically synthesized
ggtagggagtacagttcatg

SEQ ID NO: 5867 - DNA, 20 bp, Artificial Sequence
  chemically synthesized
ggggtagggagtacagttca

SEQ ID NO: 5868 - DNA, 20 bp, Artificial Sequence
  chemically synthesized
tcactgaggggtagggagta

SEQ ID NO: 5869 - DNA, 20 bp, Artificial Sequence
  chemically synthesized
ggagatcactgaggggtagg

SEQ ID NO: 5870 - DNA, 20 bp, Artificial Sequence
  chemically synthesized
gaactgtactccctacccct

SEQ ID NO: 5871 - DNA, 20 bp, Artificial Sequence
  chemically synthesized
ttggagatcactgaggggta

SEQ ID NO: 5872 - DNA, 20 bp, Artificial Sequence
  chemically synthesized
cttggagatcactgaggggt

SEQ ID NO: 5873 - DNA, 20 bp, Artificial Sequence
  chemically synthesized
acttggagatcactgagggg

SEQ ID NO: 5874 - DNA, 20 bp, Artificial Sequence
  chemically synthesized
tttacttggagatcactgag

SEQ ID NO: 5875 - DNA, 20 bp, Artificial Sequence
  chemically synthesized
ttttacttggagatcactga

SEQ ID NO: 5876 - DNA, 20 bp, Artificial Sequence
  chemically synthesized
attttacttggagatcactg

SEQ ID NO: 5877 - DNA, 20 bp, Artificial Sequence
  chemically synthesized
gattttacttggagatcact

SEQ ID NO: 5878 - DNA, 20 bp, Artificial Sequence
  chemically synthesized
cctacccctcagtgatctcc

SEQ ID NO: 5879 - DNA, 20 bp, Artificial Sequence
  chemically synthesized
gctgctgaagattttacttg

SEQ ID NO: 5880 - DNA, 20 bp, Artificial Sequence
  chemically synthesized
gagctgctgaagattttact

SEQ ID NO: 5881 - DNA, 20 bp, Artificial Sequence
  chemically synthesized
tgatctccaagtaaaatctt

SEQ ID NO: 5882 - DNA, 20 bp, Artificial Sequence
  chemically synthesized
tctccaagtaaaatcttcag

SEQ ID NO: 5883 - DNA, 20 bp, Artificial Sequence
  chemically synthesized
tgcctcccagcgagctgctg

SEQ ID NO: 5884 - DNA, 20 bp, Artificial Sequence
  chemically synthesized
taaaatcttcagcagctcgc

SEQ ID NO: 5885 - DNA, 20 bp, Artificial Sequence
  chemically synthesized
aaaatcttcagcagctcgct

SEQ ID NO: 5886 - DNA, 20 bp, Artificial Sequence
  chemically synthesized
aatcttcagcagctcgctgg

SEQ ID NO: 5887 - DNA, 20 bp, Artificial Sequence
  chemically synthesized
atcttcagcagctcgctggg

SEQ ID NO: 5888 - DNA, 20 bp, Artificial Sequence
  chemically synthesized
ctaacatggtgcctcccagc

SEQ ID NO: 5889 - DNA, 20 bp, Artificial Sequence
  chemically synthesized
acatctaacatggtgcctcc

SEQ ID NO: 5890 - DNA, 20 bp, Artificial Sequence
  chemically synthesized
ctcgctgggaggcaccatgt

SEQ ID NO: 5891 - DNA, 20 bp, Artificial Sequence
  chemically synthesized
agcaatttctacatctaaca

SEQ ID NO: 5892 - DNA, 20 bp, Artificial Sequence
  chemically synthesized
gggaggcaccatgttagatg

SEQ ID NO: 5893 - DNA, 20 bp, Artificial Sequence
  chemically synthesized
tagatgtagaaattgcttga

SEQ ID NO: 5894 - DNA, 20 bp, Artificial Sequence
  chemically synthesized
catggaagtaaaatactttc

SEQ ID NO: 5895 - DNA, 20 bp, Artificial Sequence
  chemically synthesized
tcaaaagttggatatcatgg

SEQ ID NO: 5896 - DNA, 20 bp, Artificial Sequence
  chemically synthesized
aattcaaaagttggatatca

SEQ ID NO: 5897 - DNA, 20 bp, Artificial Sequence
  chemically synthesized
agtcgggaaaattcaaaagt

SEQ ID NO: 5898 - DNA, 20 bp, Artificial Sequence
  chemically synthesized
tcacagtcgggaaaattcaa

SEQ ID NO: 5899 - DNA, 20 bp, Artificial Sequence
  chemically synthesized
aaaatttggagatcacagtc

SEQ ID NO: 5900 - DNA, 20 bp, Artificial Sequence
  chemically synthesized
aaaaatttggagatcacagt

SEQ ID NO: 5901 - DNA, 20 bp, Artificial Sequence
  chemically synthesized
ggcgaaaaatttggagatca

SEQ ID NO: 5902 - DNA, 20 bp, Artificial Sequence
  chemically synthesized
gttttatggcgaaaaatttg

SEQ ID NO: 5903 - DNA, 20 bp, Artificial Sequence
  chemically synthesized
gagttttatggcgaaaaatt

SEQ ID NO: 5904 - DNA, 20 bp, Artificial Sequence
  chemically synthesized
aggggtgtgggtgagtttta

SEQ ID NO: 5905 - DNA, 20 bp, Artificial Sequence
  chemically synthesized
gaaaagtcaggggtgtgggt

SEQ ID NO: 5906 - DNA, 20 bp, Artificial Sequence
  chemically synthesized
aaaggaaaagtcaggggtgt

SEQ ID NO: 5907 - DNA, 20 bp, Artificial Sequence
  chemically synthesized
gaaaggaaaagtcaggggtg

SEQ ID NO: 5908 - DNA, 20 bp, Artificial Sequence
  chemically synthesized
ggacagaaaggaaaagtcag

SEQ ID NO: 5909 - DNA, 20 bp, Artificial Sequence
  chemically synthesized
aggacagaaaggaaaagtca

SEQ ID NO: 5910 - DNA, 20 bp, Artificial Sequence
  chemically synthesized
taggacagaaaggaaaagtc

SEQ ID NO: 5911 - DNA, 20 bp, Artificial Sequence
  chemically synthesized
ataggacagaaaggaaaagt

SEQ ID NO: 5912 - DNA, 20 bp, Artificial Sequence
  chemically synthesized
atggataggacagaaaggaa

SEQ ID NO: 5913 - DNA, 20 bp, Artificial Sequence
  chemically synthesized
ccaaaatggataggacagaa

SEQ ID NO: 5914 - DNA, 20 bp, Artificial Sequence
  chemically synthesized
accaaaatggataggacaga

SEQ ID NO: 5915 - DNA, 20 bp, Artificial Sequence
  chemically synthesized
cttaaccaaaatggatagga

SEQ ID NO: 5916 - DNA, 20 bp, Artificial Sequence
  chemically synthesized
gtgccttaaccaaaatggat

SEQ ID NO: 5917 - DNA, 20 bp, Artificial Sequence
  chemically synthesized
cctttctgtcctatccattt

SEQ ID NO: 5918 - DNA, 20 bp, Artificial Sequence
  chemically synthesized
agtgccttaaccaaaatgga

SEQ ID NO: 5919 - DNA, 20 bp, Artificial Sequence
  chemically synthesized
gcaaagtgccttaaccaaaa

SEQ ID NO: 5920 - DNA, 20 bp, Artificial Sequence
  chemically synthesized
ctgtcctatccattttggtt

SEQ ID NO: 5921 - DNA, 20 bp, Artificial Sequence
  chemically synthesized
tgtcctatccattttggtta

SEQ ID NO: 5922 - DNA, 20 bp, Artificial Sequence
  chemically synthesized
gggtagaataaagggaggca

SEQ ID NO: 5923 - DNA, 20 bp, Artificial Sequence
  chemically synthesized
catgagggtagaataaaggg

SEQ ID NO: 5924 - DNA, 20 bp, Artificial Sequence
  chemically synthesized
ccatgagggtagaataaagg

SEQ ID NO: 5925 - DNA, 20 bp, Artificial Sequence
  chemically synthesized
ttccatgagggtagaataaa

SEQ ID NO: 5926 - DNA, 20 bp, Artificial Sequence
  chemically synthesized
cttccatgagggtagaataa

SEQ ID NO: 5927 - DNA, 20 bp, Artificial Sequence
  chemically synthesized
tcttccatgagggtagaata

SEQ ID NO: 5928 - DNA, 20 bp, Artificial Sequence
  chemically synthesized
ctccctttattctaccctca

SEQ ID NO: 5929 - DNA, 20 bp, Artificial Sequence
  chemically synthesized
cttgagctcttccatgaggg

SEQ ID NO: 5930 - DNA, 20 bp, Artificial Sequence
  chemically synthesized
cctttattctaccctcatgg

SEQ ID NO: 5931 - DNA, 20 bp, Artificial Sequence
  chemically synthesized
atacttgagctcttccatga

SEQ ID NO: 5932 - DNA, 20 bp, Artificial Sequence
  chemically synthesized
tttattctaccctcatggaa

SEQ ID NO: 5933 - DNA, 20 bp, Artificial Sequence
  chemically synthesized
catacttgagctcttccatg

SEQ ID NO: 5934 - DNA, 20 bp, Artificial Sequence
  chemically synthesized
tcatacttgagctcttccat

SEQ ID NO: 5935 - DNA, 20 bp, Artificial Sequence
  chemically synthesized
ctaccctcatggaagagctc

SEQ ID NO: 5936 - DNA, 20 bp, Artificial Sequence
  chemically synthesized
caggaattcatttcatactt

SEQ ID NO: 5937 - DNA, 20 bp, Artificial Sequence
  chemically synthesized
cctgatatgatgatgtgttc

SEQ ID NO: 5938 - DNA, 20 bp, Artificial Sequence
  chemically synthesized
gcctgatatgatgatgtgtt

SEQ ID NO: 5939 - DNA, 20 bp, Artificial Sequence
  chemically synthesized
tcctgaacacatcatcatat

SEQ ID NO: 5940 - DNA, 20 bp, Artificial Sequence
  chemically synthesized
cctgaacacatcatcatatc

SEQ ID NO: 5941 - DNA, 20 bp, Artificial Sequence
  chemically synthesized
cacatcatcatatcaggcaa

SEQ ID NO: 5942 - DNA, 20 bp, Artificial Sequence
  chemically synthesized
catcatcatatcaggcaata

SEQ ID NO: 5943 - DNA, 20 bp, Artificial Sequence
  chemically synthesized
atatcaggcaatagagctgt

SEQ ID NO: 5944 - DNA, 20 bp, Artificial Sequence
  chemically synthesized
tccttgattccatacactta

SEQ ID NO: 5945 - DNA, 20 bp, Artificial Sequence
  chemically synthesized
gcaatagagctgtaagtgta

SEQ ID NO: 5946 - DNA, 20 bp, Artificial Sequence
  chemically synthesized
agctgtaagtgtatggaatc

SEQ ID NO: 5947 - DNA, 20 bp, Artificial Sequence
  chemically synthesized
gctgtaagtgtatggaatca

SEQ ID NO: 5948 - DNA, 20 bp, Artificial Sequence
  chemically synthesized
tgtaagtgtatggaatcaag

SEQ ID NO: 5949 - DNA, 20 bp, Artificial Sequence
  chemically synthesized
tgtatggaatcaaggagtca

SEQ ID NO: 5950 - DNA, 20 bp, Artificial Sequence
  chemically synthesized
gtatggaatcaaggagtcac

SEQ ID NO: 5951 - DNA, 20 bp, Artificial Sequence
  chemically synthesized
tcttacctcacagaatagaa

SEQ ID NO: 5952 - DNA, 20 bp, Artificial Sequence
  chemically synthesized
acaggtcttttctattctgt

SEQ ID NO: 5953 - DNA, 20 bp, Artificial Sequence
  chemically synthesized
caggtcttttctattctgtg

SEQ ID NO: 5954 - DNA, 20 bp, Artificial Sequence
  chemically synthesized
tcaaatcttacctcacagaa

SEQ ID NO: 5955 - DNA, 20 bp, Artificial Sequence
  chemically synthesized
tcttttctattctgtgaggt

SEQ ID NO: 5956 - DNA, 20 bp, Artificial Sequence
  chemically synthesized
tcctctcaaatcttacctca

SEQ ID NO: 5957 - DNA, 20 bp, Artificial Sequence
  chemically synthesized
tattctgtgaggtaagattt

SEQ ID NO: 5958 - DNA, 20 bp, Artificial Sequence
  chemically synthesized
ttctgtgaggtaagatttga

SEQ ID NO: 5959 - DNA, 20 bp, Artificial Sequence
  chemically synthesized
tctgtgaggtaagatttgag

SEQ ID NO: 5960 - DNA, 20 bp, Artificial Sequence
  chemically synthesized
aggtaagatttgagaggacc

SEQ ID NO: 5961 - DNA, 20 bp, Artificial Sequence
  chemically synthesized
acctaaactggttatatact

SEQ ID NO: 5962 - DNA, 20 bp, Artificial Sequence
  chemically synthesized
gagaggaccaagtatataac

SEQ ID NO: 5963 - DNA, 20 bp, Artificial Sequence
  chemically synthesized
gaccaagtatataaccagtt

SEQ ID NO: 5964 - DNA, 20 bp, Artificial Sequence
  chemically synthesized
accaagtatataaccagttt

SEQ ID NO: 5965 - DNA, 20 bp, Artificial Sequence
  chemically synthesized
cttttccctgggacctaaac

SEQ ID NO: 5966 - DNA, 20 bp, Artificial Sequence
  chemically synthesized
tatataaccagtttaggtcc

SEQ ID NO: 5967 - DNA, 20 bp, Artificial Sequence
  chemically synthesized
atataaccagtttaggtccc

SEQ ID NO: 5968 - DNA, 20 bp, Artificial Sequence
  chemically synthesized
tataaccagtttaggtccca

SEQ ID NO: 5969 - DNA, 20 bp, Artificial Sequence
  chemically synthesized
ccagtttaggtcccagggaa

SEQ ID NO: 5970 - DNA, 20 bp, Artificial Sequence
  chemically synthesized
ctctctccttacttttccct

SEQ ID NO: 5971 - DNA, 20 bp, Artificial Sequence
  chemically synthesized
cctctctccttacttttccc

SEQ ID NO: 5972 - DNA, 20 bp, Artificial Sequence
  chemically synthesized
tttaggtcccagggaaaagt

SEQ ID NO: 5973 - DNA, 20 bp, Artificial Sequence
  chemically synthesized
ttaggtcccagggaaaagta

SEQ ID NO: 5974 - DNA, 20 bp, Artificial Sequence
  chemically synthesized
aggtcccagggaaaagtaag

SEQ ID NO: 5975 - DNA, 20 bp, Artificial Sequence
  chemically synthesized
gtcccagggaaaagtaagga

SEQ ID NO: 5976 - DNA, 20 bp, Artificial Sequence
  chemically synthesized
cccagggaaaagtaaggaga

SEQ ID NO: 5977 - DNA, 20 bp, Artificial Sequence
  chemically synthesized
ccagggaaaagtaaggagag

SEQ ID NO: 5978 - DNA, 20 bp, Artificial Sequence
  chemically synthesized
ggaaaagtaaggagagagga

SEQ ID NO: 5979 - DNA, 20 bp, Artificial Sequence
  chemically synthesized
aaaagtaaggagagaggatg

SEQ ID NO: 5980 - DNA, 20 bp, Artificial Sequence
  chemically synthesized
tgtaaaggcccagtaggagt

SEQ ID NO: 5981 - DNA, 20 bp, Artificial Sequence
  chemically synthesized
aggatggagctgactcctac

SEQ ID NO: 5982 - DNA, 20 bp, Artificial Sequence
  chemically synthesized
ggatggagctgactcctact

SEQ ID NO: 5983 - DNA, 20 bp, Artificial Sequence
  chemically synthesized
tctctgtaaaggcccagtag

SEQ ID NO: 5984 - DNA, 20 bp, Artificial Sequence
  chemically synthesized
tttctctgtaaaggcccagt

SEQ ID NO: 5985 - DNA, 20 bp, Artificial Sequence
  chemically synthesized
ctttctctgtaaaggcccag

SEQ ID NO: 5986 - DNA, 20 bp, Artificial Sequence
  chemically synthesized
tctctttctctgtaaaggcc

SEQ ID NO: 5987 - DNA, 20 bp, Artificial Sequence
  chemically synthesized
tgactcctactgggccttta

SEQ ID NO: 5988 - DNA, 20 bp, Artificial Sequence
  chemically synthesized
actcctactgggcctttaca

SEQ ID NO: 5989 - DNA, 20 bp, Artificial Sequence
  chemically synthesized
tcatttctctttctctgtaa

SEQ ID NO: 5990 - DNA, 20 bp, Artificial Sequence
  chemically synthesized
ctcatttctctttctctgta

SEQ ID NO: 5991 - DNA, 20 bp, Artificial Sequence
  chemically synthesized
ctactgggcctttacagaga

SEQ ID NO: 5992 - DNA, 20 bp, Artificial Sequence
  chemically synthesized
actgggcctttacagagaaa

SEQ ID NO: 5993 - DNA, 20 bp, Artificial Sequence
  chemically synthesized
ctttacagagaaagagaaat

SEQ ID NO: 5994 - DNA, 20 bp, Artificial Sequence
  chemically synthesized
tttacagagaaagagaaatg

SEQ ID NO: 5995 - DNA, 20 bp, Artificial Sequence
  chemically synthesized
acagagaaagagaaatgagg

SEQ ID NO: 5996 - DNA, 20 bp, Artificial Sequence
  chemically synthesized
cagagaaagagaaatgagga

SEQ ID NO: 5997 - DNA, 20 bp, Artificial Sequence
  chemically synthesized
agagaaagagaaatgaggaa

SEQ ID NO: 5998 - DNA, 20 bp, Artificial Sequence
  chemically synthesized
gagaaagagaaatgaggaag

SEQ ID NO: 5999 - DNA, 20 bp, Artificial Sequence
  chemically synthesized
agaaagagaaatgaggaagg

SEQ ID NO: 6000 - DNA, 20 bp, Artificial Sequence
  chemically synthesized
agaaatgaggaagggggacc

SEQ ID NO: 6001 - DNA, 20 bp, Artificial Sequence
  chemically synthesized
ttatgaaggccacaaatact

SEQ ID NO: 6002 - DNA, 20 bp, Artificial Sequence
  chemically synthesized
gaagggggaccaagtatttg

SEQ ID NO: 6003 - DNA, 20 bp, Artificial Sequence
  chemically synthesized
gacaatagagggttttatga

SEQ ID NO: 6004 - DNA, 20 bp, Artificial Sequence
  chemically synthesized
agacaatagagggttttatg

SEQ ID NO: 6005 - DNA, 20 bp, Artificial Sequence
  chemically synthesized
gtgtctggctagacaataga

SEQ ID NO: 6006 - DNA, 20 bp, Artificial Sequence
  chemically synthesized
tgtgtctggctagacaatag

SEQ ID NO: 6007 - DNA, 20 bp, Artificial Sequence
  chemically synthesized
tcataaaaccctctattgtc

SEQ ID NO: 6008 - DNA, 20 bp, Artificial Sequence
  chemically synthesized
ctgtgtctggctagacaata

SEQ ID NO: 6009 - DNA, 20 bp, Artificial Sequence
  chemically synthesized
tgctgtgtctggctagacaa

SEQ ID NO: 6010 - DNA, 20 bp, Artificial Sequence
  chemically synthesized
aaaaccctctattgtctagc

SEQ ID NO: 6011 - DNA, 20 bp, Artificial Sequence
  chemically synthesized
tttttcctgctgtgtctggc

SEQ ID NO: 6012 - DNA, 20 bp, Artificial Sequence
  chemically synthesized
ctctattgtctagccagaca

SEQ ID NO: 6013 - DNA, 20 bp, Artificial Sequence
  chemically synthesized
tattgtctagccagacacag

SEQ ID NO: 6014 - DNA, 20 bp, Artificial Sequence
  chemically synthesized
ttggtttttcctgctgtgtc

SEQ ID NO: 6015 - DNA, 20 bp, Artificial Sequence
  chemically synthesized
attgtctagccagacacagc

SEQ ID NO: 6016 - DNA, 20 bp, Artificial Sequence
  chemically synthesized
acacagcaggaaaaaccaat

SEQ ID NO: 6017 - DNA, 20 bp, Artificial Sequence
  chemically synthesized
cagcaggaaaaaccaatgag

SEQ ID NO: 6018 - DNA, 20 bp, Artificial Sequence
  chemically synthesized
gttcctagccagctgctcat

SEQ ID NO: 6019 - DNA, 20 bp, Artificial Sequence
  chemically synthesized
aggaaaaaccaatgagcagc

SEQ ID NO: 6020 - DNA, 20 bp, Artificial Sequence
  chemically synthesized
aaaaccaatgagcagctggc

SEQ ID NO: 6021 - DNA, 20 bp, Artificial Sequence
  chemically synthesized
aaaccaatgagcagctggct

SEQ ID NO: 6022 - DNA, 20 bp, Artificial Sequence
  chemically synthesized
ctaggacaggggttcctagc

SEQ ID NO: 6023 - DNA, 20 bp, Artificial Sequence
  chemically synthesized
atggctaggacaggggttcc

SEQ ID NO: 6024 - DNA, 20 bp, Artificial Sequence
  chemically synthesized
ctggctaggaacccctgtcc

SEQ ID NO: 6025 - DNA, 20 bp, Artificial Sequence
  chemically synthesized
gtaatgaatggctaggacag

SEQ ID NO: 6026 - DNA, 20 bp, Artificial Sequence
  chemically synthesized
ggtaatgaatggctaggaca

SEQ ID NO: 6027 - DNA, 20 bp, Artificial Sequence
  chemically synthesized
tggtaatgaatggctaggac

SEQ ID NO: 6028 - DNA, 20 bp, Artificial Sequence
  chemically synthesized
gtggtaatgaatggctagga

SEQ ID NO: 6029 - DNA, 20 bp, Artificial Sequence
  chemically synthesized
tacagtggtaatgaatggct

SEQ ID NO: 6030 - DNA, 20 bp, Artificial Sequence
  chemically synthesized
ttacagtggtaatgaatggc

SEQ ID NO: 6031 - DNA, 20 bp, Artificial Sequence
  chemically synthesized
cattttacagtggtaatgaa

SEQ ID NO: 6032 - DNA, 20 bp, Artificial Sequence
  chemically synthesized
aagagtagggcattttacag

SEQ ID NO: 6033 - DNA, 20 bp, Artificial Sequence
  chemically synthesized
aacaagagtagggcatttta

SEQ ID NO: 6034 - DNA, 20 bp, Artificial Sequence
  chemically synthesized
caaaggtcaaaacaagagta

SEQ ID NO: 6035 - DNA, 20 bp, Artificial Sequence
  chemically synthesized
tcaaaggtcaaaacaagagt

SEQ ID NO: 6036 - DNA, 20 bp, Artificial Sequence
  chemically synthesized
atcaaaggtcaaaacaagag

SEQ ID NO: 6037 - DNA, 20 bp, Artificial Sequence
  chemically synthesized
atgatcaaaggtcaaaacaa

SEQ ID NO: 6038 - DNA, 20 bp, Artificial Sequence
  chemically synthesized
aaatgatcaaaggtcaaaac

SEQ ID NO: 6039 - DNA, 20 bp, Artificial Sequence
  chemically synthesized
gatgaggcataaatgatcaa

SEQ ID NO: 6040 - DNA, 20 bp, Artificial Sequence
  chemically synthesized
tgatgaggcataaatgatca

SEQ ID NO: 6041 - DNA, 20 bp, Artificial Sequence
  chemically synthesized
tttgatcatttatgcctcat

SEQ ID NO: 6042 - DNA, 20 bp, Artificial Sequence
  chemically synthesized
taagaaaggtggagctgatg

SEQ ID NO: 6043 - DNA, 20 bp, Artificial Sequence
  chemically synthesized
ctaagaaaggtggagctgat

SEQ ID NO: 6044 - DNA, 20 bp, Artificial Sequence
  chemically synthesized
actaggttctaagaaaggtg

SEQ ID NO: 6045 - DNA, 20 bp, Artificial Sequence
  chemically synthesized
ctcatcagctccacctttct

SEQ ID NO: 6046 - DNA, 20 bp, Artificial Sequence
  chemically synthesized
ggactaggttctaagaaagg

SEQ ID NO: 6047 - DNA, 20 bp, Artificial Sequence
  chemically synthesized
ctaggactaggttctaagaa

SEQ ID NO: 6048 - DNA, 20 bp, Artificial Sequence
  chemically synthesized
cctaggactaggttctaaga

SEQ ID NO: 6049 - DNA, 20 bp, Artificial Sequence
  chemically synthesized
gctccacctttcttagaacc

SEQ ID NO: 6050 - DNA, 20 bp, Artificial Sequence
  chemically synthesized
tctgcctaggactaggttct

SEQ ID NO: 6051 - DNA, 20 bp, Artificial Sequence
  chemically synthesized
cctttcttagaacctagtcc

SEQ ID NO: 6052 - DNA, 20 bp, Artificial Sequence
  chemically synthesized
ctttcttagaacctagtcct

SEQ ID NO: 6053 - DNA, 20 bp, Artificial Sequence
  chemically synthesized
aatgttctctgcctaggact

SEQ ID NO: 6054 - DNA, 20 bp, Artificial Sequence
  chemically synthesized
caatgttctctgcctaggac

SEQ ID NO: 6055 - DNA, 20 bp, Artificial Sequence
  chemically synthesized
tcttagaacctagtcctagg

SEQ ID NO: 6056 - DNA, 20 bp, Artificial Sequence
  chemically synthesized
ttagaacctagtcctaggca

SEQ ID NO: 6057 - DNA, 20 bp, Artificial Sequence
  chemically synthesized
cttagcaatgttctctgcct

SEQ ID NO: 6058 - DNA, 20 bp, Artificial Sequence
  chemically synthesized
tcttagcaatgttctctgcc

SEQ ID NO: 6059 - DNA, 20 bp, Artificial Sequence
  chemically synthesized
cctaggcagagaacattgct

SEQ ID NO: 6060 - DNA, 20 bp, Artificial Sequence
  chemically synthesized
cagagaacattgctaagaat

SEQ ID NO: 6061 - DNA, 20 bp, Artificial Sequence
  chemically synthesized
acatgttctgttctcattct

SEQ ID NO: 6062 - DNA, 20 bp, Artificial Sequence
  chemically synthesized
aacattgctaagaatgagaa

SEQ ID NO: 6063 - DNA, 20 bp, Artificial Sequence
  chemically synthesized
aagaatgagaacagaacatg

SEQ ID NO: 6064 - DNA, 20 bp, Artificial Sequence
  chemically synthesized
ggatgaatttgttgaggaaa

SEQ ID NO: 6065 - DNA, 20 bp, Artificial Sequence
  chemically synthesized
aaagttggatgaatttgttg

SEQ ID NO: 6066 - DNA, 20 bp, Artificial Sequence
  chemically synthesized
aaaagttggatgaatttgtt

SEQ ID NO: 6067 - DNA, 20 bp, Artificial Sequence
  chemically synthesized
aggaagccttaggcaaaagt

SEQ ID NO: 6068 - DNA, 20 bp, Artificial Sequence
  chemically synthesized
aattcatccaacttttgcct

SEQ ID NO: 6069 - DNA, 20 bp, Artificial Sequence
  chemically synthesized
attcatccaacttttgccta

SEQ ID NO: 6070 - DNA, 20 bp, Artificial Sequence
  chemically synthesized
aagaaggaagccttaggcaa

SEQ ID NO: 6071 - DNA, 20 bp, Artificial Sequence
  chemically synthesized
ccaagtaagaaggaagcctt

SEQ ID NO: 6072 - DNA, 20 bp, Artificial Sequence
  chemically synthesized
accaagtaagaaggaagcct

SEQ ID NO: 6073 - DNA, 20 bp, Artificial Sequence
  chemically synthesized
aacattaccaagtaagaagg

SEQ ID NO: 6074 - DNA, 20 bp, Artificial Sequence
  chemically synthesized
cctaaggcttccttcttact

SEQ ID NO: 6075 - DNA, 20 bp, Artificial Sequence
  chemically synthesized
tgaaacattaccaagtaaga

SEQ ID NO: 6076 - DNA, 20 bp, Artificial Sequence
  chemically synthesized
ttgaaacattaccaagtaag

SEQ ID NO: 6077 - DNA, 20 bp, Artificial Sequence
  chemically synthesized
attttgaaacattaccaagt

SEQ ID NO: 6078 - DNA, 20 bp, Artificial Sequence
  chemically synthesized
gacaattttgaaacattacc

SEQ ID NO: 6079 - DNA, 20 bp, Artificial Sequence
  chemically synthesized
aatgaggattaaggaaagtg

SEQ ID NO: 6080 - DNA, 20 bp, Artificial Sequence
  chemically synthesized
aaatgaatgaggattaagga

SEQ ID NO: 6081 - DNA, 20 bp, Artificial Sequence
  chemically synthesized
cttaaaatgaatgaggatta

SEQ ID NO: 6082 - DNA, 20 bp, Artificial Sequence
  chemically synthesized
tcttaaaatgaatgaggatt

SEQ ID NO: 6083 - DNA, 20 bp, Artificial Sequence
  chemically synthesized
aggtaatcttaaaatgaatg

SEQ ID NO: 6084 - DNA, 20 bp, Artificial Sequence
  chemically synthesized
taggtaatcttaaaatgaat

SEQ ID NO: 6085 - DNA, 20 bp, Artificial Sequence
  chemically synthesized
ccttaatcctcattcatttt

SEQ ID NO: 6086 - DNA, 20 bp, Artificial Sequence
  chemically synthesized
tcattcattttaagattacc

SEQ ID NO: 6087 - DNA, 20 bp, Artificial Sequence
  chemically synthesized
tttcaatgaaatgaaagact

SEQ ID NO: 6088 - DNA, 20 bp, Artificial Sequence
  chemically synthesized
gtttcaatgaaatgaaagac

SEQ ID NO: 6089 - DNA, 20 bp, Artificial Sequence
  chemically synthesized
cttctgtttcaatgaaatga

SEQ ID NO: 6090 - DNA, 20 bp, Artificial Sequence
  chemically synthesized
agtctttcatttcattgaaa

SEQ ID NO: 6091 - DNA, 20 bp, Artificial Sequence
  chemically synthesized
ctttcatttcattgaaacag

SEQ ID NO: 6092 - DNA, 20 bp, Artificial Sequence
  chemically synthesized
taggccaagagaagggaagg

SEQ ID NO: 6093 - DNA, 20 bp, Artificial Sequence
  chemically synthesized
ttttaggccaagagaaggga

SEQ ID NO: 6094 - DNA, 20 bp, Artificial Sequence
  chemically synthesized
attttaggccaagagaaggg

SEQ ID NO: 6095 - DNA, 20 bp, Artificial Sequence
  chemically synthesized
ttttccaccttcccttctct

SEQ ID NO: 6096 - DNA, 20 bp, Artificial Sequence
  chemically synthesized
accattttaggccaagagaa

SEQ ID NO: 6097 - DNA, 20 bp, Artificial Sequence
  chemically synthesized
aaccattttaggccaagaga

SEQ ID NO: 6098 - DNA, 20 bp, Artificial Sequence
  chemically synthesized
aaaccattttaggccaagag

SEQ ID NO: 6099 - DNA, 20 bp, Artificial Sequence
  chemically synthesized
gagaaaccattttaggccaa

SEQ ID NO: 6100 - DNA, 20 bp, Artificial Sequence
  chemically synthesized
ttgagaaaccattttaggcc

SEQ ID NO: 6101 - DNA, 20 bp, Artificial Sequence
  chemically synthesized
tcccttctcttggcctaaaa

SEQ ID NO: 6102 - DNA, 20 bp, Artificial Sequence
  chemically synthesized
taattttgagaaaccatttt

SEQ ID NO: 6103 - DNA, 20 bp, Artificial Sequence
  chemically synthesized
gtaattttgagaaaccattt

SEQ ID NO: 6104 - DNA, 20 bp, Artificial Sequence
  chemically synthesized
taaatgcattgggtaatttt

SEQ ID NO: 6105 - DNA, 20 bp, Artificial Sequence
  chemically synthesized
tgggtcactataaatgcatt

SEQ ID NO: 6106 - DNA, 20 bp, Artificial Sequence
  chemically synthesized
ttgggtcactataaatgcat

SEQ ID NO: 6107 - DNA, 20 bp, Artificial Sequence
  chemically synthesized
aaaattacccaatgcattta

SEQ ID NO: 6108 - DNA, 20 bp, Artificial Sequence
  chemically synthesized
atgcatttatagtgacccaa

SEQ ID NO: 6109 - DNA, 20 bp, Artificial Sequence
  chemically synthesized
aaaataaatcacagtccatt

SEQ ID NO: 6110 - DNA, 20 bp, Artificial Sequence
  chemically synthesized
taaaataaatcacagtccat

SEQ ID NO: 6111 - DNA, 20 bp, Artificial Sequence
  chemically synthesized
atggaaattaaaataaatca

SEQ ID NO: 6112 - DNA, 20 bp, Artificial Sequence
  chemically synthesized
gatttattttaatttccatt

SEQ ID NO: 6113 - DNA, 20 bp, Artificial Sequence
  chemically synthesized
aaatgctaaagagagctcaa

SEQ ID NO: 6114 - DNA, 20 bp, Artificial Sequence
  chemically synthesized
aatttccattgagctctctt

SEQ ID NO: 6115 - DNA, 20 bp, Artificial Sequence
  chemically synthesized
aaaaggtgaaatgctaaaga

SEQ ID NO: 6116 - DNA, 20 bp, Artificial Sequence
  chemically synthesized
caaaaaggtgaaatgctaaa

SEQ ID NO: 6117 - DNA, 20 bp, Artificial Sequence
  chemically synthesized
gacaaaaaggtgaaatgcta

SEQ ID NO: 6118 - DNA, 20 bp, Artificial Sequence
  chemically synthesized
tcaaggaagatgtgacaaaa

SEQ ID NO: 6119 - DNA, 20 bp, Artificial Sequence
  chemically synthesized
ttcaaggaagatgtgacaaa

SEQ ID NO: 6120 - DNA, 20 bp, Artificial Sequence
  chemically synthesized
ataagtagggaggttcaagg

SEQ ID NO: 6121 - DNA, 20 bp, Artificial Sequence
  chemically synthesized
tggataagtagggaggttca

SEQ ID NO: 6122 - DNA, 20 bp, Artificial Sequence
  chemically synthesized
atggataagtagggaggttc

SEQ ID NO: 6123 - DNA, 20 bp, Artificial Sequence
  chemically synthesized
taaaggatggataagtaggg

SEQ ID NO: 6124 - DNA, 20 bp, Artificial Sequence
  chemically synthesized
gtaaaggatggataagtagg

SEQ ID NO: 6125 - DNA, 20 bp, Artificial Sequence
  chemically synthesized
tagtaaaggatggataagta

SEQ ID NO: 6126 - DNA, 20 bp, Artificial Sequence
  chemically synthesized
atagtaaaggatggataagt

SEQ ID NO: 6127 - DNA, 20 bp, Artificial Sequence
  chemically synthesized
gatagtaaaggatggataag

SEQ ID NO: 6128 - DNA, 20 bp, Artificial Sequence
  chemically synthesized
tgggatagtaaaggatggat

SEQ ID NO: 6129 - DNA, 20 bp, Artificial Sequence
  chemically synthesized
ggtaatgggatagtaaagga

SEQ ID NO: 6130 - DNA, 20 bp, Artificial Sequence
  chemically synthesized
tttgggtaatgggatagtaa

SEQ ID NO: 6131 - DNA, 20 bp, Artificial Sequence
  chemically synthesized
atttgggtaatgggatagta

SEQ ID NO: 6132 - DNA, 20 bp, Artificial Sequence
  chemically synthesized
cctccatttgggtaatggga

SEQ ID NO: 6133 - DNA, 20 bp, Artificial Sequence
  chemically synthesized
aagacctccatttgggtaat

SEQ ID NO: 6134 - DNA, 20 bp, Artificial Sequence
  chemically synthesized
aaagacctccatttgggtaa

SEQ ID NO: 6135 - DNA, 20 bp, Artificial Sequence
  chemically synthesized
ttactatcccattacccaaa

SEQ ID NO: 6136 - DNA, 20 bp, Artificial Sequence
  chemically synthesized
actatcccattacccaaatg

SEQ ID NO: 6137 - DNA, 20 bp, Artificial Sequence
  chemically synthesized
ctatcccattacccaaatgg

SEQ ID NO: 6138 - DNA, 20 bp, Artificial Sequence
  chemically synthesized
cttggaaaagacctccattt

SEQ ID NO: 6139 - DNA, 20 bp, Artificial Sequence
  chemically synthesized
ccttggaaaagacctccatt

SEQ ID NO: 6140 - DNA, 20 bp, Artificial Sequence
  chemically synthesized
cccaaatggaggtcttttcc

SEQ ID NO: 6141 - DNA, 20 bp, Artificial Sequence
  chemically synthesized
ccaaatggaggtcttttcca

SEQ ID NO: 6142 - DNA, 20 bp, Artificial Sequence
  chemically synthesized
ttcgatccagtgccttggaa

SEQ ID NO: 6143 - DNA, 20 bp, Artificial Sequence
  chemically synthesized
ggaggtcttttccaaggcac

SEQ ID NO: 6144 - DNA, 20 bp, Artificial Sequence
  chemically synthesized
ggtgcttcgatccagtgcct

SEQ ID NO: 6145 - DNA, 20 bp, Artificial Sequence
  chemically synthesized
ttttccaaggcactggatcg

SEQ ID NO: 6146 - DNA, 20 bp, Artificial Sequence
  chemically synthesized
ataacacaggtgcttcgatc

SEQ ID NO: 6147 - DNA, 20 bp, Artificial Sequence
  chemically synthesized
ggatcgaagcacctgtgtta

SEQ ID NO: 6148 - DNA, 20 bp, Artificial Sequence
  chemically synthesized
atctataaaatctataacac

SEQ ID NO: 6149 - DNA, 20 bp, Artificial Sequence
  chemically synthesized
aatctataaaatctataaca

SEQ ID NO: 6150 - DNA, 20 bp, Artificial Sequence
  chemically synthesized
cacctgtgttatagatttta

SEQ ID NO: 6151 - DNA, 20 bp, Artificial Sequence
  chemically synthesized
attgctgaagggtgtgagat

SEQ ID NO: 6152 - DNA, 20 bp, Artificial Sequence
  chemically synthesized
aattgattgctgaagggtgt

SEQ ID NO: 6153 - DNA, 20 bp, Artificial Sequence
  chemically synthesized
atttctcatctcacaccctt

SEQ ID NO: 6154 - DNA, 20 bp, Artificial Sequence
  chemically synthesized
tcatagaattgattgctgaa

SEQ ID NO: 6155 - DNA, 20 bp, Artificial Sequence
  chemically synthesized
ttcatagaattgattgctga

SEQ ID NO: 6156 - DNA, 20 bp, Artificial Sequence
  chemically synthesized
tttcatagaattgattgctg

SEQ ID NO: 6157 - DNA, 20 bp, Artificial Sequence
  chemically synthesized
agatttgagaatgagtttca

SEQ ID NO: 6158 - DNA, 20 bp, Artificial Sequence
  chemically synthesized
aactggagagatttgagaat

SEQ ID NO: 6159 - DNA, 20 bp, Artificial Sequence
  chemically synthesized
tgggcaaactggagagattt

SEQ ID NO: 6160 - DNA, 20 bp, Artificial Sequence
  chemically synthesized
aactcattctcaaatctctc

SEQ ID NO: 6161 - DNA, 20 bp, Artificial Sequence
  chemically synthesized
aagtaagtgggcaaactgga

SEQ ID NO: 6162 - DNA, 20 bp, Artificial Sequence
  chemically synthesized
tgaagtaagtgggcaaactg

SEQ ID NO: 6163 - DNA, 20 bp, Artificial Sequence
  chemically synthesized
cttgaagtaagtgggcaaac

SEQ ID NO: 6164 - DNA, 20 bp, Artificial Sequence
  chemically synthesized
gatctatacttgaagtaagt

SEQ ID NO: 6165 - DNA, 20 bp, Artificial Sequence
  chemically synthesized
agatctatacttgaagtaag

SEQ ID NO: 6166 - DNA, 20 bp, Artificial Sequence
  chemically synthesized
ccagtttgcccacttacttc

SEQ ID NO: 6167 - DNA, 20 bp, Artificial Sequence
  chemically synthesized
tacagatctatacttgaagt

SEQ ID NO: 6168 - DNA, 20 bp, Artificial Sequence
  chemically synthesized
ttgcccacttacttcaagta

SEQ ID NO: 6169 - DNA, 20 bp, Artificial Sequence
  chemically synthesized
aagatacagatctatacttg

SEQ ID NO: 6170 - DNA, 20 bp, Artificial Sequence
  chemically synthesized
tcccaaaagaaattaagata

SEQ ID NO: 6171 - DNA, 20 bp, Artificial Sequence
  chemically synthesized
gtcatgtcccaaaagaaatt

SEQ ID NO: 6172 - DNA, 20 bp, Artificial Sequence
  chemically synthesized
atctgtatcttaatttcttt

SEQ ID NO: 6173 - DNA, 20 bp, Artificial Sequence
  chemically synthesized
tctgtatcttaatttctttt

SEQ ID NO: 6174 - DNA, 20 bp, Artificial Sequence
  chemically synthesized
tcttctaagtcatgtcccaa

SEQ ID NO: 6175 - DNA, 20 bp, Artificial Sequence
  chemically synthesized
atttcttttgggacatgact

SEQ ID NO: 6176 - DNA, 20 bp, Artificial Sequence
  chemically synthesized
tcttttgggacatgacttag

SEQ ID NO: 6177 - DNA, 20 bp, Artificial Sequence
  chemically synthesized
gagaaattgacaggtcttct

SEQ ID NO: 6178 - DNA, 20 bp, Artificial Sequence
  chemically synthesized
aatgtgtttgagaaattgac

SEQ ID NO: 6179 - DNA, 20 bp, Artificial Sequence
  chemically synthesized
taatgtgtttgagaaattga

SEQ ID NO: 6180 - DNA, 20 bp, Artificial Sequence
  chemically synthesized
attgtggacataatgtgttt

SEQ ID NO: 6181 - DNA, 20 bp, Artificial Sequence
  chemically synthesized
aaacacattatgtccacaat

SEQ ID NO: 6182 - DNA, 20 bp, Artificial Sequence
  chemically synthesized
cacattatgtccacaatcag

SEQ ID NO: 6183 - DNA, 20 bp, Artificial Sequence
  chemically synthesized
gatagtgaaacttctgattg

SEQ ID NO: 6184 - DNA, 20 bp, Artificial Sequence
  chemically synthesized
aggatttggttggaagaaga

SEQ ID NO: 6185 - DNA, 20 bp, Artificial Sequence
  chemically synthesized
ggagaggatttggttggaag

SEQ ID NO: 6186 - DNA, 20 bp, Artificial Sequence
  chemically synthesized
aagggagaggatttggttgg

SEQ ID NO: 6187 - DNA, 20 bp, Artificial Sequence
  chemically synthesized
atgaagggagaggatttggt

SEQ ID NO: 6188 - DNA, 20 bp, Artificial Sequence
  chemically synthesized
aggaatgaagggagaggatt

SEQ ID NO: 6189 - DNA, 20 bp, Artificial Sequence
  chemically synthesized
aagaagaggaatgaagggag

SEQ ID NO: 6190 - DNA, 20 bp, Artificial Sequence
  chemically synthesized
taagaagaggaatgaaggga

SEQ ID NO: 6191 - DNA, 20 bp, Artificial Sequence
  chemically synthesized
tgtaagaagaggaatgaagg

SEQ ID NO: 6192 - DNA, 20 bp, Artificial Sequence
  chemically synthesized
attgtaagaagaggaatgaa

SEQ ID NO: 6193 - DNA, 20 bp, Artificial Sequence
  chemically synthesized
aattgtaagaagaggaatga

SEQ ID NO: 6194 - DNA, 20 bp, Artificial Sequence
  chemically synthesized
aaattgtaagaagaggaatg

SEQ ID NO: 6195 - DNA, 20 bp, Artificial Sequence
  chemically synthesized
tgagtgcaaattgtaagaag

SEQ ID NO: 6196 - DNA, 20 bp, Artificial Sequence
  chemically synthesized
ctgagtgcaaattgtaagaa

SEQ ID NO: 6197 - DNA, 20 bp, Artificial Sequence
  chemically synthesized
gactgagtgcaaattgtaag

SEQ ID NO: 6198 - DNA, 20 bp, Artificial Sequence
  chemically synthesized
ggggactgagtgcaaattgt

SEQ ID NO: 6199 - DNA, 20 bp, Artificial Sequence
  chemically synthesized
ctcttcttacaatttgcact

SEQ ID NO: 6200 - DNA, 20 bp, Artificial Sequence
  chemically synthesized
tacaatttgcactcagtccc

SEQ ID NO: 6201 - DNA, 20 bp, Artificial Sequence
  chemically synthesized
gttcccagggtctggggact

SEQ ID NO: 6202 - DNA, 20 bp, Artificial Sequence
  chemically synthesized
tgcactcagtccccagaccc

SEQ ID NO: 6203 - DNA, 20 bp, Artificial Sequence
  chemically synthesized
aatagagttcccagggtctg

SEQ ID NO: 6204 - DNA, 20 bp, Artificial Sequence
  chemically synthesized
gcactcagtccccagaccct

SEQ ID NO: 6205 - DNA, 20 bp, Artificial Sequence
  chemically synthesized
aaatagagttcccagggtct

SEQ ID NO: 6206 - DNA, 20 bp, Artificial Sequence
  chemically synthesized
aaaatagagttcccagggtc

SEQ ID NO: 6207 - DNA, 20 bp, Artificial Sequence
  chemically synthesized
aaaaaaaaatagagttccca

SEQ ID NO: 6208 - DNA, 20 bp, Artificial Sequence
  chemically synthesized
aaaaaaaaaatagagttccc

SEQ ID NO: 6209 - DNA, 20 bp, Artificial Sequence
  chemically synthesized
aaaaaaaaaaatagagttcc

SEQ ID NO: 6210 - DNA, 20 bp, Artificial Sequence
  chemically synthesized
aaaaaaaaaaaaaaaaaata

SEQ ID NO: 6211 - DNA, 20 bp, Artificial Sequence
  chemically synthesized
tcaaaaaaaaaaaaaaaaaa

SEQ ID NO: 6212 - DNA, 20 bp, Artificial Sequence
  chemically synthesized
tatttttttttttttttttt

SEQ ID NO: 6213 - DNA, 20 bp, Artificial Sequence
  chemically synthesized
ttttttttttttttgagaca

SEQ ID NO: 6214 - DNA, 20 bp, Artificial Sequence
  chemically synthesized
tccagcctgggcgacagagc

SEQ ID NO: 6215 - DNA, 20 bp, Artificial Sequence
  chemically synthesized
cacagtcttgctctgtcgcc

SEQ ID NO: 6216 - DNA, 20 bp, Artificial Sequence
  chemically synthesized
gcactccagcctgggcgaca

SEQ ID NO: 6217 - DNA, 20 bp, Artificial Sequence
  chemically synthesized
acagtcttgctctgtcgccc

SEQ ID NO: 6218 - DNA, 20 bp, Artificial Sequence
  chemically synthesized
ttgcactccagcctgggcga

SEQ ID NO: 6219 - DNA, 20 bp, Artificial Sequence
  chemically synthesized
tcttgctctgtcgcccaggc

SEQ ID NO: 6220 - DNA, 20 bp, Artificial Sequence
  chemically synthesized
ttgctctgtcgcccaggctg

SEQ ID NO: 6221 - DNA, 20 bp, Artificial Sequence
  chemically synthesized
gcaccattgcactccagcct

SEQ ID NO: 6222 - DNA, 20 bp, Artificial Sequence
  chemically synthesized
ggcaccattgcactccagcc

SEQ ID NO: 6223 - DNA, 20 bp, Artificial Sequence
  chemically synthesized
aagatggcaccattgcactc

SEQ ID NO: 6224 - DNA, 20 bp, Artificial Sequence
  chemically synthesized
tcgcccaggctggagtgcaa

SEQ ID NO: 6225 - DNA, 20 bp, Artificial Sequence
  chemically synthesized
ggagtgcaatggtgccatct

SEQ ID NO: 6226 - DNA, 20 bp, Artificial Sequence
  chemically synthesized
gaggttgcagtgagccaaga

SEQ ID NO: 6227 - DNA, 20 bp, Artificial Sequence
  chemically synthesized
ggcggaggttgcagtgagcc

SEQ ID NO: 6228 - DNA, 20 bp, Artificial Sequence
  chemically synthesized
caggaggcggaggttgcagt

SEQ ID NO: 6229 - DNA, 20 bp, Artificial Sequence
  chemically synthesized
agcccaggaggcggaggttg

SEQ ID NO: 6230 - DNA, 20 bp, Artificial Sequence
  chemically synthesized
cgcttgagcccaggaggcgg

SEQ ID NO: 6231 - DNA, 20 bp, Artificial Sequence
  chemically synthesized
tcactgcaacctccgcctcc

SEQ ID NO: 6232 - DNA, 20 bp, Artificial Sequence
  chemically synthesized
tcgcttgagcccaggaggcg

SEQ ID NO: 6233 - DNA, 20 bp, Artificial Sequence
  chemically synthesized
cactgcaacctccgcctcct

SEQ ID NO: 6234 - DNA, 20 bp, Artificial Sequence
  chemically synthesized
aatcgcttgagcccaggagg

SEQ ID NO: 6235 - DNA, 20 bp, Artificial Sequence
  chemically synthesized
gagaatcgcttgagcccagg

SEQ ID NO: 6236 - DNA, 20 bp, Artificial Sequence
  chemically synthesized
ggagaatcgcttgagcccag

SEQ ID NO: 6237 - DNA, 20 bp, Artificial Sequence
  chemically synthesized
aacctccgcctcctgggctc

SEQ ID NO: 6238 - DNA, 20 bp, Artificial Sequence
  chemically synthesized
caggagaatcgcttgagccc

SEQ ID NO: 6239 - DNA, 20 bp, Artificial Sequence
  chemically synthesized
gcaggagaatcgcttgagcc

SEQ ID NO: 6240 - DNA, 20 bp, Artificial Sequence
  chemically synthesized
atgaggcaggagaatcgctt

SEQ ID NO: 6241 - DNA, 20 bp, Artificial Sequence
  chemically synthesized
tactcgggaggatgaggcag

SEQ ID NO: 6242 - DNA, 20 bp, Artificial Sequence
  chemically synthesized
gctactcgggaggatgaggc

SEQ ID NO: 6243 - DNA, 20 bp, Artificial Sequence
  chemically synthesized
agctactcgggaggatgagg

SEQ ID NO: 6244 - DNA, 20 bp, Artificial Sequence
  chemically synthesized
cccagctactcgggaggatg

SEQ ID NO: 6245 - DNA, 20 bp, Artificial Sequence
  chemically synthesized
tcccagctactcgggaggat

SEQ ID NO: 6246 - DNA, 20 bp, Artificial Sequence
  chemically synthesized
ttctcctgcctcatcctccc

SEQ ID NO: 6247 - DNA, 20 bp, Artificial Sequence
  chemically synthesized
tcctgcctcatcctcccgag

SEQ ID NO: 6248 - DNA, 20 bp, Artificial Sequence
  chemically synthesized
tatagtcccagctactcggg

SEQ ID NO: 6249 - DNA, 20 bp, Artificial Sequence
  chemically synthesized
ctatagtcccagctactcgg

SEQ ID NO: 6250 - DNA, 20 bp, Artificial Sequence
  chemically synthesized
gcctcatcctcccgagtagc

SEQ ID NO: 6251 - DNA, 20 bp, Artificial Sequence
  chemically synthesized
gcctatagtcccagctactc

SEQ ID NO: 6252 - DNA, 20 bp, Artificial Sequence
  chemically synthesized
cctcatcctcccgagtagct

SEQ ID NO: 6253 - DNA, 20 bp, Artificial Sequence
  chemically synthesized
cgcctatagtcccagctact

SEQ ID NO: 6254 - DNA, 20 bp, Artificial Sequence
  chemically synthesized
ctcccgagtagctgggacta

SEQ ID NO: 6255 - DNA, 20 bp, Artificial Sequence
  chemically synthesized
tcccgagtagctgggactat

SEQ ID NO: 6256 - DNA, 20 bp, Artificial Sequence
  chemically synthesized
gtggtgggcgcctatagtcc

SEQ ID NO: 6257 - DNA, 20 bp, Artificial Sequence
  chemically synthesized
ggcatggtggtgggcgccta

SEQ ID NO: 6258 - DNA, 20 bp, Artificial Sequence
  chemically synthesized
aattagccaggcatggtggt

SEQ ID NO: 6259 - DNA, 20 bp, Artificial Sequence
  chemically synthesized
aaattagccaggcatggtgg

SEQ ID NO: 6260 - DNA, 20 bp, Artificial Sequence
  chemically synthesized
taggcgcccaccaccatgcc

SEQ ID NO: 6261 - DNA, 20 bp, Artificial Sequence
  chemically synthesized
gaaaaattagccaggcatgg

SEQ ID NO: 6262 - DNA, 20 bp, Artificial Sequence
  chemically synthesized
atagaaaaattagccaggca

SEQ ID NO: 6263 - DNA, 20 bp, Artificial Sequence
  chemically synthesized
taaaaatagaaaaattagcc

SEQ ID NO: 6264 - DNA, 20 bp, Artificial Sequence
  chemically synthesized
ctaaaaatagaaaaattagc

SEQ ID NO: 6265 - DNA, 20 bp, Artificial Sequence
  chemically synthesized
tctactaaaaatagaaaaat

SEQ ID NO: 6266 - DNA, 20 bp, Artificial Sequence
  chemically synthesized
ctggctaatttttctatttt

SEQ ID NO: 6267 - DNA, 20 bp, Artificial Sequence
  chemically synthesized
gctaatttttctatttttag

SEQ ID NO: 6268 - DNA, 20 bp, Artificial Sequence
  chemically synthesized
aaccctgtctctactaaaaa

SEQ ID NO: 6269 - DNA, 20 bp, Artificial Sequence
  chemically synthesized
taatttttctatttttagta

SEQ ID NO: 6270 - DNA, 20 bp, Artificial Sequence
  chemically synthesized
ttttctatttttagtagaga

SEQ ID NO: 6271 - DNA, 20 bp, Artificial Sequence
  chemically synthesized
tttctatttttagtagagac

SEQ ID NO: 6272 - DNA, 20 bp, Artificial Sequence
  chemically synthesized
ttctatttttagtagagaca

SEQ ID NO: 6273 - DNA, 20 bp, Artificial Sequence
  chemically synthesized
gagacagggtttcaccatat

SEQ ID NO: 6274 - DNA, 20 bp, Artificial Sequence
  chemically synthesized
cagggtttcaccatattggc

SEQ ID NO: 6275 - DNA, 20 bp, Artificial Sequence
  chemically synthesized
gaagaccagcccggccaata

SEQ ID NO: 6276 - DNA, 20 bp, Artificial Sequence
  chemically synthesized
agggtttcaccatattggcc

SEQ ID NO: 6277 - DNA, 20 bp, Artificial Sequence
  chemically synthesized
tttcaccatattggccgggc

SEQ ID NO: 6278 - DNA, 20 bp, Artificial Sequence
  chemically synthesized
ttaggagttgaagaccagcc

SEQ ID NO: 6279 - DNA, 20 bp, Artificial Sequence
  chemically synthesized
caaggttaggagttgaagac

SEQ ID NO: 6280 - DNA, 20 bp, Artificial Sequence
  chemically synthesized
gatcacaaggttaggagttg

SEQ ID NO: 6281 - DNA, 20 bp, Artificial Sequence
  chemically synthesized
tgggcggatcacaaggttag

SEQ ID NO: 6282 - DNA, 20 bp, Artificial Sequence
  chemically synthesized
ggtgggcggatcacaaggtt

SEQ ID NO: 6283 - DNA, 20 bp, Artificial Sequence
  chemically synthesized
aggtgggcggatcacaaggt

SEQ ID NO: 6284 - DNA, 20 bp, Artificial Sequence
  chemically synthesized
ggtgaggtgggcggatcaca

SEQ ID NO: 6285 - DNA, 20 bp, Artificial Sequence
  chemically synthesized
gggtgaggtgggcggatcac

SEQ ID NO: 6286 - DNA, 20 bp, Artificial Sequence
  chemically synthesized
ctttgggagggtgaggtggg

SEQ ID NO: 6287 - DNA, 20 bp, Artificial Sequence
  chemically synthesized
gcactttgggagggtgaggt

SEQ ID NO: 6288 - DNA, 20 bp, Artificial Sequence
  chemically synthesized
agcactttgggagggtgagg

SEQ ID NO: 6289 - DNA, 20 bp, Artificial Sequence
  chemically synthesized
cccagcactttgggagggtg

SEQ ID NO: 6290 - DNA, 20 bp, Artificial Sequence
  chemically synthesized
tcccagcactttgggagggt

SEQ ID NO: 6291 - DNA, 20 bp, Artificial Sequence
  chemically synthesized
ccgcccacctcaccctccca

SEQ ID NO: 6292 - DNA, 20 bp, Artificial Sequence
  chemically synthesized
gtaatcccagcactttggga

SEQ ID NO: 6293 - DNA, 20 bp, Artificial Sequence
  chemically synthesized
tgtaatcccagcactttggg

SEQ ID NO: 6294 - DNA, 20 bp, Artificial Sequence
  chemically synthesized
ctgtaatcccagcactttgg

SEQ ID NO: 6295 - DNA, 20 bp, Artificial Sequence
  chemically synthesized
acctcaccctcccaaagtgc

SEQ ID NO: 6296 - DNA, 20 bp, Artificial Sequence
  chemically synthesized
gcctgtaatcccagcacttt

SEQ ID NO: 6297 - DNA, 20 bp, Artificial Sequence
  chemically synthesized
cctcaccctcccaaagtgct

SEQ ID NO: 6298 - DNA, 20 bp, Artificial Sequence
  chemically synthesized
cgcctgtaatcccagcactt

SEQ ID NO: 6299 - DNA, 20 bp, Artificial Sequence
  chemically synthesized
ctcccaaagtgctgggatta

SEQ ID NO: 6300 - DNA, 20 bp, Artificial Sequence
  chemically synthesized
tcccaaagtgctgggattac

SEQ ID NO: 6301 - DNA, 20 bp, Artificial Sequence
  chemically synthesized
gaggctcacgcctgtaatcc

SEQ ID NO: 6302 - DNA, 20 bp, Artificial Sequence
  chemically synthesized
agtgctgggattacaggcgt

SEQ ID NO: 6303 - DNA, 20 bp, Artificial Sequence
  chemically synthesized
caggcgtgagcctccacgcc

SEQ ID NO: 6304 - DNA, 20 bp, Artificial Sequence
  chemically synthesized
tgccagggggctgggcgtgg

SEQ ID NO: 6305 - DNA, 20 bp, Artificial Sequence
  chemically synthesized
ttgccagggggctgggcgtg

SEQ ID NO: 6306 - DNA, 20 bp, Artificial Sequence
  chemically synthesized
acttgccagggggctgggcg

SEQ ID NO: 6307 - DNA, 20 bp, Artificial Sequence
  chemically synthesized
agcctccacgcccagccccc

SEQ ID NO: 6308 - DNA, 20 bp, Artificial Sequence
  chemically synthesized
aatagacttgccagggggct

SEQ ID NO: 6309 - DNA, 20 bp, Artificial Sequence
  chemically synthesized
aaatagacttgccagggggc

SEQ ID NO: 6310 - DNA, 20 bp, Artificial Sequence
  chemically synthesized
tccacgcccagccccctggc

SEQ ID NO: 6311 - DNA, 20 bp, Artificial Sequence
  chemically synthesized
ataaaaatagacttgccagg

SEQ ID NO: 6312 - DNA, 20 bp, Artificial Sequence
  chemically synthesized
tataaaaatagacttgccag

SEQ ID NO: 6313 - DNA, 20 bp, Artificial Sequence
  chemically synthesized
ctataaaaatagacttgcca

SEQ ID NO: 6314 - DNA, 20 bp, Artificial Sequence
  chemically synthesized
tctataaaaatagacttgcc

SEQ ID NO: 6315 - DNA, 20 bp, Artificial Sequence
  chemically synthesized
ttctataaaaatagacttgc

SEQ ID NO: 6316 - DNA, 20 bp, Artificial Sequence
  chemically synthesized
ccctggcaagtctattttta

SEQ ID NO: 6317 - DNA, 20 bp, Artificial Sequence
  chemically synthesized
gtgagactattctataaaaa

SEQ ID NO: 6318 - DNA, 20 bp, Artificial Sequence
  chemically synthesized
gcaagtctatttttatagaa

SEQ ID NO: 6319 - DNA, 20 bp, Artificial Sequence
  chemically synthesized
atttttatagaatagtctca

SEQ ID NO: 6320 - DNA, 20 bp, Artificial Sequence
  chemically synthesized
atgtgggaggagaggactgt

SEQ ID NO: 6321 - DNA, 20 bp, Artificial Sequence
  chemically synthesized
cttgagagatgtgggaggag

SEQ ID NO: 6322 - DNA, 20 bp, Artificial Sequence
  chemically synthesized
acttgagagatgtgggagga

SEQ ID NO: 6323 - DNA, 20 bp, Artificial Sequence
  chemically synthesized
gcacttgagagatgtgggag

SEQ ID NO: 6324 - DNA, 20 bp, Artificial Sequence
  chemically synthesized
ctgcacttgagagatgtggg

SEQ ID NO: 6325 - DNA, 20 bp, Artificial Sequence
  chemically synthesized
cctgcacttgagagatgtgg

SEQ ID NO: 6326 - DNA, 20 bp, Artificial Sequence
  chemically synthesized
ggcctgcacttgagagatgt

SEQ ID NO: 6327 - DNA, 20 bp, Artificial Sequence
  chemically synthesized
gggcctgcacttgagagatg

SEQ ID NO: 6328 - DNA, 20 bp, Artificial Sequence
  chemically synthesized
cctctcctcccacatctctc

SEQ ID NO: 6329 - DNA, 20 bp, Artificial Sequence
  chemically synthesized
cctcccacatctctcaagtg

SEQ ID NO: 6330 - DNA, 20 bp, Artificial Sequence
  chemically synthesized
ttctgagggcctgcacttga

SEQ ID NO: 6331 - DNA, 20 bp, Artificial Sequence
  chemically synthesized
ctcccacatctctcaagtgc

SEQ ID NO: 6332 - DNA, 20 bp, Artificial Sequence
  chemically synthesized
agttctgagggcctgcactt

SEQ ID NO: 6333 - DNA, 20 bp, Artificial Sequence
  chemically synthesized
atctctcaagtgcaggccct

SEQ ID NO: 6334 - DNA, 20 bp, Artificial Sequence
  chemically synthesized
ccaagattggtgagttctga

SEQ ID NO: 6335 - DNA, 20 bp, Artificial Sequence
  chemically synthesized
gccaagattggtgagttctg

SEQ ID NO: 6336 - DNA, 20 bp, Artificial Sequence
  chemically synthesized
ggccaagattggtgagttct

SEQ ID NO: 6337 - DNA, 20 bp, Artificial Sequence
  chemically synthesized
ttgccaaggccaagattggt

SEQ ID NO: 6338 - DNA, 20 bp, Artificial Sequence
  chemically synthesized
ccctcagaactcaccaatct

SEQ ID NO: 6339 - DNA, 20 bp, Artificial Sequence
  chemically synthesized
gcaattgccaaggccaagat

SEQ ID NO: 6340 - DNA, 20 bp, Artificial Sequence
  chemically synthesized
gaactcaccaatcttggcct

SEQ ID NO: 6341 - DNA, 20 bp, Artificial Sequence
  chemically synthesized
aggaggcaattgccaaggcc

SEQ ID NO: 6342 - DNA, 20 bp, Artificial Sequence
  chemically synthesized
cagttaggaggcaattgcca

SEQ ID NO: 6343 - DNA, 20 bp, Artificial Sequence
  chemically synthesized
ccagttaggaggcaattgcc

SEQ ID NO: 6344 - DNA, 20 bp, Artificial Sequence
  chemically synthesized
cttggcaattgcctcctaac

SEQ ID NO: 6345 - DNA, 20 bp, Artificial Sequence
  chemically synthesized
aggtgagaagaccagttagg

SEQ ID NO: 6346 - DNA, 20 bp, Artificial Sequence
  chemically synthesized
taggtgagaagaccagttag

SEQ ID NO: 6347 - DNA, 20 bp, Artificial Sequence
  chemically synthesized
tataggtgagaagaccagtt

SEQ ID NO: 6348 - DNA, 20 bp, Artificial Sequence
  chemically synthesized
gtataggtgagaagaccagt

SEQ ID NO: 6349 - DNA, 20 bp, Artificial Sequence
  chemically synthesized
acttgtataggtgagaagac

SEQ ID NO: 6350 - DNA, 20 bp, Artificial Sequence
  chemically synthesized
agaaaacttgtataggtgag

SEQ ID NO: 6351 - DNA, 20 bp, Artificial Sequence
  chemically synthesized
cacagaaaacttgtataggt

SEQ ID NO: 6352 - DNA, 20 bp, Artificial Sequence
  chemically synthesized
actggtcttctcacctatac

SEQ ID NO: 6353 - DNA, 20 bp, Artificial Sequence
  chemically synthesized
ggcccacagaaaacttgtat

SEQ ID NO: 6354 - DNA, 20 bp, Artificial Sequence
  chemically synthesized
tggcccacagaaaacttgta

SEQ ID NO: 6355 - DNA, 20 bp, Artificial Sequence
  chemically synthesized
tcacctatacaagttttctg

SEQ ID NO: 6356 - DNA, 20 bp, Artificial Sequence
  chemically synthesized
cacctatacaagttttctgt

SEQ ID NO: 6357 - DNA, 20 bp, Artificial Sequence
  chemically synthesized
tatacaagttttctgtgggc

SEQ ID NO: 6358 - DNA, 20 bp, Artificial Sequence
  chemically synthesized
tggcagctctatctggccca

SEQ ID NO: 6359 - DNA, 20 bp, Artificial Sequence
  chemically synthesized
caagttttctgtgggccaga

SEQ ID NO: 6360 - DNA, 20 bp, Artificial Sequence
  chemically synthesized
agttttctgtgggccagata

SEQ ID NO: 6361 - DNA, 20 bp, Artificial Sequence
  chemically synthesized
tgtattctggcagctctatc

SEQ ID NO: 6362 - DNA, 20 bp, Artificial Sequence
  chemically synthesized
tgtgggccagatagagctgc

SEQ ID NO: 6363 - DNA, 20 bp, Artificial Sequence
  chemically synthesized
tctaaaaaggtgtattctgg

SEQ ID NO: 6364 - DNA, 20 bp, Artificial Sequence
  chemically synthesized
aattctaaaaaggtgtattc

SEQ ID NO: 6365 - DNA, 20 bp, Artificial Sequence
  chemically synthesized
gctgccagaatacacctttt

SEQ ID NO: 6366 - DNA, 20 bp, Artificial Sequence
  chemically synthesized
ctaaaaagaaaattctaaaa

SEQ ID NO: 6367 - DNA, 20 bp, Artificial Sequence
  chemically synthesized
tctaaaaagaaaattctaaa

SEQ ID NO: 6368 - DNA, 20 bp, Artificial Sequence
  chemically synthesized
cctttttagaattttctttt

SEQ ID NO: 6369 - DNA, 20 bp, Artificial Sequence
  chemically synthesized
ccaggcgaaaaaagtctaaa

SEQ ID NO: 6370 - DNA, 20 bp, Artificial Sequence
  chemically synthesized
aatcatataccaggcgaaaa

SEQ ID NO: 6371 - DNA, 20 bp, Artificial Sequence
  chemically synthesized
ctttttagacttttttcgcc

SEQ ID NO: 6372 - DNA, 20 bp, Artificial Sequence
  chemically synthesized
gccactgaaaatcatatacc

SEQ ID NO: 6373 - DNA, 20 bp, Artificial Sequence
  chemically synthesized
agccactgaaaatcatatac

SEQ ID NO: 6374 - DNA, 20 bp, Artificial Sequence
  chemically synthesized
ttcgcctggtatatgatttt

SEQ ID NO: 6375 - DNA, 20 bp, Artificial Sequence
  chemically synthesized
gcctggtatatgattttcag

SEQ ID NO: 6376 - DNA, 20 bp, Artificial Sequence
  chemically synthesized
tgactcatcttggtatcagg

SEQ ID NO: 6377 - DNA, 20 bp, Artificial Sequence
  chemically synthesized
ttcagtggctccctgatacc

SEQ ID NO: 6378 - DNA, 20 bp, Artificial Sequence
  chemically synthesized
tttgactcatcttggtatca

SEQ ID NO: 6379 - DNA, 20 bp, Artificial Sequence
  chemically synthesized
gtttgactcatcttggtatc

SEQ ID NO: 6380 - DNA, 20 bp, Artificial Sequence
  chemically synthesized
tgtttgactcatcttggtat

SEQ ID NO: 6381 - DNA, 20 bp, Artificial Sequence
  chemically synthesized
tggctccctgataccaagat

SEQ ID NO: 6382 - DNA, 20 bp, Artificial Sequence
  chemically synthesized
cgtaagtgtttgactcatct

SEQ ID NO: 6383 - DNA, 20 bp, Artificial Sequence
  chemically synthesized
caagatgagtcaaacactta

SEQ ID NO: 6384 - DNA, 20 bp, Artificial Sequence
  chemically synthesized
ggacatgaatatttggccgt

SEQ ID NO: 6385 - DNA, 20 bp, Artificial Sequence
  chemically synthesized
attacagggacatgaatatt

SEQ ID NO: 6386 - DNA, 20 bp, Artificial Sequence
  chemically synthesized
aaaggtagagtcgtattaca

SEQ ID NO: 6387 - DNA, 20 bp, Artificial Sequence
  chemically synthesized
gaaaggtagagtcgtattac

SEQ ID NO: 6388 - DNA, 20 bp, Artificial Sequence
  chemically synthesized
agaaaggtagagtcgtatta

SEQ ID NO: 6389 - DNA, 20 bp, Artificial Sequence
  chemically synthesized
ttgttgtctgaagaaaggta

SEQ ID NO: 6390 - DNA, 20 bp, Artificial Sequence
  chemically synthesized
ttttgttgtctgaagaaagg

SEQ ID NO: 6391 - DNA, 20 bp, Artificial Sequence
  chemically synthesized
aatacgactctacctttctt

SEQ ID NO: 6392 - DNA, 20 bp, Artificial Sequence
  chemically synthesized
agattttgttgtctgaagaa

SEQ ID NO: 6393 - DNA, 20 bp, Artificial Sequence
  chemically synthesized
cagattttgttgtctgaaga

SEQ ID NO: 6394 - DNA, 20 bp, Artificial Sequence
  chemically synthesized
ctctcagattttgttgtctg

SEQ ID NO: 6395 - DNA, 20 bp, Artificial Sequence
  chemically synthesized
ttcttcagacaacaaaatct

SEQ ID NO: 6396 - DNA, 20 bp, Artificial Sequence
  chemically synthesized
cttcagacaacaaaatctga

SEQ ID NO: 6397 - DNA, 20 bp, Artificial Sequence
  chemically synthesized
cagacaacaaaatctgagag

SEQ ID NO: 6398 - DNA, 20 bp, Artificial Sequence
  chemically synthesized
gtaagtgtcctagctactct

SEQ ID NO: 6399 - DNA, 20 bp, Artificial Sequence
  chemically synthesized
caacaaaatctgagagtagc

SEQ ID NO: 6400 - DNA, 20 bp, Artificial Sequence
  chemically synthesized
aacaaaatctgagagtagct

SEQ ID NO: 6401 - DNA, 20 bp, Artificial Sequence
  chemically synthesized
gactccatgggtaagtgtcc

SEQ ID NO: 6402 - DNA, 20 bp, Artificial Sequence
  chemically synthesized
gtagctaggacacttaccca

SEQ ID NO: 6403 - DNA, 20 bp, Artificial Sequence
  chemically synthesized
agctaggacacttacccatg

SEQ ID NO: 6404 - DNA, 20 bp, Artificial Sequence
  chemically synthesized
aaacttcggactccatgggt

SEQ ID NO: 6405 - DNA, 20 bp, Artificial Sequence
  chemically synthesized
agtcaaacttcggactccat

SEQ ID NO: 6406 - DNA, 20 bp, Artificial Sequence
  chemically synthesized
cagtcaaacttcggactcca

SEQ ID NO: 6407 - DNA, 20 bp, Artificial Sequence
  chemically synthesized
acacttacccatggagtccg

SEQ ID NO: 6408 - DNA, 20 bp, Artificial Sequence
  chemically synthesized
agtggttggcagtcaaactt

SEQ ID NO: 6409 - DNA, 20 bp, Artificial Sequence
  chemically synthesized
atgctgctccgagtggttgg

SEQ ID NO: 6410 - DNA, 20 bp, Artificial Sequence
  chemically synthesized
aagtttgactgccaaccact

SEQ ID NO: 6411 - DNA, 20 bp, Artificial Sequence
  chemically synthesized
cctatgctgctccgagtggt

SEQ ID NO: 6412 - DNA, 20 bp, Artificial Sequence
  chemically synthesized
gtttgactgccaaccactcg

SEQ ID NO: 6413 - DNA, 20 bp, Artificial Sequence
  chemically synthesized
tgactgccaaccactcggag

SEQ ID NO: 6414 - DNA, 20 bp, Artificial Sequence
  chemically synthesized
tcagcctatgctgctccgag

SEQ ID NO: 6415 - DNA, 20 bp, Artificial Sequence
  chemically synthesized
cagtcagcctatgctgctcc

SEQ ID NO: 6416 - DNA, 20 bp, Artificial Sequence
  chemically synthesized
gccaaccactcggagcagca

SEQ ID NO: 6417 - DNA, 20 bp, Artificial Sequence
  chemically synthesized
ccaaccactcggagcagcat

SEQ ID NO: 6418 - DNA, 20 bp, Artificial Sequence
  chemically synthesized
tacagaggtccgacagcagt

SEQ ID NO: 6419 - DNA, 20 bp, Artificial Sequence
  chemically synthesized
cagcataggctgactgctgt

SEQ ID NO: 6420 - DNA, 20 bp, Artificial Sequence
  chemically synthesized
tctctacagaggtccgacag

SEQ ID NO: 6421 - DNA, 20 bp, Artificial Sequence
  chemically synthesized
acctctctacagaggtccga

SEQ ID NO: 6422 - DNA, 20 bp, Artificial Sequence
  chemically synthesized
tgactgctgtcggacctctg

SEQ ID NO: 6423 - DNA, 20 bp, Artificial Sequence
  chemically synthesized
actgctgtcggacctctgta

SEQ ID NO: 6424 - DNA, 20 bp, Artificial Sequence
  chemically synthesized
tgctgtcggacctctgtaga

SEQ ID NO: 6425 - DNA, 20 bp, Artificial Sequence
  chemically synthesized
ctccttctacctctctacag

SEQ ID NO: 6426 - DNA, 20 bp, Artificial Sequence
  chemically synthesized
gctgtcggacctctgtagag

SEQ ID NO: 6427 - DNA, 20 bp, Artificial Sequence
  chemically synthesized
tctccttctacctctctaca

SEQ ID NO: 6428 - DNA, 20 bp, Artificial Sequence
  chemically synthesized
cctctccttctacctctcta

SEQ ID NO: 6429 - DNA, 20 bp, Artificial Sequence
  chemically synthesized
gtcggacctctgtagagagg

SEQ ID NO: 6430 - DNA, 20 bp, Artificial Sequence
  chemically synthesized
ggacctctgtagagaggtag

SEQ ID NO: 6431 - DNA, 20 bp, Artificial Sequence
  chemically synthesized
gacctctgtagagaggtaga

SEQ ID NO: 6432 - DNA, 20 bp, Artificial Sequence
  chemically synthesized
cctctgtagagaggtagaag

SEQ ID NO: 6433 - DNA, 20 bp, Artificial Sequence
  chemically synthesized
tctgtagagaggtagaagga

SEQ ID NO: 6434 - DNA, 20 bp, Artificial Sequence
  chemically synthesized
ctgtagagaggtagaaggag

SEQ ID NO: 6435 - DNA, 20 bp, Artificial Sequence
  chemically synthesized
ggccaaagtgaatggcacaa

SEQ ID NO: 6436 - DNA, 20 bp, Artificial Sequence
  chemically synthesized
caccgttgtgccattcactt

SEQ ID NO: 6437 - DNA, 20 bp, Artificial Sequence
  chemically synthesized
caggcagaggccaaagtgaa

SEQ ID NO: 6438 - DNA, 20 bp, Artificial Sequence
  chemically synthesized
ttagccccaggcagaggcca

SEQ ID NO: 6439 - DNA, 20 bp, Artificial Sequence
  chemically synthesized
cattcactttggcctctgcc

SEQ ID NO: 6440 - DNA, 20 bp, Artificial Sequence
  chemically synthesized
attcactttggcctctgcct

SEQ ID NO: 6441 - DNA, 20 bp, Artificial Sequence
  chemically synthesized
ttcactttggcctctgcctg

SEQ ID NO: 6442 - DNA, 20 bp, Artificial Sequence
  chemically synthesized
gatgacttagccccaggcag

SEQ ID NO: 6443 - DNA, 20 bp, Artificial Sequence
  chemically synthesized
ggatgacttagccccaggca

SEQ ID NO: 6444 - DNA, 20 bp, Artificial Sequence
  chemically synthesized
ttggatgacttagccccagg

SEQ ID NO: 6445 - DNA, 20 bp, Artificial Sequence
  chemically synthesized
tttggcctctgcctggggct

SEQ ID NO: 6446 - DNA, 20 bp, Artificial Sequence
  chemically synthesized
cttttggatgacttagcccc

SEQ ID NO: 6447 - DNA, 20 bp, Artificial Sequence
  chemically synthesized
tcttttggatgacttagccc

SEQ ID NO: 6448 - DNA, 20 bp, Artificial Sequence
  chemically synthesized
ctgttttcttttggatgact

SEQ ID NO: 6449 - DNA, 20 bp, Artificial Sequence
  chemically synthesized
cctggggctaagtcatccaa

SEQ ID NO: 6450 - DNA, 20 bp, Artificial Sequence
  chemically synthesized
aaagtaattctgttttcttt

SEQ ID NO: 6451 - DNA, 20 bp, Artificial Sequence
  chemically synthesized
ctaagtcatccaaaagaaaa

SEQ ID NO: 6452 - DNA, 20 bp, Artificial Sequence
  chemically synthesized
atttgtatgtttattatgaa

SEQ ID NO: 6453 - DNA, 20 bp, Artificial Sequence
  chemically synthesized
ttcaaaatatgatacacact

SEQ ID NO: 6454 - DNA, 20 bp, Artificial Sequence
  chemically synthesized
tcaaaatatgatacacactc

SEQ ID NO: 6455 - DNA, 20 bp, Artificial Sequence
  chemically synthesized
ggtcaaaatttatgagtcct

SEQ ID NO: 6456 - DNA, 20 bp, Artificial Sequence
  chemically synthesized
taggaagggtcaaaatttat

SEQ ID NO: 6457 - DNA, 20 bp, Artificial Sequence
  chemically synthesized
gagggcttctaaagtaggaa

SEQ ID NO: 6458 - DNA, 20 bp, Artificial Sequence
  chemically synthesized
ggagggcttctaaagtagga

SEQ ID NO: 6459 - DNA, 20 bp, Artificial Sequence
  chemically synthesized
aattttgacccttcctactt

SEQ ID NO: 6460 - DNA, 20 bp, Artificial Sequence
  chemically synthesized
gggagggcttctaaagtagg

SEQ ID NO: 6461 - DNA, 20 bp, Artificial Sequence
  chemically synthesized
tttgacccttcctactttag

SEQ ID NO: 6462 - DNA, 20 bp, Artificial Sequence
  chemically synthesized
tttgggagggcttctaaagt

SEQ ID NO: 6463 - DNA, 20 bp, Artificial Sequence
  chemically synthesized
ctttgggagggcttctaaag

SEQ ID NO: 6464 - DNA, 20 bp, Artificial Sequence
  chemically synthesized
aatctttgggagggcttcta

SEQ ID NO: 6465 - DNA, 20 bp, Artificial Sequence
  chemically synthesized
ctactttagaagccctccca

SEQ ID NO: 6466 - DNA, 20 bp, Artificial Sequence
  chemically synthesized
aaattaaacaatctttggga

SEQ ID NO: 6467 - DNA, 20 bp, Artificial Sequence
  chemically synthesized
caaattaaacaatctttggg

SEQ ID NO: 6468 - DNA, 20 bp, Artificial Sequence
  chemically synthesized
ccaaattaaacaatctttgg

SEQ ID NO: 6469 - DNA, 20 bp, Artificial Sequence
  chemically synthesized
tcccaaattaaacaatcttt

SEQ ID NO: 6470 - DNA, 20 bp, Artificial Sequence
  chemically synthesized
atcccaaattaaacaatctt

SEQ ID NO: 6471 - DNA, 20 bp, Artificial Sequence
  chemically synthesized
ctcccaaagattgtttaatt

SEQ ID NO: 6472 - DNA, 20 bp, Artificial Sequence
  chemically synthesized
tcccaaagattgtttaattt

SEQ ID NO: 6473 - DNA, 20 bp, Artificial Sequence
  chemically synthesized
gtttctatggattatatcaa

SEQ ID NO: 6474 - DNA, 20 bp, Artificial Sequence
  chemically synthesized
ttcactgttgatataatcca

SEQ ID NO: 6475 - DNA, 20 bp, Artificial Sequence
  chemically synthesized
agatacaaagacagtttcta

SEQ ID NO: 6476 - DNA, 20 bp, Artificial Sequence
  chemically synthesized
gcacaattcagatacaaaga

SEQ ID NO: 6477 - DNA, 20 bp, Artificial Sequence
  chemically synthesized
gggagcacaattcagataca

SEQ ID NO: 6478 - DNA, 20 bp, Artificial Sequence
  chemically synthesized
atttataagggagcacaatt

SEQ ID NO: 6479 - DNA, 20 bp, Artificial Sequence
  chemically synthesized
tttttctcaaatttataagg

SEQ ID NO: 6480 - DNA, 20 bp, Artificial Sequence
  chemically synthesized
tttttttctcaaatttataa

SEQ ID NO: 6481 - DNA, 20 bp, Artificial Sequence
  chemically synthesized
atttttttctcaaatttata

SEQ ID NO: 6482 - DNA, 20 bp, Artificial Sequence
  chemically synthesized
gatttttttctcaaatttat

SEQ ID NO: 6483 - DNA, 20 bp, Artificial Sequence
  chemically synthesized
ttgtgctcccttataaattt

SEQ ID NO: 6484 - DNA, 20 bp, Artificial Sequence
  chemically synthesized
tataaatttgagaaaaaaat

SEQ ID NO: 6485 - DNA, 20 bp, Artificial Sequence
  chemically synthesized
taaatttgagaaaaaaatca

SEQ ID NO: 6486 - DNA, 20 bp, Artificial Sequence
  chemically synthesized
gaaaaaaatcagagctacac

SEQ ID NO: 6487 - DNA, 20 bp, Artificial Sequence
  chemically synthesized
tgtatagtctcattccagtg

SEQ ID NO: 6488 - DNA, 20 bp, Artificial Sequence
  chemically synthesized
aatcagagctacactggaat

SEQ ID NO: 6489 - DNA, 20 bp, Artificial Sequence
  chemically synthesized
aatgatgtatagtctcattc

SEQ ID NO: 6490 - DNA, 20 bp, Artificial Sequence
  chemically synthesized
ttatttaatgtaatgatgta

SEQ ID NO: 6491 - DNA, 20 bp, Artificial Sequence
  chemically synthesized
acatcattacattaaataac

SEQ ID NO: 6492 - DNA, 20 bp, Artificial Sequence
  chemically synthesized
tcattacattaaataactgg

SEQ ID NO: 6493 - DNA, 20 bp, Artificial Sequence
  chemically synthesized
cattaaataactggaagatt

SEQ ID NO: 6494 - DNA, 20 bp, Artificial Sequence
  chemically synthesized
acatgaccttctaaatcttc

SEQ ID NO: 6495 - DNA, 20 bp, Artificial Sequence
  chemically synthesized
taaataactggaagatttag

SEQ ID NO: 6496 - DNA, 20 bp, Artificial Sequence
  chemically synthesized
aaataactggaagatttaga

SEQ ID NO: 6497 - DNA, 20 bp, Artificial Sequence
  chemically synthesized
gaaggtcatgtgtgaatgat

SEQ ID NO: 6498 - DNA, 20 bp, Artificial Sequence
  chemically synthesized
tgtgaatgatgagactatgt

SEQ ID NO: 6499 - DNA, 20 bp, Artificial Sequence
  chemically synthesized
tacagttttgagatctcaca

SEQ ID NO: 6500 - DNA, 20 bp, Artificial Sequence
  chemically synthesized
gaatcttccattacagtttt

SEQ ID NO: 6501 - DNA, 20 bp, Artificial Sequence
  chemically synthesized
gtgagatctcaaaactgtaa

SEQ ID NO: 6502 - DNA, 20 bp, Artificial Sequence
  chemically synthesized
agatctcaaaactgtaatgg

SEQ ID NO: 6503 - DNA, 20 bp, Artificial Sequence
  chemically synthesized
aagatatgaatcttccatta

SEQ ID NO: 6504 - DNA, 20 bp, Artificial Sequence
  chemically synthesized
ggaagattcatatctttgtg

SEQ ID NO: 6505 - DNA, 20 bp, Artificial Sequence
  chemically synthesized
ttgttacttaatacttcaca

SEQ ID NO: 6506 - DNA, 20 bp, Artificial Sequence
  chemically synthesized
tcatatctttgtgaagtatt

SEQ ID NO: 6507 - DNA, 20 bp, Artificial Sequence
  chemically synthesized
tttgtgaagtattaagtaac

SEQ ID NO: 6508 - DNA, 20 bp, Artificial Sequence
  chemically synthesized
tgaagtattaagtaacaaga

SEQ ID NO: 6509 - DNA, 20 bp, Artificial Sequence
  chemically synthesized
aagtattaagtaacaagata

SEQ ID NO: 6510 - DNA, 20 bp, Artificial Sequence
  chemically synthesized
gtattaagtaacaagataga

SEQ ID NO: 6511 - DNA, 20 bp, Artificial Sequence
  chemically synthesized
attgaaaaatttaaaattcc

SEQ ID NO: 6512 - DNA, 20 bp, Artificial Sequence
  chemically synthesized
aaaaatttaaaattcccaga

SEQ ID NO: 6513 - DNA, 20 bp, Artificial Sequence
  chemically synthesized
atttaaaattcccagaaagc

SEQ ID NO: 6514 - DNA, 20 bp, Artificial Sequence
  chemically synthesized
ggacatagttctggctttct

SEQ ID NO: 6515 - DNA, 20 bp, Artificial Sequence
  chemically synthesized
tggacatagttctggctttc

SEQ ID NO: 6516 - DNA, 20 bp, Artificial Sequence
  chemically synthesized
gacctacctggacatagttc

SEQ ID NO: 6517 - DNA, 20 bp, Artificial Sequence
  chemically synthesized
cagaaagccagaactatgtc

SEQ ID NO: 6518 - DNA, 20 bp, Artificial Sequence
  chemically synthesized
agaaagccagaactatgtcc

SEQ ID NO: 6519 - DNA, 20 bp, Artificial Sequence
  chemically synthesized
taagaggacctacctggaca

SEQ ID NO: 6520 - DNA, 20 bp, Artificial Sequence
  chemically synthesized
aagccagaactatgtccagg

SEQ ID NO: 6521 - DNA, 20 bp, Artificial Sequence
  chemically synthesized
agccagaactatgtccaggt

SEQ ID NO: 6522 - DNA, 20 bp, Artificial Sequence
  chemically synthesized
gcattgtaagaggacctacc

SEQ ID NO: 6523 - DNA, 20 bp, Artificial Sequence
  chemically synthesized
gcaagatactgcattgtaag

SEQ ID NO: 6524 - DNA, 20 bp, Artificial Sequence
  chemically synthesized
agcaagatactgcattgtaa

SEQ ID NO: 6525 - DNA, 20 bp, Artificial Sequence
  chemically synthesized
aggtaggtcctcttacaatg

SEQ ID NO: 6526 - DNA, 20 bp, Artificial Sequence
  chemically synthesized
ctagcaagatactgcattgt

SEQ ID NO: 6527 - DNA, 20 bp, Artificial Sequence
  chemically synthesized
cttacaatgcagtatcttgc

SEQ ID NO: 6528 - DNA, 20 bp, Artificial Sequence
  chemically synthesized
ttacaatgcagtatcttgct

SEQ ID NO: 6529 - DNA, 20 bp, Artificial Sequence
  chemically synthesized
gcctccatcgaaaacctagc

SEQ ID NO: 6530 - DNA, 20 bp, Artificial Sequence
  chemically synthesized
ttaagcctccatcgaaaacc

SEQ ID NO: 6531 - DNA, 20 bp, Artificial Sequence
  chemically synthesized
gtatcttgctaggttttcga

SEQ ID NO: 6532 - DNA, 20 bp, Artificial Sequence
  chemically synthesized
atcttgctaggttttcgatg

SEQ ID NO: 6533 - DNA, 20 bp, Artificial Sequence
  chemically synthesized
tcttgctaggttttcgatgg

SEQ ID NO: 6534 - DNA, 20 bp, Artificial Sequence
  chemically synthesized
aggttttcgatggaggctta

SEQ ID NO: 6535 - DNA, 20 bp, Artificial Sequence
  chemically synthesized
tccctaacacatagttcttt

SEQ ID NO: 6536 - DNA, 20 bp, Artificial Sequence
  chemically synthesized
aggcttaaagaactatgtgt

SEQ ID NO: 6537 - DNA, 20 bp, Artificial Sequence
  chemically synthesized
ggcttaaagaactatgtgtt

SEQ ID NO: 6538 - DNA, 20 bp, Artificial Sequence
  chemically synthesized
gcttaaagaactatgtgtta

SEQ ID NO: 6539 - DNA, 20 bp, Artificial Sequence
  chemically synthesized
ttctcctaatccctaacaca

SEQ ID NO: 6540 - DNA, 20 bp, Artificial Sequence
  chemically synthesized
aagaactatgtgttagggat

SEQ ID NO: 6541 - DNA, 20 bp, Artificial Sequence
  chemically synthesized
agaactatgtgttagggatt

SEQ ID NO: 6542 - DNA, 20 bp, Artificial Sequence
  chemically synthesized
aactatgtgttagggattag

SEQ ID NO: 6543 - DNA, 20 bp, Artificial Sequence
  chemically synthesized
attaggagaaaaaaaacaca

SEQ ID NO: 6544 - DNA, 20 bp, Artificial Sequence
  chemically synthesized
ttaggagaaaaaaaacacaa

SEQ ID NO: 6545 - DNA, 20 bp, Artificial Sequence
  chemically synthesized
aaaaaaacacaaaggtatac

SEQ ID NO: 6546 - DNA, 20 bp, Artificial Sequence
  chemically synthesized
ttacaattagttatattttc

SEQ ID NO: 6547 - DNA, 20 bp, Artificial Sequence
  chemically synthesized
ggaactatttcatttacaat

SEQ ID NO: 6548 - DNA, 20 bp, Artificial Sequence
  chemically synthesized
ataactaattgtaaatgaaa

SEQ ID NO: 6549 - DNA, 20 bp, Artificial Sequence
  chemically synthesized
aaatgaaatagttccatttc

SEQ ID NO: 6550 - DNA, 20 bp, Artificial Sequence
  chemically synthesized
tgaaatagttccatttcaag

SEQ ID NO: 6551 - DNA, 20 bp, Artificial Sequence
  chemically synthesized
gaatatttcacttcttgaaa

SEQ ID NO: 6552 - DNA, 20 bp, Artificial Sequence
  chemically synthesized
agaagtgaaatattcacttt

SEQ ID NO: 6553 - DNA, 20 bp, Artificial Sequence
  chemically synthesized
aagtgaaatattcactttta

SEQ ID NO: 6554 - DNA, 20 bp, Artificial Sequence
  chemically synthesized
ggtttccactagttctctaa

SEQ ID NO: 6555 - DNA, 20 bp, Artificial Sequence
  chemically synthesized
aatattcacttttagagaac

SEQ ID NO: 6556 - DNA, 20 bp, Artificial Sequence
  chemically synthesized
attcacttttagagaactag

SEQ ID NO: 6557 - DNA, 20 bp, Artificial Sequence
  chemically synthesized
aaacgcctaaaggtttccac

SEQ ID NO: 6558 - DNA, 20 bp, Artificial Sequence
  chemically synthesized
agagaactagtggaaacctt

SEQ ID NO: 6559 - DNA, 20 bp, Artificial Sequence
  chemically synthesized
gagaactagtggaaaccttt

SEQ ID NO: 6560 - DNA, 20 bp, Artificial Sequence
  chemically synthesized
ttggggaaaaaaacgcctaa

SEQ ID NO: 6561 - DNA, 20 bp, Artificial Sequence
  chemically synthesized
cttggggaaaaaaacgccta

SEQ ID NO: 6562 - DNA, 20 bp, Artificial Sequence
  chemically synthesized
ctttaggcgtttttttcccc

SEQ ID NO: 6563 - DNA, 20 bp, Artificial Sequence
  chemically synthesized
ccaatttgaaatacatcttg

SEQ ID NO: 6564 - DNA, 20 bp, Artificial Sequence
  chemically synthesized
accaatttgaaatacatctt

SEQ ID NO: 6565 - DNA, 20 bp, Artificial Sequence
  chemically synthesized
gaccaatttgaaatacatct

SEQ ID NO: 6566 - DNA, 20 bp, Artificial Sequence
  chemically synthesized
ccccaagatgtatttcaaat

SEQ ID NO: 6567 - DNA, 20 bp, Artificial Sequence
  chemically synthesized
agatgtatttcaaattggtc

SEQ ID NO: 6568 - DNA, 20 bp, Artificial Sequence
  chemically synthesized
tggtcaagaaaaaaccattt

SEQ ID NO: 6569 - DNA, 20 bp, Artificial Sequence
  chemically synthesized
tcaagaaaaaaccattttgg

SEQ ID NO: 6570 - DNA, 20 bp, Artificial Sequence
  chemically synthesized
caagaaaaaaccattttggt

SEQ ID NO: 6571 - DNA, 20 bp, Artificial Sequence
  chemically synthesized
aatattgtttcctaccaaaa

SEQ ID NO: 6572 - DNA, 20 bp, Artificial Sequence
  chemically synthesized
attttggtaggaaacaatat

SEQ ID NO: 6573 - DNA, 20 bp, Artificial Sequence
  chemically synthesized
aatattggacaaatacaaaa

SEQ ID NO: 6574 - DNA, 20 bp, Artificial Sequence
  chemically synthesized
caaatacaaaaaagacacac

SEQ ID NO: 6575 - DNA, 20 bp, Artificial Sequence
  chemically synthesized
agtagaggagatagaaaaac

SEQ ID NO: 6576 - DNA, 20 bp, Artificial Sequence
  chemically synthesized
aaggatagaagtagaggaga

SEQ ID NO: 6577 - DNA, 20 bp, Artificial Sequence
  chemically synthesized
atcaaaggatagaagtagag

SEQ ID NO: 6578 - DNA, 20 bp, Artificial Sequence
  chemically synthesized
gtatcaaaggatagaagtag

SEQ ID NO: 6579 - DNA, 20 bp, Artificial Sequence
  chemically synthesized
agtatcaaaggatagaagta

SEQ ID NO: 6580 - DNA, 20 bp, Artificial Sequence
  chemically synthesized
atagtatcaaaggatagaag

SEQ ID NO: 6581 - DNA, 20 bp, Artificial Sequence
  chemically synthesized
gtgatagtatcaaaggatag

SEQ ID NO: 6582 - DNA, 20 bp, Artificial Sequence
  chemically synthesized
aaagtgatagtatcaaagga

SEQ ID NO: 6583 - DNA, 20 bp, Artificial Sequence
  chemically synthesized
ctgcaaagtgatagtatcaa

SEQ ID NO: 6584 - DNA, 20 bp, Artificial Sequence
  chemically synthesized
cctgcaaagtgatagtatca

SEQ ID NO: 6585 - DNA, 20 bp, Artificial Sequence
  chemically synthesized
ggtatgtgcctgcaaagtga

SEQ ID NO: 6586 - DNA, 20 bp, Artificial Sequence
  chemically synthesized
cctttgatactatcactttg

SEQ ID NO: 6587 - DNA, 20 bp, Artificial Sequence
  chemically synthesized
ctttgatactatcactttgc

SEQ ID NO: 6588 - DNA, 20 bp, Artificial Sequence
  chemically synthesized
gtgcttggtatgtgcctgca

SEQ ID NO: 6589 - DNA, 20 bp, Artificial Sequence
  chemically synthesized
tcactttgcaggcacatacc

SEQ ID NO: 6590 - DNA, 20 bp, Artificial Sequence
  chemically synthesized
caggcacataccaagcactt

SEQ ID NO: 6591 - DNA, 20 bp, Artificial Sequence
  chemically synthesized
agcatcaattcttaagtgct

SEQ ID NO: 6592 - DNA, 20 bp, Artificial Sequence
  chemically synthesized
tgcaacaagcatcaattctt

SEQ ID NO: 6593 - DNA, 20 bp, Artificial Sequence
  chemically synthesized
gcactttttataggtgcaac

SEQ ID NO: 6594 - DNA, 20 bp, Artificial Sequence
  chemically synthesized
atgcttgttgcacctataaa

SEQ ID NO: 6595 - DNA, 20 bp, Artificial Sequence
  chemically synthesized
cctcagagagcactttttat

SEQ ID NO: 6596 - DNA, 20 bp, Artificial Sequence
  chemically synthesized
acctcagagagcacttttta

SEQ ID NO: 6597 - DNA, 20 bp, Artificial Sequence
  chemically synthesized
acctataaaaagtgctctct

SEQ ID NO: 6598 - DNA, 20 bp, Artificial Sequence
  chemically synthesized
cctataaaaagtgctctctg

SEQ ID NO: 6599 - DNA, 20 bp, Artificial Sequence
  chemically synthesized
aaacaaaactaaacctcaga

SEQ ID NO: 6600 - DNA, 20 bp, Artificial Sequence
  chemically synthesized
aaaaagtgctctctgaggtt

SEQ ID NO: 6601 - DNA, 20 bp, Artificial Sequence
  chemically synthesized
ttaaacaaaactaaacctca

SEQ ID NO: 6602 - DNA, 20 bp, Artificial Sequence
  chemically synthesized
tcttaaacaaaactaaacct

SEQ ID NO: 6603 - DNA, 20 bp, Artificial Sequence
  chemically synthesized
tctgaggtttagttttgttt

SEQ ID NO: 6604 - DNA, 20 bp, Artificial Sequence
  chemically synthesized
tgaggtttagttttgtttaa

SEQ ID NO: 6605 - DNA, 20 bp, Artificial Sequence
  chemically synthesized
gaggtttagttttgtttaag

SEQ ID NO: 6606 - DNA, 20 bp, Artificial Sequence
  chemically synthesized
aggtttagttttgtttaaga

SEQ ID NO: 6607 - DNA, 20 bp, Artificial Sequence
  chemically synthesized
gagcaagtgaggagagagat

SEQ ID NO: 6608 - DNA, 20 bp, Artificial Sequence
  chemically synthesized
ggagcaagtgaggagagaga

SEQ ID NO: 6609 - DNA, 20 bp, Artificial Sequence
  chemically synthesized
tgctggagcaagtgaggaga

SEQ ID NO: 6610 - DNA, 20 bp, Artificial Sequence
  chemically synthesized
gctgctggagcaagtgagga

SEQ ID NO: 6611 - DNA, 20 bp, Artificial Sequence
  chemically synthesized
cagctgctggagcaagtgag

SEQ ID NO: 6612 - DNA, 20 bp, Artificial Sequence
  chemically synthesized
ggcagctgctggagcaagtg

SEQ ID NO: 6613 - DNA, 20 bp, Artificial Sequence
  chemically synthesized
aggcagctgctggagcaagt

SEQ ID NO: 6614 - DNA, 20 bp, Artificial Sequence
  chemically synthesized
atctctctcctcacttgctc

SEQ ID NO: 6615 - DNA, 20 bp, Artificial Sequence
  chemically synthesized
tctctcctcacttgctccag

SEQ ID NO: 6616 - DNA, 20 bp, Artificial Sequence
  chemically synthesized
gctaaggcagctgctggagc

SEQ ID NO: 6617 - DNA, 20 bp, Artificial Sequence
  chemically synthesized
acaggctaaggcagctgctg

SEQ ID NO: 6618 - DNA, 20 bp, Artificial Sequence
  chemically synthesized
acacaggctaaggcagctgc

SEQ ID NO: 6619 - DNA, 20 bp, Artificial Sequence
  chemically synthesized
acttgctccagcagctgcct

SEQ ID NO: 6620 - DNA, 20 bp, Artificial Sequence
  chemically synthesized
cacagttacacaggctaagg

SEQ ID NO: 6621 - DNA, 20 bp, Artificial Sequence
  chemically synthesized
agtcacagttacacaggcta

SEQ ID NO: 6622 - DNA, 20 bp, Artificial Sequence
  chemically synthesized
gagtcacagttacacaggct

SEQ ID NO: 6623 - DNA, 20 bp, Artificial Sequence
  chemically synthesized
agctggagtcacagttacac

SEQ ID NO: 6624 - DNA, 20 bp, Artificial Sequence
  chemically synthesized
cagctggagtcacagttaca

SEQ ID NO: 6625 - DNA, 20 bp, Artificial Sequence
  chemically synthesized
agcctgtgtaactgtgactc

SEQ ID NO: 6626 - DNA, 20 bp, Artificial Sequence
  chemically synthesized
acaataaacagctggagtca

SEQ ID NO: 6627 - DNA, 20 bp, Artificial Sequence
  chemically synthesized
aagaccacaataaacagctg

SEQ ID NO: 6628 - DNA, 20 bp, Artificial Sequence
  chemically synthesized
ggaagaccacaataaacagc

SEQ ID NO: 6629 - DNA, 20 bp, Artificial Sequence
  chemically synthesized
gtgactccagctgtttattg

SEQ ID NO: 6630 - DNA, 20 bp, Artificial Sequence
  chemically synthesized
tcctggaagaccacaataaa

SEQ ID NO: 6631 - DNA, 20 bp, Artificial Sequence
  chemically synthesized
agctgtttattgtggtcttc

SEQ ID NO: 6632 - DNA, 20 bp, Artificial Sequence
  chemically synthesized
gctgtttattgtggtcttcc

SEQ ID NO: 6633 - DNA, 20 bp, Artificial Sequence
  chemically synthesized
agccaggatgcaaatcctgg

SEQ ID NO: 6634 - DNA, 20 bp, Artificial Sequence
  chemically synthesized
ggaagccaggatgcaaatcc

SEQ ID NO: 6635 - DNA, 20 bp, Artificial Sequence
  chemically synthesized
gtcttccaggatttgcatcc

SEQ ID NO: 6636 - DNA, 20 bp, Artificial Sequence
  chemically synthesized
aggatttgcatcctggcttc

SEQ ID NO: 6637 - DNA, 20 bp, Artificial Sequence
  chemically synthesized
ggatttgcatcctggcttcc

SEQ ID NO: 6638 - DNA, 20 bp, Artificial Sequence
  chemically synthesized
acaaaggccgcctggaagcc

SEQ ID NO: 6639 - DNA, 20 bp, Artificial Sequence
  chemically synthesized
cacaaaggccgcctggaagc

SEQ ID NO: 6640 - DNA, 20 bp, Artificial Sequence
  chemically synthesized
tttgcatcctggcttccagg

SEQ ID NO: 6641 - DNA, 20 bp, Artificial Sequence
  chemically synthesized
tcaacacaaaggccgcctgg

SEQ ID NO: 6642 - DNA, 20 bp, Artificial Sequence
  chemically synthesized
gcgtcaacacaaaggccgcc

SEQ ID NO: 6643 - DNA, 20 bp, Artificial Sequence
  chemically synthesized
aagctactgcgtcaacacaa

SEQ ID NO: 6644 - DNA, 20 bp, Artificial Sequence
  chemically synthesized
caagctactgcgtcaacaca

SEQ ID NO: 6645 - DNA, 20 bp, Artificial Sequence
  chemically synthesized
aggcggcctttgtgttgacg

SEQ ID NO: 6646 - DNA, 20 bp, Artificial Sequence
  chemically synthesized
cggcctttgtgttgacgcag

SEQ ID NO: 6647 - DNA, 20 bp, Artificial Sequence
  chemically synthesized
tttgtgttgacgcagtagct

SEQ ID NO: 6648 - DNA, 20 bp, Artificial Sequence
  chemically synthesized
ttgacgcagtagcttggcct

SEQ ID NO: 6649 - DNA, 20 bp, Artificial Sequence
  chemically synthesized
ctgagctcattgctgaggcc

SEQ ID NO: 6650 - DNA, 20 bp, Artificial Sequence
  chemically synthesized
agtagcttggcctcagcaat

SEQ ID NO: 6651 - DNA, 20 bp, Artificial Sequence
  chemically synthesized
ggatgctgagctcattgctg

SEQ ID NO: 6652 - DNA, 20 bp, Artificial Sequence
  chemically synthesized
gggatgctgagctcattgct

SEQ ID NO: 6653 - DNA, 20 bp, Artificial Sequence
  chemically synthesized
cttggcctcagcaatgagct

SEQ ID NO: 6654 - DNA, 20 bp, Artificial Sequence
  chemically synthesized
cagcaatgagctcagcatcc

SEQ ID NO: 6655 - DNA, 20 bp, Artificial Sequence
  chemically synthesized
cccagagtccccgggatgct

SEQ ID NO: 6656 - DNA, 20 bp, Artificial Sequence
  chemically synthesized
agcaatgagctcagcatccc

SEQ ID NO: 6657 - DNA, 20 bp, Artificial Sequence
  chemically synthesized
gcaatgagctcagcatcccg

SEQ ID NO: 6658 - DNA, 20 bp, Artificial Sequence
  chemically synthesized
cacctctccccagagtcccc

SEQ ID NO: 6659 - DNA, 20 bp, Artificial Sequence
  chemically synthesized
gctcagcatcccggggactc

SEQ ID NO: 6660 - DNA, 20 bp, Artificial Sequence
  chemically synthesized
ccacctctccccagagtccc

SEQ ID NO: 6661 - DNA, 20 bp, Artificial Sequence
  chemically synthesized
ctcagcatcccggggactct

SEQ ID NO: 6662 - DNA, 20 bp, Artificial Sequence
  chemically synthesized
tcagcatcccggggactctg

SEQ ID NO: 6663 - DNA, 20 bp, Artificial Sequence
  chemically synthesized
agcatcccggggactctggg

SEQ ID NO: 6664 - DNA, 20 bp, Artificial Sequence
  chemically synthesized
catcccggggactctgggga

SEQ ID NO: 6665 - DNA, 20 bp, Artificial Sequence
  chemically synthesized
atcccggggactctggggag

SEQ ID NO: 6666 - DNA, 20 bp, Artificial Sequence
  chemically synthesized
atgatgcccacctctcccca

SEQ ID NO: 6667 - DNA, 20 bp, Artificial Sequence
  chemically synthesized
aaatgatgcccacctctccc

SEQ ID NO: 6668 - DNA, 20 bp, Artificial Sequence
  chemically synthesized
ccggggactctggggagagg

SEQ ID NO: 6669 - DNA, 20 bp, Artificial Sequence
  chemically synthesized
cggggactctggggagaggt

SEQ ID NO: 6670 - DNA, 20 bp, Artificial Sequence
  chemically synthesized
gggagaggtgggcatcattt

SEQ ID NO: 6671 - DNA, 20 bp, Artificial Sequence
  chemically synthesized
ggagaggtgggcatcatttc

SEQ ID NO: 6672 - DNA, 20 bp, Artificial Sequence
  chemically synthesized
agaggtgggcatcatttcag

SEQ ID NO: 6673 - DNA, 20 bp, Artificial Sequence
  chemically synthesized
gaggtgggcatcatttcagg

SEQ ID NO: 6674 - DNA, 20 bp, Artificial Sequence
  chemically synthesized
aggtgggcatcatttcagga

SEQ ID NO: 6675 - DNA, 20 bp, Artificial Sequence
  chemically synthesized
ggtgggcatcatttcaggag

SEQ ID NO: 6676 - DNA, 20 bp, Artificial Sequence
  chemically synthesized
ggcatcatttcaggagggga

SEQ ID NO: 6677 - DNA, 20 bp, Artificial Sequence
  chemically synthesized
atcatttcaggaggggacgg

SEQ ID NO: 6678 - DNA, 20 bp, Artificial Sequence
  chemically synthesized
atttcaggaggggacggcag

SEQ ID NO: 6679 - DNA, 20 bp, Artificial Sequence
  chemically synthesized
tttcaggaggggacggcagt

SEQ ID NO: 6680 - DNA, 20 bp, Artificial Sequence
  chemically synthesized
ttcaggaggggacggcagtg

SEQ ID NO: 6681 - DNA, 20 bp, Artificial Sequence
  chemically synthesized
ggaggggacggcagtgggga

SEQ ID NO: 6682 - DNA, 20 bp, Artificial Sequence
  chemically synthesized
gaggggacggcagtggggac

SEQ ID NO: 6683 - DNA, 20 bp, Artificial Sequence
  chemically synthesized
aagcagcagcacgaacataa

SEQ ID NO: 6684 - DNA, 20 bp, Artificial Sequence
  chemically synthesized
aaagcagcagcacgaacata

SEQ ID NO: 6685 - DNA, 20 bp, Artificial Sequence
  chemically synthesized
ttatgttcgtgctgctgctt

SEQ ID NO: 6686 - DNA, 20 bp, Artificial Sequence
  chemically synthesized
aatatgaccgtctaaagcag

SEQ ID NO: 6687 - DNA, 20 bp, Artificial Sequence
  chemically synthesized
gttcgtgctgctgctttaga

SEQ ID NO: 6688 - DNA, 20 bp, Artificial Sequence
  chemically synthesized
cagaatatgaccgtctaaag

SEQ ID NO: 6689 - DNA, 20 bp, Artificial Sequence
  chemically synthesized
aagcagaatatgaccgtcta

SEQ ID NO: 6690 - DNA, 20 bp, Artificial Sequence
  chemically synthesized
agacggtcatattctgcttg

SEQ ID NO: 6691 - DNA, 20 bp, Artificial Sequence
  chemically synthesized
tgccaataggaatctgcaag

SEQ ID NO: 6692 - DNA, 20 bp, Artificial Sequence
  chemically synthesized
tgatgccaataggaatctgc

SEQ ID NO: 6693 - DNA, 20 bp, Artificial Sequence
  chemically synthesized
ttctgcttgcagattcctat

SEQ ID NO: 6694 - DNA, 20 bp, Artificial Sequence
  chemically synthesized
tttacttttttgatgccaat

SEQ ID NO: 6695 - DNA, 20 bp, Artificial Sequence
  chemically synthesized
ttttacttttttgatgccaa

SEQ ID NO: 6696 - DNA, 20 bp, Artificial Sequence
  chemically synthesized
gattcctattggcatcaaaa

SEQ ID NO: 6697 - DNA, 20 bp, Artificial Sequence
  chemically synthesized
ttggcatcaaaaaagtaaaa

SEQ ID NO: 6698 - DNA, 20 bp, Artificial Sequence
  chemically synthesized
aaaagtaaaaaagaaaaaaa

SEQ ID NO: 6699 - DNA, 20 bp, Artificial Sequence
  chemically synthesized
gtaaaaaagaaaaaaaaaga

SEQ ID NO: 6700 - DNA, 20 bp, Artificial Sequence
  chemically synthesized
aagaaaaaaaaagaaagaaa

SEQ ID NO: 6701 - DNA, 20 bp, Artificial Sequence
  chemically synthesized
aaaaaagaaagaaaaagaaa

SEQ ID NO: 6702 - DNA, 20 bp, Artificial Sequence
  chemically synthesized
aaagaaagaaaaagaaaaag

SEQ ID NO: 6703 - DNA, 20 bp, Artificial Sequence
  chemically synthesized
aaaaagaaaaagaagaaaaa

SEQ ID NO: 6704 - DNA, 20 bp, Artificial Sequence
  chemically synthesized
ctaccatggtatataaaatt

SEQ ID NO: 6705 - DNA, 20 bp, Artificial Sequence
  chemically synthesized
tcaccaaattttatatacca

SEQ ID NO: 6706 - DNA, 20 bp, Artificial Sequence
  chemically synthesized
ccaaattttatataccatgg

SEQ ID NO: 6707 - DNA, 20 bp, Artificial Sequence
  chemically synthesized
attttatataccatggtaga

SEQ ID NO: 6708 - DNA, 20 bp, Artificial Sequence
  chemically synthesized
tcagatgcatctatctacca

SEQ ID NO: 6709 - DNA, 20 bp, Artificial Sequence
  chemically synthesized
tgctgttcttcggtggcagt

SEQ ID NO: 6710 - DNA, 20 bp, Artificial Sequence
  chemically synthesized
gatgcatctgactgccaccg

SEQ ID NO: 6711 - DNA, 20 bp, Artificial Sequence
  chemically synthesized
tgcttgctgttcttcggtgg

SEQ ID NO: 6712 - DNA, 20 bp, Artificial Sequence
  chemically synthesized
ttttgcttgctgttcttcgg

SEQ ID NO: 6713 - DNA, 20 bp, Artificial Sequence
  chemically synthesized
atctgactgccaccgaagaa

SEQ ID NO: 6714 - DNA, 20 bp, Artificial Sequence
  chemically synthesized
ctcttttgcttgctgttctt

SEQ ID NO: 6715 - DNA, 20 bp, Artificial Sequence
  chemically synthesized
gactgccaccgaagaacagc

SEQ ID NO: 6716 - DNA, 20 bp, Artificial Sequence
  chemically synthesized
caccgaagaacagcaagcaa

SEQ ID NO: 6717 - DNA, 20 bp, Artificial Sequence
  chemically synthesized
ccgaagaacagcaagcaaaa

SEQ ID NO: 6718 - DNA, 20 bp, Artificial Sequence
  chemically synthesized
cgaagaacagcaagcaaaag

SEQ ID NO: 6719 - DNA, 20 bp, Artificial Sequence
  chemically synthesized
gcaaaagaggcactaatgaa

SEQ ID NO: 6720 - DNA, 20 bp, Artificial Sequence
  chemically synthesized
tcatcattaaaaccattcat

SEQ ID NO: 6721 - DNA, 20 bp, Artificial Sequence
  chemically synthesized
tttaatgatgacaatcttac

SEQ ID NO: 6722 - DNA, 20 bp, Artificial Sequence
  chemically synthesized
tttgttcttttagcactggt

SEQ ID NO: 6723 - DNA, 20 bp, Artificial Sequence
  chemically synthesized
gacaatcttaccagtgctaa

SEQ ID NO: 6724 - DNA, 20 bp, Artificial Sequence
  chemically synthesized
ttgttttgttcttttagcac

SEQ ID NO: 6725 - DNA, 20 bp, Artificial Sequence
  chemically synthesized
caaattttgttttgttcttt

SEQ ID NO: 6726 - DNA, 20 bp, Artificial Sequence
  chemically synthesized
aaagaacaaaacaaaatttg

SEQ ID NO: 6727 - DNA, 20 bp, Artificial Sequence
  chemically synthesized
caaaatttgaagcttttgcc

SEQ ID NO: 6728 - DNA, 20 bp, Artificial Sequence
  chemically synthesized
tcccttcacacaccaggcaa

SEQ ID NO: 6729 - DNA, 20 bp, Artificial Sequence
  chemically synthesized
catggctcccttcacacacc

SEQ ID NO: 6730 - DNA, 20 bp, Artificial Sequence
  chemically synthesized
aagcttttgcctggtgtgtg

SEQ ID NO: 6731 - DNA, 20 bp, Artificial Sequence
  chemically synthesized
gcatggctcccttcacacac

SEQ ID NO: 6732 - DNA, 20 bp, Artificial Sequence
  chemically synthesized
agcttttgcctggtgtgtga

SEQ ID NO: 6733 - DNA, 20 bp, Artificial Sequence
  chemically synthesized
gcttttgcctggtgtgtgaa

SEQ ID NO: 6734 - DNA, 20 bp, Artificial Sequence
  chemically synthesized
ttttgcctggtgtgtgaagg

SEQ ID NO: 6735 - DNA, 20 bp, Artificial Sequence
  chemically synthesized
acataaaaaattgaaaagca

SEQ ID NO: 6736 - DNA, 20 bp, Artificial Sequence
  chemically synthesized
gtgtaacataaaaaattgaa

SEQ ID NO: 6737 - DNA, 20 bp, Artificial Sequence
  chemically synthesized
aattttttatgttacactaa

SEQ ID NO: 6738 - DNA, 20 bp, Artificial Sequence
  chemically synthesized
cataccagtcgcgaggcttt

SEQ ID NO: 6739 - DNA, 20 bp, Artificial Sequence
  chemically synthesized
tacactaaaagcctcgcgac

SEQ ID NO: 6740 - DNA, 20 bp, Artificial Sequence
  chemically synthesized
atctgaacataccagtcgcg

SEQ ID NO: 6741 - DNA, 20 bp, Artificial Sequence
  chemically synthesized
tatctgaacataccagtcgc

SEQ ID NO: 6742 - DNA, 20 bp, Artificial Sequence
  chemically synthesized
agcctcgcgactggtatgtt

SEQ ID NO: 6743 - DNA, 20 bp, Artificial Sequence
  chemically synthesized
gcttacttatctgaacatac

SEQ ID NO: 6744 - DNA, 20 bp, Artificial Sequence
  chemically synthesized
cgcgactggtatgttcagat

SEQ ID NO: 6745 - DNA, 20 bp, Artificial Sequence
  chemically synthesized
actggtatgttcagataagt

SEQ ID NO: 6746 - DNA, 20 bp, Artificial Sequence
  chemically synthesized
ggtatgttcagataagtaag

SEQ ID NO: 6747 - DNA, 20 bp, Artificial Sequence
  chemically synthesized
gttcagataagtaagcagca

SEQ ID NO: 6748 - DNA, 20 bp, Artificial Sequence
  chemically synthesized
ttcagataagtaagcagcaa

SEQ ID NO: 6749 - DNA, 20 bp, Artificial Sequence
  chemically synthesized
attataaagaaatatttaca

SEQ ID NO: 6750 - DNA, 20 bp, Artificial Sequence
  chemically synthesized
tttaatctcatgacattata

SEQ ID NO: 6751 - DNA, 20 bp, Artificial Sequence
  chemically synthesized
atatttctttataatgtcat

SEQ ID NO: 6752 - DNA, 20 bp, Artificial Sequence
  chemically synthesized
gcaaaccaaagtgttgatag

SEQ ID NO: 6753 - DNA, 20 bp, Artificial Sequence
  chemically synthesized
agcaaaccaaagtgttgata

SEQ ID NO: 6754 - DNA, 20 bp, Artificial Sequence
  chemically synthesized
agagcaaaccaaagtgttga

SEQ ID NO: 6755 - DNA, 20 bp, Artificial Sequence
  chemically synthesized
ttatacctctatcaacactt

SEQ ID NO: 6756 - DNA, 20 bp, Artificial Sequence
  chemically synthesized
ctaatgtttagagcaaacca

SEQ ID NO: 6757 - DNA, 20 bp, Artificial Sequence
  chemically synthesized
ctttggtttgctctaaacat

SEQ ID NO: 6758 - DNA, 20 bp, Artificial Sequence
  chemically synthesized
aaaatatttgctaatgttta

SEQ ID NO: 6759 - DNA, 20 bp, Artificial Sequence
  chemically synthesized
tgaaaatatttgctaatgtt

SEQ ID NO: 6760 - DNA, 20 bp, Artificial Sequence
  chemically synthesized
acattagcaaatattttcaa

SEQ ID NO: 6761 - DNA, 20 bp, Artificial Sequence
  chemically synthesized
tattttcaacagaaatgtat

SEQ ID NO: 6762 - DNA, 20 bp, Artificial Sequence
  chemically synthesized
tcaacagaaatgtataagaa

SEQ ID NO: 6763 - DNA, 20 bp, Artificial Sequence
  chemically synthesized
aacagaaatgtataagaatg

SEQ ID NO: 6764 - DNA, 20 bp, Artificial Sequence
  chemically synthesized
gaaatgtataagaatggagt

SEQ ID NO: 6765 - DNA, 20 bp, Artificial Sequence
  chemically synthesized
aggggaggtgataggaacat

SEQ ID NO: 6766 - DNA, 20 bp, Artificial Sequence
  chemically synthesized
aaggggaggtgataggaaca

SEQ ID NO: 6767 - DNA, 20 bp, Artificial Sequence
  chemically synthesized
acttatcaaggggaggtgat

SEQ ID NO: 6768 - DNA, 20 bp, Artificial Sequence
  chemically synthesized
aacttatcaaggggaggtga

SEQ ID NO: 6769 - DNA, 20 bp, Artificial Sequence
  chemically synthesized
atgataaacttatcaagggg

SEQ ID NO: 6770 - DNA, 20 bp, Artificial Sequence
  chemically synthesized
aatgataaacttatcaaggg

SEQ ID NO: 6771 - DNA, 20 bp, Artificial Sequence
  chemically synthesized
tcctatcacctccccttgat

SEQ ID NO: 6772 - DNA, 20 bp, Artificial Sequence
  chemically synthesized
caaatgataaacttatcaag

SEQ ID NO: 6773 - DNA, 20 bp, Artificial Sequence
  chemically synthesized
gcaaatgataaacttatcaa

SEQ ID NO: 6774 - DNA, 20 bp, Artificial Sequence
  chemically synthesized
ggcaaatgataaacttatca

SEQ ID NO: 6775 - DNA, 20 bp, Artificial Sequence
  chemically synthesized
tggcaaatgataaacttatc

SEQ ID NO: 6776 - DNA, 20 bp, Artificial Sequence
  chemically synthesized
aaaaacttttgaagaaaata

SEQ ID NO: 6777 - DNA, 20 bp, Artificial Sequence
  chemically synthesized
atttgccatattttcttcaa

SEQ ID NO: 6778 - DNA, 20 bp, Artificial Sequence
  chemically synthesized
ctttcttcaaaaaacttttg

SEQ ID NO: 6779 - DNA, 20 bp, Artificial Sequence
  chemically synthesized
ttttcttcaaaagttttttg

SEQ ID NO: 6780 - DNA, 20 bp, Artificial Sequence
  chemically synthesized
cttcaaaagttttttgaaga

SEQ ID NO: 6781 - DNA, 20 bp, Artificial Sequence
  chemically synthesized
aaagttttttgaagaaagaa

SEQ ID NO: 6782 - DNA, 20 bp, Artificial Sequence
  chemically synthesized
tttgaagaaagaaaagttaa

SEQ ID NO: 6783 - DNA, 20 bp, Artificial Sequence
  chemically synthesized
gaaagaaaagttaacagcca

SEQ ID NO: 6784 - DNA, 20 bp, Artificial Sequence
  chemically synthesized
agaaaagttaacagccaaag

SEQ ID NO: 6785 - DNA, 20 bp, Artificial Sequence
  chemically synthesized
aaagttaacagccaaagcag

SEQ ID NO: 6786 - DNA, 20 bp, Artificial Sequence
  chemically synthesized
atgtgagggagcttctgctt

SEQ ID NO: 6787 - DNA, 20 bp, Artificial Sequence
  chemically synthesized
gttgaggcgggcatgtgagg

SEQ ID NO: 6788 - DNA, 20 bp, Artificial Sequence
  chemically synthesized
gtgttgaggcgggcatgtga

SEQ ID NO: 6789 - DNA, 20 bp, Artificial Sequence
  chemically synthesized
ggtgttgaggcgggcatgtg

SEQ ID NO: 6790 - DNA, 20 bp, Artificial Sequence
  chemically synthesized
tggtgttgaggcgggcatgt

SEQ ID NO: 6791 - DNA, 20 bp, Artificial Sequence
  chemically synthesized
gaatggtatggtgttgaggc

SEQ ID NO: 6792 - DNA, 20 bp, Artificial Sequence
  chemically synthesized
agaatggtatggtgttgagg

SEQ ID NO: 6793 - DNA, 20 bp, Artificial Sequence
  chemically synthesized
gagagaatggtatggtgttg

SEQ ID NO: 6794 - DNA, 20 bp, Artificial Sequence
  chemically synthesized
ggagagaatggtatggtgtt

SEQ ID NO: 6795 - DNA, 20 bp, Artificial Sequence
  chemically synthesized
gcggggaggagagaatggta

SEQ ID NO: 6796 - DNA, 20 bp, Artificial Sequence
  chemically synthesized
gggcagcggggaggagagaa

SEQ ID NO: 6797 - DNA, 20 bp, Artificial Sequence
  chemically synthesized
cttgagggcagcggggagga

SEQ ID NO: 6798 - DNA, 20 bp, Artificial Sequence
  chemically synthesized
tccttgagggcagcggggag

SEQ ID NO: 6799 - DNA, 20 bp, Artificial Sequence
  chemically synthesized
tctccttgagggcagcgggg

SEQ ID NO: 6800 - DNA, 20 bp, Artificial Sequence
  chemically synthesized
atctccttgagggcagcggg

SEQ ID NO: 6801 - DNA, 20 bp, Artificial Sequence
  chemically synthesized
ttatctccttgagggcagcg

SEQ ID NO: 6802 - DNA, 20 bp, Artificial Sequence
  chemically synthesized
attatctccttgagggcagc

SEQ ID NO: 6803 - DNA, 20 bp, Artificial Sequence
  chemically synthesized
cattatctccttgagggcag

SEQ ID NO: 6804 - DNA, 20 bp, Artificial Sequence
  chemically synthesized
ctctcctccccgctgccctc

SEQ ID NO: 6805 - DNA, 20 bp, Artificial Sequence
  chemically synthesized
tctcctccccgctgccctca

SEQ ID NO: 6806 - DNA, 20 bp, Artificial Sequence
  chemically synthesized
tggcattatctccttgaggg

SEQ ID NO: 6807 - DNA, 20 bp, Artificial Sequence
  chemically synthesized
tcctccccgctgccctcaag

SEQ ID NO: 6808 - DNA, 20 bp, Artificial Sequence
  chemically synthesized
gtgtggcattatctccttga

SEQ ID NO: 6809 - DNA, 20 bp, Artificial Sequence
  chemically synthesized
agtgtggcattatctccttg

SEQ ID NO: 6810 - DNA, 20 bp, Artificial Sequence
  chemically synthesized
cagtgtggcattatctcctt

SEQ ID NO: 6811 - DNA, 20 bp, Artificial Sequence
  chemically synthesized
actgggcatgaaattcagtg

SEQ ID NO: 6812 - DNA, 20 bp, Artificial Sequence
  chemically synthesized
gtaacactgggcatgaaatt

SEQ ID NO: 6813 - DNA, 20 bp, Artificial Sequence
  chemically synthesized
gccacactgaatttcatgcc

SEQ ID NO: 6814 - DNA, 20 bp, Artificial Sequence
  chemically synthesized
gatacattcatggtaacact

SEQ ID NO: 6815 - DNA, 20 bp, Artificial Sequence
  chemically synthesized
tgatacattcatggtaacac

SEQ ID NO: 6816 - DNA, 20 bp, Artificial Sequence
  chemically synthesized
agtatttgttgatacattca

SEQ ID NO: 6817 - DNA, 20 bp, Artificial Sequence
  chemically synthesized
atgaatgtatcaacaaatac

SEQ ID NO: 6818 - DNA, 20 bp, Artificial Sequence
  chemically synthesized
tgaatgtatcaacaaatact

SEQ ID NO: 6819 - DNA, 20 bp, Artificial Sequence
  chemically synthesized
gtatcaacaaatactaggtt

SEQ ID NO: 6820 - DNA, 20 bp, Artificial Sequence
  chemically synthesized
catcttttttaagctcaacc

SEQ ID NO: 6821 - DNA, 20 bp, Artificial Sequence
  chemically synthesized
atactaggttgagcttaaaa

SEQ ID NO: 6822 - DNA, 20 bp, Artificial Sequence
  chemically synthesized
caaacatcagcatctttttt

SEQ ID NO: 6823 - DNA, 20 bp, Artificial Sequence
  chemically synthesized
agaaaaatacaggcaaacat

SEQ ID NO: 6824 - DNA, 20 bp, Artificial Sequence
  chemically synthesized
tgtaggtgaaagaaaaatac

SEQ ID NO: 6825 - DNA, 20 bp, Artificial Sequence
  chemically synthesized
ttgtaggtgaaagaaaaata

SEQ ID NO: 6826 - DNA, 20 bp, Artificial Sequence
  chemically synthesized
atgggtgtttttgtaggtga

SEQ ID NO: 6827 - DNA, 20 bp, Artificial Sequence
  chemically synthesized
cataaaatgggtgtttttgt

SEQ ID NO: 6828 - DNA, 20 bp, Artificial Sequence
  chemically synthesized
acataaaatgggtgtttttg

SEQ ID NO: 6829 - DNA, 20 bp, Artificial Sequence
  chemically synthesized
tagattgaatcacataaaat

SEQ ID NO: 6830 - DNA, 20 bp, Artificial Sequence
  chemically synthesized
ttagattgaatcacataaaa

SEQ ID NO: 6831 - DNA, 20 bp, Artificial Sequence
  chemically synthesized
aacatgcaaaataatgttat

SEQ ID NO: 6832 - DNA, 20 bp, Artificial Sequence
  chemically synthesized
tgtttttaaactttaaattt

SEQ ID NO: 6833 - DNA, 20 bp, Artificial Sequence
  chemically synthesized
atgtgaagttcttaaattta

SEQ ID NO: 6834 - DNA, 20 bp, Artificial Sequence
  chemically synthesized
aatttaagaacttcacattt

SEQ ID NO: 6835 - DNA, 20 bp, Artificial Sequence
  chemically synthesized
tatgtatattcttaaatgtg

SEQ ID NO: 6836 - DNA, 20 bp, Artificial Sequence
  chemically synthesized
aagaatatacataccattct

SEQ ID NO: 6837 - DNA, 20 bp, Artificial Sequence
  chemically synthesized
gaatatacataccattctaa

SEQ ID NO: 6838 - DNA, 20 bp, Artificial Sequence
  chemically synthesized
gcaaaaagcaactcttagaa

SEQ ID NO: 6839 - DNA, 20 bp, Artificial Sequence
  chemically synthesized
tgaaggcaaaaagcaactct

SEQ ID NO: 6840 - DNA, 20 bp, Artificial Sequence
  chemically synthesized
aaaatggtgttgaaggcaaa

SEQ ID NO: 6841 - DNA, 20 bp, Artificial Sequence
  chemically synthesized
aatctccaaaatggtgttga

SEQ ID NO: 6842 - DNA, 20 bp, Artificial Sequence
  chemically synthesized
aaatctccaaaatggtgttg

SEQ ID NO: 6843 - DNA, 20 bp, Artificial Sequence
  chemically synthesized
ttttgccttcaacaccattt

SEQ ID NO: 6844 - DNA, 20 bp, Artificial Sequence
  chemically synthesized
ttgccttcaacaccattttg

SEQ ID NO: 6845 - DNA, 20 bp, Artificial Sequence
  chemically synthesized
acctggagaaatctccaaaa

SEQ ID NO: 6846 - DNA, 20 bp, Artificial Sequence
  chemically synthesized
caccattttggagatttctc

SEQ ID NO: 6847 - DNA, 20 bp, Artificial Sequence
  chemically synthesized
accattttggagatttctcc

SEQ ID NO: 6848 - DNA, 20 bp, Artificial Sequence
  chemically synthesized
aactattatgtatcgacctg

SEQ ID NO: 6849 - DNA, 20 bp, Artificial Sequence
  chemically synthesized
caaactattatgtatcgacc

SEQ ID NO: 6850 - DNA, 20 bp, Artificial Sequence
  chemically synthesized
ttctccaggtcgatacataa

SEQ ID NO: 6851 - DNA, 20 bp, Artificial Sequence
  chemically synthesized
ataccttatggcagttaaaa

SEQ ID NO: 6852 - DNA, 20 bp, Artificial Sequence
  chemically synthesized
tttgctattttaactgccat

SEQ ID NO: 6853 - DNA, 20 bp, Artificial Sequence
  chemically synthesized
ttgctattttaactgccata

SEQ ID NO: 6854 - DNA, 20 bp, Artificial Sequence
  chemically synthesized
agaataataataccttatgg

SEQ ID NO: 6855 - DNA, 20 bp, Artificial Sequence
  chemically synthesized
aacagaataataatacctta

SEQ ID NO: 6856 - DNA, 20 bp, Artificial Sequence
  chemically synthesized
atgttggcatattcaagcaa

SEQ ID NO: 6857 - DNA, 20 bp, Artificial Sequence
  chemically synthesized
aggaaaatgttggcatattc

SEQ ID NO: 6858 - DNA, 20 bp, Artificial Sequence
  chemically synthesized
gtccatggacaggaaaatgt

SEQ ID NO: 6859 - DNA, 20 bp, Artificial Sequence
  chemically synthesized
tgccaacattttcctgtcca

SEQ ID NO: 6860 - DNA, 20 bp, Artificial Sequence
  chemically synthesized
caacctaaatgtccatggac

SEQ ID NO: 6861 - DNA, 20 bp, Artificial Sequence
  chemically synthesized
acaacctaaatgtccatgga

SEQ ID NO: 6862 - DNA, 20 bp, Artificial Sequence
  chemically synthesized
ggaaacaacctaaatgtcca

SEQ ID NO: 6863 - DNA, 20 bp, Artificial Sequence
  chemically synthesized
ttttcctgtccatggacatt

SEQ ID NO: 6864 - DNA, 20 bp, Artificial Sequence
  chemically synthesized
tttcctgtccatggacattt

SEQ ID NO: 6865 - DNA, 20 bp, Artificial Sequence
  chemically synthesized
tgtttataatagtgaaaagt

SEQ ID NO: 6866 - DNA, 20 bp, Artificial Sequence
  chemically synthesized
tcattgtttataatagtgaa

SEQ ID NO: 6867 - DNA, 20 bp, Artificial Sequence
  chemically synthesized
cattgtatcattgtttataa

SEQ ID NO: 6868 - DNA, 20 bp, Artificial Sequence
  chemically synthesized
ccaaggagataggtataaaa

SEQ ID NO: 6869 - DNA, 20 bp, Artificial Sequence
  chemically synthesized
cttttttatacctatctcct

SEQ ID NO: 6870 - DNA, 20 bp, Artificial Sequence
  chemically synthesized
caacaggtatccaaggagat

SEQ ID NO: 6871 - DNA, 20 bp, Artificial Sequence
  chemically synthesized
tcaacaggtatccaaggaga

SEQ ID NO: 6872 - DNA, 20 bp, Artificial Sequence
  chemically synthesized
ctcttcaacaggtatccaag

SEQ ID NO: 6873 - DNA, 20 bp, Artificial Sequence
  chemically synthesized
atctcttcaacaggtatcca

SEQ ID NO: 6874 - DNA, 20 bp, Artificial Sequence
  chemically synthesized
aatctcttcaacaggtatcc

SEQ ID NO: 6875 - DNA, 20 bp, Artificial Sequence
  chemically synthesized
atctccttggatacctgttg

SEQ ID NO: 6876 - DNA, 20 bp, Artificial Sequence
  chemically synthesized
ctccttggatacctgttgaa

SEQ ID NO: 6877 - DNA, 20 bp, Artificial Sequence
  chemically synthesized
ctgtaaagaatctcttcaac

SEQ ID NO: 6878 - DNA, 20 bp, Artificial Sequence
  chemically synthesized
tctgtaaagaatctcttcaa

SEQ ID NO: 6879 - DNA, 20 bp, Artificial Sequence
  chemically synthesized
cctgttgaagagattcttta

SEQ ID NO: 6880 - DNA, 20 bp, Artificial Sequence
  chemically synthesized
acatcaaactatattctgta

SEQ ID NO: 6881 - DNA, 20 bp, Artificial Sequence
  chemically synthesized
aagagattctttacagaata

SEQ ID NO: 6882 - DNA, 20 bp, Artificial Sequence
  chemically synthesized
ttacagaatatagtttgatg

SEQ ID NO: 6883 - DNA, 20 bp, Artificial Sequence
  chemically synthesized
atagtttgatgtggaattgt

SEQ ID NO: 6884 - DNA, 20 bp, Artificial Sequence
  chemically synthesized
gatgtggaattgttggatct

SEQ ID NO: 6885 - DNA, 20 bp, Artificial Sequence
  chemically synthesized
gcaatgttgaagatgttgct

SEQ ID NO: 6886 - DNA, 20 bp, Artificial Sequence
  chemically synthesized
ggtgacatgtagcaatgttg

SEQ ID NO: 6887 - DNA, 20 bp, Artificial Sequence
  chemically synthesized
cagagcgattcggtgacatg

SEQ ID NO: 6888 - DNA, 20 bp, Artificial Sequence
  chemically synthesized
atttgtcacccagagcgatt

SEQ ID NO: 6889 - DNA, 20 bp, Artificial Sequence
  chemically synthesized
tacatgtcaccgaatcgctc

SEQ ID NO: 6890 - DNA, 20 bp, Artificial Sequence
  chemically synthesized
acatgtcaccgaatcgctct

SEQ ID NO: 6891 - DNA, 20 bp, Artificial Sequence
  chemically synthesized
aagcaccgatttgtcaccca

SEQ ID NO: 6892 - DNA, 20 bp, Artificial Sequence
  chemically synthesized
aaaagcaccgatttgtcacc

SEQ ID NO: 6893 - DNA, 20 bp, Artificial Sequence
  chemically synthesized
aatcgctctgggtgacaaat

SEQ ID NO: 6894 - DNA, 20 bp, Artificial Sequence
  chemically synthesized
aagcgagagtaaattggtaa

SEQ ID NO: 6895 - DNA, 20 bp, Artificial Sequence
  chemically synthesized
ctactgaagcgagagtaaat

SEQ ID NO: 6896 - DNA, 20 bp, Artificial Sequence
  chemically synthesized
ttaccaatttactctcgctt

SEQ ID NO: 6897 - DNA, 20 bp, Artificial Sequence
  chemically synthesized
ctcattcactactgaagcga

SEQ ID NO: 6898 - DNA, 20 bp, Artificial Sequence
  chemically synthesized
ccaatttactctcgcttcag

SEQ ID NO: 6899 - DNA, 20 bp, Artificial Sequence
  chemically synthesized
acctcattcactactgaagc

SEQ ID NO: 6900 - DNA, 20 bp, Artificial Sequence
  chemically synthesized
gaaaacctcattcactactg

SEQ ID NO: 6901 - DNA, 20 bp, Artificial Sequence
  chemically synthesized
ctctcgcttcagtagtgaat

SEQ ID NO: 6902 - DNA, 20 bp, Artificial Sequence
  chemically synthesized
tctcgcttcagtagtgaatg

SEQ ID NO: 6903 - DNA, 20 bp, Artificial Sequence
  chemically synthesized
agtgaatgaggttttccatt

SEQ ID NO: 6904 - DNA, 20 bp, Artificial Sequence
  chemically synthesized
tggtgaggaggtgggccaaa

SEQ ID NO: 6905 - DNA, 20 bp, Artificial Sequence
  chemically synthesized
caagtatttggtgaggaggt

SEQ ID NO: 6906 - DNA, 20 bp, Artificial Sequence
  chemically synthesized
ccaagtatttggtgaggagg

SEQ ID NO: 6907 - DNA, 20 bp, Artificial Sequence
  chemically synthesized
acaccaagtatttggtgagg

SEQ ID NO: 6908 - DNA, 20 bp, Artificial Sequence
  chemically synthesized
aacaccaagtatttggtgag

SEQ ID NO: 6909 - DNA, 20 bp, Artificial Sequence
  chemically synthesized
ataacaccaagtatttggtg

SEQ ID NO: 6910 - DNA, 20 bp, Artificial Sequence
  chemically synthesized
gataacaccaagtatttggt

SEQ ID NO: 6911 - DNA, 20 bp, Artificial Sequence
  chemically synthesized
ccacctcctcaccaaatact

SEQ ID NO: 6912 - DNA, 20 bp, Artificial Sequence
  chemically synthesized
gtctgataacaccaagtatt

SEQ ID NO: 6913 - DNA, 20 bp, Artificial Sequence
  chemically synthesized
cttgaatgtctgataacacc

SEQ ID NO: 6914 - DNA, 20 bp, Artificial Sequence
  chemically synthesized
caccaaatacttggtgttat

SEQ ID NO: 6915 - DNA, 20 bp, Artificial Sequence
  chemically synthesized
cttggtgttatcagacattc

SEQ ID NO: 6916 - DNA, 20 bp, Artificial Sequence
  chemically synthesized
gttatcagacattcaagttt

SEQ ID NO: 6917 - DNA, 20 bp, Artificial Sequence
  chemically synthesized
tcaagttttagttaacctga

SEQ ID NO: 6918 - DNA, 20 bp, Artificial Sequence
  chemically synthesized
caagttttagttaacctgat

SEQ ID NO: 6919 - DNA, 20 bp, Artificial Sequence
  chemically synthesized
caaattaaaatgcacccatc

SEQ ID NO: 6920 - DNA, 20 bp, Artificial Sequence
  chemically synthesized
gcaaattaaaatgcacccat

SEQ ID NO: 6921 - DNA, 20 bp, Artificial Sequence
  chemically synthesized
tttaatttgcacatacatcc

SEQ ID NO: 6922 - DNA, 20 bp, Artificial Sequence
  chemically synthesized
gcacatacatcccggattac

SEQ ID NO: 6923 - DNA, 20 bp, Artificial Sequence
  chemically synthesized
tctaaccttgccagtaatcc

SEQ ID NO: 6924 - DNA, 20 bp, Artificial Sequence
  chemically synthesized
gtctaaccttgccagtaatc

SEQ ID NO: 6925 - DNA, 20 bp, Artificial Sequence
  chemically synthesized
atacatcccggattactggc

SEQ ID NO: 6926 - DNA, 20 bp, Artificial Sequence
  chemically synthesized
tacatcccggattactggca

SEQ ID NO: 6927 - DNA, 20 bp, Artificial Sequence
  chemically synthesized
tcccggattactggcaaggt

SEQ ID NO: 6928 - DNA, 20 bp, Artificial Sequence
  chemically synthesized
tggaagaagtctaaccttgc

SEQ ID NO: 6929 - DNA, 20 bp, Artificial Sequence
  chemically synthesized
aaagccagttaacatggaag

SEQ ID NO: 6930 - DNA, 20 bp, Artificial Sequence
  chemically synthesized
tgaaaagccagttaacatgg

SEQ ID NO: 6931 - DNA, 20 bp, Artificial Sequence
  chemically synthesized
tagacttcttccatgttaac

SEQ ID NO: 6932 - DNA, 20 bp, Artificial Sequence
  chemically synthesized
gcatgaaaagccagttaaca

SEQ ID NO: 6933 - DNA, 20 bp, Artificial Sequence
  chemically synthesized
gtaaaggaagcatgaaaagc

SEQ ID NO: 6934 - DNA, 20 bp, Artificial Sequence
  chemically synthesized
atgggtaaaggaagcatgaa

SEQ ID NO: 6935 - DNA, 20 bp, Artificial Sequence
  chemically synthesized
agcaggaaaatgggtaaagg

SEQ ID NO: 6936 - DNA, 20 bp, Artificial Sequence
  chemically synthesized
tccagcaggaaaatgggtaa

SEQ ID NO: 6937 - DNA, 20 bp, Artificial Sequence
  chemically synthesized
atccagcaggaaaatgggta

SEQ ID NO: 6938 - DNA, 20 bp, Artificial Sequence
  chemically synthesized
agacaatccagcaggaaaat

SEQ ID NO: 6939 - DNA, 20 bp, Artificial Sequence
  chemically synthesized
aagacaatccagcaggaaaa

SEQ ID NO: 6940 - DNA, 20 bp, Artificial Sequence
  chemically synthesized
tcctttacccattttcctgc

SEQ ID NO: 6941 - DNA, 20 bp, Artificial Sequence
  chemically synthesized
aaagaaaaagacaatccagc

SEQ ID NO: 6942 - DNA, 20 bp, Artificial Sequence
  chemically synthesized
aaaagaaaaagacaatccag

SEQ ID NO: 6943 - DNA, 20 bp, Artificial Sequence
  chemically synthesized
ttaaaaagaaaaagacaatc

SEQ ID NO: 6944 - DNA, 20 bp, Artificial Sequence
  chemically synthesized
tccaaaggtttaaaaagaaa

SEQ ID NO: 6945 - DNA, 20 bp, Artificial Sequence
  chemically synthesized
aacatatccaaaggtttaaa

SEQ ID NO: 6946 - DNA, 20 bp, Artificial Sequence
  chemically synthesized
tctttttctttttaaacctt

SEQ ID NO: 6947 - DNA, 20 bp, Artificial Sequence
  chemically synthesized
agcatctagaacatatccaa

SEQ ID NO: 6948 - DNA, 20 bp, Artificial Sequence
  chemically synthesized
tagcatctagaacatatcca

SEQ ID NO: 6949 - DNA, 20 bp, Artificial Sequence
  chemically synthesized
ttaaacctttggatatgttc

SEQ ID NO: 6950 - DNA, 20 bp, Artificial Sequence
  chemically synthesized
actaacaatggattagcatc

SEQ ID NO: 6951 - DNA, 20 bp, Artificial Sequence
  chemically synthesized
gcacataactaacaatggat

SEQ ID NO: 6952 - DNA, 20 bp, Artificial Sequence
  chemically synthesized
tctagatgctaatccattgt

SEQ ID NO: 6953 - DNA, 20 bp, Artificial Sequence
  chemically synthesized
gccatgcacataactaacaa

SEQ ID NO: 6954 - DNA, 20 bp, Artificial Sequence
  chemically synthesized
tccattgttagttatgtgca

SEQ ID NO: 6955 - DNA, 20 bp, Artificial Sequence
  chemically synthesized
ctacactaagataagggtag

SEQ ID NO: 6956 - DNA, 20 bp, Artificial Sequence
  chemically synthesized
aagctacactaagataaggg

SEQ ID NO: 6957 - DNA, 20 bp, Artificial Sequence
  chemically synthesized
atgatcttctacccttatct

SEQ ID NO: 6958 - DNA, 20 bp, Artificial Sequence
  chemically synthesized
gataagctacactaagataa

SEQ ID NO: 6959 - DNA, 20 bp, Artificial Sequence
  chemically synthesized
agataagctacactaagata

SEQ ID NO: 6960 - DNA, 20 bp, Artificial Sequence
  chemically synthesized
aagataagctacactaagat

SEQ ID NO: 6961 - DNA, 20 bp, Artificial Sequence
  chemically synthesized
cttctacccttatcttagtg

SEQ ID NO: 6962 - DNA, 20 bp, Artificial Sequence
  chemically synthesized
agttaaagataagctacact

SEQ ID NO: 6963 - DNA, 20 bp, Artificial Sequence
  chemically synthesized
ccataagcaaagttaaagat

SEQ ID NO: 6964 - DNA, 20 bp, Artificial Sequence
  chemically synthesized
ggatgccataagcaaagtta

SEQ ID NO: 6965 - DNA, 20 bp, Artificial Sequence
  chemically synthesized
cttatctttaactttgctta

SEQ ID NO: 6966 - DNA, 20 bp, Artificial Sequence
  chemically synthesized
accataggatgccataagca

SEQ ID NO: 6967 - DNA, 20 bp, Artificial Sequence
  chemically synthesized
tttataccataggatgccat

SEQ ID NO: 6968 - DNA, 20 bp, Artificial Sequence
  chemically synthesized
actttgcttatggcatccta

SEQ ID NO: 6969 - DNA, 20 bp, Artificial Sequence
  chemically synthesized
atttacatcttttataccat

SEQ ID NO: 6970 - DNA, 20 bp, Artificial Sequence
  chemically synthesized
aatttacatcttttatacca

SEQ ID NO: 6971 - DNA, 20 bp, Artificial Sequence
  chemically synthesized
tatggcatcctatggtataa

SEQ ID NO: 6972 - DNA, 20 bp, Artificial Sequence
  chemically synthesized
taaaaagcagagaacataca

SEQ ID NO: 6973 - DNA, 20 bp, Artificial Sequence
  chemically synthesized
ataaaaagcagagaacatac

SEQ ID NO: 6974 - DNA, 20 bp, Artificial Sequence
  chemically synthesized
cataaaaagcagagaacata

SEQ ID NO: 6975 - DNA, 20 bp, Artificial Sequence
  chemically synthesized
tgaacaaaacataaaaagca

SEQ ID NO: 6976 - DNA, 20 bp, Artificial Sequence
  chemically synthesized
cgtgaacaaaacataaaaag

SEQ ID NO: 6977 - DNA, 20 bp, Artificial Sequence
  chemically synthesized
tttcgtgaacaaaacataaa

SEQ ID NO: 6978 - DNA, 20 bp, Artificial Sequence
  chemically synthesized
ttaaaatgtaggtgtaagaa

SEQ ID NO: 6979 - DNA, 20 bp, Artificial Sequence
  chemically synthesized
aaactttaaaatgtaggtgt

SEQ ID NO: 6980 - DNA, 20 bp, Artificial Sequence
  chemically synthesized
aattttaaactttaaaatgt

SEQ ID NO: 6981 - DNA, 20 bp, Artificial Sequence
  chemically synthesized
tttcttacacctacatttta

SEQ ID NO: 6982 - DNA, 20 bp, Artificial Sequence
  chemically synthesized
aaattttaaactttaaaatg

SEQ ID NO: 6983 - DNA, 20 bp, Artificial Sequence
  chemically synthesized
acattttaaagtttaaaatt

SEQ ID NO: 6984 - DNA, 20 bp, Artificial Sequence
  chemically synthesized
aaaatttggtttttcacatt

SEQ ID NO: 6985 - DNA, 20 bp, Artificial Sequence
  chemically synthesized
aaatttggtttttcacattt

SEQ ID NO: 6986 - DNA, 20 bp, Artificial Sequence
  chemically synthesized
aatagattctgggtaaattc

SEQ ID NO: 6987 - DNA, 20 bp, Artificial Sequence
  chemically synthesized
atttaggacttgaatttacc

SEQ ID NO: 6988 - DNA, 20 bp, Artificial Sequence
  chemically synthesized
caagcacaaaaatagattct

SEQ ID NO: 6989 - DNA, 20 bp, Artificial Sequence
  chemically synthesized
gcaagcacaaaaatagattc

SEQ ID NO: 6990 - DNA, 20 bp, Artificial Sequence
  chemically synthesized
gttcacggcaagcacaaaaa

SEQ ID NO: 6991 - DNA, 20 bp, Artificial Sequence
  chemically synthesized
ttagatcgcatgttcacggc

SEQ ID NO: 6992 - DNA, 20 bp, Artificial Sequence
  chemically synthesized
aaaattagatcgcatgttca

SEQ ID NO: 6993 - DNA, 20 bp, Artificial Sequence
  chemically synthesized
ccatgggggaaaagtaaaat

SEQ ID NO: 6994 - DNA, 20 bp, Artificial Sequence
  chemically synthesized
atagtttatccatgggggaa

SEQ ID NO: 6995 - DNA, 20 bp, Artificial Sequence
  chemically synthesized
ctaattttacttttccccca

SEQ ID NO: 6996 - DNA, 20 bp, Artificial Sequence
  chemically synthesized
gcttcatagtttatccatgg

SEQ ID NO: 6997 - DNA, 20 bp, Artificial Sequence
  chemically synthesized
ggcttcatagtttatccatg

SEQ ID NO: 6998 - DNA, 20 bp, Artificial Sequence
  chemically synthesized
tggcttcatagtttatccat

SEQ ID NO: 6999 - DNA, 20 bp, Artificial Sequence
  chemically synthesized
ctggcttcatagtttatcca

SEQ ID NO: 7000 - DNA, 20 bp, Artificial Sequence
  chemically synthesized
tcccccatggataaactatg

SEQ ID NO: 7001 - DNA, 20 bp, Artificial Sequence
  chemically synthesized
ccatggataaactatgaagc

SEQ ID NO: 7002 - DNA, 20 bp, Artificial Sequence
  chemically synthesized
aatgaatgaggctggcttca

SEQ ID NO: 7003 - DNA, 20 bp, Artificial Sequence
  chemically synthesized
gaccatacaatgaatgaggc

SEQ ID NO: 7004 - DNA, 20 bp, Artificial Sequence
  chemically synthesized
gatggaccatacaatgaatg

SEQ ID NO: 7005 - DNA, 20 bp, Artificial Sequence
  chemically synthesized
agatggaccatacaatgaat

SEQ ID NO: 7006 - DNA, 20 bp, Artificial Sequence
  chemically synthesized
agccagcctcattcattgta

SEQ ID NO: 7007 - DNA, 20 bp, Artificial Sequence
  chemically synthesized
agagatcagtgggaaataga

SEQ ID NO: 7008 - DNA, 20 bp, Artificial Sequence
  chemically synthesized
cgttagagatcagtgggaaa

SEQ ID NO: 7009 - DNA, 20 bp, Artificial Sequence
  chemically synthesized
aagcatcgttagagatcagt

SEQ ID NO: 7010 - DNA, 20 bp, Artificial Sequence
  chemically synthesized
gaagcatcgttagagatcag

SEQ ID NO: 7011 - DNA, 20 bp, Artificial Sequence
  chemically synthesized
gcggaagcatcgttagagat

SEQ ID NO: 7012 - DNA, 20 bp, Artificial Sequence
  chemically synthesized
gttttgcggaagcatcgtta

SEQ ID NO: 7013 - DNA, 20 bp, Artificial Sequence
  chemically synthesized
atgttttgcggaagcatcgt

SEQ ID NO: 7014 - DNA, 20 bp, Artificial Sequence
  chemically synthesized
ggacacttgatgttttgcgg

SEQ ID NO: 7015 - DNA, 20 bp, Artificial Sequence
  chemically synthesized
tatggacacttgatgttttg

SEQ ID NO: 7016 - DNA, 20 bp, Artificial Sequence
  chemically synthesized
cgatgcttccgcaaaacatc

SEQ ID NO: 7017 - DNA, 20 bp, Artificial Sequence
  chemically synthesized
gaagcacacctgtatattta

SEQ ID NO: 7018 - DNA, 20 bp, Artificial Sequence
  chemically synthesized
atcaagtgtccataaatata

SEQ ID NO: 7019 - DNA, 20 bp, Artificial Sequence
  chemically synthesized
tcaagtgtccataaatatac

SEQ ID NO: 7020 - DNA, 20 bp, Artificial Sequence
  chemically synthesized
aaatatacaggtgtgcttct

SEQ ID NO: 7021 - DNA, 20 bp, Artificial Sequence
  chemically synthesized
gactagaatacagagctcag

SEQ ID NO: 7022 - DNA, 20 bp, Artificial Sequence
  chemically synthesized
acagactagaatacagagct

SEQ ID NO: 7023 - DNA, 20 bp, Artificial Sequence
  chemically synthesized
tgcttctgagctctgtattc

SEQ ID NO: 7024 - DNA, 20 bp, Artificial Sequence
  chemically synthesized
gaaccacagactagaataca

SEQ ID NO: 7025 - DNA, 20 bp, Artificial Sequence
  chemically synthesized
tagaaccacagactagaata

SEQ ID NO: 7026 - DNA, 20 bp, Artificial Sequence
  chemically synthesized
gagctctgtattctagtctg

SEQ ID NO: 7027 - DNA, 20 bp, Artificial Sequence
  chemically synthesized
atgcagatagaaccacagac

SEQ ID NO: 7028 - DNA, 20 bp, Artificial Sequence
  chemically synthesized
gggatatgcagatagaacca

SEQ ID NO: 7029 - DNA, 20 bp, Artificial Sequence
  chemically synthesized
atctaccagggatatgcaga

SEQ ID NO: 7030 - DNA, 20 bp, Artificial Sequence
  chemically synthesized
tgggatctaccagggatatg

SEQ ID NO: 7031 - DNA, 20 bp, Artificial Sequence
  chemically synthesized
tggttctatctgcatatccc

SEQ ID NO: 7032 - DNA, 20 bp, Artificial Sequence
  chemically synthesized
ttctatctgcatatccctgg

SEQ ID NO: 7033 - DNA, 20 bp, Artificial Sequence
  chemically synthesized
ctggagtgtgggatctacca

SEQ ID NO: 7034 - DNA, 20 bp, Artificial Sequence
  chemically synthesized
gctggagtgtgggatctacc

SEQ ID NO: 7035 - DNA, 20 bp, Artificial Sequence
  chemically synthesized
agctggagtgtgggatctac

SEQ ID NO: 7036 - DNA, 20 bp, Artificial Sequence
  chemically synthesized
ccctggtagatcccacactc

SEQ ID NO: 7037 - DNA, 20 bp, Artificial Sequence
  chemically synthesized
ttgatttaaagctggagtgt

SEQ ID NO: 7038 - DNA, 20 bp, Artificial Sequence
  chemically synthesized
attgatttaaagctggagtg

SEQ ID NO: 7039 - DNA, 20 bp, Artificial Sequence
  chemically synthesized
catcaattgatttaaagctg

SEQ ID NO: 7040 - DNA, 20 bp, Artificial Sequence
  chemically synthesized
gacatcaattgatttaaagc

SEQ ID NO: 7041 - DNA, 20 bp, Artificial Sequence
  chemically synthesized
atcagacatcaattgattta

SEQ ID NO: 7042 - DNA, 20 bp, Artificial Sequence
  chemically synthesized
ttaaatcaattgatgtctga

SEQ ID NO: 7043 - DNA, 20 bp, Artificial Sequence
  chemically synthesized
taaatcaattgatgtctgat

SEQ ID NO: 7044 - DNA, 20 bp, Artificial Sequence
  chemically synthesized
agtgggctgagaaggcctat

SEQ ID NO: 7045 - DNA, 20 bp, Artificial Sequence
  chemically synthesized
tgatgtctgataggccttct

SEQ ID NO: 7046 - DNA, 20 bp, Artificial Sequence
  chemically synthesized
aaaaacaaagtgggctgaga

SEQ ID NO: 7047 - DNA, 20 bp, Artificial Sequence
  chemically synthesized
gaaaaacaaagtgggctgag

SEQ ID NO: 7048 - DNA, 20 bp, Artificial Sequence
  chemically synthesized
gaggaaaaacaaagtgggct

SEQ ID NO: 7049 - DNA, 20 bp, Artificial Sequence
  chemically synthesized
attttgaggaaaaacaaagt

SEQ ID NO: 7050 - DNA, 20 bp, Artificial Sequence
  chemically synthesized
aattttgaggaaaaacaaag

SEQ ID NO: 7051 - DNA, 20 bp, Artificial Sequence
  chemically synthesized
gacaattttgaggaaaaaca

SEQ ID NO: 7052 - DNA, 20 bp, Artificial Sequence
  chemically synthesized
gaatagtcaagacaattttg

SEQ ID NO: 7053 - DNA, 20 bp, Artificial Sequence
  chemically synthesized
agaatagtcaagacaatttt

SEQ ID NO: 7054 - DNA, 20 bp, Artificial Sequence
  chemically synthesized
tcaaaggggtcagaatagtc

SEQ ID NO: 7055 - DNA, 20 bp, Artificial Sequence
  chemically synthesized
gaagatcaaaggggtcagaa

SEQ ID NO: 7056 - DNA, 20 bp, Artificial Sequence
  chemically synthesized
atggagaagatcaaaggggt

SEQ ID NO: 7057 - DNA, 20 bp, Artificial Sequence
  chemically synthesized
aatcatggagaagatcaaag

SEQ ID NO: 7058 - DNA, 20 bp, Artificial Sequence
  chemically synthesized
aaatcatggagaagatcaaa

SEQ ID NO: 7059 - DNA, 20 bp, Artificial Sequence
  chemically synthesized
aaaatcatggagaagatcaa

SEQ ID NO: 7060 - DNA, 20 bp, Artificial Sequence
  chemically synthesized
taaaatcatggagaagatca

SEQ ID NO: 7061 - DNA, 20 bp, Artificial Sequence
  chemically synthesized
caaacactaaaatcatggag

SEQ ID NO: 7062 - DNA, 20 bp, Artificial Sequence
  chemically synthesized
aaccaaacactaaaatcatg

SEQ ID NO: 7063 - DNA, 20 bp, Artificial Sequence
  chemically synthesized
tttgatcttctccatgattt

SEQ ID NO: 7064 - DNA, 20 bp, Artificial Sequence
  chemically synthesized
aaaaccaaacactaaaatca

SEQ ID NO: 7065 - DNA, 20 bp, Artificial Sequence
  chemically synthesized
ttctccatgattttagtgtt

SEQ ID NO: 7066 - DNA, 20 bp, Artificial Sequence
  chemically synthesized
aacaagcattttcataaaat

SEQ ID NO: 7067 - DNA, 20 bp, Artificial Sequence
  chemically synthesized
ttcaaactcaaaatttcaac

SEQ ID NO: 7068 - DNA, 20 bp, Artificial Sequence
  chemically synthesized
aaaatgcttgttgaaatttt

SEQ ID NO: 7069 - DNA, 20 bp, Artificial Sequence
  chemically synthesized
tttgaattacattgaattca

SEQ ID NO: 7070 - DNA, 20 bp, Artificial Sequence
  chemically synthesized
ttgaattacattgaattcat

SEQ ID NO: 7071 - DNA, 20 bp, Artificial Sequence
  chemically synthesized
attgaattcataggttaaac

SEQ ID NO: 7072 - DNA, 20 bp, Artificial Sequence
  chemically synthesized
ttgaattcataggttaaact

SEQ ID NO: 7073 - DNA, 20 bp, Artificial Sequence
  chemically synthesized
aattcataggttaaactggg

SEQ ID NO: 7074 - DNA, 20 bp, Artificial Sequence
  chemically synthesized
attatgaacttagttcttcc

SEQ ID NO: 7075 - DNA, 20 bp, Artificial Sequence
  chemically synthesized
aggttaaactgggaagaact

SEQ ID NO: 7076 - DNA, 20 bp, Artificial Sequence
  chemically synthesized
agactcaattattatgaact

SEQ ID NO: 7077 - DNA, 20 bp, Artificial Sequence
  chemically synthesized
gaactaagttcataataatt

SEQ ID NO: 7078 - DNA, 20 bp, Artificial Sequence
  chemically synthesized
ataattgagtcttcacatcc

SEQ ID NO: 7079 - DNA, 20 bp, Artificial Sequence
  chemically synthesized
tcactgcattcttggatgtg

SEQ ID NO: 7080 - DNA, 20 bp, Artificial Sequence
  chemically synthesized
agtcttcacatccaagaatg

SEQ ID NO: 7081 - DNA, 20 bp, Artificial Sequence
  chemically synthesized
aaggagcttcactgcattct

SEQ ID NO: 7082 - DNA, 20 bp, Artificial Sequence
  chemically synthesized
tcacatccaagaatgcagtg

SEQ ID NO: 7083 - DNA, 20 bp, Artificial Sequence
  chemically synthesized
atgagaccatagtaagtaag

SEQ ID NO: 7084 - DNA, 20 bp, Artificial Sequence
  chemically synthesized
aaatgagaccatagtaagta

SEQ ID NO: 7085 - DNA, 20 bp, Artificial Sequence
  chemically synthesized
aaaatgagaccatagtaagt

SEQ ID NO: 7086 - DNA, 20 bp, Artificial Sequence
  chemically synthesized
gtgaagctccttacttacta

SEQ ID NO: 7087 - DNA, 20 bp, Artificial Sequence
  chemically synthesized
acataaaatgagaccatagt

SEQ ID NO: 7088 - DNA, 20 bp, Artificial Sequence
  chemically synthesized
atggacataaaatgagacca

SEQ ID NO: 7089 - DNA, 20 bp, Artificial Sequence
  chemically synthesized
attattaatggacataaaat

SEQ ID NO: 7090 - DNA, 20 bp, Artificial Sequence
  chemically synthesized
aacaagtaaaacattattaa

SEQ ID NO: 7091 - DNA, 20 bp, Artificial Sequence
  chemically synthesized
agaggaaaaaaaagagtaac

SEQ ID NO: 7092 - DNA, 20 bp, Artificial Sequence
  chemically synthesized
taaagcaagaggaaaaaaaa

SEQ ID NO: 7093 - DNA, 20 bp, Artificial Sequence
  chemically synthesized
tgtaaagcaagaggaaaaaa

SEQ ID NO: 7094 - DNA, 20 bp, Artificial Sequence
  chemically synthesized
tattcaacctgtaaagcaag

SEQ ID NO: 7095 - DNA, 20 bp, Artificial Sequence
  chemically synthesized
ttattcaacctgtaaagcaa

SEQ ID NO: 7096 - DNA, 20 bp, Artificial Sequence
  chemically synthesized
ttttttttcctcttgcttta

SEQ ID NO: 7097 - DNA, 20 bp, Artificial Sequence
  chemically synthesized
tttttttcctcttgctttac

SEQ ID NO: 7098 - DNA, 20 bp, Artificial Sequence
  chemically synthesized
acttattcaacctgtaaagc

SEQ ID NO: 7099 - DNA, 20 bp, Artificial Sequence
  chemically synthesized
aatgacttattcaacctgta

SEQ ID NO: 7100 - DNA, 20 bp, Artificial Sequence
  chemically synthesized
tcttgctttacaggttgaat

SEQ ID NO: 7101 - DNA, 20 bp, Artificial Sequence
  chemically synthesized
ttatttttaatgaacacatt

SEQ ID NO: 7102 - DNA, 20 bp, Artificial Sequence
  chemically synthesized
tatttttaatgaacacattt

SEQ ID NO: 7103 - DNA, 20 bp, Artificial Sequence
  chemically synthesized
atttttaatgaacacattta

SEQ ID NO: 7104 - DNA, 20 bp, Artificial Sequence
  chemically synthesized
agggttatacatttcctcct

SEQ ID NO: 7105 - DNA, 20 bp, Artificial Sequence
  chemically synthesized
taattaaagtggtaccaagg

SEQ ID NO: 7106 - DNA, 20 bp, Artificial Sequence
  chemically synthesized
ataattaaagtggtaccaag

SEQ ID NO: 7107 - DNA, 20 bp, Artificial Sequence
  chemically synthesized
atataattaaagtggtacca

SEQ ID NO: 7108 - DNA, 20 bp, Artificial Sequence
  chemically synthesized
tatataattaaagtggtacc

SEQ ID NO: 7109 - DNA, 20 bp, Artificial Sequence
  chemically synthesized
cttttggtatataattaaag

SEQ ID NO: 7110 - DNA, 20 bp, Artificial Sequence
  chemically synthesized
aaacttttggtatataatta

SEQ ID NO: 7111 - DNA, 20 bp, Artificial Sequence
  chemically synthesized
ccactttaattatataccaa

SEQ ID NO: 7112 - DNA, 20 bp, Artificial Sequence
  chemically synthesized
gtgatgtatataaaaacttt

SEQ ID NO: 7113 - DNA, 20 bp, Artificial Sequence
  chemically synthesized
ataaggcactgaattgaatc

SEQ ID NO: 7114 - DNA, 20 bp, Artificial Sequence
  chemically synthesized
cataaggcactgaattgaat

SEQ ID NO: 7115 - DNA, 20 bp, Artificial Sequence
  chemically synthesized
atacatcacctgattcaatt

SEQ ID NO: 7116 - DNA, 20 bp, Artificial Sequence
  chemically synthesized
agtaagaattacaaaacata

SEQ ID NO: 7117 - DNA, 20 bp, Artificial Sequence
  chemically synthesized
cagtaagaattacaaaacat

SEQ ID NO: 7118 - DNA, 20 bp, Artificial Sequence
  chemically synthesized
aagttaaaagaaatcacagt

SEQ ID NO: 7119 - DNA, 20 bp, Artificial Sequence
  chemically synthesized
ggttaagttaaaagaaatca

SEQ ID NO: 7120 - DNA, 20 bp, Artificial Sequence
  chemically synthesized
atgactatgggttaagttaa

SEQ ID NO: 7121 - DNA, 20 bp, Artificial Sequence
  chemically synthesized
atttcttttaacttaaccca

SEQ ID NO: 7122 - DNA, 20 bp, Artificial Sequence
  chemically synthesized
ctcctaaatgactatgggtt

SEQ ID NO: 7123 - DNA, 20 bp, Artificial Sequence
  chemically synthesized
ctgtgctcctaaatgactat

SEQ ID NO: 7124 - DNA, 20 bp, Artificial Sequence
  chemically synthesized
actgtgctcctaaatgacta

SEQ ID NO: 7125 - DNA, 20 bp, Artificial Sequence
  chemically synthesized
taacttaacccatagtcatt

SEQ ID NO: 7126 - DNA, 20 bp, Artificial Sequence
  chemically synthesized
aacttaacccatagtcattt

SEQ ID NO: 7127 - DNA, 20 bp, Artificial Sequence
  chemically synthesized
cttaacccatagtcatttag

SEQ ID NO: 7128 - DNA, 20 bp, Artificial Sequence
  chemically synthesized
cccatagtcatttaggagca

SEQ ID NO: 7129 - DNA, 20 bp, Artificial Sequence
  chemically synthesized
atagtcatttaggagcacag

SEQ ID NO: 7130 - DNA, 20 bp, Artificial Sequence
  chemically synthesized
aatgcactaagaagtgaaaa

SEQ ID NO: 7131 - DNA, 20 bp, Artificial Sequence
  chemically synthesized
atatttccattttcacttct

SEQ ID NO: 7132 - DNA, 20 bp, Artificial Sequence
  chemically synthesized
taaattagaaatgcactaag

SEQ ID NO: 7133 - DNA, 20 bp, Artificial Sequence
  chemically synthesized
aattaaattagaaatgcact

SEQ ID NO: 7134 - DNA, 20 bp, Artificial Sequence
  chemically synthesized
tgattgaaacgcaattaaat

SEQ ID NO: 7135 - DNA, 20 bp, Artificial Sequence
  chemically synthesized
taatttaattgcgtttcaat

SEQ ID NO: 7136 - DNA, 20 bp, Artificial Sequence
  chemically synthesized
atttaattgcgtttcaatca

SEQ ID NO: 7137 - DNA, 20 bp, Artificial Sequence
  chemically synthesized
aaaggatcagtatcatacag

SEQ ID NO: 7138 - DNA, 20 bp, Artificial Sequence
  chemically synthesized
caaaggatcagtatcataca

SEQ ID NO: 7139 - DNA, 20 bp, Artificial Sequence
  chemically synthesized
tcaaaggatcagtatcatac

SEQ ID NO: 7140 - DNA, 20 bp, Artificial Sequence
  chemically synthesized
ttcaaaggatcagtatcata

SEQ ID NO: 7141 - DNA, 20 bp, Artificial Sequence
  chemically synthesized
attgctaaatttcaaaggat

SEQ ID NO: 7142 - DNA, 20 bp, Artificial Sequence
  chemically synthesized
gaagtattgctaaatttcaa

SEQ ID NO: 7143 - DNA, 20 bp, Artificial Sequence
  chemically synthesized
gatactgatcctttgaaatt

SEQ ID NO: 7144 - DNA, 20 bp, Artificial Sequence
  chemically synthesized
agaagtattgctaaatttca

SEQ ID NO: 7145 - DNA, 20 bp, Artificial Sequence
  chemically synthesized
gtgaactaggtcacaaaaag

SEQ ID NO: 7146 - DNA, 20 bp, Artificial Sequence
  chemically synthesized
actgtgaactaggtcacaaa

SEQ ID NO: 7147 - DNA, 20 bp, Artificial Sequence
  chemically synthesized
caatacttctttttgtgacc

SEQ ID NO: 7148 - DNA, 20 bp, Artificial Sequence
  chemically synthesized
tctttttgtgacctagttca

SEQ ID NO: 7149 - DNA, 20 bp, Artificial Sequence
  chemically synthesized
ttagaaagtgactgtgaact

SEQ ID NO: 7150 - DNA, 20 bp, Artificial Sequence
  chemically synthesized
tttagaaagtgactgtgaac

SEQ ID NO: 7151 - DNA, 20 bp, Artificial Sequence
  chemically synthesized
actcaatgaacatttttaga

SEQ ID NO: 7152 - DNA, 20 bp, Artificial Sequence
  chemically synthesized
aagtactcaatgaacatttt

SEQ ID NO: 7153 - DNA, 20 bp, Artificial Sequence
  chemically synthesized
actttctaaaaatgttcatt

SEQ ID NO: 7154 - DNA, 20 bp, Artificial Sequence
  chemically synthesized
ggaaaaatacacattatttc

SEQ ID NO: 7155 - DNA, 20 bp, Artificial Sequence
  chemically synthesized
aataatgtgtatttttccat

SEQ ID NO: 7156 - DNA, 20 bp, Artificial Sequence
  chemically synthesized
atgtgtatttttccattgga

SEQ ID NO: 7157 - DNA, 20 bp, Artificial Sequence
  chemically synthesized
tagagactccatctttccaa

SEQ ID NO: 7158 - DNA, 20 bp, Artificial Sequence
  chemically synthesized
gtatttttccattggaaaga

SEQ ID NO: 7159 - DNA, 20 bp, Artificial Sequence
  chemically synthesized
atttttccattggaaagatg

SEQ ID NO: 7160 - DNA, 20 bp, Artificial Sequence
  chemically synthesized
atcagcacactatgtattta

SEQ ID NO: 7161 - DNA, 20 bp, Artificial Sequence
  chemically synthesized
agatggagtctctaaataca

SEQ ID NO: 7162 - DNA, 20 bp, Artificial Sequence
  chemically synthesized
aaatcagcacactatgtatt

SEQ ID NO: 7163 - DNA, 20 bp, Artificial Sequence
  chemically synthesized
gacaattttaacaacaaaat

SEQ ID NO: 7164 - DNA, 20 bp, Artificial Sequence
  chemically synthesized
atcaaaaattaataaagata

SEQ ID NO: 7165 - DNA, 20 bp, Artificial Sequence
  chemically synthesized
caaataatcaaaaattaata

SEQ ID NO: 7166 - DNA, 20 bp, Artificial Sequence
  chemically synthesized
tattaatttttgattatttg

SEQ ID NO: 7167 - DNA, 20 bp, Artificial Sequence
  chemically synthesized
actcatctaacaaaaattga

SEQ ID NO: 7168 - DNA, 20 bp, Artificial Sequence
  chemically synthesized
ttgtagctatcaatttttgt

SEQ ID NO: 7169 - DNA, 20 bp, Artificial Sequence
  chemically synthesized
gctatcaatttttgttagat

SEQ ID NO: 7170 - DNA, 20 bp, Artificial Sequence
  chemically synthesized
atttttgttagatgagtgtt

SEQ ID NO: 7171 - DNA, 20 bp, Artificial Sequence
  chemically synthesized
tgagtgttgagatataatta

SEQ ID NO: 7172 - DNA, 20 bp, Artificial Sequence
  chemically synthesized
agatataattatggatttgt

SEQ ID NO: 7173 - DNA, 20 bp, Artificial Sequence
  chemically synthesized
aattatgatagaattaaaag

SEQ ID NO: 7174 - DNA, 20 bp, Artificial Sequence
  chemically synthesized
tgaattatgatagaattaaa

SEQ ID NO: 7175 - DNA, 20 bp, Artificial Sequence
  chemically synthesized
gtgaattatgatagaattaa

SEQ ID NO: 7176 - DNA, 20 bp, Artificial Sequence
  chemically synthesized
atatataaagtgaattatga

SEQ ID NO: 7177 - DNA, 20 bp, Artificial Sequence
  chemically synthesized
tataggtctagaaatatata

SEQ ID NO: 7178 - DNA, 20 bp, Artificial Sequence
  chemically synthesized
taattcactttatatatttc

SEQ ID NO: 7179 - DNA, 20 bp, Artificial Sequence
  chemically synthesized
tgcatctaactatataggtc

SEQ ID NO: 7180 - DNA, 20 bp, Artificial Sequence
  chemically synthesized
tatatatttctagacctata

SEQ ID NO: 7181 - DNA, 20 bp, Artificial Sequence
  chemically synthesized
tatttctagacctatatagt

SEQ ID NO: 7182 - DNA, 20 bp, Artificial Sequence
  chemically synthesized
ttctgtgcatctaactatat

SEQ ID NO: 7183 - DNA, 20 bp, Artificial Sequence
  chemically synthesized
cttctgtgcatctaactata

SEQ ID NO: 7184 - DNA, 20 bp, Artificial Sequence
  chemically synthesized
gacctatatagttagatgca

SEQ ID NO: 7185 - DNA, 20 bp, Artificial Sequence
  chemically synthesized
ctatatagttagatgcacag

SEQ ID NO: 7186 - DNA, 20 bp, Artificial Sequence
  chemically synthesized
gaaacagtgcaagaacaacg

SEQ ID NO: 7187 - DNA, 20 bp, Artificial Sequence
  chemically synthesized
agaaacagtgcaagaacaac

SEQ ID NO: 7188 - DNA, 20 bp, Artificial Sequence
  chemically synthesized
atactacctagaaacagtgc

SEQ ID NO: 7189 - DNA, 20 bp, Artificial Sequence
  chemically synthesized
cgttgttcttgcactgtttc

SEQ ID NO: 7190 - DNA, 20 bp, Artificial Sequence
  chemically synthesized
gttgttcttgcactgtttct

SEQ ID NO: 7191 - DNA, 20 bp, Artificial Sequence
  chemically synthesized
aaaagtatactacctagaaa

SEQ ID NO: 7192 - DNA, 20 bp, Artificial Sequence
  chemically synthesized
gttcttgcactgtttctagg

SEQ ID NO: 7193 - DNA, 20 bp, Artificial Sequence
  chemically synthesized
ggaagaaaaagtatactacc

SEQ ID NO: 7194 - DNA, 20 bp, Artificial Sequence
  chemically synthesized
tcaacattattaggaagaaa

SEQ ID NO: 7195 - DNA, 20 bp, Artificial Sequence
  chemically synthesized
tggcaatcaacattattagg

SEQ ID NO: 7196 - DNA, 20 bp, Artificial Sequence
  chemically synthesized
ttatggcaatcaacattatt

SEQ ID NO: 7197 - DNA, 20 bp, Artificial Sequence
  chemically synthesized
tttatggcaatcaacattat

SEQ ID NO: 7198 - DNA, 20 bp, Artificial Sequence
  chemically synthesized
tttaaatggaataaaattta

SEQ ID NO: 7199 - DNA, 20 bp, Artificial Sequence
  chemically synthesized
cataaattttattccattta

SEQ ID NO: 7200 - DNA, 20 bp, Artificial Sequence
  chemically synthesized
ataaattttattccatttaa

SEQ ID NO: 7201 - DNA, 20 bp, Artificial Sequence
  chemically synthesized
taaccatagaaacctttaaa

SEQ ID NO: 7202 - DNA, 20 bp, Artificial Sequence
  chemically synthesized
attccatttaaaggtttcta

SEQ ID NO: 7203 - DNA, 20 bp, Artificial Sequence
  chemically synthesized
aaaagacagtggaataacca

SEQ ID NO: 7204 - DNA, 20 bp, Artificial Sequence
  chemically synthesized
caaatataaccaaaagacag

SEQ ID NO: 7205 - DNA, 20 bp, Artificial Sequence
  chemically synthesized
atggttattccactgtcttt

SEQ ID NO: 7206 - DNA, 20 bp, Artificial Sequence
  chemically synthesized
aaccaaatataaccaaaaga

SEQ ID NO: 7207 - DNA, 20 bp, Artificial Sequence
  chemically synthesized
aattaaccaaatataaccaa

SEQ ID NO: 7208 - DNA, 20 bp, Artificial Sequence
  chemically synthesized
cactgtcttttggttatatt

SEQ ID NO: 7209 - DNA, 20 bp, Artificial Sequence
  chemically synthesized
taatactgtttatatttatt

SEQ ID NO: 7210 - DNA, 20 bp, Artificial Sequence
  chemically synthesized
aatttccaaataaatataaa

SEQ ID NO: 7211 - DNA, 20 bp, Artificial Sequence
  chemically synthesized
caaataaatataaacagtat

SEQ ID NO: 7212 - DNA, 20 bp, Artificial Sequence
  chemically synthesized
aaacagtattagcacatgtg

SEQ ID NO: 7213 - DNA, 20 bp, Artificial Sequence
  chemically synthesized
aacagtattagcacatgtga

SEQ ID NO: 7214 - DNA, 20 bp, Artificial Sequence
  chemically synthesized
cagtaaatcctaaagcattt

SEQ ID NO: 7215 - DNA, 20 bp, Artificial Sequence
  chemically synthesized
tgtgaaggtcccaaatgctt

SEQ ID NO: 7216 - DNA, 20 bp, Artificial Sequence
  chemically synthesized
tcagtaaatcctaaagcatt

SEQ ID NO: 7217 - DNA, 20 bp, Artificial Sequence
  chemically synthesized
gtgaaggtcccaaatgcttt

SEQ ID NO: 7218 - DNA, 20 bp, Artificial Sequence
  chemically synthesized
tgtattctcagtaaatccta

SEQ ID NO: 7219 - DNA, 20 bp, Artificial Sequence
  chemically synthesized
caaatgctttaggatttact

SEQ ID NO: 7220 - DNA, 20 bp, Artificial Sequence
  chemically synthesized
ctcaattggaattgtattct

SEQ ID NO: 7221 - DNA, 20 bp, Artificial Sequence
  chemically synthesized
ctgagaatacaattccaatt

SEQ ID NO: 7222 - DNA, 20 bp, Artificial Sequence
  chemically synthesized
tgagaatacaattccaattg

SEQ ID NO: 7223 - DNA, 20 bp, Artificial Sequence
  chemically synthesized
atatcagaaatgtcctcaat

SEQ ID NO: 7224 - DNA, 20 bp, Artificial Sequence
  chemically synthesized
agtcactggatatcaaatat

SEQ ID NO: 7225 - DNA, 20 bp, Artificial Sequence
  chemically synthesized
catttctgatatttgatatc

SEQ ID NO: 7226 - DNA, 20 bp, Artificial Sequence
  chemically synthesized
caagagttctaatcagtcac

SEQ ID NO: 7227 - DNA, 20 bp, Artificial Sequence
  chemically synthesized
tttgatatccagtgactgat

SEQ ID NO: 7228 - DNA, 20 bp, Artificial Sequence
  chemically synthesized
aagatgtcaagagttctaat

SEQ ID NO: 7229 - DNA, 20 bp, Artificial Sequence
  chemically synthesized
aagtagaagaaagatgtcaa

SEQ ID NO: 7230 - DNA, 20 bp, Artificial Sequence
  chemically synthesized
acaagtagaagaaagatgtc

SEQ ID NO: 7231 - DNA, 20 bp, Artificial Sequence
  chemically synthesized
tatttatcacaagtagaaga

SEQ ID NO: 7232 - DNA, 20 bp, Artificial Sequence
  chemically synthesized
ttggtatttatcacaagtag

SEQ ID NO: 7233 - DNA, 20 bp, Artificial Sequence
  chemically synthesized
attttggtatttatcacaag

SEQ ID NO: 7234 - DNA, 20 bp, Artificial Sequence
  chemically synthesized
cttattttggtatttatcac

SEQ ID NO: 7235 - DNA, 20 bp, Artificial Sequence
  chemically synthesized
cttgtgataaataccaaaat

SEQ ID NO: 7236 - DNA, 20 bp, Artificial Sequence
  chemically synthesized
agaaatctgtcatcttattt

SEQ ID NO: 7237 - DNA, 20 bp, Artificial Sequence
  chemically synthesized
taaataccaaaataagatga

SEQ ID NO: 7238 - DNA, 20 bp, Artificial Sequence
  chemically synthesized
tgacagatttctgttgttca

SEQ ID NO: 7239 - DNA, 20 bp, Artificial Sequence
  chemically synthesized
gaaatatcatctgtgaacaa

SEQ ID NO: 7240 - DNA, 20 bp, Artificial Sequence
  chemically synthesized
gttcacagatgatatttcat

SEQ ID NO: 7241 - DNA, 20 bp, Artificial Sequence
  chemically synthesized
ttcacagatgatatttcatc

SEQ ID NO: 7242 - DNA, 20 bp, Artificial Sequence
  chemically synthesized
cagatgatatttcatcaggt

SEQ ID NO: 7243 - DNA, 20 bp, Artificial Sequence
  chemically synthesized
gatgatatttcatcaggtga

SEQ ID NO: 7244 - DNA, 20 bp, Artificial Sequence
  chemically synthesized
gatctcccacatttgtggat

SEQ ID NO: 7245 - DNA, 20 bp, Artificial Sequence
  chemically synthesized
agatctcccacatttgtgga

SEQ ID NO: 7246 - DNA, 20 bp, Artificial Sequence
  chemically synthesized
gaaattcctatccacaaatg

SEQ ID NO: 7247 - DNA, 20 bp, Artificial Sequence
  chemically synthesized
aaattcctatccacaaatgt

SEQ ID NO: 7248 - DNA, 20 bp, Artificial Sequence
  chemically synthesized
atatagatctcccacatttg

SEQ ID NO: 7249 - DNA, 20 bp, Artificial Sequence
  chemically synthesized
attcctatccacaaatgtgg

SEQ ID NO: 7250 - DNA, 20 bp, Artificial Sequence
  chemically synthesized
tgtgggagatctatatcaat

SEQ ID NO: 7251 - DNA, 20 bp, Artificial Sequence
  chemically synthesized
catctcttttctcattgata

SEQ ID NO: 7252 - DNA, 20 bp, Artificial Sequence
  chemically synthesized
gagatctatatcaatgagaa

SEQ ID NO: 7253 - DNA, 20 bp, Artificial Sequence
  chemically synthesized
gatctatatcaatgagaaaa

SEQ ID NO: 7254 - DNA, 20 bp, Artificial Sequence
  chemically synthesized
tgagaaaagagatgaaatgt

SEQ ID NO: 7255 - DNA, 20 bp, Artificial Sequence
  chemically synthesized
gaaaagagatgaaatgtaag

SEQ ID NO: 7256 - DNA, 20 bp, Artificial Sequence
  chemically synthesized
agagatgaaatgtaagtagt

SEQ ID NO: 7257 - DNA, 20 bp, Artificial Sequence
  chemically synthesized
gatgaaatgtaagtagtgag

SEQ ID NO: 7258 - DNA, 20 bp, Artificial Sequence
  chemically synthesized
aatgtaagtagtgagtagcc

SEQ ID NO: 7259 - DNA, 20 bp, Artificial Sequence
  chemically synthesized
gtaagtagtgagtagccaag

SEQ ID NO: 7260 - DNA, 20 bp, Artificial Sequence
  chemically synthesized
aagtagtgagtagccaagaa

SEQ ID NO: 7261 - DNA, 20 bp, Artificial Sequence
  chemically synthesized
gacaatgggaaaactcttct

SEQ ID NO: 7262 - DNA, 20 bp, Artificial Sequence
  chemically synthesized
agaagagttttcccattgtc

SEQ ID NO: 7263 - DNA, 20 bp, Artificial Sequence
  chemically synthesized
gctttctcaaactggacaat

SEQ ID NO: 7264 - DNA, 20 bp, Artificial Sequence
  chemically synthesized
tgctttctcaaactggacaa

SEQ ID NO: 7265 - DNA, 20 bp, Artificial Sequence
  chemically synthesized
gttttcccattgtccagttt

SEQ ID NO: 7266 - DNA, 20 bp, Artificial Sequence
  chemically synthesized
atgatcttgctttctcaaac

SEQ ID NO: 7267 - DNA, 20 bp, Artificial Sequence
  chemically synthesized
tcccattgtccagtttgaga

SEQ ID NO: 7268 - DNA, 20 bp, Artificial Sequence
  chemically synthesized
attgtccagtttgagaaagc

SEQ ID NO: 7269 - DNA, 20 bp, Artificial Sequence
  chemically synthesized
aagcaagatcatctcatcac

SEQ ID NO: 7270 - DNA, 20 bp, Artificial Sequence
  chemically synthesized
agcaagatcatctcatcacc

SEQ ID NO: 7271 - DNA, 20 bp, Artificial Sequence
  chemically synthesized
tatttagcagacctggtgat

SEQ ID NO: 7272 - DNA, 20 bp, Artificial Sequence
  chemically synthesized
cagaaaatatttagcagacc

SEQ ID NO: 7273 - DNA, 20 bp, Artificial Sequence
  chemically synthesized
ggacaacagaaaatatttag

SEQ ID NO: 7274 - DNA, 20 bp, Artificial Sequence
  chemically synthesized
atgggacaacagaaaatatt

SEQ ID NO: 7275 - DNA, 20 bp, Artificial Sequence
  chemically synthesized
tcattccgagtatgggacaa

SEQ ID NO: 7276 - DNA, 20 bp, Artificial Sequence
  chemically synthesized
attttctgttgtcccatact

SEQ ID NO: 7277 - DNA, 20 bp, Artificial Sequence
  chemically synthesized
ggaatgttcattccgagtat

SEQ ID NO: 7278 - DNA, 20 bp, Artificial Sequence
  chemically synthesized
tggaatgttcattccgagta

SEQ ID NO: 7279 - DNA, 20 bp, Artificial Sequence
  chemically synthesized
ccctgtggaatgttcattcc

SEQ ID NO: 7280 - DNA, 20 bp, Artificial Sequence
  chemically synthesized
tactcggaatgaacattcca

SEQ ID NO: 7281 - DNA, 20 bp, Artificial Sequence
  chemically synthesized
actcggaatgaacattccac

SEQ ID NO: 7282 - DNA, 20 bp, Artificial Sequence
  chemically synthesized
ctcggaatgaacattccaca

SEQ ID NO: 7283 - DNA, 20 bp, Artificial Sequence
  chemically synthesized
tcggaatgaacattccacag

SEQ ID NO: 7284 - DNA, 20 bp, Artificial Sequence
  chemically synthesized
aatgaacattccacagggga

SEQ ID NO: 7285 - DNA, 20 bp, Artificial Sequence
  chemically synthesized
ggaagacatgccgtcccctg

SEQ ID NO: 7286 - DNA, 20 bp, Artificial Sequence
  chemically synthesized
tttgaaactgagcattttgg

SEQ ID NO: 7287 - DNA, 20 bp, Artificial Sequence
  chemically synthesized
ggcatgtcttccaaaatgct

SEQ ID NO: 7288 - DNA, 20 bp, Artificial Sequence
  chemically synthesized
ccttttgaaactgagcattt

SEQ ID NO: 7289 - DNA, 20 bp, Artificial Sequence
  chemically synthesized
agatctagccttttgaaact

SEQ ID NO: 7290 - DNA, 20 bp, Artificial Sequence
  chemically synthesized
tccaaaatgctcagtttcaa

SEQ ID NO: 7291 - DNA, 20 bp, Artificial Sequence
  chemically synthesized
ccaaaatgctcagtttcaaa

SEQ ID NO: 7292 - DNA, 20 bp, Artificial Sequence
  chemically synthesized
aatgctcagtttcaaaaggc

SEQ ID NO: 7293 - DNA, 20 bp, Artificial Sequence
  chemically synthesized
tctgcttccatgtggagatc

SEQ ID NO: 7294 - DNA, 20 bp, Artificial Sequence
  chemically synthesized
caaaaggctagatctccaca

SEQ ID NO: 7295 - DNA, 20 bp, Artificial Sequence
  chemically synthesized
aaggctagatctccacatgg

SEQ ID NO: 7296 - DNA, 20 bp, Artificial Sequence
  chemically synthesized
tttctttctgcttccatgtg

SEQ ID NO: 7297 - DNA, 20 bp, Artificial Sequence
  chemically synthesized
gttttctttctgcttccatg

SEQ ID NO: 7298 - DNA, 20 bp, Artificial Sequence
  chemically synthesized
gctagatctccacatggaag

SEQ ID NO: 7299 - DNA, 20 bp, Artificial Sequence
  chemically synthesized
gatctccacatggaagcaga

SEQ ID NO: 7300 - DNA, 20 bp, Artificial Sequence
  chemically synthesized
gaaaaaaaccagagtagatt

SEQ ID NO: 7301 - DNA, 20 bp, Artificial Sequence
  chemically synthesized
agaaaaaaaccagagtagat

SEQ ID NO: 7302 - DNA, 20 bp, Artificial Sequence
  chemically synthesized
aaagaaaacccaatctactc

SEQ ID NO: 7303 - DNA, 20 bp, Artificial Sequence
  chemically synthesized
aacaaagaaaaaaaccagag

SEQ ID NO: 7304 - DNA, 20 bp, Artificial Sequence
  chemically synthesized
caaaacaaagaaaaaaacca

SEQ ID NO: 7305 - DNA, 20 bp, Artificial Sequence
  chemically synthesized
aacaaaacaaagaaaaaaac

SEQ ID NO: 7306 - DNA, 20 bp, Artificial Sequence
  chemically synthesized
aaatgaagcaaaacaaaaca

SEQ ID NO: 7307 - DNA, 20 bp, Artificial Sequence
  chemically synthesized
taggtagaatgaaaaaaatg

SEQ ID NO: 7308 - DNA, 20 bp, Artificial Sequence
  chemically synthesized
ttcatttttttcattctacc

SEQ ID NO: 7309 - DNA, 20 bp, Artificial Sequence
  chemically synthesized
ttgtaatgttaggtactagg

SEQ ID NO: 7310 - DNA, 20 bp, Artificial Sequence
  chemically synthesized
accttgtaatgttaggtact

SEQ ID NO: 7311 - DNA, 20 bp, Artificial Sequence
  chemically synthesized
aaccttgtaatgttaggtac

SEQ ID NO: 7312 - DNA, 20 bp, Artificial Sequence
  chemically synthesized
cctggaaaccttgtaatgtt

SEQ ID NO: 7313 - DNA, 20 bp, Artificial Sequence
  chemically synthesized
tacctagtacctaacattac

SEQ ID NO: 7314 - DNA, 20 bp, Artificial Sequence
  chemically synthesized
tcctggaaaccttgtaatgt

SEQ ID NO: 7315 - DNA, 20 bp, Artificial Sequence
  chemically synthesized
acctagtacctaacattaca

SEQ ID NO: 7316 - DNA, 20 bp, Artificial Sequence
  chemically synthesized
acctaacattacaaggtttc

SEQ ID NO: 7317 - DNA, 20 bp, Artificial Sequence
  chemically synthesized
cctaacattacaaggtttcc

SEQ ID NO: 7318 - DNA, 20 bp, Artificial Sequence
  chemically synthesized
tgtgactttaaataaattcc

SEQ ID NO: 7319 - DNA, 20 bp, Artificial Sequence
  chemically synthesized
ggtttccaggaatttattta

SEQ ID NO: 7320 - DNA, 20 bp, Artificial Sequence
  chemically synthesized
ggaatttatttaaagtcaca

SEQ ID NO: 7321 - DNA, 20 bp, Artificial Sequence
  chemically synthesized
ttctatttctgtagatgaaa

SEQ ID NO: 7322 - DNA, 20 bp, Artificial Sequence
  chemically synthesized
tgtatgatctttttcatcta

SEQ ID NO: 7323 - DNA, 20 bp, Artificial Sequence
  chemically synthesized
atctttttcatctacagaaa

SEQ ID NO: 7324 - DNA, 20 bp, Artificial Sequence
  chemically synthesized
gataggagattctatttctg

SEQ ID NO: 7325 - DNA, 20 bp, Artificial Sequence
  chemically synthesized
atttcaatcagtacagatag

SEQ ID NO: 7326 - DNA, 20 bp, Artificial Sequence
  chemically synthesized
ggatttcaatcagtacagat

SEQ ID NO: 7327 - DNA, 20 bp, Artificial Sequence
  chemically synthesized
aggatttcaatcagtacaga

SEQ ID NO: 7328 - DNA, 20 bp, Artificial Sequence
  chemically synthesized
caataggatttcaatcagta

SEQ ID NO: 7329 - DNA, 20 bp, Artificial Sequence
  chemically synthesized
gatagcaataggatttcaat

SEQ ID NO: 7330 - DNA, 20 bp, Artificial Sequence
  chemically synthesized
ccttgaaggctgatagcaat

SEQ ID NO: 7331 - DNA, 20 bp, Artificial Sequence
  chemically synthesized
gattgaaatcctattgctat

SEQ ID NO: 7332 - DNA, 20 bp, Artificial Sequence
  chemically synthesized
cccttgaaggctgatagcaa

SEQ ID NO: 7333 - DNA, 20 bp, Artificial Sequence
  chemically synthesized
caactacccttgaaggctga

SEQ ID NO: 7334 - DNA, 20 bp, Artificial Sequence
  chemically synthesized
tcctattgctatcagccttc

SEQ ID NO: 7335 - DNA, 20 bp, Artificial Sequence
  chemically synthesized
cctattgctatcagccttca

SEQ ID NO: 7336 - DNA, 20 bp, Artificial Sequence
  chemically synthesized
ctattgctatcagccttcaa

SEQ ID NO: 7337 - DNA, 20 bp, Artificial Sequence
  chemically synthesized
ttgctatcagccttcaaggg

SEQ ID NO: 7338 - DNA, 20 bp, Artificial Sequence
  chemically synthesized
atacaaacaactacccttga

SEQ ID NO: 7339 - DNA, 20 bp, Artificial Sequence
  chemically synthesized
tatacaaacaactacccttg

SEQ ID NO: 7340 - DNA, 20 bp, Artificial Sequence
  chemically synthesized
ttcaagggtagttgtttgta

SEQ ID NO: 7341 - DNA, 20 bp, Artificial Sequence
  chemically synthesized
tgtttgtatagtttatttca

SEQ ID NO: 7342 - DNA, 20 bp, Artificial Sequence
  chemically synthesized
tcatcactgctttgtcaaag

SEQ ID NO: 7343 - DNA, 20 bp, Artificial Sequence
  chemically synthesized
catagcaatctgctttgaca

SEQ ID NO: 7344 - DNA, 20 bp, Artificial Sequence
  chemically synthesized
ttctcatcactgctttgtca

SEQ ID NO: 7345 - DNA, 20 bp, Artificial Sequence
  chemically synthesized
agcaatctgctttgacaaag

SEQ ID NO: 7346 - DNA, 20 bp, Artificial Sequence
  chemically synthesized
tgctttgacaaagcagtgat

SEQ ID NO: 7347 - DNA, 20 bp, Artificial Sequence
  chemically synthesized
tttgacaaagcagtgatgag

SEQ ID NO: 7348 - DNA, 20 bp, Artificial Sequence
  chemically synthesized
tgacaaagcagtgatgagaa

SEQ ID NO: 7349 - DNA, 20 bp, Artificial Sequence
  chemically synthesized
tgatgagaagagattcatcg

SEQ ID NO: 7350 - DNA, 20 bp, Artificial Sequence
  chemically synthesized
gagaagagattcatcgaagt

SEQ ID NO: 7351 - DNA, 20 bp, Artificial Sequence
  chemically synthesized
catcgaagtaagtacacctt

SEQ ID NO: 7352 - DNA, 20 bp, Artificial Sequence
  chemically synthesized
gaagtaagtacaccttcagt

SEQ ID NO: 7353 - DNA, 20 bp, Artificial Sequence
  chemically synthesized
cgtgtgcagaatctgactga

SEQ ID NO: 7354 - DNA, 20 bp, Artificial Sequence
  chemically synthesized
ccgtgtgcagaatctgactg

SEQ ID NO: 7355 - DNA, 20 bp, Artificial Sequence
  chemically synthesized
cttcagtcagattctgcaca

SEQ ID NO: 7356 - DNA, 20 bp, Artificial Sequence
  chemically synthesized
ttcagtcagattctgcacac

SEQ ID NO: 7357 - DNA, 20 bp, Artificial Sequence
  chemically synthesized
acacccagaagacccgtgtg

SEQ ID NO: 7358 - DNA, 20 bp, Artificial Sequence
  chemically synthesized
gattctgcacacgggtcttc

SEQ ID NO: 7359 - DNA, 20 bp, Artificial Sequence
  chemically synthesized
attctgcacacgggtcttct

SEQ ID NO: 7360 - DNA, 20 bp, Artificial Sequence
  chemically synthesized
atacatcggtgcacacccag

SEQ ID NO: 7361 - DNA, 20 bp, Artificial Sequence
  chemically synthesized
tacatacatcggtgcacacc

SEQ ID NO: 7362 - DNA, 20 bp, Artificial Sequence
  chemically synthesized
atgtggacagttacatacat

SEQ ID NO: 7363 - DNA, 20 bp, Artificial Sequence
  chemically synthesized
ttagatttaattaatgtgga

SEQ ID NO: 7364 - DNA, 20 bp, Artificial Sequence
  chemically synthesized
gaaattagatttaattaatg

SEQ ID NO: 7365 - DNA, 20 bp, Artificial Sequence
  chemically synthesized
attaattaaatctaatttct

SEQ ID NO: 7366 - DNA, 20 bp, Artificial Sequence
  chemically synthesized
ccagttaagttctcagaaat

SEQ ID NO: 7367 - DNA, 20 bp, Artificial Sequence
  chemically synthesized
ctgattgccagttaagttct

SEQ ID NO: 7368 - DNA, 20 bp, Artificial Sequence
  chemically synthesized
ctaatttctgagaacttaac

SEQ ID NO: 7369 - DNA, 20 bp, Artificial Sequence
  chemically synthesized
cattgaactgattgccagtt

SEQ ID NO: 7370 - DNA, 20 bp, Artificial Sequence
  chemically synthesized
ctgagaacttaactggcaat

SEQ ID NO: 7371 - DNA, 20 bp, Artificial Sequence
  chemically synthesized
agaaacattgaactgattgc

SEQ ID NO: 7372 - DNA, 20 bp, Artificial Sequence
  chemically synthesized
tggatactgcttcaagttca

SEQ ID NO: 7373 - DNA, 20 bp, Artificial Sequence
  chemically synthesized
tcaatgtttctgtgaacttg

SEQ ID NO: 7374 - DNA, 20 bp, Artificial Sequence
  chemically synthesized
atgtttctgtgaacttgaag

SEQ ID NO: 7375 - DNA, 20 bp, Artificial Sequence
  chemically synthesized
tgaacattggatactgcttc

SEQ ID NO: 7376 - DNA, 20 bp, Artificial Sequence
  chemically synthesized
gaatgagaccttgtgaacat

SEQ ID NO: 7377 - DNA, 20 bp, Artificial Sequence
  chemically synthesized
aagcagtatccaatgttcac

SEQ ID NO: 7378 - DNA, 20 bp, Artificial Sequence
  chemically synthesized
agcagtatccaatgttcaca

SEQ ID NO: 7379 - DNA, 20 bp, Artificial Sequence
  chemically synthesized
gttcacaaggtctcattcca

SEQ ID NO: 7380 - DNA, 20 bp, Artificial Sequence
  chemically synthesized
ttcacaaggtctcattccat

SEQ ID NO: 7381 - DNA, 20 bp, Artificial Sequence
  chemically synthesized
gaaagtaattcctatggaat

SEQ ID NO: 7382 - DNA, 20 bp, Artificial Sequence
  chemically synthesized
aaaatagaaagtaattccta

SEQ ID NO: 7383 - DNA, 20 bp, Artificial Sequence
  chemically synthesized
aatgaagagggaaaaataga

SEQ ID NO: 7384 - DNA, 20 bp, Artificial Sequence
  chemically synthesized
ttttaatgaagagggaaaaa

SEQ ID NO: 7385 - DNA, 20 bp, Artificial Sequence
  chemically synthesized
aagttttcttttaatgaaga

SEQ ID NO: 7386 - DNA, 20 bp, Artificial Sequence
  chemically synthesized
gaagttttcttttaatgaag

SEQ ID NO: 7387 - DNA, 20 bp, Artificial Sequence
  chemically synthesized
tgaagttttcttttaatgaa

SEQ ID NO: 7388 - DNA, 20 bp, Artificial Sequence
  chemically synthesized
tatttttccctcttcattaa

SEQ ID NO: 7389 - DNA, 20 bp, Artificial Sequence
  chemically synthesized
gttgaagttttcttttaatg

SEQ ID NO: 7390 - DNA, 20 bp, Artificial Sequence
  chemically synthesized
ccagttagaacattttgttg

SEQ ID NO: 7391 - DNA, 20 bp, Artificial Sequence
  chemically synthesized
cttcaacaaaatgttctaac

SEQ ID NO: 7392 - DNA, 20 bp, Artificial Sequence
  chemically synthesized
acataaaaagtgttgccagt

SEQ ID NO: 7393 - DNA, 20 bp, Artificial Sequence
  chemically synthesized
ttctacataaaaagtgttgc

SEQ ID NO: 7394 - DNA, 20 bp, Artificial Sequence
  chemically synthesized
aactggcaacactttttatg

SEQ ID NO: 7395 - DNA, 20 bp, Artificial Sequence
  chemically synthesized
tgaataggattctacataaa

SEQ ID NO: 7396 - DNA, 20 bp, Artificial Sequence
  chemically synthesized
gtagaaagaaaaatttgaat

SEQ ID NO: 7397 - DNA, 20 bp, Artificial Sequence
  chemically synthesized
ggtagaaagaaaaatttgaa

SEQ ID NO: 7398 - DNA, 20 bp, Artificial Sequence
  chemically synthesized
attcaaatttttctttctac

SEQ ID NO: 7399 - DNA, 20 bp, Artificial Sequence
  chemically synthesized
ggctgccccaatctggtaga

SEQ ID NO: 7400 - DNA, 20 bp, Artificial Sequence
  chemically synthesized
aatttttctttctaccagat

SEQ ID NO: 7401 - DNA, 20 bp, Artificial Sequence
  chemically synthesized
atttttctttctaccagatt

SEQ ID NO: 7402 - DNA, 20 bp, Artificial Sequence
  chemically synthesized
ccatggctgccccaatctgg

SEQ ID NO: 7403 - DNA, 20 bp, Artificial Sequence
  chemically synthesized
tttttctttctaccagattg

SEQ ID NO: 7404 - DNA, 20 bp, Artificial Sequence
  chemically synthesized
acaccatggctgccccaatc

SEQ ID NO: 7405 - DNA, 20 bp, Artificial Sequence
  chemically synthesized
ttctttctaccagattgggg

SEQ ID NO: 7406 - DNA, 20 bp, Artificial Sequence
  chemically synthesized
ctaccagattggggcagcca

SEQ ID NO: 7407 - DNA, 20 bp, Artificial Sequence
  chemically synthesized
tgttttcaaaaggaacacca

SEQ ID NO: 7408 - DNA, 20 bp, Artificial Sequence
  chemically synthesized
gtctaaaaactgttttcaaa

SEQ ID NO: 7409 - DNA, 20 bp, Artificial Sequence
  chemically synthesized
catggtgttccttttgaaaa

SEQ ID NO: 7410 - DNA, 20 bp, Artificial Sequence
  chemically synthesized
tgtctaaaaactgttttcaa

SEQ ID NO: 7411 - DNA, 20 bp, Artificial Sequence
  chemically synthesized
ttccttttgaaaacagtttt

SEQ ID NO: 7412 - DNA, 20 bp, Artificial Sequence
  chemically synthesized
ttgaaaacagtttttagaca

SEQ ID NO: 7413 - DNA, 20 bp, Artificial Sequence
  chemically synthesized
agtttttagacatggacctc

SEQ ID NO: 7414 - DNA, 20 bp, Artificial Sequence
  chemically synthesized
tttagacatggacctcaaga

SEQ ID NO: 7415 - DNA, 20 bp, Artificial Sequence
  chemically synthesized
tggcttgttgtaccatcttg

SEQ ID NO: 7416 - DNA, 20 bp, Artificial Sequence
  chemically synthesized
atggcttgttgtaccatctt

SEQ ID NO: 7417 - DNA, 20 bp, Artificial Sequence
  chemically synthesized
ggacctcaagatggtacaac

SEQ ID NO: 7418 - DNA, 20 bp, Artificial Sequence
  chemically synthesized
aataggtgggaagacagtaa

SEQ ID NO: 7419 - DNA, 20 bp, Artificial Sequence
  chemically synthesized
gtgaaaaataggtgggaaga

SEQ ID NO: 7420 - DNA, 20 bp, Artificial Sequence
  chemically synthesized
ctttgtgaaaaataggtggg

SEQ ID NO: 7421 - DNA, 20 bp, Artificial Sequence
  chemically synthesized
cacctttgtgaaaaataggt

SEQ ID NO: 7422 - DNA, 20 bp, Artificial Sequence
  chemically synthesized
gcacctttgtgaaaaatagg

SEQ ID NO: 7423 - DNA, 20 bp, Artificial Sequence
  chemically synthesized
tcagcacctttgtgaaaaat

SEQ ID NO: 7424 - DNA, 20 bp, Artificial Sequence
  chemically synthesized
gtcagcacctttgtgaaaaa

SEQ ID NO: 7425 - DNA, 20 bp, Artificial Sequence
  chemically synthesized
cttcccacctatttttcaca

SEQ ID NO: 7426 - DNA, 20 bp, Artificial Sequence
  chemically synthesized
ttcccacctatttttcacaa

SEQ ID NO: 7427 - DNA, 20 bp, Artificial Sequence
  chemically synthesized
atttttcacaaaggtgctga

SEQ ID NO: 7428 - DNA, 20 bp, Artificial Sequence
  chemically synthesized
tttttcacaaaggtgctgac

SEQ ID NO: 7429 - DNA, 20 bp, Artificial Sequence
  chemically synthesized
tttcacaaaggtgctgacag

SEQ ID NO: 7430 - DNA, 20 bp, Artificial Sequence
  chemically synthesized
tagaaaaggcagtctcctgt

SEQ ID NO: 7431 - DNA, 20 bp, Artificial Sequence
  chemically synthesized
tgacaggagactgccttttc

SEQ ID NO: 7432 - DNA, 20 bp, Artificial Sequence
  chemically synthesized
gaagatctctctagaaaagg

SEQ ID NO: 7433 - DNA, 20 bp, Artificial Sequence
  chemically synthesized
acaggagactgccttttcta

SEQ ID NO: 7434 - DNA, 20 bp, Artificial Sequence
  chemically synthesized
aaggaagatctctctagaaa

SEQ ID NO: 7435 - DNA, 20 bp, Artificial Sequence
  chemically synthesized
aggagactgccttttctaga

SEQ ID NO: 7436 - DNA, 20 bp, Artificial Sequence
  chemically synthesized
caaggaagatctctctagaa

SEQ ID NO: 7437 - DNA, 20 bp, Artificial Sequence
  chemically synthesized
gataccaaggaagatctctc

SEQ ID NO: 7438 - DNA, 20 bp, Artificial Sequence
  chemically synthesized
ttttctagagagatcttcct

SEQ ID NO: 7439 - DNA, 20 bp, Artificial Sequence
  chemically synthesized
acaggatcaagataccaagg

SEQ ID NO: 7440 - DNA, 20 bp, Artificial Sequence
  chemically synthesized
cccacaggatcaagatacca

SEQ ID NO: 7441 - DNA, 20 bp, Artificial Sequence
  chemically synthesized
acccacaggatcaagatacc

SEQ ID NO: 7442 - DNA, 20 bp, Artificial Sequence
  chemically synthesized
tccttggtatcttgatcctg

SEQ ID NO: 7443 - DNA, 20 bp, Artificial Sequence
  chemically synthesized
acaactaaacccacaggatc

SEQ ID NO: 7444 - DNA, 20 bp, Artificial Sequence
  chemically synthesized
ccttggtatcttgatcctgt

SEQ ID NO: 7445 - DNA, 20 bp, Artificial Sequence
  chemically synthesized
gtatcttgatcctgtgggtt

SEQ ID NO: 7446 - DNA, 20 bp, Artificial Sequence
  chemically synthesized
ctgtggacaactaaacccac

SEQ ID NO: 7447 - DNA, 20 bp, Artificial Sequence
  chemically synthesized
cctgtggacaactaaaccca

SEQ ID NO: 7448 - DNA, 20 bp, Artificial Sequence
  chemically synthesized
cctgtgggtttagttgtcca

SEQ ID NO: 7449 - DNA, 20 bp, Artificial Sequence
  chemically synthesized
ctgtgggtttagttgtccac

SEQ ID NO: 7450 - DNA, 20 bp, Artificial Sequence
  chemically synthesized
tgtgggtttagttgtccaca

SEQ ID NO: 7451 - DNA, 20 bp, Artificial Sequence
  chemically synthesized
atcataaaagaagagccctg

SEQ ID NO: 7452 - DNA, 20 bp, Artificial Sequence
  chemically synthesized
ataaataaatcataaaagaa

SEQ ID NO: 7453 - DNA, 20 bp, Artificial Sequence
  chemically synthesized
ttataaataaatcataaaag

SEQ ID NO: 7454 - DNA, 20 bp, Artificial Sequence
  chemically synthesized
tccttataaataaatcataa

SEQ ID NO: 7455 - DNA, 20 bp, Artificial Sequence
  chemically synthesized
ttcttttatgatttatttat

SEQ ID NO: 7456 - DNA, 20 bp, Artificial Sequence
  chemically synthesized
tcttttatgatttatttata

SEQ ID NO: 7457 - DNA, 20 bp, Artificial Sequence
  chemically synthesized
atttataaggacccttgttc

SEQ ID NO: 7458 - DNA, 20 bp, Artificial Sequence
  chemically synthesized
aaaccatgcctcttgaacaa

SEQ ID NO: 7459 - DNA, 20 bp, Artificial Sequence
  chemically synthesized
ttataaggacccttgttcaa

SEQ ID NO: 7460 - DNA, 20 bp, Artificial Sequence
  chemically synthesized
caaaccatgcctcttgaaca

SEQ ID NO: 7461 - DNA, 20 bp, Artificial Sequence
  chemically synthesized
tataaggacccttgttcaag

SEQ ID NO: 7462 - DNA, 20 bp, Artificial Sequence
  chemically synthesized
ccaaaccatgcctcttgaac

SEQ ID NO: 7463 - DNA, 20 bp, Artificial Sequence
  chemically synthesized
ggacccttgttcaagaggca

SEQ ID NO: 7464 - DNA, 20 bp, Artificial Sequence
  chemically synthesized
cttgttcaagaggcatggtt

SEQ ID NO: 7465 - DNA, 20 bp, Artificial Sequence
  chemically synthesized
aacacattacatttctgttt

SEQ ID NO: 7466 - DNA, 20 bp, Artificial Sequence
  chemically synthesized
acattacatttctgttttgg

SEQ ID NO: 7467 - DNA, 20 bp, Artificial Sequence
  chemically synthesized
ttcactggaaaccaccaaaa

SEQ ID NO: 7468 - DNA, 20 bp, Artificial Sequence
  chemically synthesized
atttctgttttggtggtttc

SEQ ID NO: 7469 - DNA, 20 bp, Artificial Sequence
  chemically synthesized
ttggtggtttccagtgaaaa

SEQ ID NO: 7470 - DNA, 20 bp, Artificial Sequence
  chemically synthesized
tgagccttttctgttttcac

SEQ ID NO: 7471 - DNA, 20 bp, Artificial Sequence
  chemically synthesized
ggtttccagtgaaaacagaa

SEQ ID NO: 7472 - DNA, 20 bp, Artificial Sequence
  chemically synthesized
gtttccagtgaaaacagaaa

SEQ ID NO: 7473 - DNA, 20 bp, Artificial Sequence
  chemically synthesized
cagctttggctgattaaaat

SEQ ID NO: 7474 - DNA, 20 bp, Artificial Sequence
  chemically synthesized
cagaaaaggctcattttaat

SEQ ID NO: 7475 - DNA, 20 bp, Artificial Sequence
  chemically synthesized
aggctcattttaatcagcca

SEQ ID NO: 7476 - DNA, 20 bp, Artificial Sequence
  chemically synthesized
cattttaatcagccaaagct

SEQ ID NO: 7477 - DNA, 20 bp, Artificial Sequence
  chemically synthesized
tattctttacagctcagctt

SEQ ID NO: 7478 - DNA, 20 bp, Artificial Sequence
  chemically synthesized
tcagccaaagctgagctgta

SEQ ID NO: 7479 - DNA, 20 bp, Artificial Sequence
  chemically synthesized
aattgatattctttacagct

SEQ ID NO: 7480 - DNA, 20 bp, Artificial Sequence
  chemically synthesized
tgagcaattgatattcttta

SEQ ID NO: 7481 - DNA, 20 bp, Artificial Sequence
  chemically synthesized
agaatatcaattgctcaatg

SEQ ID NO: 7482 - DNA, 20 bp, Artificial Sequence
  chemically synthesized
gaatatcaattgctcaatgc

SEQ ID NO: 7483 - DNA, 20 bp, Artificial Sequence
  chemically synthesized
aggaaagaaaggcctgcatt

SEQ ID NO: 7484 - DNA, 20 bp, Artificial Sequence
  chemically synthesized
aacatctgggaaggaaagaa

SEQ ID NO: 7485 - DNA, 20 bp, Artificial Sequence
  chemically synthesized
aaacatctgggaaggaaaga

SEQ ID NO: 7486 - DNA, 20 bp, Artificial Sequence
  chemically synthesized
gcaggcctttctttccttcc

SEQ ID NO: 7487 - DNA, 20 bp, Artificial Sequence
  chemically synthesized
tttcaaacatctgggaagga

SEQ ID NO: 7488 - DNA, 20 bp, Artificial Sequence
  chemically synthesized
gaaatttcaaacatctggga

SEQ ID NO: 7489 - DNA, 20 bp, Artificial Sequence
  chemically synthesized
agaaatttcaaacatctggg

SEQ ID NO: 7490 - DNA, 20 bp, Artificial Sequence
  chemically synthesized
aagagaaatttcaaacatct

SEQ ID NO: 7491 - DNA, 20 bp, Artificial Sequence
  chemically synthesized
caagagaaatttcaaacatc

SEQ ID NO: 7492 - DNA, 20 bp, Artificial Sequence
  chemically synthesized
cagatgtttgaaatttctct

SEQ ID NO: 7493 - DNA, 20 bp, Artificial Sequence
  chemically synthesized
agatgtttgaaatttctctt

SEQ ID NO: 7494 - DNA, 20 bp, Artificial Sequence
  chemically synthesized
atgtttgaaatttctcttgg

SEQ ID NO: 7495 - DNA, 20 bp, Artificial Sequence
  chemically synthesized
tgaaggaaatgtgctcccaa

SEQ ID NO: 7496 - DNA, 20 bp, Artificial Sequence
  chemically synthesized
cttgaaggaaatgtgctccc

SEQ ID NO: 7497 - DNA, 20 bp, Artificial Sequence
  chemically synthesized
cttgggagcacatttccttc

SEQ ID NO: 7498 - DNA, 20 bp, Artificial Sequence
  chemically synthesized
aagaaggatgtgagtcttga

SEQ ID NO: 7499 - DNA, 20 bp, Artificial Sequence
  chemically synthesized
gaagaaggatgtgagtcttg

SEQ ID NO: 7500 - DNA, 20 bp, Artificial Sequence
  chemically synthesized
ccagaattgaagaaggatgt

SEQ ID NO: 7501 - DNA, 20 bp, Artificial Sequence
  chemically synthesized
gaatcttccagaattgaaga

SEQ ID NO: 7502 - DNA, 20 bp, Artificial Sequence
  chemically synthesized
agaatcttccagaattgaag

SEQ ID NO: 7503 - DNA, 20 bp, Artificial Sequence
  chemically synthesized
ctcacatccttcttcaattc

SEQ ID NO: 7504 - DNA, 20 bp, Artificial Sequence
  chemically synthesized
ctgagaatcttccagaattg

SEQ ID NO: 7505 - DNA, 20 bp, Artificial Sequence
  chemically synthesized
acatccttcttcaattctgg

SEQ ID NO: 7506 - DNA, 20 bp, Artificial Sequence
  chemically synthesized
tgtcatagctgagaatcttc

SEQ ID NO: 7507 - DNA, 20 bp, Artificial Sequence
  chemically synthesized
cttcaattctggaagattct

SEQ ID NO: 7508 - DNA, 20 bp, Artificial Sequence
  chemically synthesized
tatttgaagctgtcatagct

SEQ ID NO: 7509 - DNA, 20 bp, Artificial Sequence
  chemically synthesized
tggaagattctcagctatga

SEQ ID NO: 7510 - DNA, 20 bp, Artificial Sequence
  chemically synthesized
agtaatatttgaagctgtca

SEQ ID NO: 7511 - DNA, 20 bp, Artificial Sequence
  chemically synthesized
tggtagagaagtaatatttg

SEQ ID NO: 7512 - DNA, 20 bp, Artificial Sequence
  chemically synthesized
aaatggaggaaatggtagag

SEQ ID NO: 7513 - DNA, 20 bp, Artificial Sequence
  chemically synthesized
agaaaatggaggaaatggta

SEQ ID NO: 7514 - DNA, 20 bp, Artificial Sequence
  chemically synthesized
gaagaaaatggaggaaatgg

SEQ ID NO: 7515 - DNA, 20 bp, Artificial Sequence
  chemically synthesized
tcagaagaaaatggaggaaa

SEQ ID NO: 7516 - DNA, 20 bp, Artificial Sequence
  chemically synthesized
gaggtttcagaagaaaatgg

SEQ ID NO: 7517 - DNA, 20 bp, Artificial Sequence
  chemically synthesized
agaggtttcagaagaaaatg

SEQ ID NO: 7518 - DNA, 20 bp, Artificial Sequence
  chemically synthesized
tgagaggtttcagaagaaaa

SEQ ID NO: 7519 - DNA, 20 bp, Artificial Sequence
  chemically synthesized
gtgtatttgagaggtttcag

SEQ ID NO: 7520 - DNA, 20 bp, Artificial Sequence
  chemically synthesized
ggagtgtatttgagaggttt

SEQ ID NO: 7521 - DNA, 20 bp, Artificial Sequence
  chemically synthesized
tgtttaggagtgtatttgag

SEQ ID NO: 7522 - DNA, 20 bp, Artificial Sequence
  chemically synthesized
ttgtttaggagtgtatttga

SEQ ID NO: 7523 - DNA, 20 bp, Artificial Sequence
  chemically synthesized
gtttgtttaggagtgtattt

SEQ ID NO: 7524 - DNA, 20 bp, Artificial Sequence
  chemically synthesized
gaatttagaggtttgtttag

SEQ ID NO: 7525 - DNA, 20 bp, Artificial Sequence
  chemically synthesized
tagaatttagaggtttgttt

SEQ ID NO: 7526 - DNA, 20 bp, Artificial Sequence
  chemically synthesized
ctagaatttagaggtttgtt

SEQ ID NO: 7527 - DNA, 20 bp, Artificial Sequence
  chemically synthesized
tataccttactagaatttag

SEQ ID NO: 7528 - DNA, 20 bp, Artificial Sequence
  chemically synthesized
ctaaacaaacctctaaattc

SEQ ID NO: 7529 - DNA, 20 bp, Artificial Sequence
  chemically synthesized
atataccttactagaattta

SEQ ID NO: 7530 - DNA, 20 bp, Artificial Sequence
  chemically synthesized
caatataccttactagaatt

SEQ ID NO: 7531 - DNA, 20 bp, Artificial Sequence
  chemically synthesized
acaaacctctaaattctagt

SEQ ID NO: 7532 - DNA, 20 bp, Artificial Sequence
  chemically synthesized
caaacctctaaattctagta

SEQ ID NO: 7533 - DNA, 20 bp, Artificial Sequence
  chemically synthesized
ggctctacaatataccttac

SEQ ID NO: 7534 - DNA, 20 bp, Artificial Sequence
  chemically synthesized
aattctagtaaggtatattg

SEQ ID NO: 7535 - DNA, 20 bp, Artificial Sequence
  chemically synthesized
ttctagtaaggtatattgta

SEQ ID NO: 7536 - DNA, 20 bp, Artificial Sequence
  chemically synthesized
aaggtatattgtagagcctg

SEQ ID NO: 7537 - DNA, 20 bp, Artificial Sequence
  chemically synthesized
agaaatggagaattgaccac

SEQ ID NO: 7538 - DNA, 20 bp, Artificial Sequence
  chemically synthesized
gagaaatggagaattgacca

SEQ ID NO: 7539 - DNA, 20 bp, Artificial Sequence
  chemically synthesized
atgagcaattaggagaaatg

SEQ ID NO: 7540 - DNA, 20 bp, Artificial Sequence
  chemically synthesized
aaatgagcaattaggagaaa

SEQ ID NO: 7541 - DNA, 20 bp, Artificial Sequence
  chemically synthesized
aaatataaatgagcaattag

SEQ ID NO: 7542 - DNA, 20 bp, Artificial Sequence
  chemically synthesized
agaaatataaatgagcaatt

SEQ ID NO: 7543 - DNA, 20 bp, Artificial Sequence
  chemically synthesized
aagaaatataaatgagcaat

SEQ ID NO: 7544 - DNA, 20 bp, Artificial Sequence
  chemically synthesized
aaaagataagaaatataaat

SEQ ID NO: 7545 - DNA, 20 bp, Artificial Sequence
  chemically synthesized
caacactcacagaaaaagat

SEQ ID NO: 7546 - DNA, 20 bp, Artificial Sequence
  chemically synthesized
tatttcttatctttttctgt

SEQ ID NO: 7547 - DNA, 20 bp, Artificial Sequence
  chemically synthesized
gtgtacaacactcacagaaa

SEQ ID NO: 7548 - DNA, 20 bp, Artificial Sequence
  chemically synthesized
gttactgtgtacaacactca

SEQ ID NO: 7549 - DNA, 20 bp, Artificial Sequence
  chemically synthesized
ttttctgtgagtgttgtaca

SEQ ID NO: 7550 - DNA, 20 bp, Artificial Sequence
  chemically synthesized
gttgtacacagtaacattct

SEQ ID NO: 7551 - DNA, 20 bp, Artificial Sequence
  chemically synthesized
gggaattagaagatgatgct

SEQ ID NO: 7552 - DNA, 20 bp, Artificial Sequence
  chemically synthesized
agagaaggcaagggaattag

SEQ ID NO: 7553 - DNA, 20 bp, Artificial Sequence
  chemically synthesized
gtcagagaaggcaagggaat

SEQ ID NO: 7554 - DNA, 20 bp, Artificial Sequence
  chemically synthesized
tgtcctgtcagagaaggcaa

SEQ ID NO: 7555 - DNA, 20 bp, Artificial Sequence
  chemically synthesized
ttgtcctgtcagagaaggca

SEQ ID NO: 7556 - DNA, 20 bp, Artificial Sequence
  chemically synthesized
tttgtcctgtcagagaaggc

SEQ ID NO: 7557 - DNA, 20 bp, Artificial Sequence
  chemically synthesized
aattcccttgccttctctga

SEQ ID NO: 7558 - DNA, 20 bp, Artificial Sequence
  chemically synthesized
agactttgtcctgtcagaga

SEQ ID NO: 7559 - DNA, 20 bp, Artificial Sequence
  chemically synthesized
attcccttgccttctctgac

SEQ ID NO: 7560 - DNA, 20 bp, Artificial Sequence
  chemically synthesized
tagactttgtcctgtcagag

SEQ ID NO: 7561 - DNA, 20 bp, Artificial Sequence
  chemically synthesized
ttctagactttgtcctgtca

SEQ ID NO: 7562 - DNA, 20 bp, Artificial Sequence
  chemically synthesized
aattctagactttgtcctgt

SEQ ID NO: 7563 - DNA, 20 bp, Artificial Sequence
  chemically synthesized
ttgccttctctgacaggaca

SEQ ID NO: 7564 - DNA, 20 bp, Artificial Sequence
  chemically synthesized
ttctctgacaggacaaagtc

SEQ ID NO: 7565 - DNA, 20 bp, Artificial Sequence
  chemically synthesized
tcaatatacaggataaattc

SEQ ID NO: 7566 - DNA, 20 bp, Artificial Sequence
  chemically synthesized
tagaatttatcctgtatatt

SEQ ID NO: 7567 - DNA, 20 bp, Artificial Sequence
  chemically synthesized
agttactaaactcaatatac

SEQ ID NO: 7568 - DNA, 20 bp, Artificial Sequence
  chemically synthesized
aagttactaaactcaatata

SEQ ID NO: 7569 - DNA, 20 bp, Artificial Sequence
  chemically synthesized
tttatcctgtatattgagtt

SEQ ID NO: 7570 - DNA, 20 bp, Artificial Sequence
  chemically synthesized
agtttagtaacttcaatgac

SEQ ID NO: 7571 - DNA, 20 bp, Artificial Sequence
  chemically synthesized
gccaaaaaaactagtcattg

SEQ ID NO: 7572 - DNA, 20 bp, Artificial Sequence
  chemically synthesized
acttcaatgactagtttttt

SEQ ID NO: 7573 - DNA, 20 bp, Artificial Sequence
  chemically synthesized
gatatctttgccaaaaaaac

SEQ ID NO: 7574 - DNA, 20 bp, Artificial Sequence
  chemically synthesized
aatgactagtttttttggca

SEQ ID NO: 7575 - DNA, 20 bp, Artificial Sequence
  chemically synthesized
ggcaaagatatctttgtttt

SEQ ID NO: 7576 - DNA, 20 bp, Artificial Sequence
  chemically synthesized
tgtaactaggtctgaaaaca

SEQ ID NO: 7577 - DNA, 20 bp, Artificial Sequence
  chemically synthesized
gatatctttgttttcagacc

SEQ ID NO: 7578 - DNA, 20 bp, Artificial Sequence
  chemically synthesized
gagatggatgaaatgtaact

SEQ ID NO: 7579 - DNA, 20 bp, Artificial Sequence
  chemically synthesized
agagatggatgaaatgtaac

SEQ ID NO: 7580 - DNA, 20 bp, Artificial Sequence
  chemically synthesized
aagaaactaagaaacagaga

SEQ ID NO: 7581 - DNA, 20 bp, Artificial Sequence
  chemically synthesized
tttcatccatctctgtttct

SEQ ID NO: 7582 - DNA, 20 bp, Artificial Sequence
  chemically synthesized
taacaagaaactaagaaaca

SEQ ID NO: 7583 - DNA, 20 bp, Artificial Sequence
  chemically synthesized
aataacaagaaactaagaaa

SEQ ID NO: 7584 - DNA, 20 bp, Artificial Sequence
  chemically synthesized
cgctaaaataacaagaaact

SEQ ID NO: 7585 - DNA, 20 bp, Artificial Sequence
  chemically synthesized
ttcttagtttcttgttattt

SEQ ID NO: 7586 - DNA, 20 bp, Artificial Sequence
  chemically synthesized
gtaccactcgctaaaataac

SEQ ID NO: 7587 - DNA, 20 bp, Artificial Sequence
  chemically synthesized
tagtttcttgttattttagc

SEQ ID NO: 7588 - DNA, 20 bp, Artificial Sequence
  chemically synthesized
tttcttgttattttagcgag

SEQ ID NO: 7589 - DNA, 20 bp, Artificial Sequence
  chemically synthesized
tgcttaaaggcataaataag

SEQ ID NO: 7590 - DNA, 20 bp, Artificial Sequence
  chemically synthesized
atgcttaaaggcataaataa

SEQ ID NO: 7591 - DNA, 20 bp, Artificial Sequence
  chemically synthesized
gatgcttaaaggcataaata

SEQ ID NO: 7592 - DNA, 20 bp, Artificial Sequence
  chemically synthesized
agatgcttaaaggcataaat

SEQ ID NO: 7593 - DNA, 20 bp, Artificial Sequence
  chemically synthesized
taccccttatttatgccttt

SEQ ID NO: 7594 - DNA, 20 bp, Artificial Sequence
  chemically synthesized
aaaaaaaaaaagatgcttaa

SEQ ID NO: 7595 - DNA, 20 bp, Artificial Sequence
  chemically synthesized
aaaaaaaaaaaagatgctta

SEQ ID NO: 7596 - DNA, 20 bp, Artificial Sequence
  chemically synthesized
ccatctcaaaaaaaaaaaaa

SEQ ID NO: 7597 - DNA, 20 bp, Artificial Sequence
  chemically synthesized
gcatcttttttttttttttt

SEQ ID NO: 7598 - DNA, 20 bp, Artificial Sequence
  chemically synthesized
ctttttttttttttttgaga

SEQ ID NO: 7599 - DNA, 20 bp, Artificial Sequence
  chemically synthesized
ttttttttttttttgagatg

SEQ ID NO: 7600 - DNA, 20 bp, Artificial Sequence
  chemically synthesized
tttttttttttttgagatgg

SEQ ID NO: 7601 - DNA, 20 bp, Artificial Sequence
  chemically synthesized
tttttttttgagatggaggc

SEQ ID NO: 7602 - DNA, 20 bp, Artificial Sequence
  chemically synthesized
ttttttttgagatggaggct

SEQ ID NO: 7603 - DNA, 20 bp, Artificial Sequence
  chemically synthesized
tttttttgagatggaggctg

SEQ ID NO: 7604 - DNA, 20 bp, Artificial Sequence
  chemically synthesized
ttgagatggaggctggggtg

SEQ ID NO: 7605 - DNA, 20 bp, Artificial Sequence
  chemically synthesized
gagatcgtgccactgcaccc

SEQ ID NO: 7606 - DNA, 20 bp, Artificial Sequence
  chemically synthesized
agatggaggctggggtgcag

SEQ ID NO: 7607 - DNA, 20 bp, Artificial Sequence
  chemically synthesized
ggtggtggttgcagtgagcg

SEQ ID NO: 7608 - DNA, 20 bp, Artificial Sequence
  chemically synthesized
gaggtggtggttgcagtgag

SEQ ID NO: 7609 - DNA, 20 bp, Artificial Sequence
  chemically synthesized
caggaggtggtggttgcagt

SEQ ID NO: 7610 - DNA, 20 bp, Artificial Sequence
  chemically synthesized
aacccaggaggtggtggttg

SEQ ID NO: 7611 - DNA, 20 bp, Artificial Sequence
  chemically synthesized
cgcttgaacccaggaggtgg

SEQ ID NO: 7612 - DNA, 20 bp, Artificial Sequence
  chemically synthesized
tcactgcaaccaccacctcc

SEQ ID NO: 7613 - DNA, 20 bp, Artificial Sequence
  chemically synthesized
cactgcaaccaccacctcct

SEQ ID NO: 7614 - DNA, 20 bp, Artificial Sequence
  chemically synthesized
agtcgcttgaacccaggagg

SEQ ID NO: 7615 - DNA, 20 bp, Artificial Sequence
  chemically synthesized
gagagtcgcttgaacccagg

SEQ ID NO: 7616 - DNA, 20 bp, Artificial Sequence
  chemically synthesized
ggagagtcgcttgaacccag

SEQ ID NO: 7617 - DNA, 20 bp, Artificial Sequence
  chemically synthesized
aaccaccacctcctgggttc

SEQ ID NO: 7618 - DNA, 20 bp, Artificial Sequence
  chemically synthesized
caggagagtcgcttgaaccc

SEQ ID NO: 7619 - DNA, 20 bp, Artificial Sequence
  chemically synthesized
gcaggagagtcgcttgaacc

SEQ ID NO: 7620 - DNA, 20 bp, Artificial Sequence
  chemically synthesized
ctcaggaggctgaggcagga

SEQ ID NO: 7621 - DNA, 20 bp, Artificial Sequence
  chemically synthesized
ttcaagcgactctcctgcct

SEQ ID NO: 7622 - DNA, 20 bp, Artificial Sequence
  chemically synthesized
tactcaggaggctgaggcag

SEQ ID NO: 7623 - DNA, 20 bp, Artificial Sequence
  chemically synthesized
gctactcaggaggctgaggc

SEQ ID NO: 7624 - DNA, 20 bp, Artificial Sequence
  chemically synthesized
agctactcaggaggctgagg

SEQ ID NO: 7625 - DNA, 20 bp, Artificial Sequence
  chemically synthesized
cccagctactcaggaggctg

SEQ ID NO: 7626 - DNA, 20 bp, Artificial Sequence
  chemically synthesized
tcccagctactcaggaggct

SEQ ID NO: 7627 - DNA, 20 bp, Artificial Sequence
  chemically synthesized
ctctcctgcctcagcctcct

SEQ ID NO: 7628 - DNA, 20 bp, Artificial Sequence
  chemically synthesized
tcctgcctcagcctcctgag

SEQ ID NO: 7629 - DNA, 20 bp, Artificial Sequence
  chemically synthesized
tgtaatcccagctactcagg

SEQ ID NO: 7630 - DNA, 20 bp, Artificial Sequence
  chemically synthesized
ctgtaatcccagctactcag

SEQ ID NO: 7631 - DNA, 20 bp, Artificial Sequence
  chemically synthesized
gcctcagcctcctgagtagc

SEQ ID NO: 7632 - DNA, 20 bp, Artificial Sequence
  chemically synthesized
acctgtaatcccagctactc

SEQ ID NO: 7633 - DNA, 20 bp, Artificial Sequence
  chemically synthesized
cctcagcctcctgagtagct

SEQ ID NO: 7634 - DNA, 20 bp, Artificial Sequence
  chemically synthesized
cacctgtaatcccagctact

SEQ ID NO: 7635 - DNA, 20 bp, Artificial Sequence
  chemically synthesized
ctcctgagtagctgggatta

SEQ ID NO: 7636 - DNA, 20 bp, Artificial Sequence
  chemically synthesized
tcctgagtagctgggattac

SEQ ID NO: 7637 - DNA, 20 bp, Artificial Sequence
  chemically synthesized
gtggcaggcacctgtaatcc

SEQ ID NO: 7638 - DNA, 20 bp, Artificial Sequence
  chemically synthesized
aattagctgggcatggtggc

SEQ ID NO: 7639 - DNA, 20 bp, Artificial Sequence
  chemically synthesized
aaattagctgggcatggtgg

SEQ ID NO: 7640 - DNA, 20 bp, Artificial Sequence
  chemically synthesized
caggtgcctgccaccatgcc

SEQ ID NO: 7641 - DNA, 20 bp, Artificial Sequence
  chemically synthesized
caaaaattagctgggcatgg

SEQ ID NO: 7642 - DNA, 20 bp, Artificial Sequence
  chemically synthesized
atacaaaaattagctgggca

SEQ ID NO: 7643 - DNA, 20 bp, Artificial Sequence
  chemically synthesized
taaaaatacaaaaattagct

SEQ ID NO: 7644 - DNA, 20 bp, Artificial Sequence
  chemically synthesized
ctaaaaatacaaaaattagc

SEQ ID NO: 7645 - DNA, 20 bp, Artificial Sequence
  chemically synthesized
tctactaaaaatacaaaaat

SEQ ID NO: 7646 - DNA, 20 bp, Artificial Sequence
  chemically synthesized
ccagctaatttttgtatttt

SEQ ID NO: 7647 - DNA, 20 bp, Artificial Sequence
  chemically synthesized
gctaatttttgtatttttag

SEQ ID NO: 7648 - DNA, 20 bp, Artificial Sequence
  chemically synthesized
taatttttgtatttttagta

SEQ ID NO: 7649 - DNA, 20 bp, Artificial Sequence
  chemically synthesized
aatttttgtatttttagtag

SEQ ID NO: 7650 - DNA, 20 bp, Artificial Sequence
  chemically synthesized
ttttgtatttttagtagagg

SEQ ID NO: 7651 - DNA, 20 bp, Artificial Sequence
  chemically synthesized
tttgtatttttagtagaggc

SEQ ID NO: 7652 - DNA, 20 bp, Artificial Sequence
  chemically synthesized
ttgtatttttagtagaggca

SEQ ID NO: 7653 - DNA, 20 bp, Artificial Sequence
  chemically synthesized
gaggcagggtttcaccatgt

SEQ ID NO: 7654 - DNA, 20 bp, Artificial Sequence
  chemically synthesized
aggcagggtttcaccatgtt

SEQ ID NO: 7655 - DNA, 20 bp, Artificial Sequence
  chemically synthesized
cagggtttcaccatgttggg

SEQ ID NO: 7656 - DNA, 20 bp, Artificial Sequence
  chemically synthesized
caagaacagcctgcccaaca

SEQ ID NO: 7657 - DNA, 20 bp, Artificial Sequence
  chemically synthesized
agggtttcaccatgttgggc

SEQ ID NO: 7658 - DNA, 20 bp, Artificial Sequence
  chemically synthesized
tgaggtcaggagttcaagaa

SEQ ID NO: 7659 - DNA, 20 bp, Artificial Sequence
  chemically synthesized
tcacctgaggtcaggagttc

SEQ ID NO: 7660 - DNA, 20 bp, Artificial Sequence
  chemically synthesized
tgttcttgaactcctgacct

SEQ ID NO: 7661 - DNA, 20 bp, Artificial Sequence
  chemically synthesized
ggtggatcacctgaggtcag

SEQ ID NO: 7662 - DNA, 20 bp, Artificial Sequence
  chemically synthesized
gttcttgaactcctgacctc

SEQ ID NO: 7663 - DNA, 20 bp, Artificial Sequence
  chemically synthesized
tgggtggatcacctgaggtc

SEQ ID NO: 7664 - DNA, 20 bp, Artificial Sequence
  chemically synthesized
atgggtggatcacctgaggt

SEQ ID NO: 7665 - DNA, 20 bp, Artificial Sequence
  chemically synthesized
tgagatgggtggatcacctg

SEQ ID NO: 7666 - DNA, 20 bp, Artificial Sequence
  chemically synthesized
ctgagatgggtggatcacct

SEQ ID NO: 7667 - DNA, 20 bp, Artificial Sequence
  chemically synthesized
ctcaggtgatccacccatct

SEQ ID NO: 7668 - DNA, 20 bp, Artificial Sequence
  chemically synthesized
ctctgggaggctgagatggg

SEQ ID NO: 7669 - DNA, 20 bp, Artificial Sequence
  chemically synthesized
gcactctgggaggctgagat

SEQ ID NO: 7670 - DNA, 20 bp, Artificial Sequence
  chemically synthesized
agcactctgggaggctgaga

SEQ ID NO: 7671 - DNA, 20 bp, Artificial Sequence
  chemically synthesized
atccacccatctcagcctcc

SEQ ID NO: 7672 - DNA, 20 bp, Artificial Sequence
  chemically synthesized
tcccagcactctgggaggct

SEQ ID NO: 7673 - DNA, 20 bp, Artificial Sequence
  chemically synthesized
ccacccatctcagcctccca

SEQ ID NO: 7674 - DNA, 20 bp, Artificial Sequence
  chemically synthesized
tgtaatcccagcactctggg

SEQ ID NO: 7675 - DNA, 20 bp, Artificial Sequence
  chemically synthesized
ctgtaatcccagcactctgg

SEQ ID NO: 7676 - DNA, 20 bp, Artificial Sequence
  chemically synthesized
atctcagcctcccagagtgc

SEQ ID NO: 7677 - DNA, 20 bp, Artificial Sequence
  chemically synthesized
gcctgtaatcccagcactct

SEQ ID NO: 7678 - DNA, 20 bp, Artificial Sequence
  chemically synthesized
tctcagcctcccagagtgct

SEQ ID NO: 7679 - DNA, 20 bp, Artificial Sequence
  chemically synthesized
cgcctgtaatcccagcactc

SEQ ID NO: 7680 - DNA, 20 bp, Artificial Sequence
  chemically synthesized
ctcccagagtgctgggatta

SEQ ID NO: 7681 - DNA, 20 bp, Artificial Sequence
  chemically synthesized
tcccagagtgctgggattac

SEQ ID NO: 7682 - DNA, 20 bp, Artificial Sequence
  chemically synthesized
gtggctcacgcctgtaatcc

SEQ ID NO: 7683 - DNA, 20 bp, Artificial Sequence
  chemically synthesized
agtgctgggattacaggcgt

SEQ ID NO: 7684 - DNA, 20 bp, Artificial Sequence
  chemically synthesized
caggcgtgagccactgcacc

SEQ ID NO: 7685 - DNA, 20 bp, Artificial Sequence
  chemically synthesized
gatgctcagaccaggtgcag

SEQ ID NO: 7686 - DNA, 20 bp, Artificial Sequence
  chemically synthesized
taagatgctcagaccaggtg

SEQ ID NO: 7687 - DNA, 20 bp, Artificial Sequence
  chemically synthesized
tgagccactgcacctggtct

SEQ ID NO: 7688 - DNA, 20 bp, Artificial Sequence
  chemically synthesized
acatttaagatgctcagacc

SEQ ID NO: 7689 - DNA, 20 bp, Artificial Sequence
  chemically synthesized
tacatttaagatgctcagac

SEQ ID NO: 7690 - DNA, 20 bp, Artificial Sequence
  chemically synthesized
ttacttacatttaagatgct

SEQ ID NO: 7691 - DNA, 20 bp, Artificial Sequence
  chemically synthesized
ggtctgagcatcttaaatgt

SEQ ID NO: 7692 - DNA, 20 bp, Artificial Sequence
  chemically synthesized
aaagatttttacttacattt

SEQ ID NO: 7693 - DNA, 20 bp, Artificial Sequence
  chemically synthesized
aataatacactagtacaaca

SEQ ID NO: 7694 - DNA, 20 bp, Artificial Sequence
  chemically synthesized
agtaaaaatctttgttgtac

SEQ ID NO: 7695 - DNA, 20 bp, Artificial Sequence
  chemically synthesized
aagaaagcaaaataatacac

SEQ ID NO: 7696 - DNA, 20 bp, Artificial Sequence
  chemically synthesized
tgtattattttgctttcttc

SEQ ID NO: 7697 - DNA, 20 bp, Artificial Sequence
  chemically synthesized
gatgaattaattctagaaga

SEQ ID NO: 7698 - DNA, 20 bp, Artificial Sequence
  chemically synthesized
aaaagatgaattaattctag

SEQ ID NO: 7699 - DNA, 20 bp, Artificial Sequence
  chemically synthesized
aaaaaaagatgaattaattc

SEQ ID NO: 7700 - DNA, 20 bp, Artificial Sequence
  chemically synthesized
ccctatctcaaaaaaaaaaa

SEQ ID NO: 7701 - DNA, 20 bp, Artificial Sequence
  chemically synthesized
attcatcttttttttttttt

SEQ ID NO: 7702 - DNA, 20 bp, Artificial Sequence
  chemically synthesized
atctttttttttttttgaga

SEQ ID NO: 7703 - DNA, 20 bp, Artificial Sequence
  chemically synthesized
tctttttttttttttgagat

SEQ ID NO: 7704 - DNA, 20 bp, Artificial Sequence
  chemically synthesized
ctttttttttttttgagata

SEQ ID NO: 7705 - DNA, 20 bp, Artificial Sequence
  chemically synthesized
tccatcctgggcaacagagt

SEQ ID NO: 7706 - DNA, 20 bp, Artificial Sequence
  chemically synthesized
tagggtctcactctgttgcc

SEQ ID NO: 7707 - DNA, 20 bp, Artificial Sequence
  chemically synthesized
gcactccatcctgggcaaca

SEQ ID NO: 7708 - DNA, 20 bp, Artificial Sequence
  chemically synthesized
agggtctcactctgttgccc

SEQ ID NO: 7709 - DNA, 20 bp, Artificial Sequence
  chemically synthesized
ctgcactccatcctgggcaa

SEQ ID NO: 7710 - DNA, 20 bp, Artificial Sequence
  chemically synthesized
tctcactctgttgcccagga

SEQ ID NO: 7711 - DNA, 20 bp, Artificial Sequence
  chemically synthesized
tcactctgttgcccaggatg

SEQ ID NO: 7712 - DNA, 20 bp, Artificial Sequence
  chemically synthesized
gtgccactgcactccatcct

SEQ ID NO: 7713 - DNA, 20 bp, Artificial Sequence
  chemically synthesized
tgtgccactgcactccatcc

SEQ ID NO: 7714 - DNA, 20 bp, Artificial Sequence
  chemically synthesized
ctgttgcccaggatggagtg

SEQ ID NO: 7715 - DNA, 20 bp, Artificial Sequence
  chemically synthesized
ttgcccaggatggagtgcag

SEQ ID NO: 7716 - DNA, 20 bp, Artificial Sequence
  chemically synthesized
ggagtgcagtggcacaatta

SEQ ID NO: 7717 - DNA, 20 bp, Artificial Sequence
  chemically synthesized
ggcacaattatggctcaatg

SEQ ID NO: 7718 - DNA, 20 bp, Artificial Sequence
  chemically synthesized
caggaggatgaggctgcatt

SEQ ID NO: 7719 - DNA, 20 bp, Artificial Sequence
  chemically synthesized
cgcttgagcccaggaggatg

SEQ ID NO: 7720 - DNA, 20 bp, Artificial Sequence
  chemically synthesized
tcaatgcagcctcatcctcc

SEQ ID NO: 7721 - DNA, 20 bp, Artificial Sequence
  chemically synthesized
tcgcttgagcccaggaggat

SEQ ID NO: 7722 - DNA, 20 bp, Artificial Sequence
  chemically synthesized
caatgcagcctcatcctcct

SEQ ID NO: 7723 - DNA, 20 bp, Artificial Sequence
  chemically synthesized
gaggatcgcttgagcccagg

SEQ ID NO: 7724 - DNA, 20 bp, Artificial Sequence
  chemically synthesized
ggaggatcgcttgagcccag

SEQ ID NO: 7725 - DNA, 20 bp, Artificial Sequence
  chemically synthesized
agcctcatcctcctgggctc

SEQ ID NO: 7726 - DNA, 20 bp, Artificial Sequence
  chemically synthesized
taggaggatcgcttgagccc

SEQ ID NO: 7727 - DNA, 20 bp, Artificial Sequence
  chemically synthesized
ataggaggatcgcttgagcc

SEQ ID NO: 7728 - DNA, 20 bp, Artificial Sequence
  chemically synthesized
ctgagataggaggatcgctt

SEQ ID NO: 7729 - DNA, 20 bp, Artificial Sequence
  chemically synthesized
ctcaagcgatcctcctatct

SEQ ID NO: 7730 - DNA, 20 bp, Artificial Sequence
  chemically synthesized
actcaggaggctgagatagg

SEQ ID NO: 7731 - DNA, 20 bp, Artificial Sequence
  chemically synthesized
tactcaggaggctgagatag

SEQ ID NO: 7732 - DNA, 20 bp, Artificial Sequence
  chemically synthesized
actactcaggaggctgagat

SEQ ID NO: 7733 - DNA, 20 bp, Artificial Sequence
  chemically synthesized
aactactcaggaggctgaga

SEQ ID NO: 7734 - DNA, 20 bp, Artificial Sequence
  chemically synthesized
tcccaactactcaggaggct

SEQ ID NO: 7735 - DNA, 20 bp, Artificial Sequence
  chemically synthesized
tcctcctatctcagcctcct

SEQ ID NO: 7736 - DNA, 20 bp, Artificial Sequence
  chemically synthesized
tcctatctcagcctcctgag

SEQ ID NO: 7737 - DNA, 20 bp, Artificial Sequence
  chemically synthesized
tgtagtcccaactactcagg

SEQ ID NO: 7738 - DNA, 20 bp, Artificial Sequence
  chemically synthesized
ctgtagtcccaactactcag

SEQ ID NO: 7739 - DNA, 20 bp, Artificial Sequence
  chemically synthesized
atctcagcctcctgagtagt

SEQ ID NO: 7740 - DNA, 20 bp, Artificial Sequence
  chemically synthesized
gcctgtagtcccaactactc

SEQ ID NO: 7741 - DNA, 20 bp, Artificial Sequence
  chemically synthesized
tctcagcctcctgagtagtt

SEQ ID NO: 7742 - DNA, 20 bp, Artificial Sequence
  chemically synthesized
tgcctgtagtcccaactact

SEQ ID NO: 7743 - DNA, 20 bp, Artificial Sequence
  chemically synthesized
ctcctgagtagttgggacta

SEQ ID NO: 7744 - DNA, 20 bp, Artificial Sequence
  chemically synthesized
tcctgagtagttgggactac

SEQ ID NO: 7745 - DNA, 20 bp, Artificial Sequence
  chemically synthesized
ggagtggtggtacatgcctg

SEQ ID NO: 7746 - DNA, 20 bp, Artificial Sequence
  chemically synthesized
caggcatgtaccaccactcc

SEQ ID NO: 7747 - DNA, 20 bp, Artificial Sequence
  chemically synthesized
aatatattagccaggagtgg

SEQ ID NO: 7748 - DNA, 20 bp, Artificial Sequence
  chemically synthesized
taaaatatattagccaggag

SEQ ID NO: 7749 - DNA, 20 bp, Artificial Sequence
  chemically synthesized
atttaaaatatattagccag

SEQ ID NO: 7750 - DNA, 20 bp, Artificial Sequence
  chemically synthesized
taatttaaaatatattagcc

SEQ ID NO: 7751 - DNA, 20 bp, Artificial Sequence
  chemically synthesized
ataatttaaaatatattagc

SEQ ID NO: 7752 - DNA, 20 bp, Artificial Sequence
  chemically synthesized
aaaaataatttaaaatatat

SEQ ID NO: 7753 - DNA, 20 bp, Artificial Sequence
  chemically synthesized
attttaaattattttttgta

SEQ ID NO: 7754 - DNA, 20 bp, Artificial Sequence
  chemically synthesized
taaattattttttgtaaaga

SEQ ID NO: 7755 - DNA, 20 bp, Artificial Sequence
  chemically synthesized
ctagccagggcaatgtagtg

SEQ ID NO: 7756 - DNA, 20 bp, Artificial Sequence
  chemically synthesized
actagccagggcaatgtagt

SEQ ID NO: 7757 - DNA, 20 bp, Artificial Sequence
  chemically synthesized
tgagactagccagggcaatg

SEQ ID NO: 7758 - DNA, 20 bp, Artificial Sequence
  chemically synthesized
ggcacctcactacattgccc

SEQ ID NO: 7759 - DNA, 20 bp, Artificial Sequence
  chemically synthesized
cctcactacattgccctggc

SEQ ID NO: 7760 - DNA, 20 bp, Artificial Sequence
  chemically synthesized
caggtgtttgagactagcca

SEQ ID NO: 7761 - DNA, 20 bp, Artificial Sequence
  chemically synthesized
ccaggtgtttgagactagcc

SEQ ID NO: 7762 - DNA, 20 bp, Artificial Sequence
  chemically synthesized
cccaggtgtttgagactagc

SEQ ID NO: 7763 - DNA, 20 bp, Artificial Sequence
  chemically synthesized
tgtgcccaggtgtttgagac

SEQ ID NO: 7764 - DNA, 20 bp, Artificial Sequence
  chemically synthesized
cctggctagtctcaaacacc

SEQ ID NO: 7765 - DNA, 20 bp, Artificial Sequence
  chemically synthesized
ctgcttgtgcccaggtgttt

SEQ ID NO: 7766 - DNA, 20 bp, Artificial Sequence
  chemically synthesized
ctggctagtctcaaacacct

SEQ ID NO: 7767 - DNA, 20 bp, Artificial Sequence
  chemically synthesized
agtctcaaacacctgggcac

SEQ ID NO: 7768 - DNA, 20 bp, Artificial Sequence
  chemically synthesized
tgggaggactgcttgtgccc

SEQ ID NO: 7769 - DNA, 20 bp, Artificial Sequence
  chemically synthesized
gtgggaggactgcttgtgcc

SEQ ID NO: 7770 - DNA, 20 bp, Artificial Sequence
  chemically synthesized
ctcaaacacctgggcacaag

SEQ ID NO: 7771 - DNA, 20 bp, Artificial Sequence
  chemically synthesized
cacaagcagtcctcccacct

SEQ ID NO: 7772 - DNA, 20 bp, Artificial Sequence
  chemically synthesized
ctttgggaggccaaggtggg

SEQ ID NO: 7773 - DNA, 20 bp, Artificial Sequence
  chemically synthesized
actttgggaggccaaggtgg

SEQ ID NO: 7774 - DNA, 20 bp, Artificial Sequence
  chemically synthesized
tcactttgggaggccaaggt

SEQ ID NO: 7775 - DNA, 20 bp, Artificial Sequence
  chemically synthesized
atcactttgggaggccaagg

SEQ ID NO: 7776 - DNA, 20 bp, Artificial Sequence
  chemically synthesized
cctatcactttgggaggcca

SEQ ID NO: 7777 - DNA, 20 bp, Artificial Sequence
  chemically synthesized
tcctatcactttgggaggcc

SEQ ID NO: 7778 - DNA, 20 bp, Artificial Sequence
  chemically synthesized
cctcccaccttggcctccca

SEQ ID NO: 7779 - DNA, 20 bp, Artificial Sequence
  chemically synthesized
tgtaatcctatcactttggg

SEQ ID NO: 7780 - DNA, 20 bp, Artificial Sequence
  chemically synthesized
ctgtaatcctatcactttgg

SEQ ID NO: 7781 - DNA, 20 bp, Artificial Sequence
  chemically synthesized
accttggcctcccaaagtga

SEQ ID NO: 7782 - DNA, 20 bp, Artificial Sequence
  chemically synthesized
acctgtaatcctatcacttt

SEQ ID NO: 7783 - DNA, 20 bp, Artificial Sequence
  chemically synthesized
ccttggcctcccaaagtgat

SEQ ID NO: 7784 - DNA, 20 bp, Artificial Sequence
  chemically synthesized
cacctgtaatcctatcactt

SEQ ID NO: 7785 - DNA, 20 bp, Artificial Sequence
  chemically synthesized
ctcccaaagtgataggatta

SEQ ID NO: 7786 - DNA, 20 bp, Artificial Sequence
  chemically synthesized
tcccaaagtgataggattac

SEQ ID NO: 7787 - DNA, 20 bp, Artificial Sequence
  chemically synthesized
agtgataggattacaggtgt

SEQ ID NO: 7788 - DNA, 20 bp, Artificial Sequence
  chemically synthesized
caggtgtgagccactgttcc

SEQ ID NO: 7789 - DNA, 20 bp, Artificial Sequence
  chemically synthesized
gtgaattaggctgggaacag

SEQ ID NO: 7790 - DNA, 20 bp, Artificial Sequence
  chemically synthesized
aaagtgaattaggctgggaa

SEQ ID NO: 7791 - DNA, 20 bp, Artificial Sequence
  chemically synthesized
atcaaaaagtgaattaggct

SEQ ID NO: 7792 - DNA, 20 bp, Artificial Sequence
  chemically synthesized
catcaaaaagtgaattaggc

SEQ ID NO: 7793 - DNA, 20 bp, Artificial Sequence
  chemically synthesized
taaacatcaaaaagtgaatt

SEQ ID NO: 7794 - DNA, 20 bp, Artificial Sequence
  chemically synthesized
ttaaacatcaaaaagtgaat

SEQ ID NO: 7795 - DNA, 20 bp, Artificial Sequence
  chemically synthesized
cacccaagttaaacatcaaa

SEQ ID NO: 7796 - DNA, 20 bp, Artificial Sequence
  chemically synthesized
tcactttttgatgtttaact

SEQ ID NO: 7797 - DNA, 20 bp, Artificial Sequence
  chemically synthesized
cactttttgatgtttaactt

SEQ ID NO: 7798 - DNA, 20 bp, Artificial Sequence
  chemically synthesized
tttttgatgtttaacttggg

SEQ ID NO: 7799 - DNA, 20 bp, Artificial Sequence
  chemically synthesized
ttttgatgtttaacttgggt

SEQ ID NO: 7800 - DNA, 20 bp, Artificial Sequence
  chemically synthesized
tttgatgtttaacttgggtg

SEQ ID NO: 7801 - DNA, 20 bp, Artificial Sequence
  chemically synthesized
ttgatgtttaacttgggtgg

SEQ ID NO: 7802 - DNA, 20 bp, Artificial Sequence
  chemically synthesized
tgatgtttaacttgggtggg

SEQ ID NO: 7803 - DNA, 20 bp, Artificial Sequence
  chemically synthesized
tgggatagcaccccccaccc

SEQ ID NO: 7804 - DNA, 20 bp, Artificial Sequence
  chemically synthesized
aaatacatgaagaaatggga

SEQ ID NO: 7805 - DNA, 20 bp, Artificial Sequence
  chemically synthesized
tccaaaatacatgaagaaat

SEQ ID NO: 7806 - DNA, 20 bp, Artificial Sequence
  chemically synthesized
atccaaaatacatgaagaaa

SEQ ID NO: 7807 - DNA, 20 bp, Artificial Sequence
  chemically synthesized
atcacgatccaaaatacatg

SEQ ID NO: 7808 - DNA, 20 bp, Artificial Sequence
  chemically synthesized
tcccatttcttcatgtattt

SEQ ID NO: 7809 - DNA, 20 bp, Artificial Sequence
  chemically synthesized
atgtattttggatcgtgatt

SEQ ID NO: 7810 - DNA, 20 bp, Artificial Sequence
  chemically synthesized
gtattttggatcgtgatttg

SEQ ID NO: 7811 - DNA, 20 bp, Artificial Sequence
  chemically synthesized
gatttggagacaaattttgc

SEQ ID NO: 7812 - DNA, 20 bp, Artificial Sequence
  chemically synthesized
atttggagacaaattttgca

SEQ ID NO: 7813 - DNA, 20 bp, Artificial Sequence
  chemically synthesized
tttggagacaaattttgcaa

SEQ ID NO: 7814 - DNA, 20 bp, Artificial Sequence
  chemically synthesized
gtacacacacatgagaataa

SEQ ID NO: 7815 - DNA, 20 bp, Artificial Sequence
  chemically synthesized
atattaaagtacacacacat

SEQ ID NO: 7816 - DNA, 20 bp, Artificial Sequence
  chemically synthesized
aaaaagagaggaaaatatta

SEQ ID NO: 7817 - DNA, 20 bp, Artificial Sequence
  chemically synthesized
gataatgagtttaaaaagag

SEQ ID NO: 7818 - DNA, 20 bp, Artificial Sequence
  chemically synthesized
agataatgagtttaaaaaga

SEQ ID NO: 7819 - DNA, 20 bp, Artificial Sequence
  chemically synthesized
agagataatgagtttaaaaa

SEQ ID NO: 7820 - DNA, 20 bp, Artificial Sequence
  chemically synthesized
agagagataatgagtttaaa

SEQ ID NO: 7821 - DNA, 20 bp, Artificial Sequence
  chemically synthesized
ccacctgagagagagataat

SEQ ID NO: 7822 - DNA, 20 bp, Artificial Sequence
  chemically synthesized
taaactcattatctctctct

SEQ ID NO: 7823 - DNA, 20 bp, Artificial Sequence
  chemically synthesized
aaactcattatctctctctc

SEQ ID NO: 7824 - DNA, 20 bp, Artificial Sequence
  chemically synthesized
ccataaaaccacctgagaga

SEQ ID NO: 7825 - DNA, 20 bp, Artificial Sequence
  chemically synthesized
ctcattatctctctctcagg

SEQ ID NO: 7826 - DNA, 20 bp, Artificial Sequence
  chemically synthesized
agccataaaaccacctgaga

SEQ ID NO: 7827 - DNA, 20 bp, Artificial Sequence
  chemically synthesized
gaagccataaaaccacctga

SEQ ID NO: 7828 - DNA, 20 bp, Artificial Sequence
  chemically synthesized
gagaagccataaaaccacct

SEQ ID NO: 7829 - DNA, 20 bp, Artificial Sequence
  chemically synthesized
ctctctctcaggtggtttta

SEQ ID NO: 7830 - DNA, 20 bp, Artificial Sequence
  chemically synthesized
ggtggttttatggcttctcc

SEQ ID NO: 7831 - DNA, 20 bp, Artificial Sequence
  chemically synthesized
cccctgggtatggctgggag

SEQ ID NO: 7832 - DNA, 20 bp, Artificial Sequence
  chemically synthesized
aagcccctgggtatggctgg

SEQ ID NO: 7833 - DNA, 20 bp, Artificial Sequence
  chemically synthesized
ctaagcccctgggtatggct

SEQ ID NO: 7834 - DNA, 20 bp, Artificial Sequence
  chemically synthesized
tctaagcccctgggtatggc

SEQ ID NO: 7835 - DNA, 20 bp, Artificial Sequence
  chemically synthesized
tggcttctcccagccatacc

SEQ ID NO: 7836 - DNA, 20 bp, Artificial Sequence
  chemically synthesized
ggcttctcccagccataccc

SEQ ID NO: 7837 - DNA, 20 bp, Artificial Sequence
  chemically synthesized
gcttctcccagccataccca

SEQ ID NO: 7838 - DNA, 20 bp, Artificial Sequence
  chemically synthesized
cttctcccagccatacccag

SEQ ID NO: 7839 - DNA, 20 bp, Artificial Sequence
  chemically synthesized
aaactctaagcccctgggta

SEQ ID NO: 7840 - DNA, 20 bp, Artificial Sequence
  chemically synthesized
cccagccatacccaggggct

SEQ ID NO: 7841 - DNA, 20 bp, Artificial Sequence
  chemically synthesized
gctctaaactctaagcccct

SEQ ID NO: 7842 - DNA, 20 bp, Artificial Sequence
  chemically synthesized
ggctctaaactctaagcccc

SEQ ID NO: 7843 - DNA, 20 bp, Artificial Sequence
  chemically synthesized
cagccatacccaggggctta

SEQ ID NO: 7844 - DNA, 20 bp, Artificial Sequence
  chemically synthesized
atacccaggggcttagagtt

SEQ ID NO: 7845 - DNA, 20 bp, Artificial Sequence
  chemically synthesized
cagatgtggctctaaactct

SEQ ID NO: 7846 - DNA, 20 bp, Artificial Sequence
  chemically synthesized
acccaggggcttagagttta

SEQ ID NO: 7847 - DNA, 20 bp, Artificial Sequence
  chemically synthesized
gagtttagagccacatctgt

SEQ ID NO: 7848 - DNA, 20 bp, Artificial Sequence
  chemically synthesized
ctgcaaactaccaacagatg

SEQ ID NO: 7849 - DNA, 20 bp, Artificial Sequence
  chemically synthesized
tttagagccacatctgttgg

SEQ ID NO: 7850 - DNA, 20 bp, Artificial Sequence
  chemically synthesized
taggagctgcaaactaccaa

SEQ ID NO: 7851 - DNA, 20 bp, Artificial Sequence
  chemically synthesized
ccacatctgttggtagtttg

SEQ ID NO: 7852 - DNA, 20 bp, Artificial Sequence
  chemically synthesized
tagtttgcagctcctacact

SEQ ID NO: 7853 - DNA, 20 bp, Artificial Sequence
  chemically synthesized
ctctgtatcactcagtgtag

SEQ ID NO: 7854 - DNA, 20 bp, Artificial Sequence
  chemically synthesized
atctctgtatcactcagtgt

SEQ ID NO: 7855 - DNA, 20 bp, Artificial Sequence
  chemically synthesized
tatctctgtatcactcagtg

SEQ ID NO: 7856 - DNA, 20 bp, Artificial Sequence
  chemically synthesized
agctcctacactgagtgata

SEQ ID NO: 7857 - DNA, 20 bp, Artificial Sequence
  chemically synthesized
agtgatatctctgtatcact

SEQ ID NO: 7858 - DNA, 20 bp, Artificial Sequence
  chemically synthesized
ctcctacactgagtgataca

SEQ ID NO: 7859 - DNA, 20 bp, Artificial Sequence
  chemically synthesized
ctactgcctggcaatgaaat

SEQ ID NO: 7860 - DNA, 20 bp, Artificial Sequence
  chemically synthesized
gatatcactcatttcattgc

SEQ ID NO: 7861 - DNA, 20 bp, Artificial Sequence
  chemically synthesized
atatcactcatttcattgcc

SEQ ID NO: 7862 - DNA, 20 bp, Artificial Sequence
  chemically synthesized
tcactcatttcattgccagg

SEQ ID NO: 7863 - DNA, 20 bp, Artificial Sequence
  chemically synthesized
ctcatttcattgccaggcag

SEQ ID NO: 7864 - DNA, 20 bp, Artificial Sequence
  chemically synthesized
tcatttcattgccaggcagt

SEQ ID NO: 7865 - DNA, 20 bp, Artificial Sequence
  chemically synthesized
gaaccaatctacctactgcc

SEQ ID NO: 7866 - DNA, 20 bp, Artificial Sequence
  chemically synthesized
tttcattgccaggcagtagg

SEQ ID NO: 7867 - DNA, 20 bp, Artificial Sequence
  chemically synthesized
ttgccaggcagtaggtagat

SEQ ID NO: 7868 - DNA, 20 bp, Artificial Sequence
  chemically synthesized
aggcagtaggtagattggtt

SEQ ID NO: 7869 - DNA, 20 bp, Artificial Sequence
  chemically synthesized
ggcagtaggtagattggttc

SEQ ID NO: 7870 - DNA, 20 bp, Artificial Sequence
  chemically synthesized
aggtagattggttcaggtcc

SEQ ID NO: 7871 - DNA, 20 bp, Artificial Sequence
  chemically synthesized
ttggttcaggtcctggtttc

SEQ ID NO: 7872 - DNA, 20 bp, Artificial Sequence
  chemically synthesized
tggttcaggtcctggtttca

SEQ ID NO: 7873 - DNA, 20 bp, Artificial Sequence
  chemically synthesized
agcatcacagccttgaaacc

SEQ ID NO: 7874 - DNA, 20 bp, Artificial Sequence
  chemically synthesized
gagcatcacagccttgaaac

SEQ ID NO: 7875 - DNA, 20 bp, Artificial Sequence
  chemically synthesized
agttgggaaagagagcatca

SEQ ID NO: 7876 - DNA, 20 bp, Artificial Sequence
  chemically synthesized
agattcgcagttgggaaaga

SEQ ID NO: 7877 - DNA, 20 bp, Artificial Sequence
  chemically synthesized
aaagattcgcagttgggaaa

SEQ ID NO: 7878 - DNA, 20 bp, Artificial Sequence
  chemically synthesized
gcaaagattcgcagttggga

SEQ ID NO: 7879 - DNA, 20 bp, Artificial Sequence
  chemically synthesized
agaggcaaagattcgcagtt

SEQ ID NO: 7880 - DNA, 20 bp, Artificial Sequence
  chemically synthesized
aagaggcaaagattcgcagt

SEQ ID NO: 7881 - DNA, 20 bp, Artificial Sequence
  chemically synthesized
agggaagaggcaaagattcg

SEQ ID NO: 7882 - DNA, 20 bp, Artificial Sequence
  chemically synthesized
tagagccgagggaagaggca

SEQ ID NO: 7883 - DNA, 20 bp, Artificial Sequence
  chemically synthesized
cgaatctttgcctcttccct

SEQ ID NO: 7884 - DNA, 20 bp, Artificial Sequence
  chemically synthesized
atgcatagagccgagggaag

SEQ ID NO: 7885 - DNA, 20 bp, Artificial Sequence
  chemically synthesized
aatgcatagagccgagggaa

SEQ ID NO: 7886 - DNA, 20 bp, Artificial Sequence
  chemically synthesized
ctaatgcatagagccgaggg

SEQ ID NO: 7887 - DNA, 20 bp, Artificial Sequence
  chemically synthesized
gccctaatgcatagagccga

SEQ ID NO: 7888 - DNA, 20 bp, Artificial Sequence
  chemically synthesized
ggccctaatgcatagagccg

SEQ ID NO: 7889 - DNA, 20 bp, Artificial Sequence
  chemically synthesized
tggccctaatgcatagagcc

SEQ ID NO: 7890 - DNA, 20 bp, Artificial Sequence
  chemically synthesized
cttccctcggctctatgcat

SEQ ID NO: 7891 - DNA, 20 bp, Artificial Sequence
  chemically synthesized
agctatggccctaatgcata

SEQ ID NO: 7892 - DNA, 20 bp, Artificial Sequence
  chemically synthesized
ttccctcggctctatgcatt

SEQ ID NO: 7893 - DNA, 20 bp, Artificial Sequence
  chemically synthesized
tccctcggctctatgcatta

SEQ ID NO: 7894 - DNA, 20 bp, Artificial Sequence
  chemically synthesized
gcagctatggccctaatgca

SEQ ID NO: 7895 - DNA, 20 bp, Artificial Sequence
  chemically synthesized
ggctctatgcattagggcca

SEQ ID NO: 7896 - DNA, 20 bp, Artificial Sequence
  chemically synthesized
ctacagcttatatgcagcta

SEQ ID NO: 7897 - DNA, 20 bp, Artificial Sequence
  chemically synthesized
ttagggccatagctgcatat

SEQ ID NO: 7898 - DNA, 20 bp, Artificial Sequence
  chemically synthesized
aagggtctacagcttatatg

SEQ ID NO: 7899 - DNA, 20 bp, Artificial Sequence
  chemically synthesized
ccatagctgcatataagctg

SEQ ID NO: 7900 - DNA, 20 bp, Artificial Sequence
  chemically synthesized
cagtttgctgcaagggtcta

SEQ ID NO: 7901 - DNA, 20 bp, Artificial Sequence
  chemically synthesized
atataagctgtagacccttg

SEQ ID NO: 7902 - DNA, 20 bp, Artificial Sequence
  chemically synthesized
aaagaaacagtttgctgcaa

SEQ ID NO: 7903 - DNA, 20 bp, Artificial Sequence
  chemically synthesized
aaaagaaacagtttgctgca

SEQ ID NO: 7904 - DNA, 20 bp, Artificial Sequence
  chemically synthesized
gaaaagaaacagtttgctgc

SEQ ID NO: 7905 - DNA, 20 bp, Artificial Sequence
  chemically synthesized
aaaagcaacatgaaaagaaa

SEQ ID NO: 7906 - DNA, 20 bp, Artificial Sequence
  chemically synthesized
acacttaaaagcaacatgaa

SEQ ID NO: 7907 - DNA, 20 bp, Artificial Sequence
  chemically synthesized
tttcttttcatgttgctttt

SEQ ID NO: 7908 - DNA, 20 bp, Artificial Sequence
  chemically synthesized
acatacacacttacacttaa

SEQ ID NO: 7909 - DNA, 20 bp, Artificial Sequence
  chemically synthesized
ttcatgttgcttttaagtgt

SEQ ID NO: 7910 - DNA, 20 bp, Artificial Sequence
  chemically synthesized
agtgtgtatgtgtctctctc

SEQ ID NO: 7911 - DNA, 20 bp, Artificial Sequence
  chemically synthesized
gtgtgtatgtgtctctctct

SEQ ID NO: 7912 - DNA, 20 bp, Artificial Sequence
  chemically synthesized
cacaaaaacacacctagaga

SEQ ID NO: 7913 - DNA, 20 bp, Artificial Sequence
  chemically synthesized
cccacaaaaacacacctaga

SEQ ID NO: 7914 - DNA, 20 bp, Artificial Sequence
  chemically synthesized
gccccacaaaaacacaccta

SEQ ID NO: 7915 - DNA, 20 bp, Artificial Sequence
  chemically synthesized
gagccccacaaaaacacacc

SEQ ID NO: 7916 - DNA, 20 bp, Artificial Sequence
  chemically synthesized
tctctctaggtgtgtttttg

SEQ ID NO: 7917 - DNA, 20 bp, Artificial Sequence
  chemically synthesized
ctctctaggtgtgtttttgt

SEQ ID NO: 7918 - DNA, 20 bp, Artificial Sequence
  chemically synthesized
tctctaggtgtgtttttgtg

SEQ ID NO: 7919 - DNA, 20 bp, Artificial Sequence
  chemically synthesized
aggattactatttgaaatca

SEQ ID NO: 7920 - DNA, 20 bp, Artificial Sequence
  chemically synthesized
ccaggattactatttgaaat

SEQ ID NO: 7921 - DNA, 20 bp, Artificial Sequence
  chemically synthesized
tgtggggctctgatttcaaa

SEQ ID NO: 7922 - DNA, 20 bp, Artificial Sequence
  chemically synthesized
ctgatttcaaatagtaatcc

SEQ ID NO: 7923 - DNA, 20 bp, Artificial Sequence
  chemically synthesized
tcaaatagtaatcctggctt

SEQ ID NO: 7924 - DNA, 20 bp, Artificial Sequence
  chemically synthesized
caaatagtaatcctggcttt

SEQ ID NO: 7925 - DNA, 20 bp, Artificial Sequence
  chemically synthesized
caaggtagtggcccaaagcc

SEQ ID NO: 7926 - DNA, 20 bp, Artificial Sequence
  chemically synthesized
acaaggtagtggcccaaagc

SEQ ID NO: 7927 - DNA, 20 bp, Artificial Sequence
  chemically synthesized
ccttacaaggtagtggccca

SEQ ID NO: 7928 - DNA, 20 bp, Artificial Sequence
  chemically synthesized
aaattctccttacaaggtag

SEQ ID NO: 7929 - DNA, 20 bp, Artificial Sequence
  chemically synthesized
gctttgggccactaccttgt

SEQ ID NO: 7930 - DNA, 20 bp, Artificial Sequence
  chemically synthesized
ctttgggccactaccttgta

SEQ ID NO: 7931 - DNA, 20 bp, Artificial Sequence
  chemically synthesized
ttaaaattctccttacaagg

SEQ ID NO: 7932 - DNA, 20 bp, Artificial Sequence
  chemically synthesized
ttgggccactaccttgtaag

SEQ ID NO: 7933 - DNA, 20 bp, Artificial Sequence
  chemically synthesized
ggattaaaattctccttaca

SEQ ID NO: 7934 - DNA, 20 bp, Artificial Sequence
  chemically synthesized
gggattaaaattctccttac

SEQ ID NO: 7935 - DNA, 20 bp, Artificial Sequence
  chemically synthesized
cagctcgtgctgtagtaaca

SEQ ID NO: 7936 - DNA, 20 bp, Artificial Sequence
  chemically synthesized
aattttaatccctgttacta

SEQ ID NO: 7937 - DNA, 20 bp, Artificial Sequence
  chemically synthesized
tcagctcgtgctgtagtaac

SEQ ID NO: 7938 - DNA, 20 bp, Artificial Sequence
  chemically synthesized
ttcagctcgtgctgtagtaa

SEQ ID NO: 7939 - DNA, 20 bp, Artificial Sequence
  chemically synthesized
aatccctgttactacagcac

SEQ ID NO: 7940 - DNA, 20 bp, Artificial Sequence
  chemically synthesized
tgggctttcagctcgtgctg

SEQ ID NO: 7941 - DNA, 20 bp, Artificial Sequence
  chemically synthesized
gttactacagcacgagctga

SEQ ID NO: 7942 - DNA, 20 bp, Artificial Sequence
  chemically synthesized
gggctaaattagtgggcttt

SEQ ID NO: 7943 - DNA, 20 bp, Artificial Sequence
  chemically synthesized
gagctgaaagcccactaatt

SEQ ID NO: 7944 - DNA, 20 bp, Artificial Sequence
  chemically synthesized
gtaagtggggctaaattagt

SEQ ID NO: 7945 - DNA, 20 bp, Artificial Sequence
  chemically synthesized
agtaagtggggctaaattag

SEQ ID NO: 7946 - DNA, 20 bp, Artificial Sequence
  chemically synthesized
aaaagtaagtggggctaaat

SEQ ID NO: 7947 - DNA, 20 bp, Artificial Sequence
  chemically synthesized
gaaaaaaaaaaaagtaagtg

SEQ ID NO: 7948 - DNA, 20 bp, Artificial Sequence
  chemically synthesized
agaaaaaaaaaaaagtaagt

SEQ ID NO: 7949 - DNA, 20 bp, Artificial Sequence
  chemically synthesized
aagaaaaaaaaaaaagtaag

SEQ ID NO: 7950 - DNA, 20 bp, Artificial Sequence
  chemically synthesized
tgaaagaaaaaaaaaaaagt

SEQ ID NO: 7951 - DNA, 20 bp, Artificial Sequence
  chemically synthesized
aatgtgaaagaaaaaaaaaa

SEQ ID NO: 7952 - DNA, 20 bp, Artificial Sequence
  chemically synthesized
tctgtgaaccagaaatgtga

SEQ ID NO: 7953 - DNA, 20 bp, Artificial Sequence
  chemically synthesized
ttttttttctttcacatttc

SEQ ID NO: 7954 - DNA, 20 bp, Artificial Sequence
  chemically synthesized
tctttcacatttctggttca

SEQ ID NO: 7955 - DNA, 20 bp, Artificial Sequence
  chemically synthesized
tttcacatttctggttcaca

SEQ ID NO: 7956 - DNA, 20 bp, Artificial Sequence
  chemically synthesized
agatgaacatctctgtgaac

SEQ ID NO: 7957 - DNA, 20 bp, Artificial Sequence
  chemically synthesized
gagatgttcatcttgcttta

SEQ ID NO: 7958 - DNA, 20 bp, Artificial Sequence
  chemically synthesized
acatagctgggctttaaagc

SEQ ID NO: 7959 - DNA, 20 bp, Artificial Sequence
  chemically synthesized
gttcatcttgctttaaagcc

SEQ ID NO: 7960 - DNA, 20 bp, Artificial Sequence
  chemically synthesized
aaagacatagctgggcttta

SEQ ID NO: 7961 - DNA, 20 bp, Artificial Sequence
  chemically synthesized
aaaatgaaaaagacatagct

SEQ ID NO: 7962 - DNA, 20 bp, Artificial Sequence
  chemically synthesized
aaaaatgaaaaagacatagc

SEQ ID NO: 7963 - DNA, 20 bp, Artificial Sequence
  chemically synthesized
agtgaaaaatgaaaaagaca

SEQ ID NO: 7964 - DNA, 20 bp, Artificial Sequence
  chemically synthesized
atatggagtgaaaaatgaaa

SEQ ID NO: 7965 - DNA, 20 bp, Artificial Sequence
  chemically synthesized
ccagtggtagataatatatg

SEQ ID NO: 7966 - DNA, 20 bp, Artificial Sequence
  chemically synthesized
atccagtggtagataatata

SEQ ID NO: 7967 - DNA, 20 bp, Artificial Sequence
  chemically synthesized
ctccatatattatctaccac

SEQ ID NO: 7968 - DNA, 20 bp, Artificial Sequence
  chemically synthesized
tcctaccatttatccagtgg

SEQ ID NO: 7969 - DNA, 20 bp, Artificial Sequence
  chemically synthesized
tgctcctaccatttatccag

SEQ ID NO: 7970 - DNA, 20 bp, Artificial Sequence
  chemically synthesized
attatctaccactggataaa

SEQ ID NO: 7971 - DNA, 20 bp, Artificial Sequence
  chemically synthesized
ctctgctcctaccatttatc

SEQ ID NO: 7972 - DNA, 20 bp, Artificial Sequence
  chemically synthesized
atctaccactggataaatgg

SEQ ID NO: 7973 - DNA, 20 bp, Artificial Sequence
  chemically synthesized
tctaccactggataaatggt

SEQ ID NO: 7974 - DNA, 20 bp, Artificial Sequence
  chemically synthesized
taccactggataaatggtag

SEQ ID NO: 7975 - DNA, 20 bp, Artificial Sequence
  chemically synthesized
cactggataaatggtaggag

SEQ ID NO: 7976 - DNA, 20 bp, Artificial Sequence
  chemically synthesized
ctggataaatggtaggagca

SEQ ID NO: 7977 - DNA, 20 bp, Artificial Sequence
  chemically synthesized
ataaatggtaggagcagaga

SEQ ID NO: 7978 - DNA, 20 bp, Artificial Sequence
  chemically synthesized
gagcagagaaagatgccttc

SEQ ID NO: 7979 - DNA, 20 bp, Artificial Sequence
  chemically synthesized
agagaaagatgccttcaagc

SEQ ID NO: 7980 - DNA, 20 bp, Artificial Sequence
  chemically synthesized
taacattagctcttgcttga

SEQ ID NO: 7981 - DNA, 20 bp, Artificial Sequence
  chemically synthesized
agaaagatgccttcaagcaa

SEQ ID NO: 7982 - DNA, 20 bp, Artificial Sequence
  chemically synthesized
ataacattagctcttgcttg

SEQ ID NO: 7983 - DNA, 20 bp, Artificial Sequence
  chemically synthesized
gcttctgattaagataacat

SEQ ID NO: 7984 - DNA, 20 bp, Artificial Sequence
  chemically synthesized
agagctaatgttatcttaat

SEQ ID NO: 7985 - DNA, 20 bp, Artificial Sequence
  chemically synthesized
gctaatgttatcttaatcag

SEQ ID NO: 7986 - DNA, 20 bp, Artificial Sequence
  chemically synthesized
gtcctggtaggcttctgatt

SEQ ID NO: 7987 - DNA, 20 bp, Artificial Sequence
  chemically synthesized
tatcttaatcagaagcctac

SEQ ID NO: 7988 - DNA, 20 bp, Artificial Sequence
  chemically synthesized
atcttaatcagaagcctacc

SEQ ID NO: 7989 - DNA, 20 bp, Artificial Sequence
  chemically synthesized
caaaatcaatgtgtcctggt

SEQ ID NO: 7990 - DNA, 20 bp, Artificial Sequence
  chemically synthesized
acaaaatcaatgtgtcctgg

SEQ ID NO: 7991 - DNA, 20 bp, Artificial Sequence
  chemically synthesized
tctacaaaatcaatgtgtcc

SEQ ID NO: 7992 - DNA, 20 bp, Artificial Sequence
  chemically synthesized
accaggacacattgattttg

SEQ ID NO: 7993 - DNA, 20 bp, Artificial Sequence
  chemically synthesized
acattgattttgtagatgta

SEQ ID NO: 7994 - DNA, 20 bp, Artificial Sequence
  chemically synthesized
gattttgtagatgtatagtc

SEQ ID NO: 7995 - DNA, 20 bp, Artificial Sequence
  chemically synthesized
attttgtagatgtatagtca

SEQ ID NO: 7996 - DNA, 20 bp, Artificial Sequence
  chemically synthesized
atgtatagtcaaggttccct

SEQ ID NO: 7997 - DNA, 20 bp, Artificial Sequence
  chemically synthesized
aaggcttgaattaatactga

SEQ ID NO: 7998 - DNA, 20 bp, Artificial Sequence
  chemically synthesized
taaggcttgaattaatactg

SEQ ID NO: 7999 - DNA, 20 bp, Artificial Sequence
  chemically synthesized
ttaaggcttgaattaatact

SEQ ID NO: 8000 - DNA, 20 bp, Artificial Sequence
  chemically synthesized
ggttccctcagtattaattc

SEQ ID NO: 8001 - DNA, 20 bp, Artificial Sequence
  chemically synthesized
aatcctggcctgatgaatta

SEQ ID NO: 8002 - DNA, 20 bp, Artificial Sequence
  chemically synthesized
taattcaagccttaattcat

SEQ ID NO: 8003 - DNA, 20 bp, Artificial Sequence
  chemically synthesized
taatcctggcctgatgaatt

SEQ ID NO: 8004 - DNA, 20 bp, Artificial Sequence
  chemically synthesized
aattcaagccttaattcatc

SEQ ID NO: 8005 - DNA, 20 bp, Artificial Sequence
  chemically synthesized
caagccttaattcatcaggc

SEQ ID NO: 8006 - DNA, 20 bp, Artificial Sequence
  chemically synthesized
aagccttaattcatcaggcc

SEQ ID NO: 8007 - DNA, 20 bp, Artificial Sequence
  chemically synthesized
ttgttcgactcatttaatcc

SEQ ID NO: 8008 - DNA, 20 bp, Artificial Sequence
  chemically synthesized
tcatcaggccaggattaaat

SEQ ID NO: 8009 - DNA, 20 bp, Artificial Sequence
  chemically synthesized
caggattaaatgagtcgaac

SEQ ID NO: 8010 - DNA, 20 bp, Artificial Sequence
  chemically synthesized
catatgtttgtttagaagaa

SEQ ID NO: 8011 - DNA, 20 bp, Artificial Sequence
  chemically synthesized
tatgtcatatgtttgtttag

SEQ ID NO: 8012 - DNA, 20 bp, Artificial Sequence
  chemically synthesized
ctgtatgtcatatgtttgtt

SEQ ID NO: 8013 - DNA, 20 bp, Artificial Sequence
  chemically synthesized
ctaaacaaacatatgacata

SEQ ID NO: 8014 - DNA, 20 bp, Artificial Sequence
  chemically synthesized
acatacagaaacctcttatt

SEQ ID NO: 8015 - DNA, 20 bp, Artificial Sequence
  chemically synthesized
ttgctattgagcttaataag

SEQ ID NO: 8016 - DNA, 20 bp, Artificial Sequence
  chemically synthesized
tttgctattgagcttaataa

SEQ ID NO: 8017 - DNA, 20 bp, Artificial Sequence
  chemically synthesized
agtttgctattgagcttaat

SEQ ID NO: 8018 - DNA, 20 bp, Artificial Sequence
  chemically synthesized
aaacctcttattaagctcaa

SEQ ID NO: 8019 - DNA, 20 bp, Artificial Sequence
  chemically synthesized
tcaaaatcaagtttgctatt

SEQ ID NO: 8020 - DNA, 20 bp, Artificial Sequence
  chemically synthesized
tcaatagcaaacttgatttt

SEQ ID NO: 8021 - DNA, 20 bp, Artificial Sequence
  chemically synthesized
caatagcaaacttgattttg

SEQ ID NO: 8022 - DNA, 20 bp, Artificial Sequence
  chemically synthesized
aaaactagtccctcaaaatc

SEQ ID NO: 8023 - DNA, 20 bp, Artificial Sequence
  chemically synthesized
aatagcaaacttgattttga

SEQ ID NO: 8024 - DNA, 20 bp, Artificial Sequence
  chemically synthesized
caaacttgattttgagggac

SEQ ID NO: 8025 - DNA, 20 bp, Artificial Sequence
  chemically synthesized
agagcttcaggaggaaaaac

SEQ ID NO: 8026 - DNA, 20 bp, Artificial Sequence
  chemically synthesized
gggactagtttttcctcctg

SEQ ID NO: 8027 - DNA, 20 bp, Artificial Sequence
  chemically synthesized
tcctatctcagagcttcagg

SEQ ID NO: 8028 - DNA, 20 bp, Artificial Sequence
  chemically synthesized
gtcctatctcagagcttcag

SEQ ID NO: 8029 - DNA, 20 bp, Artificial Sequence
  chemically synthesized
ttgtcctatctcagagcttc

SEQ ID NO: 8030 - DNA, 20 bp, Artificial Sequence
  chemically synthesized
gtttttcctcctgaagctct

SEQ ID NO: 8031 - DNA, 20 bp, Artificial Sequence
  chemically synthesized
cttgtcctatctcagagctt

SEQ ID NO: 8032 - DNA, 20 bp, Artificial Sequence
  chemically synthesized
ttcctcctgaagctctgaga

SEQ ID NO: 8033 - DNA, 20 bp, Artificial Sequence
  chemically synthesized
tcctcctgaagctctgagat

SEQ ID NO: 8034 - DNA, 20 bp, Artificial Sequence
  chemically synthesized
tgacagcttgtcctatctca

SEQ ID NO: 8035 - DNA, 20 bp, Artificial Sequence
  chemically synthesized
catgacagcttgtcctatct

SEQ ID NO: 8036 - DNA, 20 bp, Artificial Sequence
  chemically synthesized
ctgaagctctgagataggac

SEQ ID NO: 8037 - DNA, 20 bp, Artificial Sequence
  chemically synthesized
ataggacaagctgtcatgat

SEQ ID NO: 8038 - DNA, 20 bp, Artificial Sequence
  chemically synthesized
ttttagaatccttatcatga

SEQ ID NO: 8039 - DNA, 20 bp, Artificial Sequence
  chemically synthesized
taggacaagctgtcatgata

SEQ ID NO: 8040 - DNA, 20 bp, Artificial Sequence
  chemically synthesized
tgtcatgataaggattctaa

SEQ ID NO: 8041 - DNA, 20 bp, Artificial Sequence
  chemically synthesized
atgataaggattctaaaagc

SEQ ID NO: 8042 - DNA, 20 bp, Artificial Sequence
  chemically synthesized
ttttaaccatttctggcttt

SEQ ID NO: 8043 - DNA, 20 bp, Artificial Sequence
  chemically synthesized
aggattctaaaagccagaaa

SEQ ID NO: 8044 - DNA, 20 bp, Artificial Sequence
  chemically synthesized
atacctcttttaaccatttc

SEQ ID NO: 8045 - DNA, 20 bp, Artificial Sequence
  chemically synthesized
taaaagccagaaatggttaa

SEQ ID NO: 8046 - DNA, 20 bp, Artificial Sequence
  chemically synthesized
aaagccagaaatggttaaaa

SEQ ID NO: 8047 - DNA, 20 bp, Artificial Sequence
  chemically synthesized
aagccagaaatggttaaaag

SEQ ID NO: 8048 - DNA, 20 bp, Artificial Sequence
  chemically synthesized
aatggttaaaagaggtatct

SEQ ID NO: 8049 - DNA, 20 bp, Artificial Sequence
  chemically synthesized
atttcatttggttgcaggcc

SEQ ID NO: 8050 - DNA, 20 bp, Artificial Sequence
  chemically synthesized
accttatttcatttggttgc

SEQ ID NO: 8051 - DNA, 20 bp, Artificial Sequence
  chemically synthesized
aaccttatttcatttggttg

SEQ ID NO: 8052 - DNA, 20 bp, Artificial Sequence
  chemically synthesized
tcaaaaaaccttatttcatt

SEQ ID NO: 8053 - DNA, 20 bp, Artificial Sequence
  chemically synthesized
ggcctgcaaccaaatgaaat

SEQ ID NO: 8054 - DNA, 20 bp, Artificial Sequence
  chemically synthesized
gcctgcaaccaaatgaaata

SEQ ID NO: 8055 - DNA, 20 bp, Artificial Sequence
  chemically synthesized
gaaataaggttttttgattt

SEQ ID NO: 8056 - DNA, 20 bp, Artificial Sequence
  chemically synthesized
aaataccttaaaagagaatt

SEQ ID NO: 8057 - DNA, 20 bp, Artificial Sequence
  chemically synthesized
ttgagtctgaattctctttt

SEQ ID NO: 8058 - DNA, 20 bp, Artificial Sequence
  chemically synthesized
tgagtctgaattctctttta

SEQ ID NO: 8059 - DNA, 20 bp, Artificial Sequence
  chemically synthesized
catttagaaataccttaaaa

SEQ ID NO: 8060 - DNA, 20 bp, Artificial Sequence
  chemically synthesized
aacatttagaaataccttaa

SEQ ID NO: 8061 - DNA, 20 bp, Artificial Sequence
  chemically synthesized
tgataattctcatgaacatt

SEQ ID NO: 8062 - DNA, 20 bp, Artificial Sequence
  chemically synthesized
aggtatttctaaatgttcat

SEQ ID NO: 8063 - DNA, 20 bp, Artificial Sequence
  chemically synthesized
aaatgttcatgagaattatc

SEQ ID NO: 8064 - DNA, 20 bp, Artificial Sequence
  chemically synthesized
tgttcatgagaattatcaag

SEQ ID NO: 8065 - DNA, 20 bp, Artificial Sequence
  chemically synthesized
ttatcaagaagaactgatgc

SEQ ID NO: 8066 - DNA, 20 bp, Artificial Sequence
  chemically synthesized
atcaagaagaactgatgctg

SEQ ID NO: 8067 - DNA, 20 bp, Artificial Sequence
  chemically synthesized
tcaagaagaactgatgctgg

SEQ ID NO: 8068 - DNA, 20 bp, Artificial Sequence
  chemically synthesized
tagttcaaaccctccagcat

SEQ ID NO: 8069 - DNA, 20 bp, Artificial Sequence
  chemically synthesized
caagaagaactgatgctgga

SEQ ID NO: 8070 - DNA, 20 bp, Artificial Sequence
  chemically synthesized
catctctagttcaaaccctc

SEQ ID NO: 8071 - DNA, 20 bp, Artificial Sequence
  chemically synthesized
tgatgctggagggtttgaac

SEQ ID NO: 8072 - DNA, 20 bp, Artificial Sequence
  chemically synthesized
atgctggagggtttgaacta

SEQ ID NO: 8073 - DNA, 20 bp, Artificial Sequence
  chemically synthesized
catttagtaaaaatcatctc

SEQ ID NO: 8074 - DNA, 20 bp, Artificial Sequence
  chemically synthesized
tgcatttattagaaaacatt

SEQ ID NO: 8075 - DNA, 20 bp, Artificial Sequence
  chemically synthesized
taaatgttttctaataaatg

SEQ ID NO: 8076 - DNA, 20 bp, Artificial Sequence
  chemically synthesized
gtgactatgactgcatttat

SEQ ID NO: 8077 - DNA, 20 bp, Artificial Sequence
  chemically synthesized
ttttctaataaatgcagtca

SEQ ID NO: 8078 - DNA, 20 bp, Artificial Sequence
  chemically synthesized
aataaatgcagtcatagtca

SEQ ID NO: 8079 - DNA, 20 bp, Artificial Sequence
  chemically synthesized
taaatgcagtcatagtcaca

SEQ ID NO: 8080 - DNA, 20 bp, Artificial Sequence
  chemically synthesized
tcatagtcacagagctgtgt

SEQ ID NO: 8081 - DNA, 20 bp, Artificial Sequence
  chemically synthesized
catagtcacagagctgtgtt

SEQ ID NO: 8082 - DNA, 20 bp, Artificial Sequence
  chemically synthesized
atagtcacagagctgtgtta

SEQ ID NO: 8083 - DNA, 20 bp, Artificial Sequence
  chemically synthesized
aacaaaaatatgccctaaca

SEQ ID NO: 8084 - DNA, 20 bp, Artificial Sequence
  chemically synthesized
gtgttagggcatatttttgt

SEQ ID NO: 8085 - DNA, 20 bp, Artificial Sequence
  chemically synthesized
tgttagggcatatttttgtt

SEQ ID NO: 8086 - DNA, 20 bp, Artificial Sequence
  chemically synthesized
gttagggcatatttttgtta

SEQ ID NO: 8087 - DNA, 20 bp, Artificial Sequence
  chemically synthesized
ttagggcatatttttgttag

SEQ ID NO: 8088 - DNA, 20 bp, Artificial Sequence
  chemically synthesized
ggcatatttttgttaggggt

SEQ ID NO: 8089 - DNA, 20 bp, Artificial Sequence
  chemically synthesized
gcatatttttgttaggggtt

SEQ ID NO: 8090 - DNA, 20 bp, Artificial Sequence
  chemically synthesized
ttgttaggggttgggaaatt

SEQ ID NO: 8091 - DNA, 20 bp, Artificial Sequence
  chemically synthesized
ggttgggaaattgagccatt

SEQ ID NO: 8092 - DNA, 20 bp, Artificial Sequence
  chemically synthesized
cgtaattgataagggctaaa

SEQ ID NO: 8093 - DNA, 20 bp, Artificial Sequence
  chemically synthesized
ttcaaatgcgtaattgataa

SEQ ID NO: 8094 - DNA, 20 bp, Artificial Sequence
  chemically synthesized
attcaaatgcgtaattgata

SEQ ID NO: 8095 - DNA, 20 bp, Artificial Sequence
  chemically synthesized
aattcaaatgcgtaattgat

SEQ ID NO: 8096 - DNA, 20 bp, Artificial Sequence
  chemically synthesized
gcatagatgtttttaaatat

SEQ ID NO: 8097 - DNA, 20 bp, Artificial Sequence
  chemically synthesized
tacctcaaaaagtattggca

SEQ ID NO: 8098 - DNA, 20 bp, Artificial Sequence
  chemically synthesized
tggtatacctcaaaaagtat

SEQ ID NO: 8099 - DNA, 20 bp, Artificial Sequence
  chemically synthesized
catctatgccaatacttttt

SEQ ID NO: 8100 - DNA, 20 bp, Artificial Sequence
  chemically synthesized
atctatgccaatactttttg

SEQ ID NO: 8101 - DNA, 20 bp, Artificial Sequence
  chemically synthesized
acattatggtatacctcaaa

SEQ ID NO: 8102 - DNA, 20 bp, Artificial Sequence
  chemically synthesized
tttgaggtataccataatgt

SEQ ID NO: 8103 - DNA, 20 bp, Artificial Sequence
  chemically synthesized
ctgcatcaaaactaacatta

SEQ ID NO: 8104 - DNA, 20 bp, Artificial Sequence
  chemically synthesized
ccataatgttagttttgatg

SEQ ID NO: 8105 - DNA, 20 bp, Artificial Sequence
  chemically synthesized
gttttgatgcagtattaacg

SEQ ID NO: 8106 - DNA, 20 bp, Artificial Sequence
  chemically synthesized
ttttgatgcagtattaacgt

SEQ ID NO: 8107 - DNA, 20 bp, Artificial Sequence
  chemically synthesized
tttgatgcagtattaacgta

SEQ ID NO: 8108 - DNA, 20 bp, Artificial Sequence
  chemically synthesized
ttgatgcagtattaacgtag

SEQ ID NO: 8109 - DNA, 20 bp, Artificial Sequence
  chemically synthesized
gatgcagtattaacgtaggg

SEQ ID NO: 8110 - DNA, 20 bp, Artificial Sequence
  chemically synthesized
agggaaccttgatcatttat

SEQ ID NO: 8111 - DNA, 20 bp, Artificial Sequence
  chemically synthesized
gatcattctcataaatgatc

SEQ ID NO: 8112 - DNA, 20 bp, Artificial Sequence
  chemically synthesized
atcattctcataaatgatca

SEQ ID NO: 8113 - DNA, 20 bp, Artificial Sequence
  chemically synthesized
ataaatgatcaaggttccct

SEQ ID NO: 8114 - DNA, 20 bp, Artificial Sequence
  chemically synthesized
aaatgatcaaggttccctca

SEQ ID NO: 8115 - DNA, 20 bp, Artificial Sequence
  chemically synthesized
ccttggaacagtaactctga

SEQ ID NO: 8116 - DNA, 20 bp, Artificial Sequence
  chemically synthesized
accttggaacagtaactctg

SEQ ID NO: 8117 - DNA, 20 bp, Artificial Sequence
  chemically synthesized
taccttggaacagtaactct

SEQ ID NO: 8118 - DNA, 20 bp, Artificial Sequence
  chemically synthesized
tccctcagagttactgttcc

SEQ ID NO: 8119 - DNA, 20 bp, Artificial Sequence
  chemically synthesized
ccctcagagttactgttcca

SEQ ID NO: 8120 - DNA, 20 bp, Artificial Sequence
  chemically synthesized
tagaataacttaccttggaa

SEQ ID NO: 8121 - DNA, 20 bp, Artificial Sequence
  chemically synthesized
cagagttactgttccaaggt

SEQ ID NO: 8122 - DNA, 20 bp, Artificial Sequence
  chemically synthesized
aacattagaataacttacct

SEQ ID NO: 8123 - DNA, 20 bp, Artificial Sequence
  chemically synthesized
aaaaaataaaaaaaaaacat

SEQ ID NO: 8124 - DNA, 20 bp, Artificial Sequence
  chemically synthesized
ttttttattttttatttttt

SEQ ID NO: 8125 - DNA, 20 bp, Artificial Sequence
  chemically synthesized
ttattttttattttttgaga

SEQ ID NO: 8126 - DNA, 20 bp, Artificial Sequence
  chemically synthesized
tccagcatgggcgacagagc

SEQ ID NO: 8127 - DNA, 20 bp, Artificial Sequence
  chemically synthesized
gcactccagcatgggcgaca

SEQ ID NO: 8128 - DNA, 20 bp, Artificial Sequence
  chemically synthesized
ctgcactccagcatgggcga

SEQ ID NO: 8129 - DNA, 20 bp, Artificial Sequence
  chemically synthesized
tctcgctctgtcgcccatgc

SEQ ID NO: 8130 - DNA, 20 bp, Artificial Sequence
  chemically synthesized
tcgctctgtcgcccatgctg

SEQ ID NO: 8131 - DNA, 20 bp, Artificial Sequence
  chemically synthesized
gcaccactgcactccagcat

SEQ ID NO: 8132 - DNA, 20 bp, Artificial Sequence
  chemically synthesized
cgcaccactgcactccagca

SEQ ID NO: 8133 - DNA, 20 bp, Artificial Sequence
  chemically synthesized
ctgtcgcccatgctggagtg

SEQ ID NO: 8134 - DNA, 20 bp, Artificial Sequence
  chemically synthesized
gagatcgcaccactgcactc

SEQ ID NO: 8135 - DNA, 20 bp, Artificial Sequence
  chemically synthesized
tcgcccatgctggagtgcag

SEQ ID NO: 8136 - DNA, 20 bp, Artificial Sequence
  chemically synthesized
ggagtgcagtggtgcgatct

SEQ ID NO: 8137 - DNA, 20 bp, Artificial Sequence
  chemically synthesized
ggcagagcttgcagtgagct

SEQ ID NO: 8138 - DNA, 20 bp, Artificial Sequence
  chemically synthesized
gtgcgatctcagctcactgc

SEQ ID NO: 8139 - DNA, 20 bp, Artificial Sequence
  chemically synthesized
caggaggcagagcttgcagt

SEQ ID NO: 8140 - DNA, 20 bp, Artificial Sequence
  chemically synthesized
aacccaggaggcagagcttg

SEQ ID NO: 8141 - DNA, 20 bp, Artificial Sequence
  chemically synthesized
tcactgcaagctctgcctcc

SEQ ID NO: 8142 - DNA, 20 bp, Artificial Sequence
  chemically synthesized
gaatgtgaacccaggaggca

SEQ ID NO: 8143 - DNA, 20 bp, Artificial Sequence
  chemically synthesized
cactgcaagctctgcctcct

SEQ ID NO: 8144 - DNA, 20 bp, Artificial Sequence
  chemically synthesized
gagaatgtgaacccaggagg

SEQ ID NO: 8145 - DNA, 20 bp, Artificial Sequence
  chemically synthesized
caggagaatgtgaacccagg

SEQ ID NO: 8146 - DNA, 20 bp, Artificial Sequence
  chemically synthesized
gcaggagaatgtgaacccag

SEQ ID NO: 8147 - DNA, 20 bp, Artificial Sequence
  chemically synthesized
aggcaggagaatgtgaaccc

SEQ ID NO: 8148 - DNA, 20 bp, Artificial Sequence
  chemically synthesized
gaggcaggagaatgtgaacc

SEQ ID NO: 8149 - DNA, 20 bp, Artificial Sequence
  chemically synthesized
gggttcacattctcctgcct

SEQ ID NO: 8150 - DNA, 20 bp, Artificial Sequence
  chemically synthesized
gactctggaggctgaggcag

SEQ ID NO: 8151 - DNA, 20 bp, Artificial Sequence
  chemically synthesized
gtgactctggaggctgaggc

SEQ ID NO: 8152 - DNA, 20 bp, Artificial Sequence
  chemically synthesized
agtgactctggaggctgagg

SEQ ID NO: 8153 - DNA, 20 bp, Artificial Sequence
  chemically synthesized
cattctcctgcctcagcctc

SEQ ID NO: 8154 - DNA, 20 bp, Artificial Sequence
  chemically synthesized
cccagtgactctggaggctg

SEQ ID NO: 8155 - DNA, 20 bp, Artificial Sequence
  chemically synthesized
tcccagtgactctggaggct

SEQ ID NO: 8156 - DNA, 20 bp, Artificial Sequence
  chemically synthesized
ttctcctgcctcagcctcca

SEQ ID NO: 8157 - DNA, 20 bp, Artificial Sequence
  chemically synthesized
tgtagtcccagtgactctgg

SEQ ID NO: 8158 - DNA, 20 bp, Artificial Sequence
  chemically synthesized
ctgtagtcccagtgactctg

SEQ ID NO: 8159 - DNA, 20 bp, Artificial Sequence
  chemically synthesized
gcctcagcctccagagtcac

SEQ ID NO: 8160 - DNA, 20 bp, Artificial Sequence
  chemically synthesized
acctgtagtcccagtgactc

SEQ ID NO: 8161 - DNA, 20 bp, Artificial Sequence
  chemically synthesized
cctcagcctccagagtcact

SEQ ID NO: 8162 - DNA, 20 bp, Artificial Sequence
  chemically synthesized
ctccagagtcactgggacta

SEQ ID NO: 8163 - DNA, 20 bp, Artificial Sequence
  chemically synthesized
tccagagtcactgggactac

SEQ ID NO: 8164 - DNA, 20 bp, Artificial Sequence
  chemically synthesized
gtggcgggcacctgtagtcc

SEQ ID NO: 8165 - DNA, 20 bp, Artificial Sequence
  chemically synthesized
ggcgtggtggcgggcacctg

SEQ ID NO: 8166 - DNA, 20 bp, Artificial Sequence
  chemically synthesized
aaaaagccgggcgtggtggc

SEQ ID NO: 8167 - DNA, 20 bp, Artificial Sequence
  chemically synthesized
aaaaaagccgggcgtggtgg

SEQ ID NO: 8168 - DNA, 20 bp, Artificial Sequence
  chemically synthesized
caggtgcccgccaccacgcc

SEQ ID NO: 8169 - DNA, 20 bp, Artificial Sequence
  chemically synthesized
aaaaaaaaagccgggcgtgg

SEQ ID NO: 8170 - DNA, 20 bp, Artificial Sequence
  chemically synthesized
caaaaaaaaaaagccgggcg

SEQ ID NO: 8171 - DNA, 20 bp, Artificial Sequence
  chemically synthesized
aaatacaaaaaaaaaaagcc

SEQ ID NO: 8172 - DNA, 20 bp, Artificial Sequence
  chemically synthesized
aaaatacaaaaaaaaaaagc

SEQ ID NO: 8173 - DNA, 20 bp, Artificial Sequence
  chemically synthesized
actaaaaatacaaaaaaaaa

SEQ ID NO: 8174 - DNA, 20 bp, Artificial Sequence
  chemically synthesized
gctttttttttttgtatttt

SEQ ID NO: 8175 - DNA, 20 bp, Artificial Sequence
  chemically synthesized
ttttttttttgtatttttag

SEQ ID NO: 8176 - DNA, 20 bp, Artificial Sequence
  chemically synthesized
ttttttttgtatttttagta

SEQ ID NO: 8177 - DNA, 20 bp, Artificial Sequence
  chemically synthesized
ttttgtatttttagtagaga

SEQ ID NO: 8178 - DNA, 20 bp, Artificial Sequence
  chemically synthesized
tttgtatttttagtagagac

SEQ ID NO: 8179 - DNA, 20 bp, Artificial Sequence
  chemically synthesized
ttgtatttttagtagagaca

SEQ ID NO: 8180 - DNA, 20 bp, Artificial Sequence
  chemically synthesized
gagacagggtttcaccgtgt

SEQ ID NO: 8181 - DNA, 20 bp, Artificial Sequence
  chemically synthesized
cagggtttcaccgtgttagc

SEQ ID NO: 8182 - DNA, 20 bp, Artificial Sequence
  chemically synthesized
ggagaccatcctggctaaca

SEQ ID NO: 8183 - DNA, 20 bp, Artificial Sequence
  chemically synthesized
agggtttcaccgtgttagcc

SEQ ID NO: 8184 - DNA, 20 bp, Artificial Sequence
  chemically synthesized
tttcaccgtgttagccagga

SEQ ID NO: 8185 - DNA, 20 bp, Artificial Sequence
  chemically synthesized
tcaggagatggagaccatcc

SEQ ID NO: 8186 - DNA, 20 bp, Artificial Sequence
  chemically synthesized
gatcacgaggtcaggagatg

SEQ ID NO: 8187 - DNA, 20 bp, Artificial Sequence
  chemically synthesized
cggatcacgaggtcaggaga

SEQ ID NO: 8188 - DNA, 20 bp, Artificial Sequence
  chemically synthesized
caggcggatcacgaggtcag

SEQ ID NO: 8189 - DNA, 20 bp, Artificial Sequence
  chemically synthesized
ggcaggcggatcacgaggtc

SEQ ID NO: 8190 - DNA, 20 bp, Artificial Sequence
  chemically synthesized
aggcaggcggatcacgaggt

SEQ ID NO: 8191 - DNA, 20 bp, Artificial Sequence
  chemically synthesized
gccgaggcaggcggatcacg

SEQ ID NO: 8192 - DNA, 20 bp, Artificial Sequence
  chemically synthesized
ggccgaggcaggcggatcac

SEQ ID NO: 8193 - DNA, 20 bp, Artificial Sequence
  chemically synthesized
acctcgtgatccgcctgcct

SEQ ID NO: 8194 - DNA, 20 bp, Artificial Sequence
  chemically synthesized
ctttgggaggccgaggcagg

SEQ ID NO: 8195 - DNA, 20 bp, Artificial Sequence
  chemically synthesized
gcactttgggaggccgaggc

SEQ ID NO: 8196 - DNA, 20 bp, Artificial Sequence
  chemically synthesized
agcactttgggaggccgagg

SEQ ID NO: 8197 - DNA, 20 bp, Artificial Sequence
  chemically synthesized
cccagcactttgggaggccg

SEQ ID NO: 8198 - DNA, 20 bp, Artificial Sequence
  chemically synthesized
tcccagcactttgggaggcc

SEQ ID NO: 8199 - DNA, 20 bp, Artificial Sequence
  chemically synthesized
ccgcctgcctcggcctccca

SEQ ID NO: 8200 - DNA, 20 bp, Artificial Sequence
  chemically synthesized
tgtaatcccagcactttggg

SEQ ID NO: 8201 - DNA, 20 bp, Artificial Sequence
  chemically synthesized
ctgtaatcccagcactttgg

SEQ ID NO: 8202 - DNA, 20 bp, Artificial Sequence
  chemically synthesized
gcctcggcctcccaaagtgc

SEQ ID NO: 8203 - DNA, 20 bp, Artificial Sequence
  chemically synthesized
acctgtaatcccagcacttt

SEQ ID NO: 8204 - DNA, 20 bp, Artificial Sequence
  chemically synthesized
cctcggcctcccaaagtgct

SEQ ID NO: 8205 - DNA, 20 bp, Artificial Sequence
  chemically synthesized
cacctgtaatcccagcactt

SEQ ID NO: 8206 - DNA, 20 bp, Artificial Sequence
  chemically synthesized
ctcccaaagtgctgggatta

SEQ ID NO: 8207 - DNA, 20 bp, Artificial Sequence
  chemically synthesized
tcccaaagtgctgggattac

SEQ ID NO: 8208 - DNA, 20 bp, Artificial Sequence
  chemically synthesized
ttggctcacacctgtaatcc

SEQ ID NO: 8209 - DNA, 20 bp, Artificial Sequence
  chemically synthesized
agtgctgggattacaggtgt

SEQ ID NO: 8210 - DNA, 20 bp, Artificial Sequence
  chemically synthesized
caggtgtgagccaacatgcc

SEQ ID NO: 8211 - DNA, 20 bp, Artificial Sequence
  chemically synthesized
acattagaggctgggcatgt

SEQ ID NO: 8212 - DNA, 20 bp, Artificial Sequence
  chemically synthesized
cttgttaaacattagaggct

SEQ ID NO: 8213 - DNA, 20 bp, Artificial Sequence
  chemically synthesized
acttgttaaacattagaggc

SEQ ID NO: 8214 - DNA, 20 bp, Artificial Sequence
  chemically synthesized
gtgtacttgttaaacattag

SEQ ID NO: 8215 - DNA, 20 bp, Artificial Sequence
  chemically synthesized
tgtgtacttgttaaacatta

SEQ ID NO: 8216 - DNA, 20 bp, Artificial Sequence
  chemically synthesized
attgtgtacttgttaaacat

SEQ ID NO: 8217 - DNA, 20 bp, Artificial Sequence
  chemically synthesized
cccagcctctaatgtttaac

SEQ ID NO: 8218 - DNA, 20 bp, Artificial Sequence
  chemically synthesized
acacaatgcactcgttttaa

SEQ ID NO: 8219 - DNA, 20 bp, Artificial Sequence
  chemically synthesized
taattgacagctgttaaaac

SEQ ID NO: 8220 - DNA, 20 bp, Artificial Sequence
  chemically synthesized
tatgtattggtaataattga

SEQ ID NO: 8221 - DNA, 20 bp, Artificial Sequence
  chemically synthesized
aagaaaagcaaaatatgtat

SEQ ID NO: 8222 - DNA, 20 bp, Artificial Sequence
  chemically synthesized
tacatattttgcttttcttg

SEQ ID NO: 8223 - DNA, 20 bp, Artificial Sequence
  chemically synthesized
acatattttgcttttcttga

SEQ ID NO: 8224 - DNA, 20 bp, Artificial Sequence
  chemically synthesized
tacgtgtataccttcaagaa

SEQ ID NO: 8225 - DNA, 20 bp, Artificial Sequence
  chemically synthesized
agatgtacgtgtataccttc

SEQ ID NO: 8226 - DNA, 20 bp, Artificial Sequence
  chemically synthesized
attagagaatcattaggggt

SEQ ID NO: 8227 - DNA, 20 bp, Artificial Sequence
  chemically synthesized
aacaattagagaatcattag

SEQ ID NO: 8228 - DNA, 20 bp, Artificial Sequence
  chemically synthesized
taacaattagagaatcatta

SEQ ID NO: 8229 - DNA, 20 bp, Artificial Sequence
  chemically synthesized
ctaacaattagagaatcatt

SEQ ID NO: 8230 - DNA, 20 bp, Artificial Sequence
  chemically synthesized
tctaacaattagagaatcat

SEQ ID NO: 8231 - DNA, 20 bp, Artificial Sequence
  chemically synthesized
cctaatgattctctaattgt

SEQ ID NO: 8232 - DNA, 20 bp, Artificial Sequence
  chemically synthesized
tgactacattctaacaatta

SEQ ID NO: 8233 - DNA, 20 bp, Artificial Sequence
  chemically synthesized
catgactacattctaacaat

SEQ ID NO: 8234 - DNA, 20 bp, Artificial Sequence
  chemically synthesized
attctctaattgttagaatg

SEQ ID NO: 8235 - DNA, 20 bp, Artificial Sequence
  chemically synthesized
attgttagaatgtagtcatg

SEQ ID NO: 8236 - DNA, 20 bp, Artificial Sequence
  chemically synthesized
gtcatgaagtcatttcaata

SEQ ID NO: 8237 - DNA, 20 bp, Artificial Sequence
  chemically synthesized
caatacagatgaatatatgt

SEQ ID NO: 8238 - DNA, 20 bp, Artificial Sequence
  chemically synthesized
gatgaatatatgtcagtgat

SEQ ID NO: 8239 - DNA, 20 bp, Artificial Sequence
  chemically synthesized
gtgatcagacaacgactcca

SEQ ID NO: 8240 - DNA, 20 bp, Artificial Sequence
  chemically synthesized
gatcagacaacgactccaca

SEQ ID NO: 8241 - DNA, 20 bp, Artificial Sequence
  chemically synthesized
acgtaaatagattctctgtg

SEQ ID NO: 8242 - DNA, 20 bp, Artificial Sequence
  chemically synthesized
gaacgtaaatagattctctg

SEQ ID NO: 8243 - DNA, 20 bp, Artificial Sequence
  chemically synthesized
aagataatcaagaacgtaaa

SEQ ID NO: 8244 - DNA, 20 bp, Artificial Sequence
  chemically synthesized
atataatttacaagataatc

SEQ ID NO: 8245 - DNA, 20 bp, Artificial Sequence
  chemically synthesized
accagagaaatataatttac

SEQ ID NO: 8246 - DNA, 20 bp, Artificial Sequence
  chemically synthesized
tcttgtaaattatatttctc

SEQ ID NO: 8247 - DNA, 20 bp, Artificial Sequence
  chemically synthesized
tgtaaattatatttctctgg

SEQ ID NO: 8248 - DNA, 20 bp, Artificial Sequence
  chemically synthesized
tgttccttagggagctacca

SEQ ID NO: 8249 - DNA, 20 bp, Artificial Sequence
  chemically synthesized
aatgttccttagggagctac

SEQ ID NO: 8250 - DNA, 20 bp, Artificial Sequence
  chemically synthesized
tatttctctggtagctccct

SEQ ID NO: 8251 - DNA, 20 bp, Artificial Sequence
  chemically synthesized
atttctctggtagctcccta

SEQ ID NO: 8252 - DNA, 20 bp, Artificial Sequence
  chemically synthesized
ttgaattaatgttccttagg

SEQ ID NO: 8253 - DNA, 20 bp, Artificial Sequence
  chemically synthesized
atttgaattaatgttcctta

SEQ ID NO: 8254 - DNA, 20 bp, Artificial Sequence
  chemically synthesized
aatttgaattaatgttcctt

SEQ ID NO: 8255 - DNA, 20 bp, Artificial Sequence
  chemically synthesized
gaatttgaattaatgttcct

SEQ ID NO: 8256 - DNA, 20 bp, Artificial Sequence
  chemically synthesized
taattcaaattcaatacaca

SEQ ID NO: 8257 - DNA, 20 bp, Artificial Sequence
  chemically synthesized
ggaagaaattgtagtgacag

SEQ ID NO: 8258 - DNA, 20 bp, Artificial Sequence
  chemically synthesized
acaggaagaaattgtagtga

SEQ ID NO: 8259 - DNA, 20 bp, Artificial Sequence
  chemically synthesized
ctggctacaggaagaaattg

SEQ ID NO: 8260 - DNA, 20 bp, Artificial Sequence
  chemically synthesized
gtcactacaatttcttcctg

SEQ ID NO: 8261 - DNA, 20 bp, Artificial Sequence
  chemically synthesized
ttaggatgactggctacagg

SEQ ID NO: 8262 - DNA, 20 bp, Artificial Sequence
  chemically synthesized
ctacaatttcttcctgtagc

SEQ ID NO: 8263 - DNA, 20 bp, Artificial Sequence
  chemically synthesized
tttttaggatgactggctac

SEQ ID NO: 8264 - DNA, 20 bp, Artificial Sequence
  chemically synthesized
ttttttaggatgactggcta

SEQ ID NO: 8265 - DNA, 20 bp, Artificial Sequence
  chemically synthesized
aagactttttttaggatgac

SEQ ID NO: 8266 - DNA, 20 bp, Artificial Sequence
  chemically synthesized
gtagccagtcatcctaaaaa

SEQ ID NO: 8267 - DNA, 20 bp, Artificial Sequence
  chemically synthesized
ctggatggaagacttttttt

SEQ ID NO: 8268 - DNA, 20 bp, Artificial Sequence
  chemically synthesized
actggatggaagactttttt

SEQ ID NO: 8269 - DNA, 20 bp, Artificial Sequence
  chemically synthesized
cctaaaaaaagtcttccatc

SEQ ID NO: 8270 - DNA, 20 bp, Artificial Sequence
  chemically synthesized
gaataagaaatactggatgg

SEQ ID NO: 8271 - DNA, 20 bp, Artificial Sequence
  chemically synthesized
agagaataagaaatactgga

SEQ ID NO: 8272 - DNA, 20 bp, Artificial Sequence
  chemically synthesized
ctatagagaataagaaatac

SEQ ID NO: 8273 - DNA, 20 bp, Artificial Sequence
  chemically synthesized
ttcttagctctatagagaat

SEQ ID NO: 8274 - DNA, 20 bp, Artificial Sequence
  chemically synthesized
ccagtatttcttattctcta

SEQ ID NO: 8275 - DNA, 20 bp, Artificial Sequence
  chemically synthesized
agtatttcttattctctata

SEQ ID NO: 8276 - DNA, 20 bp, Artificial Sequence
  chemically synthesized
gggggattcttagctctata

SEQ ID NO: 8277 - DNA, 20 bp, Artificial Sequence
  chemically synthesized
ttcttattctctatagagct

SEQ ID NO: 8278 - DNA, 20 bp, Artificial Sequence
  chemically synthesized
tggggggattcttagctcta

SEQ ID NO: 8279 - DNA, 20 bp, Artificial Sequence
  chemically synthesized
ttgtagaatggggggattct

SEQ ID NO: 8280 - DNA, 20 bp, Artificial Sequence
  chemically synthesized
ctacatatttgtagaatggg

SEQ ID NO: 8281 - DNA, 20 bp, Artificial Sequence
  chemically synthesized
tctacatatttgtagaatgg

SEQ ID NO: 8282 - DNA, 20 bp, Artificial Sequence
  chemically synthesized
atctacatatttgtagaatg

SEQ ID NO: 8283 - DNA, 20 bp, Artificial Sequence
  chemically synthesized
tatctacatatttgtagaat

SEQ ID NO: 8284 - DNA, 20 bp, Artificial Sequence
  chemically synthesized
atatctacatatttgtagaa

SEQ ID NO: 8285 - DNA, 20 bp, Artificial Sequence
  chemically synthesized
cagatatatctacatatttg

SEQ ID NO: 8286 - DNA, 20 bp, Artificial Sequence
  chemically synthesized
ccccccattctacaaatatg

SEQ ID NO: 8287 - DNA, 20 bp, Artificial Sequence
  chemically synthesized
ctttatgacataaaattaat

SEQ ID NO: 8288 - DNA, 20 bp, Artificial Sequence
  chemically synthesized
ctgattaattttatgtcata

SEQ ID NO: 8289 - DNA, 20 bp, Artificial Sequence
  chemically synthesized
aaatttgtatgtagacaaca

SEQ ID NO: 8290 - DNA, 20 bp, Artificial Sequence
  chemically synthesized
gtaaatttgtatgtagacaa

SEQ ID NO: 8291 - DNA, 20 bp, Artificial Sequence
  chemically synthesized
tttgagtgtaaatttgtatg

SEQ ID NO: 8292 - DNA, 20 bp, Artificial Sequence
  chemically synthesized
gttggttgggaagttttttt

SEQ ID NO: 8293 - DNA, 20 bp, Artificial Sequence
  chemically synthesized
atgtccattagttggttggg

SEQ ID NO: 8294 - DNA, 20 bp, Artificial Sequence
  chemically synthesized
cttatgtccattagttggtt

SEQ ID NO: 8295 - DNA, 20 bp, Artificial Sequence
  chemically synthesized
tcttatgtccattagttggt

SEQ ID NO: 8296 - DNA, 20 bp, Artificial Sequence
  chemically synthesized
aaaacttcccaaccaactaa

SEQ ID NO: 8297 - DNA, 20 bp, Artificial Sequence
  chemically synthesized
aatctcttatgtccattagt

SEQ ID NO: 8298 - DNA, 20 bp, Artificial Sequence
  chemically synthesized
gattaatctcttatgtccat

SEQ ID NO: 8299 - DNA, 20 bp, Artificial Sequence
  chemically synthesized
cccaaccaactaatggacat

SEQ ID NO: 8300 - DNA, 20 bp, Artificial Sequence
  chemically synthesized
caaccaactaatggacataa

SEQ ID NO: 8301 - DNA, 20 bp, Artificial Sequence
  chemically synthesized
acataagagattaatcaaat

SEQ ID NO: 8302 - DNA, 20 bp, Artificial Sequence
  chemically synthesized
aagagattaatcaaattggc

SEQ ID NO: 8303 - DNA, 20 bp, Artificial Sequence
  chemically synthesized
agagattaatcaaattggca

SEQ ID NO: 8304 - DNA, 20 bp, Artificial Sequence
  chemically synthesized
gcaggttgagttaagggaac

SEQ ID NO: 8305 - DNA, 20 bp, Artificial Sequence
  chemically synthesized
ttttcagcaggttgagttaa

SEQ ID NO: 8306 - DNA, 20 bp, Artificial Sequence
  chemically synthesized
gttttcagcaggttgagtta

SEQ ID NO: 8307 - DNA, 20 bp, Artificial Sequence
  chemically synthesized
tgttttcagcaggttgagtt

SEQ ID NO: 8308 - DNA, 20 bp, Artificial Sequence
  chemically synthesized
tttcatgttttcagcaggtt

SEQ ID NO: 8309 - DNA, 20 bp, Artificial Sequence
  chemically synthesized
gctgctttcatgttttcagc

SEQ ID NO: 8310 - DNA, 20 bp, Artificial Sequence
  chemically synthesized
agctgctttcatgttttcag

SEQ ID NO: 8311 - DNA, 20 bp, Artificial Sequence
  chemically synthesized
gccagctgctttcatgtttt

SEQ ID NO: 8312 - DNA, 20 bp, Artificial Sequence
  chemically synthesized
tcaacctgctgaaaacatga

SEQ ID NO: 8313 - DNA, 20 bp, Artificial Sequence
  chemically synthesized
acctgctgaaaacatgaaag

SEQ ID NO: 8314 - DNA, 20 bp, Artificial Sequence
  chemically synthesized
gctgaaaacatgaaagcagc

SEQ ID NO: 8315 - DNA, 20 bp, Artificial Sequence
  chemically synthesized
atgaaagcagctggcccttt

SEQ ID NO: 8316 - DNA, 20 bp, Artificial Sequence
  chemically synthesized
taaatcattgctaaaagggc

SEQ ID NO: 8317 - DNA, 20 bp, Artificial Sequence
  chemically synthesized
ctcataaatcattgctaaaa

SEQ ID NO: 8318 - DNA, 20 bp, Artificial Sequence
  chemically synthesized
actcataaatcattgctaaa

SEQ ID NO: 8319 - DNA, 20 bp, Artificial Sequence
  chemically synthesized
cactcataaatcattgctaa

SEQ ID NO: 8320 - DNA, 20 bp, Artificial Sequence
  chemically synthesized
cccttttagcaatgatttat

SEQ ID NO: 8321 - DNA, 20 bp, Artificial Sequence
  chemically synthesized
atgatttatgagtgcctctc

SEQ ID NO: 8322 - DNA, 20 bp, Artificial Sequence
  chemically synthesized
aatagttacgattgctagag

SEQ ID NO: 8323 - DNA, 20 bp, Artificial Sequence
  chemically synthesized
taatagttacgattgctaga

SEQ ID NO: 8324 - DNA, 20 bp, Artificial Sequence
  chemically synthesized
cataatagttacgattgcta

SEQ ID NO: 8325 - DNA, 20 bp, Artificial Sequence
  chemically synthesized
tacataatagttacgattgc

SEQ ID NO: 8326 - DNA, 20 bp, Artificial Sequence
  chemically synthesized
atgttctttatcatacataa

SEQ ID NO: 8327 - DNA, 20 bp, Artificial Sequence
  chemically synthesized
cgtaactattatgtatgata

SEQ ID NO: 8328 - DNA, 20 bp, Artificial Sequence
  chemically synthesized
aaattagtttaaattacaca

SEQ ID NO: 8329 - DNA, 20 bp, Artificial Sequence
  chemically synthesized
gtaaattagtttaaattaca

SEQ ID NO: 8330 - DNA, 20 bp, Artificial Sequence
  chemically synthesized
gtaatttaaactaatttaca

SEQ ID NO: 8331 - DNA, 20 bp, Artificial Sequence
  chemically synthesized
atcatttgacctttgtaaat

SEQ ID NO: 8332 - DNA, 20 bp, Artificial Sequence
  chemically synthesized
taatttaaactaatttacaa

SEQ ID NO: 8333 - DNA, 20 bp, Artificial Sequence
  chemically synthesized
ttacaaaggtcaaatgattt

SEQ ID NO: 8334 - DNA, 20 bp, Artificial Sequence
  chemically synthesized
aggtcaaatgatttcagtgt

SEQ ID NO: 8335 - DNA, 20 bp, Artificial Sequence
  chemically synthesized
gggaagctccatttaaagag

SEQ ID NO: 8336 - DNA, 20 bp, Artificial Sequence
  chemically synthesized
taagtcatctactctttaaa

SEQ ID NO: 8337 - DNA, 20 bp, Artificial Sequence
  chemically synthesized
gtagggaagctccatttaaa

SEQ ID NO: 8338 - DNA, 20 bp, Artificial Sequence
  chemically synthesized
agtcatctactctttaaatg

SEQ ID NO: 8339 - DNA, 20 bp, Artificial Sequence
  chemically synthesized
tagtagggaagctccattta

SEQ ID NO: 8340 - DNA, 20 bp, Artificial Sequence
  chemically synthesized
tataactacacgtagtaggg

SEQ ID NO: 8341 - DNA, 20 bp, Artificial Sequence
  chemically synthesized
ctatataactacacgtagta

SEQ ID NO: 8342 - DNA, 20 bp, Artificial Sequence
  chemically synthesized
actatataactacacgtagt

SEQ ID NO: 8343 - DNA, 20 bp, Artificial Sequence
  chemically synthesized
tggagcttccctactacgtg

SEQ ID NO: 8344 - DNA, 20 bp, Artificial Sequence
  chemically synthesized
aactatataactacacgtag

SEQ ID NO: 8345 - DNA, 20 bp, Artificial Sequence
  chemically synthesized
tacaactatataactacacg

SEQ ID NO: 8346 - DNA, 20 bp, Artificial Sequence
  chemically synthesized
ccctactacgtgtagttata

SEQ ID NO: 8347 - DNA, 20 bp, Artificial Sequence
  chemically synthesized
ataatgatatttatgaaata

SEQ ID NO: 8348 - DNA, 20 bp, Artificial Sequence
  chemically synthesized
atttatgaaataaagaaatg

SEQ ID NO: 8349 - DNA, 20 bp, Artificial Sequence
  chemically synthesized
tttatgaaataaagaaatga

SEQ ID NO: 8350 - DNA, 20 bp, Artificial Sequence
  chemically synthesized
aagaaatgaaggtcactttc

SEQ ID NO: 8351 - DNA, 20 bp, Artificial Sequence
  chemically synthesized
agaaaacattgatcactgga

SEQ ID NO: 8352 - DNA, 20 bp, Artificial Sequence
  chemically synthesized
gttaagaaaacattgatcac

SEQ ID NO: 8353 - DNA, 20 bp, Artificial Sequence
  chemically synthesized
agtgatcaatgttttcttaa

SEQ ID NO: 8354 - DNA, 20 bp, Artificial Sequence
  chemically synthesized
gttaaatgtatgatactgtt

SEQ ID NO: 8355 - DNA, 20 bp, Artificial Sequence
  chemically synthesized
atacatttaactgtatacca

SEQ ID NO: 8356 - DNA, 20 bp, Artificial Sequence
  chemically synthesized
tgtgctcatgctttggtata

SEQ ID NO: 8357 - DNA, 20 bp, Artificial Sequence
  chemically synthesized
ttaactgtataccaaagcat

SEQ ID NO: 8358 - DNA, 20 bp, Artificial Sequence
  chemically synthesized
ccctgtgtgtgctcatgctt

SEQ ID NO: 8359 - DNA, 20 bp, Artificial Sequence
  chemically synthesized
taccaaagcatgagcacaca

SEQ ID NO: 8360 - DNA, 20 bp, Artificial Sequence
  chemically synthesized
accaaagcatgagcacacac

SEQ ID NO: 8361 - DNA, 20 bp, Artificial Sequence
  chemically synthesized
ccaaagcatgagcacacaca

SEQ ID NO: 8362 - DNA, 20 bp, Artificial Sequence
  chemically synthesized
cacacagggattattttgta

SEQ ID NO: 8363 - DNA, 20 bp, Artificial Sequence
  chemically synthesized
acagggattattttgtaaag

SEQ ID NO: 8364 - DNA, 20 bp, Artificial Sequence
  chemically synthesized
tgtaaagtagaacaactaca

SEQ ID NO: 8365 - DNA, 20 bp, Artificial Sequence
  chemically synthesized
cttttagatggcaatctttg

SEQ ID NO: 8366 - DNA, 20 bp, Artificial Sequence
  chemically synthesized
ctacaaagattgccatctaa

SEQ ID NO: 8367 - DNA, 20 bp, Artificial Sequence
  chemically synthesized
tacaaagattgccatctaaa

SEQ ID NO: 8368 - DNA, 20 bp, Artificial Sequence
  chemically synthesized
ttggatctattccttttaga

SEQ ID NO: 8369 - DNA, 20 bp, Artificial Sequence
  chemically synthesized
agattgccatctaaaaggaa

SEQ ID NO: 8370 - DNA, 20 bp, Artificial Sequence
  chemically synthesized
ttctttggatctattccttt

SEQ ID NO: 8371 - DNA, 20 bp, Artificial Sequence
  chemically synthesized
atctaaaaggaatagatcca

SEQ ID NO: 8372 - DNA, 20 bp, Artificial Sequence
  chemically synthesized
agggtaaagccagatttctt

SEQ ID NO: 8373 - DNA, 20 bp, Artificial Sequence
  chemically synthesized
ggaatagatccaaagaaatc

SEQ ID NO: 8374 - DNA, 20 bp, Artificial Sequence
  chemically synthesized
atattatatgagggtaaagc

SEQ ID NO: 8375 - DNA, 20 bp, Artificial Sequence
  chemically synthesized
tttaatattatatgagggta

SEQ ID NO: 8376 - DNA, 20 bp, Artificial Sequence
  chemically synthesized
ctgcttttaatattatatga

SEQ ID NO: 8377 - DNA, 20 bp, Artificial Sequence
  chemically synthesized
gctgcttttaatattatatg

SEQ ID NO: 8378 - DNA, 20 bp, Artificial Sequence
  chemically synthesized
agctgcttttaatattatat

SEQ ID NO: 8379 - DNA, 20 bp, Artificial Sequence
  chemically synthesized
ttaccctcatataatattaa

SEQ ID NO: 8380 - DNA, 20 bp, Artificial Sequence
  chemically synthesized
ccctcatataatattaaaag

SEQ ID NO: 8381 - DNA, 20 bp, Artificial Sequence
  chemically synthesized
ttagattggtggatatgatt

SEQ ID NO: 8382 - DNA, 20 bp, Artificial Sequence
  chemically synthesized
tttgcctgaatttagattgg

SEQ ID NO: 8383 - DNA, 20 bp, Artificial Sequence
  chemically synthesized
acatttgcctgaatttagat

SEQ ID NO: 8384 - DNA, 20 bp, Artificial Sequence
  chemically synthesized
catatccaccaatctaaatt

SEQ ID NO: 8385 - DNA, 20 bp, Artificial Sequence
  chemically synthesized
atatccaccaatctaaattc

SEQ ID NO: 8386 - DNA, 20 bp, Artificial Sequence
  chemically synthesized
ttactacatttgcctgaatt

SEQ ID NO: 8387 - DNA, 20 bp, Artificial Sequence
  chemically synthesized
aatctaaattcaggcaaatg

SEQ ID NO: 8388 - DNA, 20 bp, Artificial Sequence
  chemically synthesized
ggcaaatgtagtaaatcata

SEQ ID NO: 8389 - DNA, 20 bp, Artificial Sequence
  chemically synthesized
taaatcatacagaactatta

SEQ ID NO: 8390 - DNA, 20 bp, Artificial Sequence
  chemically synthesized
atcatacagaactattacag

SEQ ID NO: 8391 - DNA, 20 bp, Artificial Sequence
  chemically synthesized
tacatttatagctgctgtaa

SEQ ID NO: 8392 - DNA, 20 bp, Artificial Sequence
  chemically synthesized
tattacagcagctataaatg

SEQ ID NO: 8393 - DNA, 20 bp, Artificial Sequence
  chemically synthesized
ctgctgattggctacattta

SEQ ID NO: 8394 - DNA, 20 bp, Artificial Sequence
  chemically synthesized
cagctataaatgtagccaat

SEQ ID NO: 8395 - DNA, 20 bp, Artificial Sequence
  chemically synthesized
ctataaatgtagccaatcag

SEQ ID NO: 8396 - DNA, 20 bp, Artificial Sequence
  chemically synthesized
tttaaaaaaaaactgctgat

SEQ ID NO: 8397 - DNA, 20 bp, Artificial Sequence
  chemically synthesized
agcagtttttttttaaatga

SEQ ID NO: 8398 - DNA, 20 bp, Artificial Sequence
  chemically synthesized
aaatgaaagacaaattctgc

SEQ ID NO: 8399 - DNA, 20 bp, Artificial Sequence
  chemically synthesized
gaaagacaaattctgcaagc

SEQ ID NO: 8400 - DNA, 20 bp, Artificial Sequence
  chemically synthesized
tttaaagttcatcttgcttg

SEQ ID NO: 8401 - DNA, 20 bp, Artificial Sequence
  chemically synthesized
gcaagatgaactttaaaaac

SEQ ID NO: 8402 - DNA, 20 bp, Artificial Sequence
  chemically synthesized
aatgcaatttccagttttta

SEQ ID NO: 8403 - DNA, 20 bp, Artificial Sequence
  chemically synthesized
caagggctcaatgcaatttc

SEQ ID NO: 8404 - DNA, 20 bp, Artificial Sequence
  chemically synthesized
taaaaactggaaattgcatt

SEQ ID NO: 8405 - DNA, 20 bp, Artificial Sequence
  chemically synthesized
gagctttattgtaatttcaa

SEQ ID NO: 8406 - DNA, 20 bp, Artificial Sequence
  chemically synthesized
tgagctttattgtaatttca

SEQ ID NO: 8407 - DNA, 20 bp, Artificial Sequence
  chemically synthesized
ctgagctttattgtaatttc

SEQ ID NO: 8408 - DNA, 20 bp, Artificial Sequence
  chemically synthesized
gagcccttgaaattacaata

SEQ ID NO: 8409 - DNA, 20 bp, Artificial Sequence
  chemically synthesized
cttgaaattacaataaagct

SEQ ID NO: 8410 - DNA, 20 bp, Artificial Sequence
  chemically synthesized
tacaataaagctcagtgcaa

SEQ ID NO: 8411 - DNA, 20 bp, Artificial Sequence
  chemically synthesized
caggtgtgagccattgcact

SEQ ID NO: 8412 - DNA, 20 bp, Artificial Sequence
  chemically synthesized
agtgctgggattacaggtgt

SEQ ID NO: 8413 - DNA, 20 bp, Artificial Sequence
  chemically synthesized
atggctcacacctgtaatcc

SEQ ID NO: 8414 - DNA, 20 bp, Artificial Sequence
  chemically synthesized
tcccaaagtgctgggattac

SEQ ID NO: 8415 - DNA, 20 bp, Artificial Sequence
  chemically synthesized
ctcccaaagtgctgggatta

SEQ ID NO: 8416 - DNA, 20 bp, Artificial Sequence
  chemically synthesized
cacctgtaatcccagcactt

SEQ ID NO: 8417 - DNA, 20 bp, Artificial Sequence
  chemically synthesized
cctcaacctcccaaagtgct

SEQ ID NO: 8418 - DNA, 20 bp, Artificial Sequence
  chemically synthesized
acctgtaatcccagcacttt

SEQ ID NO: 8419 - DNA, 20 bp, Artificial Sequence
  chemically synthesized
acctcaacctcccaaagtgc

SEQ ID NO: 8420 - DNA, 20 bp, Artificial Sequence
  chemically synthesized
ctgtaatcccagcactttgg

SEQ ID NO: 8421 - DNA, 20 bp, Artificial Sequence
  chemically synthesized
tgtaatcccagcactttggg

SEQ ID NO: 8422 - DNA, 20 bp, Artificial Sequence
  chemically synthesized
cctcccacctcaacctccca

SEQ ID NO: 8423 - DNA, 20 bp, Artificial Sequence
  chemically synthesized
tcccagcactttgggaggtt

SEQ ID NO: 8424 - DNA, 20 bp, Artificial Sequence
  chemically synthesized
cccagcactttgggaggttg

SEQ ID NO: 8425 - DNA, 20 bp, Artificial Sequence
  chemically synthesized
agcactttgggaggttgagg

SEQ ID NO: 8426 - DNA, 20 bp, Artificial Sequence
  chemically synthesized
gcactttgggaggttgaggt

SEQ ID NO: 8427 - DNA, 20 bp, Artificial Sequence
  chemically synthesized
actttgggaggttgaggtgg

SEQ ID NO: 8428 - DNA, 20 bp, Artificial Sequence
  chemically synthesized
ctttgggaggttgaggtggg

SEQ ID NO: 8429 - DNA, 20 bp, Artificial Sequence
  chemically synthesized
ttgaggtgggaggatcactt

SEQ ID NO: 8430 - DNA, 20 bp, Artificial Sequence
  chemically synthesized
gtgggaggatcacttgagct

SEQ ID NO: 8431 - DNA, 20 bp, Artificial Sequence
  chemically synthesized
tgggaggatcacttgagctc

SEQ ID NO: 8432 - DNA, 20 bp, Artificial Sequence
  chemically synthesized
ggtcttgaactcctgagctc

SEQ ID NO: 8433 - DNA, 20 bp, Artificial Sequence
  chemically synthesized
ggaggatcacttgagctcag

SEQ ID NO: 8434 - DNA, 20 bp, Artificial Sequence
  chemically synthesized
caggctggtcttgaactcct

SEQ ID NO: 8435 - DNA, 20 bp, Artificial Sequence
  chemically synthesized
tcacttgagctcaggagttc

SEQ ID NO: 8436 - DNA, 20 bp, Artificial Sequence
  chemically synthesized
tgagctcaggagttcaagac

SEQ ID NO: 8437 - DNA, 20 bp, Artificial Sequence
  chemically synthesized
tcaggagttcaagaccagcc

SEQ ID NO: 8438 - DNA, 20 bp, Artificial Sequence
  chemically synthesized
caggagttcaagaccagcct

SEQ ID NO: 8439 - DNA, 20 bp, Artificial Sequence
  chemically synthesized
tctccctatgttgcccaggc

SEQ ID NO: 8440 - DNA, 20 bp, Artificial Sequence
  chemically synthesized
ggtgtctccctatgttgccc

SEQ ID NO: 8441 - DNA, 20 bp, Artificial Sequence
  chemically synthesized
caagaccagcctgggcaaca

SEQ ID NO: 8442 - DNA, 20 bp, Artificial Sequence
  chemically synthesized
gggtgtctccctatgttgcc

SEQ ID NO: 8443 - DNA, 20 bp, Artificial Sequence
  chemically synthesized
aagaccagcctgggcaacat

SEQ ID NO: 8444 - DNA, 20 bp, Artificial Sequence
  chemically synthesized
agaccagcctgggcaacata

SEQ ID NO: 8445 - DNA, 20 bp, Artificial Sequence
  chemically synthesized
accagcctgggcaacatagg

SEQ ID NO: 8446 - DNA, 20 bp, Artificial Sequence
  chemically synthesized
tttttttgtaaagatggtgg

SEQ ID NO: 8447 - DNA, 20 bp, Artificial Sequence
  chemically synthesized
atttttttgtaaagatggtg

SEQ ID NO: 8448 - DNA, 20 bp, Artificial Sequence
  chemically synthesized
aatttttttgtaaagatggt

SEQ ID NO: 8449 - DNA, 20 bp, Artificial Sequence
  chemically synthesized
caatttttttgtaaagatgg

SEQ ID NO: 8450 - DNA, 20 bp, Artificial Sequence
  chemically synthesized
tttcaatttttttgtaaaga

SEQ ID NO: 8451 - DNA, 20 bp, Artificial Sequence
  chemically synthesized
tttttttcaatttttttgta

SEQ ID NO: 8452 - DNA, 20 bp, Artificial Sequence
  chemically synthesized
acaaaaaaattgaaaaaaat

SEQ ID NO: 8453 - DNA, 20 bp, Artificial Sequence
  chemically synthesized
caggcatgtgtcacgacata

SEQ ID NO: 8454 - DNA, 20 bp, Artificial Sequence
  chemically synthesized
tatgtcgtgacacatgcctg

SEQ ID NO: 8455 - DNA, 20 bp, Artificial Sequence
  chemically synthesized
gtgacacatgcctgtagtct

SEQ ID NO: 8456 - DNA, 20 bp, Artificial Sequence
  chemically synthesized
tcctgagtagctgagactac

SEQ ID NO: 8457 - DNA, 20 bp, Artificial Sequence
  chemically synthesized
ctcctgagtagctgagacta

SEQ ID NO: 8458 - DNA, 20 bp, Artificial Sequence
  chemically synthesized
tgcctgtagtctcagctact

SEQ ID NO: 8459 - DNA, 20 bp, Artificial Sequence
  chemically synthesized
cctcctcctcctgagtagct

SEQ ID NO: 8460 - DNA, 20 bp, Artificial Sequence
  chemically synthesized
gcctgtagtctcagctactc

SEQ ID NO: 8461 - DNA, 20 bp, Artificial Sequence
  chemically synthesized
ctgtagtctcagctactcag

SEQ ID NO: 8462 - DNA, 20 bp, Artificial Sequence
  chemically synthesized
tgtagtctcagctactcagg

SEQ ID NO: 8463 - DNA, 20 bp, Artificial Sequence
  chemically synthesized
cccagcctcctcctcctgag

SEQ ID NO: 8464 - DNA, 20 bp, Artificial Sequence
  chemically synthesized
tagtctcagctactcaggag

SEQ ID NO: 8465 - DNA, 20 bp, Artificial Sequence
  chemically synthesized
agtctcagctactcaggagg

SEQ ID NO: 8466 - DNA, 20 bp, Artificial Sequence
  chemically synthesized
caccccagcctcctcctcct

SEQ ID NO: 8467 - DNA, 20 bp, Artificial Sequence
  chemically synthesized
tctcagctactcaggaggag

SEQ ID NO: 8468 - DNA, 20 bp, Artificial Sequence
  chemically synthesized
ctcagctactcaggaggagg

SEQ ID NO: 8469 - DNA, 20 bp, Artificial Sequence
  chemically synthesized
gctactcaggaggaggaggc

SEQ ID NO: 8470 - DNA, 20 bp, Artificial Sequence
  chemically synthesized
ctactcaggaggaggaggct

SEQ ID NO: 8471 - DNA, 20 bp, Artificial Sequence
  chemically synthesized
tactcaggaggaggaggctg

SEQ ID NO: 8472 - DNA, 20 bp, Artificial Sequence
  chemically synthesized
tcaggaggaggaggctgggg

SEQ ID NO: 8473 - DNA, 20 bp, Artificial Sequence
  chemically synthesized
caggaggaggaggctggggt

SEQ ID NO: 8474 - DNA, 20 bp, Artificial Sequence
  chemically synthesized
ggaggaggaggctggggtgg

SEQ ID NO: 8475 - DNA, 20 bp, Artificial Sequence
  chemically synthesized
gaggaggaggctggggtggg

SEQ ID NO: 8476 - DNA, 20 bp, Artificial Sequence
  chemically synthesized
ctcaagcggtcctcccaccc

SEQ ID NO: 8477 - DNA, 20 bp, Artificial Sequence
  chemically synthesized
ctggggtgggaggaccgctt

SEQ ID NO: 8478 - DNA, 20 bp, Artificial Sequence
  chemically synthesized
ctcaacctcccagactcaag

SEQ ID NO: 8479 - DNA, 20 bp, Artificial Sequence
  chemically synthesized
gtgggaggaccgcttgagtc

SEQ ID NO: 8480 - DNA, 20 bp, Artificial Sequence
  chemically synthesized
tgggaggaccgcttgagtct

SEQ ID NO: 8481 - DNA, 20 bp, Artificial Sequence
  chemically synthesized
agcctcaacctcccagactc

SEQ ID NO: 8482 - DNA, 20 bp, Artificial Sequence
  chemically synthesized
ggaggaccgcttgagtctgg

SEQ ID NO: 8483 - DNA, 20 bp, Artificial Sequence
  chemically synthesized
gaggaccgcttgagtctggg

SEQ ID NO: 8484 - DNA, 20 bp, Artificial Sequence
  chemically synthesized
ccgcttgagtctgggaggtt

SEQ ID NO: 8485 - DNA, 20 bp, Artificial Sequence
  chemically synthesized
tcactgcagcctcaacctcc

SEQ ID NO: 8486 - DNA, 20 bp, Artificial Sequence
  chemically synthesized
cgcttgagtctgggaggttg

SEQ ID NO: 8487 - DNA, 20 bp, Artificial Sequence
  chemically synthesized
agtctgggaggttgaggctg

SEQ ID NO: 8488 - DNA, 20 bp, Artificial Sequence
  chemically synthesized
tgggaggttgaggctgcagt

SEQ ID NO: 8489 - DNA, 20 bp, Artificial Sequence
  chemically synthesized
ggcatgatcatggctcactg

SEQ ID NO: 8490 - DNA, 20 bp, Artificial Sequence
  chemically synthesized
ggagtgcagtggcatgatca

SEQ ID NO: 8491 - DNA, 20 bp, Artificial Sequence
  chemically synthesized
ttacccagcttggagtgcag

SEQ ID NO: 8492 - DNA, 20 bp, Artificial Sequence
  chemically synthesized
tgatcatgccactgcactcc

SEQ ID NO: 8493 - DNA, 20 bp, Artificial Sequence
  chemically synthesized
ctgttacccagcttggagtg

SEQ ID NO: 8494 - DNA, 20 bp, Artificial Sequence
  chemically synthesized
catgccactgcactccaagc

SEQ ID NO: 8495 - DNA, 20 bp, Artificial Sequence
  chemically synthesized
atgccactgcactccaagct

SEQ ID NO: 8496 - DNA, 20 bp, Artificial Sequence
  chemically synthesized
tccctctgttacccagcttg

SEQ ID NO: 8497 - DNA, 20 bp, Artificial Sequence
  chemically synthesized
tctccctctgttacccagct

SEQ ID NO: 8498 - DNA, 20 bp, Artificial Sequence
  chemically synthesized
ctgcactccaagctgggtaa

SEQ ID NO: 8499 - DNA, 20 bp, Artificial Sequence
  chemically synthesized
gcactccaagctgggtaaca

SEQ ID NO: 8500 - DNA, 20 bp, Artificial Sequence
  chemically synthesized
tggagtctccctctgttacc

SEQ ID NO: 8501 - DNA, 20 bp, Artificial Sequence
  chemically synthesized
cactccaagctgggtaacag

SEQ ID NO: 8502 - DNA, 20 bp, Artificial Sequence
  chemically synthesized
actccaagctgggtaacaga

SEQ ID NO: 8503 - DNA, 20 bp, Artificial Sequence
  chemically synthesized
tccaagctgggtaacagagg

SEQ ID NO: 8504 - DNA, 20 bp, Artificial Sequence
  chemically synthesized
gtcacttttttttttaaatg

SEQ ID NO: 8505 - DNA, 20 bp, Artificial Sequence
  chemically synthesized
ttgtcacttttttttttaaa

SEQ ID NO: 8506 - DNA, 20 bp, Artificial Sequence
  chemically synthesized
gagactccatttaaaaaaaa

SEQ ID NO: 8507 - DNA, 20 bp, Artificial Sequence
  chemically synthesized
aaagtgacaataaaatttta

SEQ ID NO: 8508 - DNA, 20 bp, Artificial Sequence
  chemically synthesized
gacaataaaattttacagta

SEQ ID NO: 8509 - DNA, 20 bp, Artificial Sequence
  chemically synthesized
aaaattttacagtacagctt

SEQ ID NO: 8510 - DNA, 20 bp, Artificial Sequence
  chemically synthesized
gtgtttgataaagatgtcta

SEQ ID NO: 8511 - DNA, 20 bp, Artificial Sequence
  chemically synthesized
ttttgaatttgtgtttgata

SEQ ID NO: 8512 - DNA, 20 bp, Artificial Sequence
  chemically synthesized
attcaaaaatacccctaaac

SEQ ID NO: 8513 - DNA, 20 bp, Artificial Sequence
  chemically synthesized
ttcaaaaatacccctaaact

SEQ ID NO: 8514 - DNA, 20 bp, Artificial Sequence
  chemically synthesized
tctttttccacctagtttag

SEQ ID NO: 8515 - DNA, 20 bp, Artificial Sequence
  chemically synthesized
gtctttttccacctagttta

SEQ ID NO: 8516 - DNA, 20 bp, Artificial Sequence
  chemically synthesized
tgtctttttccacctagttt

SEQ ID NO: 8517 - DNA, 20 bp, Artificial Sequence
  chemically synthesized
aaaaatacccctaaactagg

SEQ ID NO: 8518 - DNA, 20 bp, Artificial Sequence
  chemically synthesized
atgtctttttccacctagtt

SEQ ID NO: 8519 - DNA, 20 bp, Artificial Sequence
  chemically synthesized
tattaatgtctttttccacc

SEQ ID NO: 8520 - DNA, 20 bp, Artificial Sequence
  chemically synthesized
acccctaaactaggtggaaa

SEQ ID NO: 8521 - DNA, 20 bp, Artificial Sequence
  chemically synthesized
aggtggaaaaagacattaat

SEQ ID NO: 8522 - DNA, 20 bp, Artificial Sequence
  chemically synthesized
ggtggaaaaagacattaata

SEQ ID NO: 8523 - DNA, 20 bp, Artificial Sequence
  chemically synthesized
aaaaagacattaataaggat

SEQ ID NO: 8524 - DNA, 20 bp, Artificial Sequence
  chemically synthesized
cattaataaggataagctca

SEQ ID NO: 8525 - DNA, 20 bp, Artificial Sequence
  chemically synthesized
attaataaggataagctcac

SEQ ID NO: 8526 - DNA, 20 bp, Artificial Sequence
  chemically synthesized
ttaataaggataagctcaca

SEQ ID NO: 8527 - DNA, 20 bp, Artificial Sequence
  chemically synthesized
taaggataagctcacagggt

SEQ ID NO: 8528 - DNA, 20 bp, Artificial Sequence
  chemically synthesized
agtcttacttctcaccctgt

SEQ ID NO: 8529 - DNA, 20 bp, Artificial Sequence
  chemically synthesized
ggataagctcacagggtgag

SEQ ID NO: 8530 - DNA, 20 bp, Artificial Sequence
  chemically synthesized
aagctcacagggtgagaagt

SEQ ID NO: 8531 - DNA, 20 bp, Artificial Sequence
  chemically synthesized
aggctgacctaaaatatgca

SEQ ID NO: 8532 - DNA, 20 bp, Artificial Sequence
  chemically synthesized
aagtaagactatgcatattt

SEQ ID NO: 8533 - DNA, 20 bp, Artificial Sequence
  chemically synthesized
agtaagactatgcatatttt

SEQ ID NO: 8534 - DNA, 20 bp, Artificial Sequence
  chemically synthesized
agactatgcatattttaggt

SEQ ID NO: 8535 - DNA, 20 bp, Artificial Sequence
  chemically synthesized
gcatattttaggtcagcctt

SEQ ID NO: 8536 - DNA, 20 bp, Artificial Sequence
  chemically synthesized
catttttactgttttgctta

SEQ ID NO: 8537 - DNA, 20 bp, Artificial Sequence
  chemically synthesized
ccatttttactgttttgctt

SEQ ID NO: 8538 - DNA, 20 bp, Artificial Sequence
  chemically synthesized
taggtcagccttaagcaaaa

SEQ ID NO: 8539 - DNA, 20 bp, Artificial Sequence
  chemically synthesized
cttaagcaaaacagtaaaaa

SEQ ID NO: 8540 - DNA, 20 bp, Artificial Sequence
  chemically synthesized
aagcaaaacagtaaaaatgg

SEQ ID NO: 8541 - DNA, 20 bp, Artificial Sequence
  chemically synthesized
agcaaaacagtaaaaatggc

SEQ ID NO: 8542 - DNA, 20 bp, Artificial Sequence
  chemically synthesized
taaaaatggcaggacccctc

SEQ ID NO: 8543 - DNA, 20 bp, Artificial Sequence
  chemically synthesized
aaaaatggcaggacccctcc

SEQ ID NO: 8544 - DNA, 20 bp, Artificial Sequence
  chemically synthesized
ttagaaacaagagcctggag

SEQ ID NO: 8545 - DNA, 20 bp, Artificial Sequence
  chemically synthesized
attagaaacaagagcctgga

SEQ ID NO: 8546 - DNA, 20 bp, Artificial Sequence
  chemically synthesized
gattagaaacaagagcctgg

SEQ ID NO: 8547 - DNA, 20 bp, Artificial Sequence
  chemically synthesized
tgattagaaacaagagcctg

SEQ ID NO: 8548 - DNA, 20 bp, Artificial Sequence
  chemically synthesized
aatgattagaaacaagagcc

SEQ ID NO: 8549 - DNA, 20 bp, Artificial Sequence
  chemically synthesized
taagaaatgattagaaacaa

SEQ ID NO: 8550 - DNA, 20 bp, Artificial Sequence
  chemically synthesized
gctaagaaatgattagaaac

SEQ ID NO: 8551 - DNA, 20 bp, Artificial Sequence
  chemically synthesized
ggacagtgctaagaaatgat

SEQ ID NO: 8552 - DNA, 20 bp, Artificial Sequence
  chemically synthesized
tcttgtttctaatcatttct

SEQ ID NO: 8553 - DNA, 20 bp, Artificial Sequence
  chemically synthesized
ttttaaagggggacagtgct

SEQ ID NO: 8554 - DNA, 20 bp, Artificial Sequence
  chemically synthesized
ctgaatgttttaaaggggga

SEQ ID NO: 8555 - DNA, 20 bp, Artificial Sequence
  chemically synthesized
ggctctgaatgttttaaagg

SEQ ID NO: 8556 - DNA, 20 bp, Artificial Sequence
  chemically synthesized
aggctctgaatgttttaaag

SEQ ID NO: 8557 - DNA, 20 bp, Artificial Sequence
  chemically synthesized
aaggctctgaatgttttaaa

SEQ ID NO: 8558 - DNA, 20 bp, Artificial Sequence
  chemically synthesized
taaggctctgaatgttttaa

SEQ ID NO: 8559 - DNA, 20 bp, Artificial Sequence
  chemically synthesized
gtaaggctctgaatgtttta

SEQ ID NO: 8560 - DNA, 20 bp, Artificial Sequence
  chemically synthesized
ctgtccccctttaaaacatt

SEQ ID NO: 8561 - DNA, 20 bp, Artificial Sequence
  chemically synthesized
gtccccctttaaaacattca

SEQ ID NO: 8562 - DNA, 20 bp, Artificial Sequence
  chemically synthesized
acattcagagccttacttcc

SEQ ID NO: 8563 - DNA, 20 bp, Artificial Sequence
  chemically synthesized
taggaaagggcttggaagta

SEQ ID NO: 8564 - DNA, 20 bp, Artificial Sequence
  chemically synthesized
gtaggaaagggcttggaagt

SEQ ID NO: 8565 - DNA, 20 bp, Artificial Sequence
  chemically synthesized
ttcagtaggaaagggcttgg

SEQ ID NO: 8566 - DNA, 20 bp, Artificial Sequence
  chemically synthesized
aatttcagtaggaaagggct

SEQ ID NO: 8567 - DNA, 20 bp, Artificial Sequence
  chemically synthesized
gagcaaatttcagtaggaaa

SEQ ID NO: 8568 - DNA, 20 bp, Artificial Sequence
  chemically synthesized
tgagcaaatttcagtaggaa

SEQ ID NO: 8569 - DNA, 20 bp, Artificial Sequence
  chemically synthesized
ctgagcaaatttcagtagga

SEQ ID NO: 8570 - DNA, 20 bp, Artificial Sequence
  chemically synthesized
tatactgagcaaatttcagt

SEQ ID NO: 8571 - DNA, 20 bp, Artificial Sequence
  chemically synthesized
ttatactgagcaaatttcag

SEQ ID NO: 8572 - DNA, 20 bp, Artificial Sequence
  chemically synthesized
cctttatactgagcaaattt

SEQ ID NO: 8573 - DNA, 20 bp, Artificial Sequence
  chemically synthesized
ctttcctactgaaatttgct

SEQ ID NO: 8574 - DNA, 20 bp, Artificial Sequence
  chemically synthesized
actgaaatttgctcagtata

SEQ ID NO: 8575 - DNA, 20 bp, Artificial Sequence
  chemically synthesized
ctgaaatttgctcagtataa

SEQ ID NO: 8576 - DNA, 20 bp, Artificial Sequence
  chemically synthesized
ttatataaaacctttatact

SEQ ID NO: 8577 - DNA, 20 bp, Artificial Sequence
  chemically synthesized
tcagtataaaggttttatat

SEQ ID NO: 8578 - DNA, 20 bp, Artificial Sequence
  chemically synthesized
ataagacatttacattttac

SEQ ID NO: 8579 - DNA, 20 bp, Artificial Sequence
  chemically synthesized
taagacatttacattttact

SEQ ID NO: 8580 - DNA, 20 bp, Artificial Sequence
  chemically synthesized
acaactttattataaaatcc

SEQ ID NO: 8581 - DNA, 20 bp, Artificial Sequence
  chemically synthesized
tttactgggattttataata

SEQ ID NO: 8582 - DNA, 20 bp, Artificial Sequence
  chemically synthesized
aataaagttgtcatttcttc

SEQ ID NO: 8583 - DNA, 20 bp, Artificial Sequence
  chemically synthesized
taaaatgcagatatcactag

SEQ ID NO: 8584 - DNA, 20 bp, Artificial Sequence
  chemically synthesized
ttttaaaatgcagatatcac

SEQ ID NO: 8585 - DNA, 20 bp, Artificial Sequence
  chemically synthesized
ttgacatctgttttaaaatg

SEQ ID NO: 8586 - DNA, 20 bp, Artificial Sequence
  chemically synthesized
gtgatatctgcattttaaaa

SEQ ID NO: 8587 - DNA, 20 bp, Artificial Sequence
  chemically synthesized
gcattttaaaacagatgtca

SEQ ID NO: 8588 - DNA, 20 bp, Artificial Sequence
  chemically synthesized
aacagatgtcaaagaacgta

SEQ ID NO: 8589 - DNA, 20 bp, Artificial Sequence
  chemically synthesized
acagatgtcaaagaacgtaa

SEQ ID NO: 8590 - DNA, 20 bp, Artificial Sequence
  chemically synthesized
aacgtaaaggaaaaaaataa

SEQ ID NO: 8591 - DNA, 20 bp, Artificial Sequence
  chemically synthesized
acctttcccctgatggggca

SEQ ID NO: 8592 - DNA, 20 bp, Artificial Sequence
  chemically synthesized
aaataaaagctttgccccat

SEQ ID NO: 8593 - DNA, 20 bp, Artificial Sequence
  chemically synthesized
aataaaagctttgccccatc

SEQ ID NO: 8594 - DNA, 20 bp, Artificial Sequence
  chemically synthesized
ataaaagctttgccccatca

SEQ ID NO: 8595 - DNA, 20 bp, Artificial Sequence
  chemically synthesized
taaaagctttgccccatcag

SEQ ID NO: 8596 - DNA, 20 bp, Artificial Sequence
  chemically synthesized
gttcaacctttcccctgatg

SEQ ID NO: 8597 - DNA, 20 bp, Artificial Sequence
  chemically synthesized
tgttcaacctttcccctgat

SEQ ID NO: 8598 - DNA, 20 bp, Artificial Sequence
  chemically synthesized
ttgttcaacctttcccctga

SEQ ID NO: 8599 - DNA, 20 bp, Artificial Sequence
  chemically synthesized
agctttgccccatcagggga

SEQ ID NO: 8600 - DNA, 20 bp, Artificial Sequence
  chemically synthesized
gctttgccccatcaggggaa

SEQ ID NO: 8601 - DNA, 20 bp, Artificial Sequence
  chemically synthesized
aaaggcagcgtgtcaaaaag

SEQ ID NO: 8602 - DNA, 20 bp, Artificial Sequence
  chemically synthesized
cacaaaggcagcgtgtcaaa

SEQ ID NO: 8603 - DNA, 20 bp, Artificial Sequence
  chemically synthesized
tttttgacacgctgcctttg

SEQ ID NO: 8604 - DNA, 20 bp, Artificial Sequence
  chemically synthesized
ggtgaaaggcaccacaaagg

SEQ ID NO: 8605 - DNA, 20 bp, Artificial Sequence
  chemically synthesized
gatggtgaaaggcaccacaa

SEQ ID NO: 8606 - DNA, 20 bp, Artificial Sequence
  chemically synthesized
ggatggtgaaaggcaccaca

SEQ ID NO: 8607 - DNA, 20 bp, Artificial Sequence
  chemically synthesized
cctcagccatggatggtgaa

SEQ ID NO: 8608 - DNA, 20 bp, Artificial Sequence
  chemically synthesized
tcctcagccatggatggtga

SEQ ID NO: 8609 - DNA, 20 bp, Artificial Sequence
  chemically synthesized
gtggtgcctttcaccatcca

SEQ ID NO: 8610 - DNA, 20 bp, Artificial Sequence
  chemically synthesized
attctctcctcagccatgga

SEQ ID NO: 8611 - DNA, 20 bp, Artificial Sequence
  chemically synthesized
gcctttcaccatccatggct

SEQ ID NO: 8612 - DNA, 20 bp, Artificial Sequence
  chemically synthesized
cctttcaccatccatggctg

SEQ ID NO: 8613 - DNA, 20 bp, Artificial Sequence
  chemically synthesized
tctaattctctcctcagcca

SEQ ID NO: 8614 - DNA, 20 bp, Artificial Sequence
  chemically synthesized
tttcaccatccatggctgag

SEQ ID NO: 8615 - DNA, 20 bp, Artificial Sequence
  chemically synthesized
tcaccatccatggctgagga

SEQ ID NO: 8616 - DNA, 20 bp, Artificial Sequence
  chemically synthesized
ccttgttctaattctctcct

SEQ ID NO: 8617 - DNA, 20 bp, Artificial Sequence
  chemically synthesized
tccatggctgaggagagaat

SEQ ID NO: 8618 - DNA, 20 bp, Artificial Sequence
  chemically synthesized
gctgaggagagaattagaac

SEQ ID NO: 8619 - DNA, 20 bp, Artificial Sequence
  chemically synthesized
ctgaggagagaattagaaca

SEQ ID NO: 8620 - DNA, 20 bp, Artificial Sequence
  chemically synthesized
agagaattagaacaaggctt

SEQ ID NO: 8621 - DNA, 20 bp, Artificial Sequence
  chemically synthesized
agaattagaacaaggcttga

SEQ ID NO: 8622 - DNA, 20 bp, Artificial Sequence
  chemically synthesized
ttagaacaaggcttgagaga

SEQ ID NO: 8623 - DNA, 20 bp, Artificial Sequence
  chemically synthesized
tgaatccaagaccatctctc

SEQ ID NO: 8624 - DNA, 20 bp, Artificial Sequence
  chemically synthesized
caaggcttgagagatggtct

SEQ ID NO: 8625 - DNA, 20 bp, Artificial Sequence
  chemically synthesized
ttgagagatggtcttggatt

SEQ ID NO: 8626 - DNA, 20 bp, Artificial Sequence
  chemically synthesized
aatcaagatcttctgaatcc

SEQ ID NO: 8627 - DNA, 20 bp, Artificial Sequence
  chemically synthesized
agagatggtcttggattcag

SEQ ID NO: 8628 - DNA, 20 bp, Artificial Sequence
  chemically synthesized
aggcaagtaagtcataaatc

SEQ ID NO: 8629 - DNA, 20 bp, Artificial Sequence
  chemically synthesized
agcaagcagcagaggcaagt

SEQ ID NO: 8630 - DNA, 20 bp, Artificial Sequence
  chemically synthesized
cctcagcaagcagcagaggc

SEQ ID NO: 8631 - DNA, 20 bp, Artificial Sequence
  chemically synthesized
ccagcctcagcaagcagcag

SEQ ID NO: 8632 - DNA, 20 bp, Artificial Sequence
  chemically synthesized
cccagcctcagcaagcagca

SEQ ID NO: 8633 - DNA, 20 bp, Artificial Sequence
  chemically synthesized
tgcccagcctcagcaagcag

SEQ ID NO: 8634 - DNA, 20 bp, Artificial Sequence
  chemically synthesized
acttgcctctgctgcttgct

SEQ ID NO: 8635 - DNA, 20 bp, Artificial Sequence
  chemically synthesized
cttgcctctgctgcttgctg

SEQ ID NO: 8636 - DNA, 20 bp, Artificial Sequence
  chemically synthesized
agttgcccagcctcagcaag

SEQ ID NO: 8637 - DNA, 20 bp, Artificial Sequence
  chemically synthesized
gtcagttgcccagcctcagc

SEQ ID NO: 8638 - DNA, 20 bp, Artificial Sequence
  chemically synthesized
cctctgctgcttgctgaggc

SEQ ID NO: 8639 - DNA, 20 bp, Artificial Sequence
  chemically synthesized
ctctgctgcttgctgaggct

SEQ ID NO: 8640 - DNA, 20 bp, Artificial Sequence
  chemically synthesized
ttaagtcagttgcccagcct

SEQ ID NO: 8641 - DNA, 20 bp, Artificial Sequence
  chemically synthesized
tagtgcttaagtcagttgcc

SEQ ID NO: 8642 - DNA, 20 bp, Artificial Sequence
  chemically synthesized
tgaggctgggcaactgactt

SEQ ID NO: 8643 - DNA, 20 bp, Artificial Sequence
  chemically synthesized
aactgaattagtgcttaagt

SEQ ID NO: 8644 - DNA, 20 bp, Artificial Sequence
  chemically synthesized
tcataactgaattagtgctt

SEQ ID NO: 8645 - DNA, 20 bp, Artificial Sequence
  chemically synthesized
aactgacttaagcactaatt

SEQ ID NO: 8646 - DNA, 20 bp, Artificial Sequence
  chemically synthesized
aataatcctcataactgaat

SEQ ID NO: 8647 - DNA, 20 bp, Artificial Sequence
  chemically synthesized
ttaagcactaattcagttat

SEQ ID NO: 8648 - DNA, 20 bp, Artificial Sequence
  chemically synthesized
taagcactaattcagttatg

SEQ ID NO: 8649 - DNA, 20 bp, Artificial Sequence
  chemically synthesized
attcagttatgaggattatt

SEQ ID NO: 8650 - DNA, 20 bp, Artificial Sequence
  chemically synthesized
agttatgaggattattaagc

SEQ ID NO: 8651 - DNA, 20 bp, Artificial Sequence
  chemically synthesized
tgaggattattaagccagta

SEQ ID NO: 8652 - DNA, 20 bp, Artificial Sequence
  chemically synthesized
atatagaatgtcgaccatac

SEQ ID NO: 8653 - DNA, 20 bp, Artificial Sequence
  chemically synthesized
ttcaaagaaagtttgacata

SEQ ID NO: 8654 - DNA, 20 bp, Artificial Sequence
  chemically synthesized
ggctgggcatggttcaaaga

SEQ ID NO: 8655 - DNA, 20 bp, Artificial Sequence
  chemically synthesized
tatgggctgggcatggttca

SEQ ID NO: 8656 - DNA, 20 bp, Artificial Sequence
  chemically synthesized
aactttctttgaaccatgcc

SEQ ID NO: 8657 - DNA, 20 bp, Artificial Sequence
  chemically synthesized
aacacagtatgggctgggca

SEQ ID NO: 8658 - DNA, 20 bp, Artificial Sequence
  chemically synthesized
tattgaacacagtatgggct

SEQ ID NO: 8659 - DNA, 20 bp, Artificial Sequence
  chemically synthesized
ttattgaacacagtatgggc

SEQ ID NO: 8660 - DNA, 20 bp, Artificial Sequence
  chemically synthesized
acatttattgaacacagtat

SEQ ID NO: 8661 - DNA, 20 bp, Artificial Sequence
  chemically synthesized
aacatttattgaacacagta

SEQ ID NO: 8662 - DNA, 20 bp, Artificial Sequence
  chemically synthesized
taaccaacatttattgaaca

SEQ ID NO: 8663 - DNA, 20 bp, Artificial Sequence
  chemically synthesized
atactgtgttcaataaatgt

SEQ ID NO: 8664 - DNA, 20 bp, Artificial Sequence
  chemically synthesized
agaagtaataacaataataa

SEQ ID NO: 8665 - DNA, 20 bp, Artificial Sequence
  chemically synthesized
taaataatatatagagaaag

SEQ ID NO: 8666 - DNA, 20 bp, Artificial Sequence
  chemically synthesized
aagtaaataatatatagaga

SEQ ID NO: 8667 - DNA, 20 bp, Artificial Sequence
  chemically synthesized
caaaaagtaaataatatata

SEQ ID NO: 8668 - DNA, 20 bp, Artificial Sequence
  chemically synthesized
tccaaaaagtaaataatata

SEQ ID NO: 8669 - DNA, 20 bp, Artificial Sequence
  chemically synthesized
tctatatattatttactttt

SEQ ID NO: 8670 - DNA, 20 bp, Artificial Sequence
  chemically synthesized
tctgaggttctaaatccaaa

SEQ ID NO: 8671 - DNA, 20 bp, Artificial Sequence
  chemically synthesized
tattatttactttttggatt

SEQ ID NO: 8672 - DNA, 20 bp, Artificial Sequence
  chemically synthesized
actttttggatttagaacct

SEQ ID NO: 8673 - DNA, 20 bp, Artificial Sequence
  chemically synthesized
ggaagtttttagcacatctg

SEQ ID NO: 8674 - DNA, 20 bp, Artificial Sequence
  chemically synthesized
aggaagtttttagcacatct

SEQ ID NO: 8675 - DNA, 20 bp, Artificial Sequence
  chemically synthesized
ttctttttataggaagtttt

SEQ ID NO: 8676 - DNA, 20 bp, Artificial Sequence
  chemically synthesized
aagtgctttctttttatagg

SEQ ID NO: 8677 - DNA, 20 bp, Artificial Sequence
  chemically synthesized
tgctaaaaacttcctataaa

SEQ ID NO: 8678 - DNA, 20 bp, Artificial Sequence
  chemically synthesized
attaagtgctttctttttat

SEQ ID NO: 8679 - DNA, 20 bp, Artificial Sequence
  chemically synthesized
aattaagtgctttcttttta

SEQ ID NO: 8680 - DNA, 20 bp, Artificial Sequence
  chemically synthesized
aaaaacttcctataaaaaga

SEQ ID NO: 8681 - DNA, 20 bp, Artificial Sequence
  chemically synthesized
tgcttccatttcagataatt

SEQ ID NO: 8682 - DNA, 20 bp, Artificial Sequence
  chemically synthesized
aagcacttaattatctgaaa

SEQ ID NO: 8683 - DNA, 20 bp, Artificial Sequence
  chemically synthesized
cacttaattatctgaaatgg

SEQ ID NO: 8684 - DNA, 20 bp, Artificial Sequence
  chemically synthesized
taagtagattgcttccattt

SEQ ID NO: 8685 - DNA, 20 bp, Artificial Sequence
  chemically synthesized
tgaaatggaagcaatctact

SEQ ID NO: 8686 - DNA, 20 bp, Artificial Sequence
  chemically synthesized
ccaagctcagtaggtctaag

SEQ ID NO: 8687 - DNA, 20 bp, Artificial Sequence
  chemically synthesized
ctgccaagctcagtaggtct

SEQ ID NO: 8688 - DNA, 20 bp, Artificial Sequence
  chemically synthesized
gcaatctacttagacctact

SEQ ID NO: 8689 - DNA, 20 bp, Artificial Sequence
  chemically synthesized
tatgttctgccaagctcagt

SEQ ID NO: 8690 - DNA, 20 bp, Artificial Sequence
  chemically synthesized
ctacttagacctactgagct

SEQ ID NO: 8691 - DNA, 20 bp, Artificial Sequence
  chemically synthesized
atatgttctgccaagctcag

SEQ ID NO: 8692 - DNA, 20 bp, Artificial Sequence
  chemically synthesized
cttagacctactgagcttgg

SEQ ID NO: 8693 - DNA, 20 bp, Artificial Sequence
  chemically synthesized
tgcatatgttctgccaagct

SEQ ID NO: 8694 - DNA, 20 bp, Artificial Sequence
  chemically synthesized
agatatgcatatgttctgcc

SEQ ID NO: 8695 - DNA, 20 bp, Artificial Sequence
  chemically synthesized
tggcagaacatatgcatatc

SEQ ID NO: 8696 - DNA, 20 bp, Artificial Sequence
  chemically synthesized
acatatgcatatctagcgct

SEQ ID NO: 8697 - DNA, 20 bp, Artificial Sequence
  chemically synthesized
attagtcactttctaagcgc

SEQ ID NO: 8698 - DNA, 20 bp, Artificial Sequence
  chemically synthesized
atgcatatctagcgcttaga

SEQ ID NO: 8699 - DNA, 20 bp, Artificial Sequence
  chemically synthesized
tgagtgattagtcactttct

SEQ ID NO: 8700 - DNA, 20 bp, Artificial Sequence
  chemically synthesized
ttagaaagtgactaatcact

SEQ ID NO: 8701 - DNA, 20 bp, Artificial Sequence
  chemically synthesized
caggacaaatactgagtgat

SEQ ID NO: 8702 - DNA, 20 bp, Artificial Sequence
  chemically synthesized
gtatctacaggacaaatact

SEQ ID NO: 8703 - DNA, 20 bp, Artificial Sequence
  chemically synthesized
atcactcagtatttgtcctg

SEQ ID NO: 8704 - DNA, 20 bp, Artificial Sequence
  chemically synthesized
gctagaactcaggtatctac

SEQ ID NO: 8705 - DNA, 20 bp, Artificial Sequence
  chemically synthesized
ggctagaactcaggtatcta

SEQ ID NO: 8706 - DNA, 20 bp, Artificial Sequence
  chemically synthesized
tatttgtcctgtagatacct

SEQ ID NO: 8707 - DNA, 20 bp, Artificial Sequence
  chemically synthesized
tcctgtagatacctgagttc

SEQ ID NO: 8708 - DNA, 20 bp, Artificial Sequence
  chemically synthesized
gtggctaggggctagaactc

SEQ ID NO: 8709 - DNA, 20 bp, Artificial Sequence
  chemically synthesized
tgtggctaggggctagaact

SEQ ID NO: 8710 - DNA, 20 bp, Artificial Sequence
  chemically synthesized
gatacctgagttctagcccc

SEQ ID NO: 8711 - DNA, 20 bp, Artificial Sequence
  chemically synthesized
gctacaatgtggctaggggc

SEQ ID NO: 8712 - DNA, 20 bp, Artificial Sequence
  chemically synthesized
ggtggctacaatgtggctag

SEQ ID NO: 8713 - DNA, 20 bp, Artificial Sequence
  chemically synthesized
gggtggctacaatgtggcta

SEQ ID NO: 8714 - DNA, 20 bp, Artificial Sequence
  chemically synthesized
ggggtggctacaatgtggct

SEQ ID NO: 8715 - DNA, 20 bp, Artificial Sequence
  chemically synthesized
gggggtggctacaatgtggc

SEQ ID NO: 8716 - DNA, 20 bp, Artificial Sequence
  chemically synthesized
tctagcccctagccacattg

SEQ ID NO: 8717 - DNA, 20 bp, Artificial Sequence
  chemically synthesized
atttgggggtggctacaatg

SEQ ID NO: 8718 - DNA, 20 bp, Artificial Sequence
  chemically synthesized
ataattccaaaatttggggg

SEQ ID NO: 8719 - DNA, 20 bp, Artificial Sequence
  chemically synthesized
acaataattccaaaatttgg

SEQ ID NO: 8720 - DNA, 20 bp, Artificial Sequence
  chemically synthesized
ttgtagccacccccaaattt

SEQ ID NO: 8721 - DNA, 20 bp, Artificial Sequence
  chemically synthesized
cacaataattccaaaatttg

SEQ ID NO: 8722 - DNA, 20 bp, Artificial Sequence
  chemically synthesized
acacaataattccaaaattt

SEQ ID NO: 8723 - DNA, 20 bp, Artificial Sequence
  chemically synthesized
tacacaataattccaaaatt

SEQ ID NO: 8724 - DNA, 20 bp, Artificial Sequence
  chemically synthesized
ctttactaaggcacagatga

SEQ ID NO: 8725 - DNA, 20 bp, Artificial Sequence
  chemically synthesized
atcatccatcatctgtgcct

SEQ ID NO: 8726 - DNA, 20 bp, Artificial Sequence
  chemically synthesized
tgataaactttactaaggca

SEQ ID NO: 8727 - DNA, 20 bp, Artificial Sequence
  chemically synthesized
ccatcatctgtgccttagta

SEQ ID NO: 8728 - DNA, 20 bp, Artificial Sequence
  chemically synthesized
agctgtgataaactttacta

SEQ ID NO: 8729 - DNA, 20 bp, Artificial Sequence
  chemically synthesized
cagctgtgataaactttact

SEQ ID NO: 8730 - DNA, 20 bp, Artificial Sequence
  chemically synthesized
tgccttagtaaagtttatca

SEQ ID NO: 8731 - DNA, 20 bp, Artificial Sequence
  chemically synthesized
gtttatcacagctgaacatc

SEQ ID NO: 8732 - DNA, 20 bp, Artificial Sequence
  chemically synthesized
tttatcacagctgaacatct

SEQ ID NO: 8733 - DNA, 20 bp, Artificial Sequence
  chemically synthesized
tttcattttgcccagatgtt

SEQ ID NO: 8734 - DNA, 20 bp, Artificial Sequence
  chemically synthesized
ctcagtgatttcattttgcc

SEQ ID NO: 8735 - DNA, 20 bp, Artificial Sequence
  chemically synthesized
ctgggcaaaatgaaatcact

SEQ ID NO: 8736 - DNA, 20 bp, Artificial Sequence
  chemically synthesized
caaaatgaaatcactgagtt

SEQ ID NO: 8737 - DNA, 20 bp, Artificial Sequence
  chemically synthesized
tcatcctagtgatcttaact

SEQ ID NO: 8738 - DNA, 20 bp, Artificial Sequence
  chemically synthesized
aatcactgagttaagatcac

SEQ ID NO: 8739 - DNA, 20 bp, Artificial Sequence
  chemically synthesized
atcactgagttaagatcact

SEQ ID NO: 8740 - DNA, 20 bp, Artificial Sequence
  chemically synthesized
tgagttaagatcactaggat

SEQ ID NO: 8741 - DNA, 20 bp, Artificial Sequence
  chemically synthesized
aaatcaaggaaatctcatcc

SEQ ID NO: 8742 - DNA, 20 bp, Artificial Sequence
  chemically synthesized
tagcgtattgggtcaaatca

SEQ ID NO: 8743 - DNA, 20 bp, Artificial Sequence
  chemically synthesized
ctagcgtattgggtcaaatc

SEQ ID NO: 8744 - DNA, 20 bp, Artificial Sequence
  chemically synthesized
cttgatttgacccaatacgc

SEQ ID NO: 8745 - DNA, 20 bp, Artificial Sequence
  chemically synthesized
catcacatacctagcgtatt

SEQ ID NO: 8746 - DNA, 20 bp, Artificial Sequence
  chemically synthesized
ttgatttgacccaatacgct

SEQ ID NO: 8747 - DNA, 20 bp, Artificial Sequence
  chemically synthesized
tcatcacatacctagcgtat

SEQ ID NO: 8748 - DNA, 20 bp, Artificial Sequence
  chemically synthesized
tgacagtttcatcacatacc

SEQ ID NO: 8749 - DNA, 20 bp, Artificial Sequence
  chemically synthesized
atggacatattataatttga

SEQ ID NO: 8750 - DNA, 20 bp, Artificial Sequence
  chemically synthesized
gtcaaattataatatgtcca

SEQ ID NO: 8751 - DNA, 20 bp, Artificial Sequence
  chemically synthesized
tttatttcagcaatgatcca

SEQ ID NO: 8752 - DNA, 20 bp, Artificial Sequence
  chemically synthesized
ttggtccacatattttattt

SEQ ID NO: 8753 - DNA, 20 bp, Artificial Sequence
  chemically synthesized
cattgctgaaataaaatatg

SEQ ID NO: 8754 - DNA, 20 bp, Artificial Sequence
  chemically synthesized
tgaaataaaatatgtggacc

SEQ ID NO: 8755 - DNA, 20 bp, Artificial Sequence
  chemically synthesized
gaaataaaatatgtggacca

SEQ ID NO: 8756 - DNA, 20 bp, Artificial Sequence
  chemically synthesized
aaataaaatatgtggaccaa

SEQ ID NO: 8757 - DNA, 20 bp, Artificial Sequence
  chemically synthesized
aaatatgtggaccaagggta

SEQ ID NO: 8758 - DNA, 20 bp, Artificial Sequence
  chemically synthesized
aatatgtggaccaagggtac

SEQ ID NO: 8759 - DNA, 20 bp, Artificial Sequence
  chemically synthesized
atacattaaccctgtaccct

SEQ ID NO: 8760 - DNA, 20 bp, Artificial Sequence
  chemically synthesized
atatgtggaccaagggtaca

SEQ ID NO: 8761 - DNA, 20 bp, Artificial Sequence
  chemically synthesized
gggtacagggttaatgtatc

SEQ ID NO: 8762 - DNA, 20 bp, Artificial Sequence
  chemically synthesized
ggtacagggttaatgtatct

SEQ ID NO: 8763 - DNA, 20 bp, Artificial Sequence
  chemically synthesized
acagggttaatgtatctagg

SEQ ID NO: 8764 - DNA, 20 bp, Artificial Sequence
  chemically synthesized
agggttaatgtatctaggtg

SEQ ID NO: 8765 - DNA, 20 bp, Artificial Sequence
  chemically synthesized
tccagaaaatagactccacc

SEQ ID NO: 8766 - DNA, 20 bp, Artificial Sequence
  chemically synthesized
tctaggtggagtctattttc

SEQ ID NO: 8767 - DNA, 20 bp, Artificial Sequence
  chemically synthesized
tcaatgacatatccagaaaa

SEQ ID NO: 8768 - DNA, 20 bp, Artificial Sequence
  chemically synthesized
ctacgtgtcaatgacatatc

SEQ ID NO: 8769 - DNA, 20 bp, Artificial Sequence
  chemically synthesized
ctggatatgtcattgacacg

SEQ ID NO: 8770 - DNA, 20 bp, Artificial Sequence
  chemically synthesized
cttggaacttgagcaagata

SEQ ID NO: 8771 - DNA, 20 bp, Artificial Sequence
  chemically synthesized
cgtagatctgtatcttgctc

SEQ ID NO: 8772 - DNA, 20 bp, Artificial Sequence
  chemically synthesized
ctgtctcttggaacttgagc

SEQ ID NO: 8773 - DNA, 20 bp, Artificial Sequence
  chemically synthesized
ctgtatcttgctcaagttcc

SEQ ID NO: 8774 - DNA, 20 bp, Artificial Sequence
  chemically synthesized
tgttctgtctcttggaactt

SEQ ID NO: 8775 - DNA, 20 bp, Artificial Sequence
  chemically synthesized
gtatcttgctcaagttccaa

SEQ ID NO: 8776 - DNA, 20 bp, Artificial Sequence
  chemically synthesized
cttgctcaagttccaagaga

SEQ ID NO: 8777 - DNA, 20 bp, Artificial Sequence
  chemically synthesized
tattgtcatgttctgtctct

SEQ ID NO: 8778 - DNA, 20 bp, Artificial Sequence
  chemically synthesized
cagaacatgacaatattaat

SEQ ID NO: 8779 - DNA, 20 bp, Artificial Sequence
  chemically synthesized
atgacaatattaattggctt

SEQ ID NO: 8780 - DNA, 20 bp, Artificial Sequence
  chemically synthesized
cattaaagattaagaaactg

SEQ ID NO: 8781 - DNA, 20 bp, Artificial Sequence
  chemically synthesized
catctcagtcattaaagatt

SEQ ID NO: 8782 - DNA, 20 bp, Artificial Sequence
  chemically synthesized
gaaaaacatctcagtcatta

SEQ ID NO: 8783 - DNA, 20 bp, Artificial Sequence
  chemically synthesized
tttcttaatctttaatgact

SEQ ID NO: 8784 - DNA, 20 bp, Artificial Sequence
  chemically synthesized
ggaatttgtgaaaaacatct

SEQ ID NO: 8785 - DNA, 20 bp, Artificial Sequence
  chemically synthesized
gtttttcacaaattcctgat

SEQ ID NO: 8786 - DNA, 20 bp, Artificial Sequence
  chemically synthesized
taatgaattagcatctgatc

SEQ ID NO: 8787 - DNA, 20 bp, Artificial Sequence
  chemically synthesized
gtaatgaattagcatctgat

SEQ ID NO: 8788 - DNA, 20 bp, Artificial Sequence
  chemically synthesized
gtctatagacagtaatgaat

SEQ ID NO: 8789 - DNA, 20 bp, Artificial Sequence
  chemically synthesized
tgctaattcattactgtcta

SEQ ID NO: 8790 - DNA, 20 bp, Artificial Sequence
  chemically synthesized
taatacatttagtctataga

SEQ ID NO: 8791 - DNA, 20 bp, Artificial Sequence
  chemically synthesized
tgattaatacatttagtcta

SEQ ID NO: 8792 - DNA, 20 bp, Artificial Sequence
  chemically synthesized
gaacttttgattaatacatt

SEQ ID NO: 8793 - DNA, 20 bp, Artificial Sequence
  chemically synthesized
agactaaatgtattaatcaa

SEQ ID NO: 8794 - DNA, 20 bp, Artificial Sequence
  chemically synthesized
attaatcaaaagttcaacac

SEQ ID NO: 8795 - DNA, 20 bp, Artificial Sequence
  chemically synthesized
aatcaaaagttcaacacaag

SEQ ID NO: 8796 - DNA, 20 bp, Artificial Sequence
  chemically synthesized
tcaacacaagaagaattcat

SEQ ID NO: 8797 - DNA, 20 bp, Artificial Sequence
  chemically synthesized
gtcttatttccagttataag

SEQ ID NO: 8798 - DNA, 20 bp, Artificial Sequence
  chemically synthesized
aaattttaaccacttataac

SEQ ID NO: 8799 - DNA, 20 bp, Artificial Sequence
  chemically synthesized
tctgtcttatttccagttat

SEQ ID NO: 8800 - DNA, 20 bp, Artificial Sequence
  chemically synthesized
aaccacttataactggaaat

SEQ ID NO: 8801 - DNA, 20 bp, Artificial Sequence
  chemically synthesized
ttgttagtctgtcttatttc

SEQ ID NO: 8802 - DNA, 20 bp, Artificial Sequence
  chemically synthesized
acttataactggaaataaga

SEQ ID NO: 8803 - DNA, 20 bp, Artificial Sequence
  chemically synthesized
atttttgtcttaggttttgt

SEQ ID NO: 8804 - DNA, 20 bp, Artificial Sequence
  chemically synthesized
aagacagactaacaaaacct

SEQ ID NO: 8805 - DNA, 20 bp, Artificial Sequence
  chemically synthesized
gccactgccatttttgtctt

SEQ ID NO: 8806 - DNA, 20 bp, Artificial Sequence
  chemically synthesized
agccactgccatttttgtct

SEQ ID NO: 8807 - DNA, 20 bp, Artificial Sequence
  chemically synthesized
aacaaaacctaagacaaaaa

SEQ ID NO: 8808 - DNA, 20 bp, Artificial Sequence
  chemically synthesized
aaaacctaagacaaaaatgg

SEQ ID NO: 8809 - DNA, 20 bp, Artificial Sequence
  chemically synthesized
acctaagacaaaaatggcag

SEQ ID NO: 8810 - DNA, 20 bp, Artificial Sequence
  chemically synthesized
aagacaaaaatggcagtggc

SEQ ID NO: 8811 - DNA, 20 bp, Artificial Sequence
  chemically synthesized
tccttttggctgatgatgac

SEQ ID NO: 8812 - DNA, 20 bp, Artificial Sequence
  chemically synthesized
tggcagtggctggtcatcat

SEQ ID NO: 8813 - DNA, 20 bp, Artificial Sequence
  chemically synthesized
ggctggtcatcatcagccaa

SEQ ID NO: 8814 - DNA, 20 bp, Artificial Sequence
  chemically synthesized
gctggtcatcatcagccaaa

SEQ ID NO: 8815 - DNA, 20 bp, Artificial Sequence
  chemically synthesized
ccaatcctagtttttccttt

SEQ ID NO: 8816 - DNA, 20 bp, Artificial Sequence
  chemically synthesized
catcagccaaaaggaaaaac

SEQ ID NO: 8817 - DNA, 20 bp, Artificial Sequence
  chemically synthesized
atcagccaaaaggaaaaact

SEQ ID NO: 8818 - DNA, 20 bp, Artificial Sequence
  chemically synthesized
ccaaaaggaaaaactaggat

SEQ ID NO: 8819 - DNA, 20 bp, Artificial Sequence
  chemically synthesized
aaaaggaaaaactaggattg

SEQ ID NO: 8820 - DNA, 20 bp, Artificial Sequence
  chemically synthesized
ctctaaaacctctccaatcc

SEQ ID NO: 8821 - DNA, 20 bp, Artificial Sequence
  chemically synthesized
aaggaaaaactaggattgga

SEQ ID NO: 8822 - DNA, 20 bp, Artificial Sequence
  chemically synthesized
aggaaaaactaggattggag

SEQ ID NO: 8823 - DNA, 20 bp, Artificial Sequence
  chemically synthesized
aactaggattggagaggttt

SEQ ID NO: 8824 - DNA, 20 bp, Artificial Sequence
  chemically synthesized
ctaggattggagaggtttta

SEQ ID NO: 8825 - DNA, 20 bp, Artificial Sequence
  chemically synthesized
taggattggagaggttttag

SEQ ID NO: 8826 - DNA, 20 bp, Artificial Sequence
  chemically synthesized
ttggagaggttttagaggtg

SEQ ID NO: 8827 - DNA, 20 bp, Artificial Sequence
  chemically synthesized
gttttagaggtgaagaactc

SEQ ID NO: 8828 - DNA, 20 bp, Artificial Sequence
  chemically synthesized
aggtgaagaactctagtcct

SEQ ID NO: 8829 - DNA, 20 bp, Artificial Sequence
  chemically synthesized
ggcagtattcctgaggacta

SEQ ID NO: 8830 - DNA, 20 bp, Artificial Sequence
  chemically synthesized
ggtgaagaactctagtcctc

SEQ ID NO: 8831 - DNA, 20 bp, Artificial Sequence
  chemically synthesized
atggcagtattcctgaggac

SEQ ID NO: 8832 - DNA, 20 bp, Artificial Sequence
  chemically synthesized
tcccaatggcagtattcctg

SEQ ID NO: 8833 - DNA, 20 bp, Artificial Sequence
  chemically synthesized
ttcccaatggcagtattcct

SEQ ID NO: 8834 - DNA, 20 bp, Artificial Sequence
  chemically synthesized
gtcctcaggaatactgccat

SEQ ID NO: 8835 - DNA, 20 bp, Artificial Sequence
  chemically synthesized
tcctcaggaatactgccatt

SEQ ID NO: 8836 - DNA, 20 bp, Artificial Sequence
  chemically synthesized
aaacacacttttcccaatgg

SEQ ID NO: 8837 - DNA, 20 bp, Artificial Sequence
  chemically synthesized
aggaatactgccattgggaa

SEQ ID NO: 8838 - DNA, 20 bp, Artificial Sequence
  chemically synthesized
tggaaacacacttttcccaa

SEQ ID NO: 8839 - DNA, 20 bp, Artificial Sequence
  chemically synthesized
gaaaagtgtgtttccatttt

SEQ ID NO: 8840 - DNA, 20 bp, Artificial Sequence
  chemically synthesized
ttgctgtatttgtctgaaaa

SEQ ID NO: 8841 - DNA, 20 bp, Artificial Sequence
  chemically synthesized
tttccattttcagacaaata

SEQ ID NO: 8842 - DNA, 20 bp, Artificial Sequence
  chemically synthesized
ttgctgaccacagacaatga

SEQ ID NO: 8843 - DNA, 20 bp, Artificial Sequence
  chemically synthesized
tatcaaactttcattgtctg

SEQ ID NO: 8844 - DNA, 20 bp, Artificial Sequence
  chemically synthesized
aaactttcattgtctgtggt

SEQ ID NO: 8845 - DNA, 20 bp, Artificial Sequence
  chemically synthesized
ttacggctttttgctgacca

SEQ ID NO: 8846 - DNA, 20 bp, Artificial Sequence
  chemically synthesized
cattgtctgtggtcagcaaa

SEQ ID NO: 8847 - DNA, 20 bp, Artificial Sequence
  chemically synthesized
tggtcagcaaaaagccgtaa

SEQ ID NO: 8848 - DNA, 20 bp, Artificial Sequence
  chemically synthesized
gattcttctagagactgtta

SEQ ID NO: 8849 - DNA, 20 bp, Artificial Sequence
  chemically synthesized
caaaaagccgtaacagtctc

SEQ ID NO: 8850 - DNA, 20 bp, Artificial Sequence
  chemically synthesized
aaagccgtaacagtctctag

SEQ ID NO: 8851 - DNA, 20 bp, Artificial Sequence
  chemically synthesized
ttaaaattatgattcttcta

SEQ ID NO: 8852 - DNA, 20 bp, Artificial Sequence
  chemically synthesized
gcttaaaattatgattcttc

SEQ ID NO: 8853 - DNA, 20 bp, Artificial Sequence
  chemically synthesized
tctagaagaatcataatttt

SEQ ID NO: 8854 - DNA, 20 bp, Artificial Sequence
  chemically synthesized
gattgaagccgggacacaca

SEQ ID NO: 8855 - DNA, 20 bp, Artificial Sequence
  chemically synthesized
attttaagctttgtgtgtcc

SEQ ID NO: 8856 - DNA, 20 bp, Artificial Sequence
  chemically synthesized
acgcatgagggattgaagcc

SEQ ID NO: 8857 - DNA, 20 bp, Artificial Sequence
  chemically synthesized
tacgcatgagggattgaagc

SEQ ID NO: 8858 - DNA, 20 bp, Artificial Sequence
  chemically synthesized
taactacgcatgagggattg

SEQ ID NO: 8859 - DNA, 20 bp, Artificial Sequence
  chemically synthesized
cggcttcaatccctcatgcg

SEQ ID NO: 8860 - DNA, 20 bp, Artificial Sequence
  chemically synthesized
ctaagtctaactacgcatga

SEQ ID NO: 8861 - DNA, 20 bp, Artificial Sequence
  chemically synthesized
actaagtctaactacgcatg

SEQ ID NO: 8862 - DNA, 20 bp, Artificial Sequence
  chemically synthesized
gactaagtctaactacgcat

SEQ ID NO: 8863 - DNA, 20 bp, Artificial Sequence
  chemically synthesized
ttcaatccctcatgcgtagt

SEQ ID NO: 8864 - DNA, 20 bp, Artificial Sequence
  chemically synthesized
ccctcatgcgtagttagact

SEQ ID NO: 8865 - DNA, 20 bp, Artificial Sequence
  chemically synthesized
gcgtagttagacttagtctt

SEQ ID NO: 8866 - DNA, 20 bp, Artificial Sequence
  chemically synthesized
tactgggagaacttaagact

SEQ ID NO: 8867 - DNA, 20 bp, Artificial Sequence
  chemically synthesized
tgaagttactgggagaactt

SEQ ID NO: 8868 - DNA, 20 bp, Artificial Sequence
  chemically synthesized
gacttagtcttaagttctcc

SEQ ID NO: 8869 - DNA, 20 bp, Artificial Sequence
  chemically synthesized
catcaaattgaagttactgg

SEQ ID NO: 8870 - DNA, 20 bp, Artificial Sequence
  chemically synthesized
gccatcaaattgaagttact

SEQ ID NO: 8871 - DNA, 20 bp, Artificial Sequence
  chemically synthesized
ggccatcaaattgaagttac

SEQ ID NO: 8872 - DNA, 20 bp, Artificial Sequence
  chemically synthesized
aaaaataggccatcaaattg

SEQ ID NO: 8873 - DNA, 20 bp, Artificial Sequence
  chemically synthesized
tcccagtaacttcaatttga

SEQ ID NO: 8874 - DNA, 20 bp, Artificial Sequence
  chemically synthesized
catgccagggagtgaaaaat

SEQ ID NO: 8875 - DNA, 20 bp, Artificial Sequence
  chemically synthesized
gcatgccagggagtgaaaaa

SEQ ID NO: 8876 - DNA, 20 bp, Artificial Sequence
  chemically synthesized
atggcctatttttcactccc

SEQ ID NO: 8877 - DNA, 20 bp, Artificial Sequence
  chemically synthesized
atatagcagtgcatgccagg

SEQ ID NO: 8878 - DNA, 20 bp, Artificial Sequence
  chemically synthesized
gtatatagcagtgcatgcca

SEQ ID NO: 8879 - DNA, 20 bp, Artificial Sequence
  chemically synthesized
agtatatagcagtgcatgcc

SEQ ID NO: 8880 - DNA, 20 bp, Artificial Sequence
  chemically synthesized
gagtatatagcagtgcatgc

SEQ ID NO: 8881 - DNA, 20 bp, Artificial Sequence
  chemically synthesized
tatatggcaagagtatatag

SEQ ID NO: 8882 - DNA, 20 bp, Artificial Sequence
  chemically synthesized
tcatatatggcaagagtata

SEQ ID NO: 8883 - DNA, 20 bp, Artificial Sequence
  chemically synthesized
cataggatcatatatggcaa

SEQ ID NO: 8884 - DNA, 20 bp, Artificial Sequence
  chemically synthesized
gccataggatcatatatggc

SEQ ID NO: 8885 - DNA, 20 bp, Artificial Sequence
  chemically synthesized
ggaggccataggatcatata

SEQ ID NO: 8886 - DNA, 20 bp, Artificial Sequence
  chemically synthesized
tcttgccatatatgatccta

SEQ ID NO: 8887 - DNA, 20 bp, Artificial Sequence
  chemically synthesized
attgtaatagaggaggccat

SEQ ID NO: 8888 - DNA, 20 bp, Artificial Sequence
  chemically synthesized
cattgtaatagaggaggcca

SEQ ID NO: 8889 - DNA, 20 bp, Artificial Sequence
  chemically synthesized
ttctgtcattgtaatagagg

SEQ ID NO: 8890 - DNA, 20 bp, Artificial Sequence
  chemically synthesized
tttctgtcattgtaatagag

SEQ ID NO: 8891 - DNA, 20 bp, Artificial Sequence
  chemically synthesized
agtttctgtcattgtaatag

SEQ ID NO: 8892 - DNA, 20 bp, Artificial Sequence
  chemically synthesized
tagtttctgtcattgtaata

SEQ ID NO: 8893 - DNA, 20 bp, Artificial Sequence
  chemically synthesized
tatagtttctgtcattgtaa

SEQ ID NO: 8894 - DNA, 20 bp, Artificial Sequence
  chemically synthesized
ggcctcctctattacaatga

SEQ ID NO: 8895 - DNA, 20 bp, Artificial Sequence
  chemically synthesized
tattacaatgacagaaacta

SEQ ID NO: 8896 - DNA, 20 bp, Artificial Sequence
  chemically synthesized
aaaaaaaaaaaaagattcta

SEQ ID NO: 8897 - DNA, 20 bp, Artificial Sequence
  chemically synthesized
aaaaaaagaaaaaaaaaaaa

SEQ ID NO: 8898 - DNA, 20 bp, Artificial Sequence
  chemically synthesized
ttttttttttttcttttttt

SEQ ID NO: 8899 - DNA, 20 bp, Artificial Sequence
  chemically synthesized
gcaaggccctgtctcaaaaa

SEQ ID NO: 8900 - DNA, 20 bp, Artificial Sequence
  chemically synthesized
ttttttttctttttttgaga

SEQ ID NO: 8901 - DNA, 20 bp, Artificial Sequence
  chemically synthesized
tttttttctttttttgagac

SEQ ID NO: 8902 - DNA, 20 bp, Artificial Sequence
  chemically synthesized
ttttttctttttttgagaca

SEQ ID NO: 8903 - DNA, 20 bp, Artificial Sequence
  chemically synthesized
ccagcctgggtgacagagca

SEQ ID NO: 8904 - DNA, 20 bp, Artificial Sequence
  chemically synthesized
tccagcctgggtgacagagc

SEQ ID NO: 8905 - DNA, 20 bp, Artificial Sequence
  chemically synthesized
cagggccttgctctgtcacc

SEQ ID NO: 8906 - DNA, 20 bp, Artificial Sequence
  chemically synthesized
gcactccagcctgggtgaca

SEQ ID NO: 8907 - DNA, 20 bp, Artificial Sequence
  chemically synthesized
agggccttgctctgtcaccc

SEQ ID NO: 8908 - DNA, 20 bp, Artificial Sequence
  chemically synthesized
ctgcactccagcctgggtga

SEQ ID NO: 8909 - DNA, 20 bp, Artificial Sequence
  chemically synthesized
ccttgctctgtcacccaggc

SEQ ID NO: 8910 - DNA, 20 bp, Artificial Sequence
  chemically synthesized
ttgctctgtcacccaggctg

SEQ ID NO: 8911 - DNA, 20 bp, Artificial Sequence
  chemically synthesized
acaccactgcactccagcct

SEQ ID NO: 8912 - DNA, 20 bp, Artificial Sequence
  chemically synthesized
tacaccactgcactccagcc

SEQ ID NO: 8913 - DNA, 20 bp, Artificial Sequence
  chemically synthesized
ctgtcacccaggctggagtg

SEQ ID NO: 8914 - DNA, 20 bp, Artificial Sequence
  chemically synthesized
atgattacaccactgcactc

SEQ ID NO: 8915 - DNA, 20 bp, Artificial Sequence
  chemically synthesized
tcacccaggctggagtgcag

SEQ ID NO: 8916 - DNA, 20 bp, Artificial Sequence
  chemically synthesized
ggagtgcagtggtgtaatca

SEQ ID NO: 8917 - DNA, 20 bp, Artificial Sequence
  chemically synthesized
caggaattcaaggttacagt

SEQ ID NO: 8918 - DNA, 20 bp, Artificial Sequence
  chemically synthesized
agcccaggaattcaaggtta

SEQ ID NO: 8919 - DNA, 20 bp, Artificial Sequence
  chemically synthesized
cacttgagcccaggaattca

SEQ ID NO: 8920 - DNA, 20 bp, Artificial Sequence
  chemically synthesized
tcactgtaaccttgaattcc

SEQ ID NO: 8921 - DNA, 20 bp, Artificial Sequence
  chemically synthesized
tcacttgagcccaggaattc

SEQ ID NO: 8922 - DNA, 20 bp, Artificial Sequence
  chemically synthesized
cactgtaaccttgaattcct

SEQ ID NO: 8923 - DNA, 20 bp, Artificial Sequence
  chemically synthesized
aaccttgaattcctgggctc

SEQ ID NO: 8924 - DNA, 20 bp, Artificial Sequence
  chemically synthesized
ctggaggatcacttgagccc

SEQ ID NO: 8925 - DNA, 20 bp, Artificial Sequence
  chemically synthesized
gctggaggatcacttgagcc

SEQ ID NO: 8926 - DNA, 20 bp, Artificial Sequence
  chemically synthesized
ctggggctggaggatcactt

SEQ ID NO: 8927 - DNA, 20 bp, Artificial Sequence
  chemically synthesized
cctgggctcaagtgatcctc

SEQ ID NO: 8928 - DNA, 20 bp, Artificial Sequence
  chemically synthesized
ctcaagtgatcctccagccc

SEQ ID NO: 8929 - DNA, 20 bp, Artificial Sequence
  chemically synthesized
actcaagaggctggggctgg

SEQ ID NO: 8930 - DNA, 20 bp, Artificial Sequence
  chemically synthesized
tactcaagaggctggggctg

SEQ ID NO: 8931 - DNA, 20 bp, Artificial Sequence
  chemically synthesized
actactcaagaggctggggc

SEQ ID NO: 8932 - DNA, 20 bp, Artificial Sequence
  chemically synthesized
cccaactactcaagaggctg

SEQ ID NO: 8933 - DNA, 20 bp, Artificial Sequence
  chemically synthesized
tcccaactactcaagaggct

SEQ ID NO: 8934 - DNA, 20 bp, Artificial Sequence
  chemically synthesized
tcctccagccccagcctctt

SEQ ID NO: 8935 - DNA, 20 bp, Artificial Sequence
  chemically synthesized
gtcccaactactcaagaggc

SEQ ID NO: 8936 - DNA, 20 bp, Artificial Sequence
  chemically synthesized
tccagccccagcctcttgag

SEQ ID NO: 8937 - DNA, 20 bp, Artificial Sequence
  chemically synthesized
tgtagtcccaactactcaag

SEQ ID NO: 8938 - DNA, 20 bp, Artificial Sequence
  chemically synthesized
ctgtagtcccaactactcaa

SEQ ID NO: 8939 - DNA, 20 bp, Artificial Sequence
  chemically synthesized
gccccagcctcttgagtagt

SEQ ID NO: 8940 - DNA, 20 bp, Artificial Sequence
  chemically synthesized
gcctgtagtcccaactactc

SEQ ID NO: 8941 - DNA, 20 bp, Artificial Sequence
  chemically synthesized
ccccagcctcttgagtagtt

SEQ ID NO: 8942 - DNA, 20 bp, Artificial Sequence
  chemically synthesized
ctcttgagtagttgggacta

SEQ ID NO: 8943 - DNA, 20 bp, Artificial Sequence
  chemically synthesized
tcttgagtagttgggactac

SEQ ID NO: 8944 - DNA, 20 bp, Artificial Sequence
  chemically synthesized
gtagttgggactacaggcat

SEQ ID NO: 8945 - DNA, 20 bp, Artificial Sequence
  chemically synthesized
ggcatggtggctcatgcctg

SEQ ID NO: 8946 - DNA, 20 bp, Artificial Sequence
  chemically synthesized
caggcatgagccaccatgcc

SEQ ID NO: 8947 - DNA, 20 bp, Artificial Sequence
  chemically synthesized
ttttaattagccaggcatgg

SEQ ID NO: 8948 - DNA, 20 bp, Artificial Sequence
  chemically synthesized
tttttttaattagccaggca

SEQ ID NO: 8949 - DNA, 20 bp, Artificial Sequence
  chemically synthesized
atttttttttttaattagcc

SEQ ID NO: 8950 - DNA, 20 bp, Artificial Sequence
  chemically synthesized
aatttttttttttaattagc

SEQ ID NO: 8951 - DNA, 20 bp, Artificial Sequence
  chemically synthesized
ctacaatttttttttttaat

SEQ ID NO: 8952 - DNA, 20 bp, Artificial Sequence
  chemically synthesized
ctaattaaaaaaaaaaattg

SEQ ID NO: 8953 - DNA, 20 bp, Artificial Sequence
  chemically synthesized
aattaaaaaaaaaaattgta

SEQ ID NO: 8954 - DNA, 20 bp, Artificial Sequence
  chemically synthesized
aaaaaaaaaaattgtagaga

SEQ ID NO: 8955 - DNA, 20 bp, Artificial Sequence
  chemically synthesized
accagcctgggcaacatggg

SEQ ID NO: 8956 - DNA, 20 bp, Artificial Sequence
  chemically synthesized
agaccagcctgggcaacatg

SEQ ID NO: 8957 - DNA, 20 bp, Artificial Sequence
  chemically synthesized
gagaccagcctgggcaacat

SEQ ID NO: 8958 - DNA, 20 bp, Artificial Sequence
  chemically synthesized
cggtatctccccatgttgcc

SEQ ID NO: 8959 - DNA, 20 bp, Artificial Sequence
  chemically synthesized
tgagaccagcctgggcaaca

SEQ ID NO: 8960 - DNA, 20 bp, Artificial Sequence
  chemically synthesized
ggtatctccccatgttgccc

SEQ ID NO: 8961 - DNA, 20 bp, Artificial Sequence
  chemically synthesized
tctccccatgttgcccaggc

SEQ ID NO: 8962 - DNA, 20 bp, Artificial Sequence
  chemically synthesized
caagaatttgagaccagcct

SEQ ID NO: 8963 - DNA, 20 bp, Artificial Sequence
  chemically synthesized
ccaagaatttgagaccagcc

SEQ ID NO: 8964 - DNA, 20 bp, Artificial Sequence
  chemically synthesized
tgagaccaagaatttgagac

SEQ ID NO: 8965 - DNA, 20 bp, Artificial Sequence
  chemically synthesized
ccaggctggtctcaaattct

SEQ ID NO: 8966 - DNA, 20 bp, Artificial Sequence
  chemically synthesized
tcacttgagaccaagaattt

SEQ ID NO: 8967 - DNA, 20 bp, Artificial Sequence
  chemically synthesized
ggtctcaaattcttggtctc

SEQ ID NO: 8968 - DNA, 20 bp, Artificial Sequence
  chemically synthesized
tgggaggatcacttgagacc

SEQ ID NO: 8969 - DNA, 20 bp, Artificial Sequence
  chemically synthesized
ctgaggtgggaggatcactt

SEQ ID NO: 8970 - DNA, 20 bp, Artificial Sequence
  chemically synthesized
ctcaagtgatcctcccacct

SEQ ID NO: 8971 - DNA, 20 bp, Artificial Sequence
  chemically synthesized
ctttggcaggctgaggtggg

SEQ ID NO: 8972 - DNA, 20 bp, Artificial Sequence
  chemically synthesized
actttggcaggctgaggtgg

SEQ ID NO: 8973 - DNA, 20 bp, Artificial Sequence
  chemically synthesized
acactttggcaggctgaggt

SEQ ID NO: 8974 - DNA, 20 bp, Artificial Sequence
  chemically synthesized
aacactttggcaggctgagg

SEQ ID NO: 8975 - DNA, 20 bp, Artificial Sequence
  chemically synthesized
cccaacactttggcaggctg

SEQ ID NO: 8976 - DNA, 20 bp, Artificial Sequence
  chemically synthesized
acccaacactttggcaggct

SEQ ID NO: 8977 - DNA, 20 bp, Artificial Sequence
  chemically synthesized
cctcccacctcagcctgcca

SEQ ID NO: 8978 - DNA, 20 bp, Artificial Sequence
  chemically synthesized
tgtaaacccaacactttggc

SEQ ID NO: 8979 - DNA, 20 bp, Artificial Sequence
  chemically synthesized
ctgtaaacccaacactttgg

SEQ ID NO: 8980 - DNA, 20 bp, Artificial Sequence
  chemically synthesized
acctcagcctgccaaagtgt

SEQ ID NO: 8981 - DNA, 20 bp, Artificial Sequence
  chemically synthesized
cctcagcctgccaaagtgtt

SEQ ID NO: 8982 - DNA, 20 bp, Artificial Sequence
  chemically synthesized
cacctgtaaacccaacactt

SEQ ID NO: 8983 - DNA, 20 bp, Artificial Sequence
  chemically synthesized
ctgccaaagtgttgggttta

SEQ ID NO: 8984 - DNA, 20 bp, Artificial Sequence
  chemically synthesized
tgccaaagtgttgggtttac

SEQ ID NO: 8985 - DNA, 20 bp, Artificial Sequence
  chemically synthesized
agtgttgggtttacaggtgt

SEQ ID NO: 8986 - DNA, 20 bp, Artificial Sequence
  chemically synthesized
caggtgtgagccaccatgcc

SEQ ID NO: 8987 - DNA, 20 bp, Artificial Sequence
  chemically synthesized
ttattctgggctgggcatgg

SEQ ID NO: 8988 - DNA, 20 bp, Artificial Sequence
  chemically synthesized
aagttattctgggctgggca

SEQ ID NO: 8989 - DNA, 20 bp, Artificial Sequence
  chemically synthesized
gtgagccaccatgcccagcc

SEQ ID NO: 8990 - DNA, 20 bp, Artificial Sequence
  chemically synthesized
taaagaagttattctgggct

SEQ ID NO: 8991 - DNA, 20 bp, Artificial Sequence
  chemically synthesized
ttaaagaagttattctgggc

SEQ ID NO: 8992 - DNA, 20 bp, Artificial Sequence
  chemically synthesized
tattttaaagaagttattct

SEQ ID NO: 8993 - DNA, 20 bp, Artificial Sequence
  chemically synthesized
ttattttaaagaagttattc

SEQ ID NO: 8994 - DNA, 20 bp, Artificial Sequence
  chemically synthesized
taccggtaattattttaaag

SEQ ID NO: 8995 - DNA, 20 bp, Artificial Sequence
  chemically synthesized
aagtaccggtaattatttta

SEQ ID NO: 8996 - DNA, 20 bp, Artificial Sequence
  chemically synthesized
aacttctttaaaataattac

SEQ ID NO: 8997 - DNA, 20 bp, Artificial Sequence
  chemically synthesized
gaacattcatgtacaagtac

SEQ ID NO: 8998 - DNA, 20 bp, Artificial Sequence
  chemically synthesized
agctatgaacattcatgtac

SEQ ID NO: 8999 - DNA, 20 bp, Artificial Sequence
  chemically synthesized
tacttgtacatgaatgttca

SEQ ID NO: 9000 - DNA, 20 bp, Artificial Sequence
  chemically synthesized
attgtctgttatggataatg

SEQ ID NO: 9001 - DNA, 20 bp, Artificial Sequence
  chemically synthesized
catagctgcattatccataa

SEQ ID NO: 9002 - DNA, 20 bp, Artificial Sequence
  chemically synthesized
tttctacttattgtctgtta

SEQ ID NO: 9003 - DNA, 20 bp, Artificial Sequence
  chemically synthesized
cattatccataacagacaat

SEQ ID NO: 9004 - DNA, 20 bp, Artificial Sequence
  chemically synthesized
tatccataacagacaataag

SEQ ID NO: 9005 - DNA, 20 bp, Artificial Sequence
  chemically synthesized
taacagacaataagtagaaa

SEQ ID NO: 9006 - DNA, 20 bp, Artificial Sequence
  chemically synthesized
tcattacttgatggacattt

SEQ ID NO: 9007 - DNA, 20 bp, Artificial Sequence
  chemically synthesized
ttcattacttgatggacatt

SEQ ID NO: 9008 - DNA, 20 bp, Artificial Sequence
  chemically synthesized
aaatagcccaaatgtccatc

SEQ ID NO: 9009 - DNA, 20 bp, Artificial Sequence
  chemically synthesized
ttaatctattcattacttga

SEQ ID NO: 9010 - DNA, 20 bp, Artificial Sequence
  chemically synthesized
aatgtccatcaagtaatgaa

SEQ ID NO: 9011 - DNA, 20 bp, Artificial Sequence
  chemically synthesized
aatgaatagattaaaaaatg

SEQ ID NO: 9012 - DNA, 20 bp, Artificial Sequence
  chemically synthesized
ctgagtaacatttcattgta

SEQ ID NO: 9013 - DNA, 20 bp, Artificial Sequence
  chemically synthesized
ccatacaatgaaatgttact

SEQ ID NO: 9014 - DNA, 20 bp, Artificial Sequence
  chemically synthesized
tgaaatgttactcagcatta

SEQ ID NO: 9015 - DNA, 20 bp, Artificial Sequence
  chemically synthesized
ttcattctttctttaatgct

SEQ ID NO: 9016 - DNA, 20 bp, Artificial Sequence
  chemically synthesized
atgttactcagcattaaaga

SEQ ID NO: 9017 - DNA, 20 bp, Artificial Sequence
  chemically synthesized
gaaagaatgaaatactaata

SEQ ID NO: 9018 - DNA, 20 bp, Artificial Sequence
  chemically synthesized
aaagaatgaaatactaatac

SEQ ID NO: 9019 - DNA, 20 bp, Artificial Sequence
  chemically synthesized
atctatattatagcccgtat

SEQ ID NO: 9020 - DNA, 20 bp, Artificial Sequence
  chemically synthesized
tactaatacgggctataata

SEQ ID NO: 9021 - DNA, 20 bp, Artificial Sequence
  chemically synthesized
ttaaaatggtatctatatta

SEQ ID NO: 9022 - DNA, 20 bp, Artificial Sequence
  chemically synthesized
taatatagataccattttaa

SEQ ID NO: 9023 - DNA, 20 bp, Artificial Sequence
  chemically synthesized
catagcgtaatcttttaaaa

SEQ ID NO: 9024 - DNA, 20 bp, Artificial Sequence
  chemically synthesized
taaaagattacgctatgtga

SEQ ID NO: 9025 - DNA, 20 bp, Artificial Sequence
  chemically synthesized
tgtgactggcttctttcaca

SEQ ID NO: 9026 - DNA, 20 bp, Artificial Sequence
  chemically synthesized
aagattacgctatgtgaaag

SEQ ID NO: 9027 - DNA, 20 bp, Artificial Sequence
  chemically synthesized
ttacgctatgtgaaagaagc

SEQ ID NO: 9028 - DNA, 20 bp, Artificial Sequence
  chemically synthesized
gtgaaagaagccagtcacaa

SEQ ID NO: 9029 - DNA, 20 bp, Artificial Sequence
  chemically synthesized
aatataaagtcttttgtgac

SEQ ID NO: 9030 - DNA, 20 bp, Artificial Sequence
  chemically synthesized
aaatgaaataatacaatata

SEQ ID NO: 9031 - DNA, 20 bp, Artificial Sequence
  chemically synthesized
tattatttcatttacattaa

SEQ ID NO: 9032 - DNA, 20 bp, Artificial Sequence
  chemically synthesized
tttcatttacattaacagtc

SEQ ID NO: 9033 - DNA, 20 bp, Artificial Sequence
  chemically synthesized
ttacattaacagtccagaat

SEQ ID NO: 9034 - DNA, 20 bp, Artificial Sequence
  chemically synthesized
ctctatggatttgcttattc

SEQ ID NO: 9035 - DNA, 20 bp, Artificial Sequence
  chemically synthesized
gtccagaataagcaaatcca

SEQ ID NO: 9036 - DNA, 20 bp, Artificial Sequence
  chemically synthesized
ccagaataagcaaatccata

SEQ ID NO: 9037 - DNA, 20 bp, Artificial Sequence
  chemically synthesized
aataagcaaatccatagaga

SEQ ID NO: 9038 - DNA, 20 bp, Artificial Sequence
  chemically synthesized
tgatctactttctgtctcta

SEQ ID NO: 9039 - DNA, 20 bp, Artificial Sequence
  chemically synthesized
agcaaatccatagagacaga

SEQ ID NO: 9040 - DNA, 20 bp, Artificial Sequence
  chemically synthesized
aaatccatagagacagaaag

SEQ ID NO: 9041 - DNA, 20 bp, Artificial Sequence
  chemically synthesized
catagagacagaaagtagat

SEQ ID NO: 9042 - DNA, 20 bp, Artificial Sequence
  chemically synthesized
atagagacagaaagtagatc

SEQ ID NO: 9043 - DNA, 20 bp, Artificial Sequence
  chemically synthesized
tagagacagaaagtagatca

SEQ ID NO: 9044 - DNA, 20 bp, Artificial Sequence
  chemically synthesized
gatcagggattgtctactgc

SEQ ID NO: 9045 - DNA, 20 bp, Artificial Sequence
  chemically synthesized
atcagggattgtctactgct

SEQ ID NO: 9046 - DNA, 20 bp, Artificial Sequence
  chemically synthesized
tcagggattgtctactgcta

SEQ ID NO: 9047 - DNA, 20 bp, Artificial Sequence
  chemically synthesized
actcttttcagccctagcag

SEQ ID NO: 9048 - DNA, 20 bp, Artificial Sequence
  chemically synthesized
actactcttttcagccctag

SEQ ID NO: 9049 - DNA, 20 bp, Artificial Sequence
  chemically synthesized
gcaactactcttttcagccc

SEQ ID NO: 9050 - DNA, 20 bp, Artificial Sequence
  chemically synthesized
tgtctactgctagggctgaa

SEQ ID NO: 9051 - DNA, 20 bp, Artificial Sequence
  chemically synthesized
tctactgctagggctgaaaa

SEQ ID NO: 9052 - DNA, 20 bp, Artificial Sequence
  chemically synthesized
actgctagggctgaaaagag

SEQ ID NO: 9053 - DNA, 20 bp, Artificial Sequence
  chemically synthesized
tctcctgcaactactctttt

SEQ ID NO: 9054 - DNA, 20 bp, Artificial Sequence
  chemically synthesized
agggctgaaaagagtagttg

SEQ ID NO: 9055 - DNA, 20 bp, Artificial Sequence
  chemically synthesized
gggctgaaaagagtagttgc

SEQ ID NO: 9056 - DNA, 20 bp, Artificial Sequence
  chemically synthesized
gctgaaaagagtagttgcag

SEQ ID NO: 9057 - DNA, 20 bp, Artificial Sequence
  chemically synthesized
agagtagttgcaggagaaac

SEQ ID NO: 9058 - DNA, 20 bp, Artificial Sequence
  chemically synthesized
gagtagttgcaggagaaacg

SEQ ID NO: 9059 - DNA, 20 bp, Artificial Sequence
  chemically synthesized
gtagttgcaggagaaacgag

SEQ ID NO: 9060 - DNA, 20 bp, Artificial Sequence
  chemically synthesized
aacgaggagtgacttgaaaa

SEQ ID NO: 9061 - DNA, 20 bp, Artificial Sequence
  chemically synthesized
acgaggagtgacttgaaaat

SEQ ID NO: 9062 - DNA, 20 bp, Artificial Sequence
  chemically synthesized
cgaggagtgacttgaaaatg

SEQ ID NO: 9063 - DNA, 20 bp, Artificial Sequence
  chemically synthesized
gaaatcccatccccattttc

SEQ ID NO: 9064 - DNA, 20 bp, Artificial Sequence
  chemically synthesized
gagtgacttgaaaatgggga

SEQ ID NO: 9065 - DNA, 20 bp, Artificial Sequence
  chemically synthesized
agtgacttgaaaatggggat

SEQ ID NO: 9066 - DNA, 20 bp, Artificial Sequence
  chemically synthesized
aatggggatgggatttcttt

SEQ ID NO: 9067 - DNA, 20 bp, Artificial Sequence
  chemically synthesized
atggggatgggatttctttt

SEQ ID NO: 9068 - DNA, 20 bp, Artificial Sequence
  chemically synthesized
tggggatgggatttcttttg

SEQ ID NO: 9069 - DNA, 20 bp, Artificial Sequence
  chemically synthesized
ggggatgggatttcttttgg

SEQ ID NO: 9070 - DNA, 20 bp, Artificial Sequence
  chemically synthesized
gggatgggatttcttttggg

SEQ ID NO: 9071 - DNA, 20 bp, Artificial Sequence
  chemically synthesized
acatttttatcaccccccaa

SEQ ID NO: 9072 - DNA, 20 bp, Artificial Sequence
  chemically synthesized
caaccatcagcgcacaattt

SEQ ID NO: 9073 - DNA, 20 bp, Artificial Sequence
  chemically synthesized
gttctaaaattgtgcgctga

SEQ ID NO: 9074 - DNA, 20 bp, Artificial Sequence
  chemically synthesized
ttacagagttgtgcaaccat

SEQ ID NO: 9075 - DNA, 20 bp, Artificial Sequence
  chemically synthesized
atcactggttattaattaca

SEQ ID NO: 9076 - DNA, 20 bp, Artificial Sequence
  chemically synthesized
taatcactggttattaatta

SEQ ID NO: 9077 - DNA, 20 bp, Artificial Sequence
  chemically synthesized
acaactctgtaattaataac

SEQ ID NO: 9078 - DNA, 20 bp, Artificial Sequence
  chemically synthesized
taaccagtattagtaatcac

SEQ ID NO: 9079 - DNA, 20 bp, Artificial Sequence
  chemically synthesized
taaccagtgattactaatac

SEQ ID NO: 9080 - DNA, 20 bp, Artificial Sequence
  chemically synthesized
gttaataggttaaccagtat

SEQ ID NO: 9081 - DNA, 20 bp, Artificial Sequence
  chemically synthesized
ttattagttaataggttaac

SEQ ID NO: 9082 - DNA, 20 bp, Artificial Sequence
  chemically synthesized
gtcactgattattagttaat

SEQ ID NO: 9083 - DNA, 20 bp, Artificial Sequence
  chemically synthesized
agtcactgattattagttaa

SEQ ID NO: 9084 - DNA, 20 bp, Artificial Sequence
  chemically synthesized
ttaacctattaactaataat

SEQ ID NO: 9085 - DNA, 20 bp, Artificial Sequence
  chemically synthesized
gtgtattagtcactgattat

SEQ ID NO: 9086 - DNA, 20 bp, Artificial Sequence
  chemically synthesized
gttacccatttacagtgtat

SEQ ID NO: 9087 - DNA, 20 bp, Artificial Sequence
  chemically synthesized
agtgactaatacactgtaaa

SEQ ID NO: 9088 - DNA, 20 bp, Artificial Sequence
  chemically synthesized
gtgactaatacactgtaaat

SEQ ID NO: 9089 - DNA, 20 bp, Artificial Sequence
  chemically synthesized
ccataggagttacccattta

SEQ ID NO: 9090 - DNA, 20 bp, Artificial Sequence
  chemically synthesized
ctgtaaatgggtaactccta

SEQ ID NO: 9091 - DNA, 20 bp, Artificial Sequence
  chemically synthesized
atataattctcgtaccatag

SEQ ID NO: 9092 - DNA, 20 bp, Artificial Sequence
  chemically synthesized
atgggtaactcctatggtac

SEQ ID NO: 9093 - DNA, 20 bp, Artificial Sequence
  chemically synthesized
agatataattctcgtaccat

SEQ ID NO: 9094 - DNA, 20 bp, Artificial Sequence
  chemically synthesized
gagatataattctcgtacca

SEQ ID NO: 9095 - DNA, 20 bp, Artificial Sequence
  chemically synthesized
acgagaattatatctcaata

SEQ ID NO: 9096 - DNA, 20 bp, Artificial Sequence
  chemically synthesized
cgagaattatatctcaataa

SEQ ID NO: 9097 - DNA, 20 bp, Artificial Sequence
  chemically synthesized
ttttttataagacctttatt

SEQ ID NO: 9098 - DNA, 20 bp, Artificial Sequence
  chemically synthesized
tctagaacttagttttttat

SEQ ID NO: 9099 - DNA, 20 bp, Artificial Sequence
  chemically synthesized
taaaggtcttataaaaaact

SEQ ID NO: 9100 - DNA, 20 bp, Artificial Sequence
  chemically synthesized
tcttataaaaaactaagttc

SEQ ID NO: 9101 - DNA, 20 bp, Artificial Sequence
  chemically synthesized
aaaattttgaatctagaact

SEQ ID NO: 9102 - DNA, 20 bp, Artificial Sequence
  chemically synthesized
aagaaataaaattttgaatc

SEQ ID NO: 9103 - DNA, 20 bp, Artificial Sequence
  chemically synthesized
attcaaaattttatttctta

SEQ ID NO: 9104 - DNA, 20 bp, Artificial Sequence
  chemically synthesized
ggtaatatcttttgtgctat

SEQ ID NO: 9105 - DNA, 20 bp, Artificial Sequence
  chemically synthesized
ttttatttcttatagcacaa

SEQ ID NO: 9106 - DNA, 20 bp, Artificial Sequence
  chemically synthesized
tagcacaaaagatattaccc

SEQ ID NO: 9107 - DNA, 20 bp, Artificial Sequence
  chemically synthesized
agattttattgttttcactg

SEQ ID NO: 9108 - DNA, 20 bp, Artificial Sequence
  chemically synthesized
aagattttattgttttcact

SEQ ID NO: 9109 - DNA, 20 bp, Artificial Sequence
  chemically synthesized
taagattttattgttttcac

SEQ ID NO: 9110 - DNA, 20 bp, Artificial Sequence
  chemically synthesized
atagtaggagaaagcattat

SEQ ID NO: 9111 - DNA, 20 bp, Artificial Sequence
  chemically synthesized
gatttttccatagtaggaga

SEQ ID NO: 9112 - DNA, 20 bp, Artificial Sequence
  chemically synthesized
tataatgctttctcctacta

SEQ ID NO: 9113 - DNA, 20 bp, Artificial Sequence
  chemically synthesized
ccttgatttttccatagtag

SEQ ID NO: 9114 - DNA, 20 bp, Artificial Sequence
  chemically synthesized
aaccttgatttttccatagt

SEQ ID NO: 9115 - DNA, 20 bp, Artificial Sequence
  chemically synthesized
aaaccttgatttttccatag

SEQ ID NO: 9116 - DNA, 20 bp, Artificial Sequence
  chemically synthesized
gttaaaccttgatttttcca

SEQ ID NO: 9117 - DNA, 20 bp, Artificial Sequence
  chemically synthesized
tctcctactatggaaaaatc

SEQ ID NO: 9118 - DNA, 20 bp, Artificial Sequence
  chemically synthesized
ctcctactatggaaaaatca

SEQ ID NO: 9119 - DNA, 20 bp, Artificial Sequence
  chemically synthesized
catttttcttttatgtacat

SEQ ID NO: 9120 - DNA, 20 bp, Artificial Sequence
  chemically synthesized
ccatttttcttttatgtaca

SEQ ID NO: 9121 - DNA, 20 bp, Artificial Sequence
  chemically synthesized
ggtttaacccatgtacataa

SEQ ID NO: 9122 - DNA, 20 bp, Artificial Sequence
  chemically synthesized
ccatgtacataaaagaaaaa

SEQ ID NO: 9123 - DNA, 20 bp, Artificial Sequence
  chemically synthesized
aaatggtatgcacatgtctt

SEQ ID NO: 9124 - DNA, 20 bp, Artificial Sequence
  chemically synthesized
tgtccacacggataattctg

SEQ ID NO: 9125 - DNA, 20 bp, Artificial Sequence
  chemically synthesized
tgtcttcagaattatccgtg

SEQ ID NO: 9126 - DNA, 20 bp, Artificial Sequence
  chemically synthesized
gaaaatatttaatgtccaca

SEQ ID NO: 9127 - DNA, 20 bp, Artificial Sequence
  chemically synthesized
gtgtggacattaaatatttt

SEQ ID NO: 9128 - DNA, 20 bp, Artificial Sequence
  chemically synthesized
attaaatattttcagatgat

SEQ ID NO: 9129 - DNA, 20 bp, Artificial Sequence
  chemically synthesized
ttcagatgatgagttttaaa

SEQ ID NO: 9130 - DNA, 20 bp, Artificial Sequence
  chemically synthesized
cagatgatgagttttaaaaa

SEQ ID NO: 9131 - DNA, 20 bp, Artificial Sequence
  chemically synthesized
tttaaaaagagtccaaaaat

SEQ ID NO: 9132 - DNA, 20 bp, Artificial Sequence
  chemically synthesized
gcattttctgggcttatttt

SEQ ID NO: 9133 - DNA, 20 bp, Artificial Sequence
  chemically synthesized
aaagagtccaaaaataagcc

SEQ ID NO: 9134 - DNA, 20 bp, Artificial Sequence
  chemically synthesized
cccagacttaagcattttct

SEQ ID NO: 9135 - DNA, 20 bp, Artificial Sequence
  chemically synthesized
acccagacttaagcattttc

SEQ ID NO: 9136 - DNA, 20 bp, Artificial Sequence
  chemically synthesized
aataagcccagaaaatgctt

SEQ ID NO: 9137 - DNA, 20 bp, Artificial Sequence
  chemically synthesized
gcccagaaaatgcttaagtc

SEQ ID NO: 9138 - DNA, 20 bp, Artificial Sequence
  chemically synthesized
cccagaaaatgcttaagtct

SEQ ID NO: 9139 - DNA, 20 bp, Artificial Sequence
  chemically synthesized
gtttaggctaacccagactt

SEQ ID NO: 9140 - DNA, 20 bp, Artificial Sequence
  chemically synthesized
gaaaatgcttaagtctgggt

SEQ ID NO: 9141 - DNA, 20 bp, Artificial Sequence
  chemically synthesized
ccaagttgtttaggctaacc

SEQ ID NO: 9142 - DNA, 20 bp, Artificial Sequence
  chemically synthesized
tgaaaccatccaagttgttt

SEQ ID NO: 9143 - DNA, 20 bp, Artificial Sequence
  chemically synthesized
ctgggttagcctaaacaact

SEQ ID NO: 9144 - DNA, 20 bp, Artificial Sequence
  chemically synthesized
ctgaaaccatccaagttgtt

SEQ ID NO: 9145 - DNA, 20 bp, Artificial Sequence
  chemically synthesized
gttagcctaaacaacttgga

SEQ ID NO: 9146 - DNA, 20 bp, Artificial Sequence
  chemically synthesized
ccattagactgaaaccatcc

SEQ ID NO: 9147 - DNA, 20 bp, Artificial Sequence
  chemically synthesized
ctaaacaacttggatggttt

SEQ ID NO: 9148 - DNA, 20 bp, Artificial Sequence
  chemically synthesized
cttggatggtttcagtctaa

SEQ ID NO: 9149 - DNA, 20 bp, Artificial Sequence
  chemically synthesized
tttgtgatgtcattttccat

SEQ ID NO: 9150 - DNA, 20 bp, Artificial Sequence
  chemically synthesized
aaatgacatcacaaactaaa

SEQ ID NO: 9151 - DNA, 20 bp, Artificial Sequence
  chemically synthesized
aatgacatcacaaactaaac

SEQ ID NO: 9152 - DNA, 20 bp, Artificial Sequence
  chemically synthesized
aatcccttaatatacctgtt

SEQ ID NO: 9153 - DNA, 20 bp, Artificial Sequence
  chemically synthesized
acaaactaaacaggtatatt

SEQ ID NO: 9154 - DNA, 20 bp, Artificial Sequence
  chemically synthesized
caaactaaacaggtatatta

SEQ ID NO: 9155 - DNA, 20 bp, Artificial Sequence
  chemically synthesized
aaactaaacaggtatattaa

SEQ ID NO: 9156 - DNA, 20 bp, Artificial Sequence
  chemically synthesized
acaggtatattaagggattt

SEQ ID NO: 9157 - DNA, 20 bp, Artificial Sequence
  chemically synthesized
caggtatattaagggatttt

SEQ ID NO: 9158 - DNA, 20 bp, Artificial Sequence
  chemically synthesized
tatattaagggattttggga

SEQ ID NO: 9159 - DNA, 20 bp, Artificial Sequence
  chemically synthesized
tttgggaaagaaaataatgt

SEQ ID NO: 9160 - DNA, 20 bp, Artificial Sequence
  chemically synthesized
aagaaaataatgtaagaaat

SEQ ID NO: 9161 - DNA, 20 bp, Artificial Sequence
  chemically synthesized
atgtaagaaatgagaaaaac

SEQ ID NO: 9162 - DNA, 20 bp, Artificial Sequence
  chemically synthesized
tgtaagaaatgagaaaaaca

SEQ ID NO: 9163 - DNA, 20 bp, Artificial Sequence
  chemically synthesized
gtaagaaatgagaaaaacaa

SEQ ID NO: 9164 - DNA, 20 bp, Artificial Sequence
  chemically synthesized
aagaaatgagaaaaacaagg

SEQ ID NO: 9165 - DNA, 20 bp, Artificial Sequence
  chemically synthesized
ggtttttggggttgattttc

SEQ ID NO: 9166 - DNA, 20 bp, Artificial Sequence
  chemically synthesized
gggtttttggggttgatttt

SEQ ID NO: 9167 - DNA, 20 bp, Artificial Sequence
  chemically synthesized
tgttacttgatgggtttttg

SEQ ID NO: 9168 - DNA, 20 bp, Artificial Sequence
  chemically synthesized
ctgttacttgatgggttttt

SEQ ID NO: 9169 - DNA, 20 bp, Artificial Sequence
  chemically synthesized
tctgttacttgatgggtttt

SEQ ID NO: 9170 - DNA, 20 bp, Artificial Sequence
  chemically synthesized
atcaaccccaaaaacccatc

SEQ ID NO: 9171 - DNA, 20 bp, Artificial Sequence
  chemically synthesized
gagtttttctgttacttgat

SEQ ID NO: 9172 - DNA, 20 bp, Artificial Sequence
  chemically synthesized
ggagtttttctgttacttga

SEQ ID NO: 9173 - DNA, 20 bp, Artificial Sequence
  chemically synthesized
cccaaaaacccatcaagtaa

SEQ ID NO: 9174 - DNA, 20 bp, Artificial Sequence
  chemically synthesized
caagtaacagaaaaactcca

SEQ ID NO: 9175 - DNA, 20 bp, Artificial Sequence
  chemically synthesized
aagtaacagaaaaactccaa

SEQ ID NO: 9176 - DNA, 20 bp, Artificial Sequence
  chemically synthesized
gaatgggtaaatatcctttg

SEQ ID NO: 9177 - DNA, 20 bp, Artificial Sequence
  chemically synthesized
atgaatgggtaaatatcctt

SEQ ID NO: 9178 - DNA, 20 bp, Artificial Sequence
  chemically synthesized
aatgtgtcataaaaatgaat

SEQ ID NO: 9179 - DNA, 20 bp, Artificial Sequence
  chemically synthesized
aaatgtgtcataaaaatgaa

SEQ ID NO: 9180 - DNA, 20 bp, Artificial Sequence
  chemically synthesized
ttatgacacatttatgtacc

SEQ ID NO: 9181 - DNA, 20 bp, Artificial Sequence
  chemically synthesized
catttatgtacccagtgctg

SEQ ID NO: 9182 - DNA, 20 bp, Artificial Sequence
  chemically synthesized
atctttatctccacagcact

SEQ ID NO: 9183 - DNA, 20 bp, Artificial Sequence
  chemically synthesized
tatctttatctccacagcac

SEQ ID NO: 9184 - DNA, 20 bp, Artificial Sequence
  chemically synthesized
tttatgtacccagtgctgtg

SEQ ID NO: 9185 - DNA, 20 bp, Artificial Sequence
  chemically synthesized
tacatatatctttatctcca

SEQ ID NO: 9186 - DNA, 20 bp, Artificial Sequence
  chemically synthesized
tacccagtgctgtggagata

SEQ ID NO: 9187 - DNA, 20 bp, Artificial Sequence
  chemically synthesized
tgtggagataaagatatatg

SEQ ID NO: 9188 - DNA, 20 bp, Artificial Sequence
  chemically synthesized
gtggagataaagatatatgt

SEQ ID NO: 9189 - DNA, 20 bp, Artificial Sequence
  chemically synthesized
agctcttcaagggtaaggga

SEQ ID NO: 9190 - DNA, 20 bp, Artificial Sequence
  chemically synthesized
tgtgagctcttcaagggtaa

SEQ ID NO: 9191 - DNA, 20 bp, Artificial Sequence
  chemically synthesized
atgtgagctcttcaagggta

SEQ ID NO: 9192 - DNA, 20 bp, Artificial Sequence
  chemically synthesized
gacactgtcccttacccttg

SEQ ID NO: 9193 - DNA, 20 bp, Artificial Sequence
  chemically synthesized
aatgtgagctcttcaagggt

SEQ ID NO: 9194 - DNA, 20 bp, Artificial Sequence
  chemically synthesized
cactgtcccttacccttgaa

SEQ ID NO: 9195 - DNA, 20 bp, Artificial Sequence
  chemically synthesized
ctagaatgtgagctcttcaa

SEQ ID NO: 9196 - DNA, 20 bp, Artificial Sequence
  chemically synthesized
tctagaatgtgagctcttca

SEQ ID NO: 9197 - DNA, 20 bp, Artificial Sequence
  chemically synthesized
ctctagaatgtgagctcttc

SEQ ID NO: 9198 - DNA, 20 bp, Artificial Sequence
  chemically synthesized
cccttgaagagctcacattc

SEQ ID NO: 9199 - DNA, 20 bp, Artificial Sequence
  chemically synthesized
tatcccacactctagaatgt

SEQ ID NO: 9200 - DNA, 20 bp, Artificial Sequence
  chemically synthesized
cttgaagagctcacattcta

SEQ ID NO: 9201 - DNA, 20 bp, Artificial Sequence
  chemically synthesized
agagctcacattctagagtg

SEQ ID NO: 9202 - DNA, 20 bp, Artificial Sequence
  chemically synthesized
gagctcacattctagagtgt

SEQ ID NO: 9203 - DNA, 20 bp, Artificial Sequence
  chemically synthesized
gtaaacaatatcccacactc

SEQ ID NO: 9204 - DNA, 20 bp, Artificial Sequence
  chemically synthesized
gatattgtttacttccacca

SEQ ID NO: 9205 - DNA, 20 bp, Artificial Sequence
  chemically synthesized
aaggtttgtttccatggtgg

SEQ ID NO: 9206 - DNA, 20 bp, Artificial Sequence
  chemically synthesized
agtaaggtttgtttccatgg

SEQ ID NO: 9207 - DNA, 20 bp, Artificial Sequence
  chemically synthesized
tcgagtaaggtttgtttcca

SEQ ID NO: 9208 - DNA, 20 bp, Artificial Sequence
  chemically synthesized
atggaaacaaaccttactcg

SEQ ID NO: 9209 - DNA, 20 bp, Artificial Sequence
  chemically synthesized
tggaaacaaaccttactcga

SEQ ID NO: 9210 - DNA, 20 bp, Artificial Sequence
  chemically synthesized
agtctttttgccttcgagta

SEQ ID NO: 9211 - DNA, 20 bp, Artificial Sequence
  chemically synthesized
cagtctttttgccttcgagt

SEQ ID NO: 9212 - DNA, 20 bp, Artificial Sequence
  chemically synthesized
ttcccagtctttttgccttc

SEQ ID NO: 9213 - DNA, 20 bp, Artificial Sequence
  chemically synthesized
aaaccttactcgaaggcaaa

SEQ ID NO: 9214 - DNA, 20 bp, Artificial Sequence
  chemically synthesized
ttactcgaaggcaaaaagac

SEQ ID NO: 9215 - DNA, 20 bp, Artificial Sequence
  chemically synthesized
tactcgaaggcaaaaagact

SEQ ID NO: 9216 - DNA, 20 bp, Artificial Sequence
  chemically synthesized
ttagcagtgagcatgattcc

SEQ ID NO: 9217 - DNA, 20 bp, Artificial Sequence
  chemically synthesized
gggaatcatgctcactgcta

SEQ ID NO: 9218 - DNA, 20 bp, Artificial Sequence
  chemically synthesized
gtatttttagctttagcagt

SEQ ID NO: 9219 - DNA, 20 bp, Artificial Sequence
  chemically synthesized
atctgtatttttagctttag

SEQ ID NO: 9220 - DNA, 20 bp, Artificial Sequence
  chemically synthesized
aaaatctgtatttttagctt

SEQ ID NO: 9221 - DNA, 20 bp, Artificial Sequence
  chemically synthesized
cactgctaaagctaaaaata

SEQ ID NO: 9222 - DNA, 20 bp, Artificial Sequence
  chemically synthesized
aagataaaaatctgtatttt

SEQ ID NO: 9223 - DNA, 20 bp, Artificial Sequence
  chemically synthesized
aaatcaaggcgataatttca

SEQ ID NO: 9224 - DNA, 20 bp, Artificial Sequence
  chemically synthesized
tgtaatttcctggtaaatca

SEQ ID NO: 9225 - DNA, 20 bp, Artificial Sequence
  chemically synthesized
aaattatcgccttgatttac

SEQ ID NO: 9226 - DNA, 20 bp, Artificial Sequence
  chemically synthesized
ctgtaatttcctggtaaatc

SEQ ID NO: 9227 - DNA, 20 bp, Artificial Sequence
  chemically synthesized
aattatcgccttgatttacc

SEQ ID NO: 9228 - DNA, 20 bp, Artificial Sequence
  chemically synthesized
attcttttcctgtaatttcc

SEQ ID NO: 9229 - DNA, 20 bp, Artificial Sequence
  chemically synthesized
cttgatttaccaggaaatta

SEQ ID NO: 9230 - DNA, 20 bp, Artificial Sequence
  chemically synthesized
ttgatttaccaggaaattac

SEQ ID NO: 9231 - DNA, 20 bp, Artificial Sequence
  chemically synthesized
ttaccaggaaattacaggaa

SEQ ID NO: 9232 - DNA, 20 bp, Artificial Sequence
  chemically synthesized
attacaggaaaagaatcata

SEQ ID NO: 9233 - DNA, 20 bp, Artificial Sequence
  chemically synthesized
ctgttgtaactacaagtcat

SEQ ID NO: 9234 - DNA, 20 bp, Artificial Sequence
  chemically synthesized
atggatttacttatgacttg

SEQ ID NO: 9235 - DNA, 20 bp, Artificial Sequence
  chemically synthesized
agtctgtctgttgtaactac

SEQ ID NO: 9236 - DNA, 20 bp, Artificial Sequence
  chemically synthesized
cttatgacttgtagttacaa

SEQ ID NO: 9237 - DNA, 20 bp, Artificial Sequence
  chemically synthesized
tgacttgtagttacaacaga

SEQ ID NO: 9238 - DNA, 20 bp, Artificial Sequence
  chemically synthesized
tgtagttacaacagacagac

SEQ ID NO: 9239 - DNA, 20 bp, Artificial Sequence
  chemically synthesized
aacagacagactagcaccat

SEQ ID NO: 9240 - DNA, 20 bp, Artificial Sequence
  chemically synthesized
tctgagttaccttatggtgc

SEQ ID NO: 9241 - DNA, 20 bp, Artificial Sequence
  chemically synthesized
acagacagactagcaccata

SEQ ID NO: 9242 - DNA, 20 bp, Artificial Sequence
  chemically synthesized
ccaaattctgagttacctta

SEQ ID NO: 9243 - DNA, 20 bp, Artificial Sequence
  chemically synthesized
actagcaccataaggtaact

SEQ ID NO: 9244 - DNA, 20 bp, Artificial Sequence
  chemically synthesized
ccataaggtaactcagaatt

SEQ ID NO: 9245 - DNA, 20 bp, Artificial Sequence
  chemically synthesized
ttcttgtgtctccaaattct

SEQ ID NO: 9246 - DNA, 20 bp, Artificial Sequence
  chemically synthesized
ataaggtaactcagaatttg

SEQ ID NO: 9247 - DNA, 20 bp, Artificial Sequence
  chemically synthesized
aactcagaatttggagacac

SEQ ID NO: 9248 - DNA, 20 bp, Artificial Sequence
  chemically synthesized
agaatttggagacacaagaa

SEQ ID NO: 9249 - DNA, 20 bp, Artificial Sequence
  chemically synthesized
gaatttggagacacaagaaa

SEQ ID NO: 9250 - DNA, 20 bp, Artificial Sequence
  chemically synthesized
aaggtcatattttaactatt

SEQ ID NO: 9251 - DNA, 20 bp, Artificial Sequence
  chemically synthesized
tcatattttaactattaaga

SEQ ID NO: 9252 - DNA, 20 bp, Artificial Sequence
  chemically synthesized
ttatttttttactatcttaa

SEQ ID NO: 9253 - DNA, 20 bp, Artificial Sequence
  chemically synthesized
aagatagtaaaaaaataaaa

SEQ ID NO: 9254 - DNA, 20 bp, Artificial Sequence
  chemically synthesized
agatagtaaaaaaataaaat

SEQ ID NO: 9255 - DNA, 20 bp, Artificial Sequence
  chemically synthesized
agtaaaaaaataaaatgggt

SEQ ID NO: 9256 - DNA, 20 bp, Artificial Sequence
  chemically synthesized
aaaaataaaatgggtgagtt

SEQ ID NO: 9257 - DNA, 20 bp, Artificial Sequence
  chemically synthesized
tgggtgagtttagccatctg

SEQ ID NO: 9258 - DNA, 20 bp, Artificial Sequence
  chemically synthesized
gtgagtttagccatctgcag

SEQ ID NO: 9259 - DNA, 20 bp, Artificial Sequence
  chemically synthesized
acatggatggcttctgcaga

SEQ ID NO: 9260 - DNA, 20 bp, Artificial Sequence
  chemically synthesized
atgtacatggatggcttctg

SEQ ID NO: 9261 - DNA, 20 bp, Artificial Sequence
  chemically synthesized
gtattacatatgtacatgga

SEQ ID NO: 9262 - DNA, 20 bp, Artificial Sequence
  chemically synthesized
gttggtattacatatgtaca

SEQ ID NO: 9263 - DNA, 20 bp, Artificial Sequence
  chemically synthesized
atgtacatatgtaataccaa

SEQ ID NO: 9264 - DNA, 20 bp, Artificial Sequence
  chemically synthesized
tgtacatatgtaataccaac

SEQ ID NO: 9265 - DNA, 20 bp, Artificial Sequence
  chemically synthesized
agttagaaatggtttcctgt

SEQ ID NO: 9266 - DNA, 20 bp, Artificial Sequence
  chemically synthesized
atgagcagcccagttagaaa

SEQ ID NO: 9267 - DNA, 20 bp, Artificial Sequence
  chemically synthesized
aacaggaaaccatttctaac

SEQ ID NO: 9268 - DNA, 20 bp, Artificial Sequence
  chemically synthesized
acaggaaaccatttctaact

SEQ ID NO: 9269 - DNA, 20 bp, Artificial Sequence
  chemically synthesized
ttgggcatgagcagcccagt

SEQ ID NO: 9270 - DNA, 20 bp, Artificial Sequence
  chemically synthesized
gtaattgggcatgagcagcc

SEQ ID NO: 9271 - DNA, 20 bp, Artificial Sequence
  chemically synthesized
tgattgtaattgggcatgag

SEQ ID NO: 9272 - DNA, 20 bp, Artificial Sequence
  chemically synthesized
acttgattgtaattgggcat

SEQ ID NO: 9273 - DNA, 20 bp, Artificial Sequence
  chemically synthesized
tgatgtacttgattgtaatt

SEQ ID NO: 9274 - DNA, 20 bp, Artificial Sequence
  chemically synthesized
ctgatgtacttgattgtaat

SEQ ID NO: 9275 - DNA, 20 bp, Artificial Sequence
  chemically synthesized
gctcatgcccaattacaatc

SEQ ID NO: 9276 - DNA, 20 bp, Artificial Sequence
  chemically synthesized
ccaattacaatcaagtacat

SEQ ID NO: 9277 - DNA, 20 bp, Artificial Sequence
  chemically synthesized
caattacaatcaagtacatc

SEQ ID NO: 9278 - DNA, 20 bp, Artificial Sequence
  chemically synthesized
attacaatcaagtacatcag

SEQ ID NO: 9279 - DNA, 20 bp, Artificial Sequence
  chemically synthesized
ttacaatcaagtacatcagg

SEQ ID NO: 9280 - DNA, 20 bp, Artificial Sequence
  chemically synthesized
caagtacatcaggaggtcct

SEQ ID NO: 9281 - DNA, 20 bp, Artificial Sequence
  chemically synthesized
tttgtgtaagaagaagacca

SEQ ID NO: 9282 - DNA, 20 bp, Artificial Sequence
  chemically synthesized
gtttgtgtaagaagaagacc

SEQ ID NO: 9283 - DNA, 20 bp, Artificial Sequence
  chemically synthesized
aagagagtttgtgtaagaag

SEQ ID NO: 9284 - DNA, 20 bp, Artificial Sequence
  chemically synthesized
aggaagagagtttgtgtaag

SEQ ID NO: 9285 - DNA, 20 bp, Artificial Sequence
  chemically synthesized
cctaggaagagagtttgtgt

SEQ ID NO: 9286 - DNA, 20 bp, Artificial Sequence
  chemically synthesized
tcttacacaaactctcttcc

SEQ ID NO: 9287 - DNA, 20 bp, Artificial Sequence
  chemically synthesized
cttacacaaactctcttcct

SEQ ID NO: 9288 - DNA, 20 bp, Artificial Sequence
  chemically synthesized
acagagacctcctaggaaga

SEQ ID NO: 9289 - DNA, 20 bp, Artificial Sequence
  chemically synthesized
tacacaaactctcttcctag

SEQ ID NO: 9290 - DNA, 20 bp, Artificial Sequence
  chemically synthesized
ggacagagacctcctaggaa

SEQ ID NO: 9291 - DNA, 20 bp, Artificial Sequence
  chemically synthesized
acacaaactctcttcctagg

SEQ ID NO: 9292 - DNA, 20 bp, Artificial Sequence
  chemically synthesized
gaggacagagacctcctagg

SEQ ID NO: 9293 - DNA, 20 bp, Artificial Sequence
  chemically synthesized
ggagaggacagagacctcct

SEQ ID NO: 9294 - DNA, 20 bp, Artificial Sequence
  chemically synthesized
gggagaggacagagacctcc

SEQ ID NO: 9295 - DNA, 20 bp, Artificial Sequence
  chemically synthesized
ggaagcctggggagaggaca

SEQ ID NO: 9296 - DNA, 20 bp, Artificial Sequence
  chemically synthesized
atggaagcctggggagagga

SEQ ID NO: 9297 - DNA, 20 bp, Artificial Sequence
  chemically synthesized
ggaggtctctgtcctctccc

SEQ ID NO: 9298 - DNA, 20 bp, Artificial Sequence
  chemically synthesized
gaggtctctgtcctctcccc

SEQ ID NO: 9299 - DNA, 20 bp, Artificial Sequence
  chemically synthesized
ggagatggaagcctggggag

SEQ ID NO: 9300 - DNA, 20 bp, Artificial Sequence
  chemically synthesized
cggagatggaagcctgggga

SEQ ID NO: 9301 - DNA, 20 bp, Artificial Sequence
  chemically synthesized
ggcggagatggaagcctggg

SEQ ID NO: 9302 - DNA, 20 bp, Artificial Sequence
  chemically synthesized
gtggcggagatggaagcctg

SEQ ID NO: 9303 - DNA, 20 bp, Artificial Sequence
  chemically synthesized
tgtggcggagatggaagcct

SEQ ID NO: 9304 - DNA, 20 bp, Artificial Sequence
  chemically synthesized
ttgtggcggagatggaagcc

SEQ ID NO: 9305 - DNA, 20 bp, Artificial Sequence
  chemically synthesized
catggttgtggcggagatgg

SEQ ID NO: 9306 - DNA, 20 bp, Artificial Sequence
  chemically synthesized
ggtcatggttgtggcggaga

SEQ ID NO: 9307 - DNA, 20 bp, Artificial Sequence
  chemically synthesized
aaggggtcatggttgtggcg

SEQ ID NO: 9308 - DNA, 20 bp, Artificial Sequence
  chemically synthesized
ggaaggggtcatggttgtgg

SEQ ID NO: 9309 - DNA, 20 bp, Artificial Sequence
  chemically synthesized
gcgggaaggggtcatggttg

SEQ ID NO: 9310 - DNA, 20 bp, Artificial Sequence
  chemically synthesized
tgagttgcgggaaggggtca

SEQ ID NO: 9311 - DNA, 20 bp, Artificial Sequence
  chemically synthesized
gagtaatgagttgcgggaag

SEQ ID NO: 9312 - DNA, 20 bp, Artificial Sequence
  chemically synthesized
ggagtaatgagttgcgggaa

SEQ ID NO: 9313 - DNA, 20 bp, Artificial Sequence
  chemically synthesized
aggagtaatgagttgcggga

SEQ ID NO: 9314 - DNA, 20 bp, Artificial Sequence
  chemically synthesized
aaggagtaatgagttgcggg

SEQ ID NO: 9315 - DNA, 20 bp, Artificial Sequence
  chemically synthesized
attaaggagtaatgagttgc

SEQ ID NO: 9316 - DNA, 20 bp, Artificial Sequence
  chemically synthesized
gattaaggagtaatgagttg

SEQ ID NO: 9317 - DNA, 20 bp, Artificial Sequence
  chemically synthesized
agtcttgattaaggagtaat

SEQ ID NO: 9318 - DNA, 20 bp, Artificial Sequence
  chemically synthesized
caactcattactccttaatc

SEQ ID NO: 9319 - DNA, 20 bp, Artificial Sequence
  chemically synthesized
gaagagaagtcttgattaag

SEQ ID NO: 9320 - DNA, 20 bp, Artificial Sequence
  chemically synthesized
tagaagagaagtcttgatta

SEQ ID NO: 9321 - DNA, 20 bp, Artificial Sequence
  chemically synthesized
ttagaagagaagtcttgatt

SEQ ID NO: 9322 - DNA, 20 bp, Artificial Sequence
  chemically synthesized
ttaatcaagacttctcttct

SEQ ID NO: 9323 - DNA, 20 bp, Artificial Sequence
  chemically synthesized
ggtctgaagccttagaagag

SEQ ID NO: 9324 - DNA, 20 bp, Artificial Sequence
  chemically synthesized
taatcaagacttctcttcta

SEQ ID NO: 9325 - DNA, 20 bp, Artificial Sequence
  chemically synthesized
ataggtctgaagccttagaa

SEQ ID NO: 9326 - DNA, 20 bp, Artificial Sequence
  chemically synthesized
agataggtctgaagccttag

SEQ ID NO: 9327 - DNA, 20 bp, Artificial Sequence
  chemically synthesized
agacttctcttctaaggctt

SEQ ID NO: 9328 - DNA, 20 bp, Artificial Sequence
  chemically synthesized
gagagataggtctgaagcct

SEQ ID NO: 9329 - DNA, 20 bp, Artificial Sequence
  chemically synthesized
atgttggagagataggtctg

SEQ ID NO: 9330 - DNA, 20 bp, Artificial Sequence
  chemically synthesized
caggagaatgttggagagat

SEQ ID NO: 9331 - DNA, 20 bp, Artificial Sequence
  chemically synthesized
ccaggagaatgttggagaga

SEQ ID NO: 9332 - DNA, 20 bp, Artificial Sequence
  chemically synthesized
ccatccaggagaatgttgga

SEQ ID NO: 9333 - DNA, 20 bp, Artificial Sequence
  chemically synthesized
agccatccaggagaatgttg

SEQ ID NO: 9334 - DNA, 20 bp, Artificial Sequence
  chemically synthesized
ggagccatccaggagaatgt

SEQ ID NO: 9335 - DNA, 20 bp, Artificial Sequence
  chemically synthesized
ctatctctccaacattctcc

SEQ ID NO: 9336 - DNA, 20 bp, Artificial Sequence
  chemically synthesized
ctctccaacattctcctgga

SEQ ID NO: 9337 - DNA, 20 bp, Artificial Sequence
  chemically synthesized
tggctaatggagccatccag

SEQ ID NO: 9338 - DNA, 20 bp, Artificial Sequence
  chemically synthesized
catggctaatggagccatcc

SEQ ID NO: 9339 - DNA, 20 bp, Artificial Sequence
  chemically synthesized
ccatggctaatggagccatc

SEQ ID NO: 9340 - DNA, 20 bp, Artificial Sequence
  chemically synthesized
attctcctggatggctccat

SEQ ID NO: 9341 - DNA, 20 bp, Artificial Sequence
  chemically synthesized
tctagagcccatggctaatg

SEQ ID NO: 9342 - DNA, 20 bp, Artificial Sequence
  chemically synthesized
ctggatggctccattagcca

SEQ ID NO: 9343 - DNA, 20 bp, Artificial Sequence
  chemically synthesized
cttctagagcccatggctaa

SEQ ID NO: 9344 - DNA, 20 bp, Artificial Sequence
  chemically synthesized
tggatggctccattagccat

SEQ ID NO: 9345 - DNA, 20 bp, Artificial Sequence
  chemically synthesized
gctccattagccatgggctc

SEQ ID NO: 9346 - DNA, 20 bp, Artificial Sequence
  chemically synthesized
gtttcagcttctagagccca

SEQ ID NO: 9347 - DNA, 20 bp, Artificial Sequence
  chemically synthesized
ccattagccatgggctctag

SEQ ID NO: 9348 - DNA, 20 bp, Artificial Sequence
  chemically synthesized
ttagcaagtttcagcttcta

SEQ ID NO: 9349 - DNA, 20 bp, Artificial Sequence
  chemically synthesized
gcttagcaagtttcagcttc

SEQ ID NO: 9350 - DNA, 20 bp, Artificial Sequence
  chemically synthesized
gcttggtgcttagcaagttt

SEQ ID NO: 9351 - DNA, 20 bp, Artificial Sequence
  chemically synthesized
tctagaagctgaaacttgct

SEQ ID NO: 9352 - DNA, 20 bp, Artificial Sequence
  chemically synthesized
cgtgtggcttggtgcttagc

SEQ ID NO: 9353 - DNA, 20 bp, Artificial Sequence
  chemically synthesized
gctgaaacttgctaagcacc

SEQ ID NO: 9354 - DNA, 20 bp, Artificial Sequence
  chemically synthesized
acctcgtgtggcttggtgct

SEQ ID NO: 9355 - DNA, 20 bp, Artificial Sequence
  chemically synthesized
tatatcaacctcgtgtggct

SEQ ID NO: 9356 - DNA, 20 bp, Artificial Sequence
  chemically synthesized
tgctaagcaccaagccacac

SEQ ID NO: 9357 - DNA, 20 bp, Artificial Sequence
  chemically synthesized
gctaagcaccaagccacacg

SEQ ID NO: 9358 - DNA, 20 bp, Artificial Sequence
  chemically synthesized
atcagtatatcaacctcgtg

SEQ ID NO: 9359 - DNA, 20 bp, Artificial Sequence
  chemically synthesized
ggttgatatactgattatgc

SEQ ID NO: 9360 - DNA, 20 bp, Artificial Sequence
  chemically synthesized
aattttagagcttgcataat

SEQ ID NO: 9361 - DNA, 20 bp, Artificial Sequence
  chemically synthesized
ttcctggcactgaaatttta

SEQ ID NO: 9362 - DNA, 20 bp, Artificial Sequence
  chemically synthesized
ttatgcaagctctaaaattt

SEQ ID NO: 9363 - DNA, 20 bp, Artificial Sequence
  chemically synthesized
ctttcctggcactgaaattt

SEQ ID NO: 9364 - DNA, 20 bp, Artificial Sequence
  chemically synthesized
aagctctaaaatttcagtgc

SEQ ID NO: 9365 - DNA, 20 bp, Artificial Sequence
  chemically synthesized
agctctaaaatttcagtgcc

SEQ ID NO: 9366 - DNA, 20 bp, Artificial Sequence
  chemically synthesized
ctaaaatttcagtgccagga

SEQ ID NO: 9367 - DNA, 20 bp, Artificial Sequence
  chemically synthesized
taaaatttcagtgccaggaa

SEQ ID NO: 9368 - DNA, 20 bp, Artificial Sequence
  chemically synthesized
gaggaaggctgttcctttcc

SEQ ID NO: 9369 - DNA, 20 bp, Artificial Sequence
  chemically synthesized
tttcagtgccaggaaaggaa

SEQ ID NO: 9370 - DNA, 20 bp, Artificial Sequence
  chemically synthesized
ggaaaggaacagccttcctc

SEQ ID NO: 9371 - DNA, 20 bp, Artificial Sequence
  chemically synthesized
tgtgtaatgctacttgagga

SEQ ID NO: 9372 - DNA, 20 bp, Artificial Sequence
  chemically synthesized
aaggaacagccttcctcaag

SEQ ID NO: 9373 - DNA, 20 bp, Artificial Sequence
  chemically synthesized
ctgtgtaatgctacttgagg

SEQ ID NO: 9374 - DNA, 20 bp, Artificial Sequence
  chemically synthesized
gtcctgtgtaatgctacttg

SEQ ID NO: 9375 - DNA, 20 bp, Artificial Sequence
  chemically synthesized
ggtcctgtgtaatgctactt

SEQ ID NO: 9376 - DNA, 20 bp, Artificial Sequence
  chemically synthesized
cttcctcaagtagcattaca

SEQ ID NO: 9377 - DNA, 20 bp, Artificial Sequence
  chemically synthesized
ttcctcaagtagcattacac

SEQ ID NO: 9378 - DNA, 20 bp, Artificial Sequence
  chemically synthesized
tagcattacacaggaccata

SEQ ID NO: 9379 - DNA, 20 bp, Artificial Sequence
  chemically synthesized
cattacacaggaccatatag

SEQ ID NO: 9380 - DNA, 20 bp, Artificial Sequence
  chemically synthesized
aaagatgtgtagctactata

SEQ ID NO: 9381 - DNA, 20 bp, Artificial Sequence
  chemically synthesized
gtataagttacaaagatgtg

SEQ ID NO: 9382 - DNA, 20 bp, Artificial Sequence
  chemically synthesized
agattaaggtataagttaca

SEQ ID NO: 9383 - DNA, 20 bp, Artificial Sequence
  chemically synthesized
tcaaagtaagattaaggtat

SEQ ID NO: 9384 - DNA, 20 bp, Artificial Sequence
  chemically synthesized
ttcatctcaaagtaagatta

SEQ ID NO: 9385 - DNA, 20 bp, Artificial Sequence
  chemically synthesized
tttcatctcaaagtaagatt

SEQ ID NO: 9386 - DNA, 20 bp, Artificial Sequence
  chemically synthesized
ttataccttaatcttacttt

SEQ ID NO: 9387 - DNA, 20 bp, Artificial Sequence
  chemically synthesized
tatagctttcatctcaaagt

SEQ ID NO: 9388 - DNA, 20 bp, Artificial Sequence
  chemically synthesized
caggtatagctttcatctca

SEQ ID NO: 9389 - DNA, 20 bp, Artificial Sequence
  chemically synthesized
ttaatcttactttgagatga

SEQ ID NO: 9390 - DNA, 20 bp, Artificial Sequence
  chemically synthesized
ttatgacagaaatgcaggta

SEQ ID NO: 9391 - DNA, 20 bp, Artificial Sequence
  chemically synthesized
ttatcttatgacagaaatgc

SEQ ID NO: 9392 - DNA, 20 bp, Artificial Sequence
  chemically synthesized
tttatcttatgacagaaatg

SEQ ID NO: 9393 - DNA, 20 bp, Artificial Sequence
  chemically synthesized
tatacctgcatttctgtcat

SEQ ID NO: 9394 - DNA, 20 bp, Artificial Sequence
  chemically synthesized
tctccctctttatcttatga

SEQ ID NO: 9395 - DNA, 20 bp, Artificial Sequence
  chemically synthesized
tgcatttctgtcataagata

SEQ ID NO: 9396 - DNA, 20 bp, Artificial Sequence
  chemically synthesized
catttctgtcataagataaa

SEQ ID NO: 9397 - DNA, 20 bp, Artificial Sequence
  chemically synthesized
atttctgtcataagataaag

SEQ ID NO: 9398 - DNA, 20 bp, Artificial Sequence
  chemically synthesized
tttctgtcataagataaaga

SEQ ID NO: 9399 - DNA, 20 bp, Artificial Sequence
  chemically synthesized
tctgtcataagataaagagg

SEQ ID NO: 9400 - DNA, 20 bp, Artificial Sequence
  chemically synthesized
gtgtatcatcaacacatggg

SEQ ID NO: 9401 - DNA, 20 bp, Artificial Sequence
  chemically synthesized
aaagtgtatcatcaacacat

SEQ ID NO: 9402 - DNA, 20 bp, Artificial Sequence
  chemically synthesized
taaagtgtatcatcaacaca

SEQ ID NO: 9403 - DNA, 20 bp, Artificial Sequence
  chemically synthesized
tctcctggattgtgatttta

SEQ ID NO: 9404 - DNA, 20 bp, Artificial Sequence
  chemically synthesized
tacactttaaaatcacaatc

SEQ ID NO: 9405 - DNA, 20 bp, Artificial Sequence
  chemically synthesized
acactttaaaatcacaatcc

SEQ ID NO: 9406 - DNA, 20 bp, Artificial Sequence
  chemically synthesized
actttaaaatcacaatccag

SEQ ID NO: 9407 - DNA, 20 bp, Artificial Sequence
  chemically synthesized
tttaaaatcacaatccagga

SEQ ID NO: 9408 - DNA, 20 bp, Artificial Sequence
  chemically synthesized
ttaaaatcacaatccaggag

SEQ ID NO: 9409 - DNA, 20 bp, Artificial Sequence
  chemically synthesized
ttgttgcttgaggcctctcc

SEQ ID NO: 9410 - DNA, 20 bp, Artificial Sequence
  chemically synthesized
cacaatccaggagaggcctc

SEQ ID NO: 9411 - DNA, 20 bp, Artificial Sequence
  chemically synthesized
caaaggccagttgttgcttg

SEQ ID NO: 9412 - DNA, 20 bp, Artificial Sequence
  chemically synthesized
gcaaaggccagttgttgctt

SEQ ID NO: 9413 - DNA, 20 bp, Artificial Sequence
  chemically synthesized
gagaggcctcaagcaacaac

SEQ ID NO: 9414 - DNA, 20 bp, Artificial Sequence
  chemically synthesized
aagtagttagatgcaaaggc

SEQ ID NO: 9415 - DNA, 20 bp, Artificial Sequence
  chemically synthesized
ttgtaagtagttagatgcaa

SEQ ID NO: 9416 - DNA, 20 bp, Artificial Sequence
  chemically synthesized
tttgtaagtagttagatgca

SEQ ID NO: 9417 - DNA, 20 bp, Artificial Sequence
  chemically synthesized
aatctttctttgtaagtagt

SEQ ID NO: 9418 - DNA, 20 bp, Artificial Sequence
  chemically synthesized
tttgcatctaactacttaca

SEQ ID NO: 9419 - DNA, 20 bp, Artificial Sequence
  chemically synthesized
gtggaatctttctttgtaag

SEQ ID NO: 9420 - DNA, 20 bp, Artificial Sequence
  chemically synthesized
catctaactacttacaaaga

SEQ ID NO: 9421 - DNA, 20 bp, Artificial Sequence
  chemically synthesized
actgtggaatctttctttgt

SEQ ID NO: 9422 - DNA, 20 bp, Artificial Sequence
  chemically synthesized
acttacaaagaaagattcca

SEQ ID NO: 9423 - DNA, 20 bp, Artificial Sequence
  chemically synthesized
tagcttcatcacaattactg

SEQ ID NO: 9424 - DNA, 20 bp, Artificial Sequence
  chemically synthesized
attccacagtaattgtgatg

SEQ ID NO: 9425 - DNA, 20 bp, Artificial Sequence
  chemically synthesized
cagtaattgtgatgaagcta

SEQ ID NO: 9426 - DNA, 20 bp, Artificial Sequence
  chemically synthesized
agtaattgtgatgaagctaa

SEQ ID NO: 9427 - DNA, 20 bp, Artificial Sequence
  chemically synthesized
tttaccaaagacagcacctt

SEQ ID NO: 9428 - DNA, 20 bp, Artificial Sequence
  chemically synthesized
gaagctaaaggtgctgtctt

SEQ ID NO: 9429 - DNA, 20 bp, Artificial Sequence
  chemically synthesized
tgaaagatgtttaccaaaga

SEQ ID NO: 9430 - DNA, 20 bp, Artificial Sequence
  chemically synthesized
actttgaaagatgtttacca

SEQ ID NO: 9431 - DNA, 20 bp, Artificial Sequence
  chemically synthesized
tctttggtaaacatctttca

SEQ ID NO: 9432 - DNA, 20 bp, Artificial Sequence
  chemically synthesized
gtgaaatgattgaactttga

SEQ ID NO: 9433 - DNA, 20 bp, Artificial Sequence
  chemically synthesized
tcaaagttcaatcatttcac

SEQ ID NO: 9434 - DNA, 20 bp, Artificial Sequence
  chemically synthesized
agttcaatcatttcacaaga

SEQ ID NO: 9435 - DNA, 20 bp, Artificial Sequence
  chemically synthesized
tcacaagaaagaactcccga

SEQ ID NO: 9436 - DNA, 20 bp, Artificial Sequence
  chemically synthesized
tgcaattaacttgctatcgg

SEQ ID NO: 9437 - DNA, 20 bp, Artificial Sequence
  chemically synthesized
aagaaagaactcccgatagc

SEQ ID NO: 9438 - DNA, 20 bp, Artificial Sequence
  chemically synthesized
gatgcaattaacttgctatc

SEQ ID NO: 9439 - DNA, 20 bp, Artificial Sequence
  chemically synthesized
tgatgcaattaacttgctat

SEQ ID NO: 9440 - DNA, 20 bp, Artificial Sequence
  chemically synthesized
gatagcaagttaattgcatc

SEQ ID NO: 9441 - DNA, 20 bp, Artificial Sequence
  chemically synthesized
agttaattgcatcaagtcac

SEQ ID NO: 9442 - DNA, 20 bp, Artificial Sequence
  chemically synthesized
taattgcatcaagtcactgg

SEQ ID NO: 9443 - DNA, 20 bp, Artificial Sequence
  chemically synthesized
ccaccaagaaaaattgccac

SEQ ID NO: 9444 - DNA, 20 bp, Artificial Sequence
  chemically synthesized
tcactggtggcaatttttct

SEQ ID NO: 9445 - DNA, 20 bp, Artificial Sequence
  chemically synthesized
ctggtggcaatttttcttgg

SEQ ID NO: 9446 - DNA, 20 bp, Artificial Sequence
  chemically synthesized
ggcaatttttcttggtggtt

SEQ ID NO: 9447 - DNA, 20 bp, Artificial Sequence
  chemically synthesized
ggcttttcacccaaaccacc

SEQ ID NO: 9448 - DNA, 20 bp, Artificial Sequence
  chemically synthesized
gcaatttttcttggtggttt

SEQ ID NO: 9449 - DNA, 20 bp, Artificial Sequence
  chemically synthesized
ttcttggtggtttgggtgaa

SEQ ID NO: 9450 - DNA, 20 bp, Artificial Sequence
  chemically synthesized
ggtggtttgggtgaaaagcc

SEQ ID NO: 9451 - DNA, 20 bp, Artificial Sequence
  chemically synthesized
gggtgaaaagccaagttatt

SEQ ID NO: 9452 - DNA, 20 bp, Artificial Sequence
  chemically synthesized
gaatatcccaccgaataact

SEQ ID NO: 9453 - DNA, 20 bp, Artificial Sequence
  chemically synthesized
tgaaaagccaagttattcgg

SEQ ID NO: 9454 - DNA, 20 bp, Artificial Sequence
  chemically synthesized
gaaaagccaagttattcggt

SEQ ID NO: 9455 - DNA, 20 bp, Artificial Sequence
  chemically synthesized
ggtgggatattctacaaaaa

SEQ ID NO: 9456 - DNA, 20 bp, Artificial Sequence
  chemically synthesized
aattctttgcaccatttttg

SEQ ID NO: 9457 - DNA, 20 bp, Artificial Sequence
  chemically synthesized
tattctacaaaaatggtgca

SEQ ID NO: 9458 - DNA, 20 bp, Artificial Sequence
  chemically synthesized
aaagaattttctatgatcat

SEQ ID NO: 9459 - DNA, 20 bp, Artificial Sequence
  chemically synthesized
taaattaactctcatgatca

SEQ ID NO: 9460 - DNA, 20 bp, Artificial Sequence
  chemically synthesized
agaattttctatgatcatga

SEQ ID NO: 9461 - DNA, 20 bp, Artificial Sequence
  chemically synthesized
gttaatttaatacctatctt

SEQ ID NO: 9462 - DNA, 20 bp, Artificial Sequence
  chemically synthesized
agtctgaaaaatctaaagat

SEQ ID NO: 9463 - DNA, 20 bp, Artificial Sequence
  chemically synthesized
tagtctgaaaaatctaaaga

SEQ ID NO: 9464 - DNA, 20 bp, Artificial Sequence
  chemically synthesized
gatttagtctgaaaaatcta

SEQ ID NO: 9465 - DNA, 20 bp, Artificial Sequence
  chemically synthesized
atacctatctttagattttt

SEQ ID NO: 9466 - DNA, 20 bp, Artificial Sequence
  chemically synthesized
acccagaagccagaatgatt

SEQ ID NO: 9467 - DNA, 20 bp, Artificial Sequence
  chemically synthesized
tttttcagactaaatcattc

SEQ ID NO: 9468 - DNA, 20 bp, Artificial Sequence
  chemically synthesized
gactaaatcattctggcttc

SEQ ID NO: 9469 - DNA, 20 bp, Artificial Sequence
  chemically synthesized
actaaatcattctggcttct

SEQ ID NO: 9470 - DNA, 20 bp, Artificial Sequence
  chemically synthesized
taccctgtagacccagaagc

SEQ ID NO: 9471 - DNA, 20 bp, Artificial Sequence
  chemically synthesized
cagttaccctgtagacccag

SEQ ID NO: 9472 - DNA, 20 bp, Artificial Sequence
  chemically synthesized
cattctggcttctgggtcta

SEQ ID NO: 9473 - DNA, 20 bp, Artificial Sequence
  chemically synthesized
attctggcttctgggtctac

SEQ ID NO: 9474 - DNA, 20 bp, Artificial Sequence
  chemically synthesized
aagcagttaccctgtagacc

SEQ ID NO: 9475 - DNA, 20 bp, Artificial Sequence
  chemically synthesized
ttctggcttctgggtctaca

SEQ ID NO: 9476 - DNA, 20 bp, Artificial Sequence
  chemically synthesized
gtggtgaagcagttaccctg

SEQ ID NO: 9477 - DNA, 20 bp, Artificial Sequence
  chemically synthesized
catatgctctagtggtgaag

SEQ ID NO: 9478 - DNA, 20 bp, Artificial Sequence
  chemically synthesized
cagggtaactgcttcaccac

SEQ ID NO: 9479 - DNA, 20 bp, Artificial Sequence
  chemically synthesized
tttcatatgctctagtggtg

SEQ ID NO: 9480 - DNA, 20 bp, Artificial Sequence
  chemically synthesized
gggtaactgcttcaccacta

SEQ ID NO: 9481 - DNA, 20 bp, Artificial Sequence
  chemically synthesized
taacttttcatatgctctag

SEQ ID NO: 9482 - DNA, 20 bp, Artificial Sequence
  chemically synthesized
aagtaacttttcatatgctc

SEQ ID NO: 9483 - DNA, 20 bp, Artificial Sequence
  chemically synthesized
tcaccactagagcatatgaa

SEQ ID NO: 9484 - DNA, 20 bp, Artificial Sequence
  chemically synthesized
agcctggatttttcgcacaa

SEQ ID NO: 9485 - DNA, 20 bp, Artificial Sequence
  chemically synthesized
ttacttttgtgcgaaaaatc

SEQ ID NO: 9486 - DNA, 20 bp, Artificial Sequence
  chemically synthesized
tacttttgtgcgaaaaatcc

SEQ ID NO: 9487 - DNA, 20 bp, Artificial Sequence
  chemically synthesized
aggtgcccacgtaggaagcc

SEQ ID NO: 9488 - DNA, 20 bp, Artificial Sequence
  chemically synthesized
aaaaatccaggcttcctacg

SEQ ID NO: 9489 - DNA, 20 bp, Artificial Sequence
  chemically synthesized
aaaatccaggcttcctacgt

SEQ ID NO: 9490 - DNA, 20 bp, Artificial Sequence
  chemically synthesized
ataacaggtgcccacgtagg

SEQ ID NO: 9491 - DNA, 20 bp, Artificial Sequence
  chemically synthesized
gctataacaggtgcccacgt

SEQ ID NO: 9492 - DNA, 20 bp, Artificial Sequence
  chemically synthesized
agctataacaggtgcccacg

SEQ ID NO: 9493 - DNA, 20 bp, Artificial Sequence
  chemically synthesized
tcctacgtgggcacctgtta

SEQ ID NO: 9494 - DNA, 20 bp, Artificial Sequence
  chemically synthesized
tcagaagataaagctataac

SEQ ID NO: 9495 - DNA, 20 bp, Artificial Sequence
  chemically synthesized
atcagaagataaagctataa

SEQ ID NO: 9496 - DNA, 20 bp, Artificial Sequence
  chemically synthesized
tctgggaacatcagaagata

SEQ ID NO: 9497 - DNA, 20 bp, Artificial Sequence
  chemically synthesized
tgtgtctctgggaacatcag

SEQ ID NO: 9498 - DNA, 20 bp, Artificial Sequence
  chemically synthesized
gctttatcttctgatgttcc

SEQ ID NO: 9499 - DNA, 20 bp, Artificial Sequence
  chemically synthesized
cgttgtgtctctgggaacat

SEQ ID NO: 9500 - DNA, 20 bp, Artificial Sequence
  chemically synthesized
tttatcttctgatgttccca

SEQ ID NO: 9501 - DNA, 20 bp, Artificial Sequence
  chemically synthesized
agcctatccgttgtgtctct

SEQ ID NO: 9502 - DNA, 20 bp, Artificial Sequence
  chemically synthesized
aagcctatccgttgtgtctc

SEQ ID NO: 9503 - DNA, 20 bp, Artificial Sequence
  chemically synthesized
tgatgttcccagagacacaa

SEQ ID NO: 9504 - DNA, 20 bp, Artificial Sequence
  chemically synthesized
gttcccagagacacaacgga

SEQ ID NO: 9505 - DNA, 20 bp, Artificial Sequence
  chemically synthesized
ttcccagagacacaacggat

SEQ ID NO: 9506 - DNA, 20 bp, Artificial Sequence
  chemically synthesized
tctctactgtagttgttgag

SEQ ID NO: 9507 - DNA, 20 bp, Artificial Sequence
  chemically synthesized
gactctctactgtagttgtt

SEQ ID NO: 9508 - DNA, 20 bp, Artificial Sequence
  chemically synthesized
gataggcttctcaacaacta

SEQ ID NO: 9509 - DNA, 20 bp, Artificial Sequence
  chemically synthesized
aggcttctcaacaactacag

SEQ ID NO: 9510 - DNA, 20 bp, Artificial Sequence
  chemically synthesized
gcttctcaacaactacagta

SEQ ID NO: 9511 - DNA, 20 bp, Artificial Sequence
  chemically synthesized
ttctcaacaactacagtaga

SEQ ID NO: 9512 - DNA, 20 bp, Artificial Sequence
  chemically synthesized
gcatagttgactctctactg

SEQ ID NO: 9513 - DNA, 20 bp, Artificial Sequence
  chemically synthesized
aaccagtctaggagatagca

SEQ ID NO: 9514 - DNA, 20 bp, Artificial Sequence
  chemically synthesized
gagtcaactatgctatctcc

SEQ ID NO: 9515 - DNA, 20 bp, Artificial Sequence
  chemically synthesized
ttgaaaaccagtctaggaga

SEQ ID NO: 9516 - DNA, 20 bp, Artificial Sequence
  chemically synthesized
aactatgctatctcctagac

SEQ ID NO: 9517 - DNA, 20 bp, Artificial Sequence
  chemically synthesized
aactttgaaaaccagtctag

SEQ ID NO: 9518 - DNA, 20 bp, Artificial Sequence
  chemically synthesized
taaactttgaaaaccagtct

SEQ ID NO: 9519 - DNA, 20 bp, Artificial Sequence
  chemically synthesized
gtaaactttgaaaaccagtc

SEQ ID NO: 9520 - DNA, 20 bp, Artificial Sequence
  chemically synthesized
atctcctagactggttttca

SEQ ID NO: 9521 - DNA, 20 bp, Artificial Sequence
  chemically synthesized
ctgaagtaaactttgaaaac

SEQ ID NO: 9522 - DNA, 20 bp, Artificial Sequence
  chemically synthesized
ctggttttcaaagtttactt

SEQ ID NO: 9523 - DNA, 20 bp, Artificial Sequence
  chemically synthesized
ggtaaagaaattcaagtctg

SEQ ID NO: 9524 - DNA, 20 bp, Artificial Sequence
  chemically synthesized
acactttggtaaagaaattc

SEQ ID NO: 9525 - DNA, 20 bp, Artificial Sequence
  chemically synthesized
agacttgaatttctttacca

SEQ ID NO: 9526 - DNA, 20 bp, Artificial Sequence
  chemically synthesized
atatggaacacactttggta

SEQ ID NO: 9527 - DNA, 20 bp, Artificial Sequence
  chemically synthesized
atgttatatggaacacactt

SEQ ID NO: 9528 - DNA, 20 bp, Artificial Sequence
  chemically synthesized
agcccaactgcaatgttata

SEQ ID NO: 9529 - DNA, 20 bp, Artificial Sequence
  chemically synthesized
gtgtgttccatataacattg

SEQ ID NO: 9530 - DNA, 20 bp, Artificial Sequence
  chemically synthesized
gttccatataacattgcagt

SEQ ID NO: 9531 - DNA, 20 bp, Artificial Sequence
  chemically synthesized
ttccatataacattgcagtt

SEQ ID NO: 9532 - DNA, 20 bp, Artificial Sequence
  chemically synthesized
ataacattgcagttgggctc

SEQ ID NO: 9533 - DNA, 20 bp, Artificial Sequence
  chemically synthesized
taacattgcagttgggctcg

SEQ ID NO: 9534 - DNA, 20 bp, Artificial Sequence
  chemically synthesized
ttgcagttgggctcgaggtc

SEQ ID NO: 9535 - DNA, 20 bp, Artificial Sequence
  chemically synthesized
gctcccacttacttgacctc

SEQ ID NO: 9536 - DNA, 20 bp, Artificial Sequence
  chemically synthesized
agttgggctcgaggtcaagt

SEQ ID NO: 9537 - DNA, 20 bp, Artificial Sequence
  chemically synthesized
tgggctcgaggtcaagtaag

SEQ ID NO: 9538 - DNA, 20 bp, Artificial Sequence
  chemically synthesized
gggctcgaggtcaagtaagt

SEQ ID NO: 9539 - DNA, 20 bp, Artificial Sequence
  chemically synthesized
gctcgaggtcaagtaagtgg

SEQ ID NO: 9540 - DNA, 20 bp, Artificial Sequence
  chemically synthesized
caagtaagtgggagcaacat

SEQ ID NO: 9541 - DNA, 20 bp, Artificial Sequence
  chemically synthesized
aagtaagtgggagcaacatg

SEQ ID NO: 9542 - DNA, 20 bp, Artificial Sequence
  chemically synthesized
aagtgggagcaacatgaggt

SEQ ID NO: 9543 - DNA, 20 bp, Artificial Sequence
  chemically synthesized
gagcaacatgaggttagaca

SEQ ID NO: 9544 - DNA, 20 bp, Artificial Sequence
  chemically synthesized
tgaggttagacaaagctaat

SEQ ID NO: 9545 - DNA, 20 bp, Artificial Sequence
  chemically synthesized
gaggttagacaaagctaatc

SEQ ID NO: 9546 - DNA, 20 bp, Artificial Sequence
  chemically synthesized
tggaagtgaagaaacctgat

SEQ ID NO: 9547 - DNA, 20 bp, Artificial Sequence
  chemically synthesized
cactgaggagtttggaagtg

SEQ ID NO: 9548 - DNA, 20 bp, Artificial Sequence
  chemically synthesized
atttgcactgaggagtttgg

SEQ ID NO: 9549 - DNA, 20 bp, Artificial Sequence
  chemically synthesized
ttcttcacttccaaactcct

SEQ ID NO: 9550 - DNA, 20 bp, Artificial Sequence
  chemically synthesized
agcatttgcactgaggagtt

SEQ ID NO: 9551 - DNA, 20 bp, Artificial Sequence
  chemically synthesized
acgttagcatttgcactgag

SEQ ID NO: 9552 - DNA, 20 bp, Artificial Sequence
  chemically synthesized
ttacgttagcatttgcactg

SEQ ID NO: 9553 - DNA, 20 bp, Artificial Sequence
  chemically synthesized
attacgttagcatttgcact

SEQ ID NO: 9554 - DNA, 20 bp, Artificial Sequence
  chemically synthesized
ctggaaagtcatcattacgt

SEQ ID NO: 9555 - DNA, 20 bp, Artificial Sequence
  chemically synthesized
ctaacgtaatgatgactttc

SEQ ID NO: 9556 - DNA, 20 bp, Artificial Sequence
  chemically synthesized
ttgaaagcactcatactgga

SEQ ID NO: 9557 - DNA, 20 bp, Artificial Sequence
  chemically synthesized
taatgatgactttccagtat

SEQ ID NO: 9558 - DNA, 20 bp, Artificial Sequence
  chemically synthesized
aactttgaaagcactcatac

SEQ ID NO: 9559 - DNA, 20 bp, Artificial Sequence
  chemically synthesized
ttccagtatgagtgctttca

SEQ ID NO: 9560 - DNA, 20 bp, Artificial Sequence
  chemically synthesized
caaggacagtaaaactttga

SEQ ID NO: 9561 - DNA, 20 bp, Artificial Sequence
  chemically synthesized
tttcaaagttttactgtcct

SEQ ID NO: 9562 - DNA, 20 bp, Artificial Sequence
  chemically synthesized
gaaaaaaaggattccaagga

SEQ ID NO: 9563 - DNA, 20 bp, Artificial Sequence
  chemically synthesized
ctgagaaaaaaaggattcca

SEQ ID NO: 9564 - DNA, 20 bp, Artificial Sequence
  chemically synthesized
tctgagaaaaaaaggattcc

SEQ ID NO: 9565 - DNA, 20 bp, Artificial Sequence
  chemically synthesized
tgagatactctgagaaaaaa

SEQ ID NO: 9566 - DNA, 20 bp, Artificial Sequence
  chemically synthesized
ccttggaatcctttttttct

SEQ ID NO: 9567 - DNA, 20 bp, Artificial Sequence
  chemically synthesized
ctgagatactctgagaaaaa

SEQ ID NO: 9568 - DNA, 20 bp, Artificial Sequence
  chemically synthesized
ttggaatcctttttttctca

SEQ ID NO: 9569 - DNA, 20 bp, Artificial Sequence
  chemically synthesized
gaataccactgagatactct

SEQ ID NO: 9570 - DNA, 20 bp, Artificial Sequence
  chemically synthesized
ctttttttctcagagtatct

SEQ ID NO: 9571 - DNA, 20 bp, Artificial Sequence
  chemically synthesized
tttttctcagagtatctcag

SEQ ID NO: 9572 - DNA, 20 bp, Artificial Sequence
  chemically synthesized
gtattctgcagaataccact

SEQ ID NO: 9573 - DNA, 20 bp, Artificial Sequence
  chemically synthesized
agtatctcagtggtattctg

SEQ ID NO: 9574 - DNA, 20 bp, Artificial Sequence
  chemically synthesized
gttgcctaaaatgtattctg

SEQ ID NO: 9575 - DNA, 20 bp, Artificial Sequence
  chemically synthesized
gtattctgcagaatacattt

SEQ ID NO: 9576 - DNA, 20 bp, Artificial Sequence
  chemically synthesized
tattctgcagaatacatttt

SEQ ID NO: 9577 - DNA, 20 bp, Artificial Sequence
  chemically synthesized
gcagaatacattttaggcaa

SEQ ID NO: 9578 - DNA, 20 bp, Artificial Sequence
  chemically synthesized
gcaacagtgacctttatcct

SEQ ID NO: 9579 - DNA, 20 bp, Artificial Sequence
  chemically synthesized
tgacagttctccaaggataa

SEQ ID NO: 9580 - DNA, 20 bp, Artificial Sequence
  chemically synthesized
gtgacagttctccaaggata

SEQ ID NO: 9581 - DNA, 20 bp, Artificial Sequence
  chemically synthesized
aacagtgacctttatccttg

SEQ ID NO: 9582 - DNA, 20 bp, Artificial Sequence
  chemically synthesized
gatagggtgacagttctcca

SEQ ID NO: 9583 - DNA, 20 bp, Artificial Sequence
  chemically synthesized
agatagggtgacagttctcc

SEQ ID NO: 9584 - DNA, 20 bp, Artificial Sequence
  chemically synthesized
aaacaccaaagatagggtga

SEQ ID NO: 9585 - DNA, 20 bp, Artificial Sequence
  chemically synthesized
gagaactgtcaccctatctt

SEQ ID NO: 9586 - DNA, 20 bp, Artificial Sequence
  chemically synthesized
acattaaaacaccaaagata

SEQ ID NO: 9587 - DNA, 20 bp, Artificial Sequence
  chemically synthesized
aacattaaaacaccaaagat

SEQ ID NO: 9588 - DNA, 20 bp, Artificial Sequence
  chemically synthesized
taacattaaaacaccaaaga

SEQ ID NO: 9589 - DNA, 20 bp, Artificial Sequence
  chemically synthesized
agcttaacattaaaacacca

SEQ ID NO: 9590 - DNA, 20 bp, Artificial Sequence
  chemically synthesized
atctttggtgttttaatgtt

SEQ ID NO: 9591 - DNA, 20 bp, Artificial Sequence
  chemically synthesized
tggcctttgataattgtgga

SEQ ID NO: 9592 - DNA, 20 bp, Artificial Sequence
  chemically synthesized
ctcatggcctttgataattg

SEQ ID NO: 9593 - DNA, 20 bp, Artificial Sequence
  chemically synthesized
taagctttccacaattatca

SEQ ID NO: 9594 - DNA, 20 bp, Artificial Sequence
  chemically synthesized
aagctttccacaattatcaa

SEQ ID NO: 9595 - DNA, 20 bp, Artificial Sequence
  chemically synthesized
ccacaattatcaaaggccat

SEQ ID NO: 9596 - DNA, 20 bp, Artificial Sequence
  chemically synthesized
ttatcaaaggccatgagaaa

SEQ ID NO: 9597 - DNA, 20 bp, Artificial Sequence
  chemically synthesized
ttatatgtggctgtttctca

SEQ ID NO: 9598 - DNA, 20 bp, Artificial Sequence
  chemically synthesized
atcccaagggaaattatatg

SEQ ID NO: 9599 - DNA, 20 bp, Artificial Sequence
  chemically synthesized
cagccacatataatttccct

SEQ ID NO: 9600 - DNA, 20 bp, Artificial Sequence
  chemically synthesized
agccacatataatttccctt

SEQ ID NO: 9601 - DNA, 20 bp, Artificial Sequence
  chemically synthesized
atttttataacaaatcccaa

SEQ ID NO: 9602 - DNA, 20 bp, Artificial Sequence
  chemically synthesized
catttttataacaaatccca

SEQ ID NO: 9603 - DNA, 20 bp, Artificial Sequence
  chemically synthesized
acatttttataacaaatccc

SEQ ID NO: 9604 - DNA, 20 bp, Artificial Sequence
  chemically synthesized
tttgttataaaaatgttgat

SEQ ID NO: 9605 - DNA, 20 bp, Artificial Sequence
  chemically synthesized
ttgttataaaaatgttgata

SEQ ID NO: 9606 - DNA, 20 bp, Artificial Sequence
  chemically synthesized
aaaaatgttgataaggacac

SEQ ID NO: 9607 - DNA, 20 bp, Artificial Sequence
  chemically synthesized
cacttgaagtgattattggc

SEQ ID NO: 9608 - DNA, 20 bp, Artificial Sequence
  chemically synthesized
gttacacttgaagtgattat

SEQ ID NO: 9609 - DNA, 20 bp, Artificial Sequence
  chemically synthesized
cactagccaataatcacttc

SEQ ID NO: 9610 - DNA, 20 bp, Artificial Sequence
  chemically synthesized
cttaagcagcgttacacttg

SEQ ID NO: 9611 - DNA, 20 bp, Artificial Sequence
  chemically synthesized
cttcaagtgtaacgctgctt

SEQ ID NO: 9612 - DNA, 20 bp, Artificial Sequence
  chemically synthesized
tcaagtgtaacgctgcttaa

SEQ ID NO: 9613 - DNA, 20 bp, Artificial Sequence
  chemically synthesized
ggtggtcctgaactcttaag

SEQ ID NO: 9614 - DNA, 20 bp, Artificial Sequence
  chemically synthesized
tgtaacgctgcttaagagtt

SEQ ID NO: 9615 - DNA, 20 bp, Artificial Sequence
  chemically synthesized
ggtggtggtcctgaactctt

SEQ ID NO: 9616 - DNA, 20 bp, Artificial Sequence
  chemically synthesized
gtaacgctgcttaagagttc

SEQ ID NO: 9617 - DNA, 20 bp, Artificial Sequence
  chemically synthesized
agagttcaggaccaccaccc

SEQ ID NO: 9618 - DNA, 20 bp, Artificial Sequence
  chemically synthesized
ctgtattcaaacttgggtgg

SEQ ID NO: 9619 - DNA, 20 bp, Artificial Sequence
  chemically synthesized
gacctgtattcaaacttggg

SEQ ID NO: 9620 - DNA, 20 bp, Artificial Sequence
  chemically synthesized
taggacctgtattcaaactt

SEQ ID NO: 9621 - DNA, 20 bp, Artificial Sequence
  chemically synthesized
ataggacctgtattcaaact

SEQ ID NO: 9622 - DNA, 20 bp, Artificial Sequence
  chemically synthesized
ccaccacccaagtttgaata

SEQ ID NO: 9623 - DNA, 20 bp, Artificial Sequence
  chemically synthesized
caccacccaagtttgaatac

SEQ ID NO: 9624 - DNA, 20 bp, Artificial Sequence
  chemically synthesized
tcatatggccagcaagtaat

SEQ ID NO: 9625 - DNA, 20 bp, Artificial Sequence
  chemically synthesized
ttcatatggccagcaagtaa

SEQ ID NO: 9626 - DNA, 20 bp, Artificial Sequence
  chemically synthesized
atacaggtcctattacttgc

SEQ ID NO: 9627 - DNA, 20 bp, Artificial Sequence
  chemically synthesized
ggacacttcatatggccagc

SEQ ID NO: 9628 - DNA, 20 bp, Artificial Sequence
  chemically synthesized
ttaaggacacttcatatggc

SEQ ID NO: 9629 - DNA, 20 bp, Artificial Sequence
  chemically synthesized
tattacttgctggccatatg

SEQ ID NO: 9630 - DNA, 20 bp, Artificial Sequence
  chemically synthesized
agtattaaggacacttcata

SEQ ID NO: 9631 - DNA, 20 bp, Artificial Sequence
  chemically synthesized
ttacgtggcacagagtatta

SEQ ID NO: 9632 - DNA, 20 bp, Artificial Sequence
  chemically synthesized
attacgtggcacagagtatt

SEQ ID NO: 9633 - DNA, 20 bp, Artificial Sequence
  chemically synthesized
ccagaggattacgtggcaca

SEQ ID NO: 9634 - DNA, 20 bp, Artificial Sequence
  chemically synthesized
ttccagaggattacgtggca

SEQ ID NO: 9635 - DNA, 20 bp, Artificial Sequence
  chemically synthesized
gctgtttccagaggattacg

SEQ ID NO: 9636 - DNA, 20 bp, Artificial Sequence
  chemically synthesized
ctctgtgccacgtaatcctc

SEQ ID NO: 9637 - DNA, 20 bp, Artificial Sequence
  chemically synthesized
gccacgtaatcctctggaaa

SEQ ID NO: 9638 - DNA, 20 bp, Artificial Sequence
  chemically synthesized
gaaagagaggctgtttccag

SEQ ID NO: 9639 - DNA, 20 bp, Artificial Sequence
  chemically synthesized
tgaaagagaggctgtttcca

SEQ ID NO: 9640 - DNA, 20 bp, Artificial Sequence
  chemically synthesized
tatgaaagagaggctgtttc

SEQ ID NO: 9641 - DNA, 20 bp, Artificial Sequence
  chemically synthesized
aaaacaaccctatgaaagag

SEQ ID NO: 9642 - DNA, 20 bp, Artificial Sequence
  chemically synthesized
tggaaacagcctctctttca

SEQ ID NO: 9643 - DNA, 20 bp, Artificial Sequence
  chemically synthesized
taaaacaaccctatgaaaga

SEQ ID NO: 9644 - DNA, 20 bp, Artificial Sequence
  chemically synthesized
ggaaacagcctctctttcat

SEQ ID NO: 9645 - DNA, 20 bp, Artificial Sequence
  chemically synthesized
gaaacagcctctctttcata

SEQ ID NO: 9646 - DNA, 20 bp, Artificial Sequence
  chemically synthesized
cttaaaacaaccctatgaaa

SEQ ID NO: 9647 - DNA, 20 bp, Artificial Sequence
  chemically synthesized
tccttaaaacaaccctatga

SEQ ID NO: 9648 - DNA, 20 bp, Artificial Sequence
  chemically synthesized
ctctttcatagggttgtttt

SEQ ID NO: 9649 - DNA, 20 bp, Artificial Sequence
  chemically synthesized
tctttcatagggttgtttta

SEQ ID NO: 9650 - DNA, 20 bp, Artificial Sequence
  chemically synthesized
gggttgttttaaggattaaa

SEQ ID NO: 9651 - DNA, 20 bp, Artificial Sequence
  chemically synthesized
ggttgttttaaggattaaat

SEQ ID NO: 9652 - DNA, 20 bp, Artificial Sequence
  chemically synthesized
ttgttttaaggattaaatag

SEQ ID NO: 9653 - DNA, 20 bp, Artificial Sequence
  chemically synthesized
aataggagttcatatgtact

SEQ ID NO: 9654 - DNA, 20 bp, Artificial Sequence
  chemically synthesized
gagttcatatgtactcagaa

SEQ ID NO: 9655 - DNA, 20 bp, Artificial Sequence
  chemically synthesized
ctatggacaggaactgttct

SEQ ID NO: 9656 - DNA, 20 bp, Artificial Sequence
  chemically synthesized
ctcagaacagttcctgtcca

SEQ ID NO: 9657 - DNA, 20 bp, Artificial Sequence
  chemically synthesized
tttgagtgattgctatggac

SEQ ID NO: 9658 - DNA, 20 bp, Artificial Sequence
  chemically synthesized
ctttgagtgattgctatgga

SEQ ID NO: 9659 - DNA, 20 bp, Artificial Sequence
  chemically synthesized
tgtcctttgagtgattgcta

SEQ ID NO: 9660 - DNA, 20 bp, Artificial Sequence
  chemically synthesized
ctgtccatagcaatcactca

SEQ ID NO: 9661 - DNA, 20 bp, Artificial Sequence
  chemically synthesized
tgtccatagcaatcactcaa

SEQ ID NO: 9662 - DNA, 20 bp, Artificial Sequence
  chemically synthesized
catagcaatcactcaaagga

SEQ ID NO: 9663 - DNA, 20 bp, Artificial Sequence
  chemically synthesized
aacaaaaatagctgtccttt

SEQ ID NO: 9664 - DNA, 20 bp, Artificial Sequence
  chemically synthesized
aataataataataacaaaaa

SEQ ID NO: 9665 - DNA, 20 bp, Artificial Sequence
  chemically synthesized
ttgttattattattattacg

SEQ ID NO: 9666 - DNA, 20 bp, Artificial Sequence
  chemically synthesized
gttattattattattacgta

SEQ ID NO: 9667 - DNA, 20 bp, Artificial Sequence
  chemically synthesized
ttattattattacgtagagc

SEQ ID NO: 9668 - DNA, 20 bp, Artificial Sequence
  chemically synthesized
tattattattacgtagagcc

SEQ ID NO: 9669 - DNA, 20 bp, Artificial Sequence
  chemically synthesized
aagaaacatcattgttttcc

SEQ ID NO: 9670 - DNA, 20 bp, Artificial Sequence
  chemically synthesized
ggaaaacaatgatgtttctt

SEQ ID NO: 9671 - DNA, 20 bp, Artificial Sequence
  chemically synthesized
gaaaacaatgatgtttcttt

SEQ ID NO: 9672 - DNA, 20 bp, Artificial Sequence
  chemically synthesized
aagaagcacgcagcatccta

SEQ ID NO: 9673 - DNA, 20 bp, Artificial Sequence
  chemically synthesized
tattgaattaaagaagcacg

SEQ ID NO: 9674 - DNA, 20 bp, Artificial Sequence
  chemically synthesized
ctcttaatattgaattaaag

SEQ ID NO: 9675 - DNA, 20 bp, Artificial Sequence
  chemically synthesized
tgtctcttaatattgaatta

SEQ ID NO: 9676 - DNA, 20 bp, Artificial Sequence
  chemically synthesized
tgcttctttaattcaatatt

SEQ ID NO: 9677 - DNA, 20 bp, Artificial Sequence
  chemically synthesized
cttctttaattcaatattaa

SEQ ID NO: 9678 - DNA, 20 bp, Artificial Sequence
  chemically synthesized
tttaattcaatattaagaga

SEQ ID NO: 9679 - DNA, 20 bp, Artificial Sequence
  chemically synthesized
cagggagataataggaaaca

SEQ ID NO: 9680 - DNA, 20 bp, Artificial Sequence
  chemically synthesized
cctgtagccagggagataat

SEQ ID NO: 9681 - DNA, 20 bp, Artificial Sequence
  chemically synthesized
ccctgtagccagggagataa

SEQ ID NO: 9682 - DNA, 20 bp, Artificial Sequence
  chemically synthesized
tttgtttcctattatctccc

SEQ ID NO: 9683 - DNA, 20 bp, Artificial Sequence
  chemically synthesized
tgagcttccctgtagccagg

SEQ ID NO: 9684 - DNA, 20 bp, Artificial Sequence
  chemically synthesized
tcctattatctccctggcta

SEQ ID NO: 9685 - DNA, 20 bp, Artificial Sequence
  chemically synthesized
cctattatctccctggctac

SEQ ID NO: 9686 - DNA, 20 bp, Artificial Sequence
  chemically synthesized
tttgagcttccctgtagcca

SEQ ID NO: 9687 - DNA, 20 bp, Artificial Sequence
  chemically synthesized
ctattatctccctggctaca

SEQ ID NO: 9688 - DNA, 20 bp, Artificial Sequence
  chemically synthesized
gtttgagcttccctgtagcc

SEQ ID NO: 9689 - DNA, 20 bp, Artificial Sequence
  chemically synthesized
agtttgagcttccctgtagc

SEQ ID NO: 9690 - DNA, 20 bp, Artificial Sequence
  chemically synthesized
ttatctccctggctacaggg

SEQ ID NO: 9691 - DNA, 20 bp, Artificial Sequence
  chemically synthesized
attcagtttgagcttccctg

SEQ ID NO: 9692 - DNA, 20 bp, Artificial Sequence
  chemically synthesized
ctaagcttcagattcagttt

SEQ ID NO: 9693 - DNA, 20 bp, Artificial Sequence
  chemically synthesized
ggaagctcaaactgaatctg

SEQ ID NO: 9694 - DNA, 20 bp, Artificial Sequence
  chemically synthesized
atttgactaagcttcagatt

SEQ ID NO: 9695 - DNA, 20 bp, Artificial Sequence
  chemically synthesized
ctcaaactgaatctgaagct

SEQ ID NO: 9696 - DNA, 20 bp, Artificial Sequence
  chemically synthesized
tagttgatttgactaagctt

SEQ ID NO: 9697 - DNA, 20 bp, Artificial Sequence
  chemically synthesized
ttagcatagttgatttgact

SEQ ID NO: 9698 - DNA, 20 bp, Artificial Sequence
  chemically synthesized
gaacatcatagggattagca

SEQ ID NO: 9699 - DNA, 20 bp, Artificial Sequence
  chemically synthesized
tcaatgaacatcatagggat

SEQ ID NO: 9700 - DNA, 20 bp, Artificial Sequence
  chemically synthesized
atagatcaatgaacatcata

SEQ ID NO: 9701 - DNA, 20 bp, Artificial Sequence
  chemically synthesized
aatagatcaatgaacatcat

SEQ ID NO: 9702 - DNA, 20 bp, Artificial Sequence
  chemically synthesized
taatagatcaatgaacatca

SEQ ID NO: 9703 - DNA, 20 bp, Artificial Sequence
  chemically synthesized
aattcctgcaatataaataa

SEQ ID NO: 9704 - DNA, 20 bp, Artificial Sequence
  chemically synthesized
ttgatctattatttatattg

SEQ ID NO: 9705 - DNA, 20 bp, Artificial Sequence
  chemically synthesized
tgatctattatttatattgc

SEQ ID NO: 9706 - DNA, 20 bp, Artificial Sequence
  chemically synthesized
aaggattctttaaaaagtca

SEQ ID NO: 9707 - DNA, 20 bp, Artificial Sequence
  chemically synthesized
tgtattgctatgacttttta

SEQ ID NO: 9708 - DNA, 20 bp, Artificial Sequence
  chemically synthesized
ttcagaaaggattctttaaa

SEQ ID NO: 9709 - DNA, 20 bp, Artificial Sequence
  chemically synthesized
tacgtattcagttttcagaa

SEQ ID NO: 9710 - DNA, 20 bp, Artificial Sequence
  chemically synthesized
ttacgtattcagttttcaga

SEQ ID NO: 9711 - DNA, 20 bp, Artificial Sequence
  chemically synthesized
gattttacgtattcagtttt

SEQ ID NO: 9712 - DNA, 20 bp, Artificial Sequence
  chemically synthesized
ctatgttgattttacgtatt

SEQ ID NO: 9713 - DNA, 20 bp, Artificial Sequence
  chemically synthesized
ctgaatacgtaaaatcaaca

SEQ ID NO: 9714 - DNA, 20 bp, Artificial Sequence
  chemically synthesized
tgaatacgtaaaatcaacat

SEQ ID NO: 9715 - DNA, 20 bp, Artificial Sequence
  chemically synthesized
ttgcccaaggacatttcaag

SEQ ID NO: 9716 - DNA, 20 bp, Artificial Sequence
  chemically synthesized
tatttgcccaaggacatttc

SEQ ID NO: 9717 - DNA, 20 bp, Artificial Sequence
  chemically synthesized
atttccacttgaaatgtcct

SEQ ID NO: 9718 - DNA, 20 bp, Artificial Sequence
  chemically synthesized
tttccacttgaaatgtcctt

SEQ ID NO: 9719 - DNA, 20 bp, Artificial Sequence
  chemically synthesized
tactgaattctatttgccca

SEQ ID NO: 9720 - DNA, 20 bp, Artificial Sequence
  chemically synthesized
ttgaaatgtccttgggcaaa

SEQ ID NO: 9721 - DNA, 20 bp, Artificial Sequence
  chemically synthesized
atactgaattctatttgccc

SEQ ID NO: 9722 - DNA, 20 bp, Artificial Sequence
  chemically synthesized
gtccttgggcaaatagaatt

SEQ ID NO: 9723 - DNA, 20 bp, Artificial Sequence
  chemically synthesized
aattcagtatgtctgatacg

SEQ ID NO: 9724 - DNA, 20 bp, Artificial Sequence
  chemically synthesized
ggagagaaagagctacgtat

SEQ ID NO: 9725 - DNA, 20 bp, Artificial Sequence
  chemically synthesized
ggttagtgcatggagagaaa

SEQ ID NO: 9726 - DNA, 20 bp, Artificial Sequence
  chemically synthesized
agggttagtgcatggagaga

SEQ ID NO: 9727 - DNA, 20 bp, Artificial Sequence
  chemically synthesized
gcaaagggttagtgcatgga

SEQ ID NO: 9728 - DNA, 20 bp, Artificial Sequence
  chemically synthesized
ttgcaaagggttagtgcatg

SEQ ID NO: 9729 - DNA, 20 bp, Artificial Sequence
  chemically synthesized
atttgcaaagggttagtgca

SEQ ID NO: 9730 - DNA, 20 bp, Artificial Sequence
  chemically synthesized
actcctgatttgcaaagggt

SEQ ID NO: 9731 - DNA, 20 bp, Artificial Sequence
  chemically synthesized
aaaaactcctgatttgcaaa

SEQ ID NO: 9732 - DNA, 20 bp, Artificial Sequence
  chemically synthesized
gaaaaactcctgatttgcaa

SEQ ID NO: 9733 - DNA, 20 bp, Artificial Sequence
  chemically synthesized
tgcactaaccctttgcaaat

SEQ ID NO: 9734 - DNA, 20 bp, Artificial Sequence
  chemically synthesized
ggaaaaactcctgatttgca

SEQ ID NO: 9735 - DNA, 20 bp, Artificial Sequence
  chemically synthesized
gcactaaccctttgcaaatc

SEQ ID NO: 9736 - DNA, 20 bp, Artificial Sequence
  chemically synthesized
actaaccctttgcaaatcag

SEQ ID NO: 9737 - DNA, 20 bp, Artificial Sequence
  chemically synthesized
tgcaaatcaggagtttttcc

SEQ ID NO: 9738 - DNA, 20 bp, Artificial Sequence
  chemically synthesized
gcaaatcaggagtttttcct

SEQ ID NO: 9739 - DNA, 20 bp, Artificial Sequence
  chemically synthesized
aaaagcaacctagtgcaccc

SEQ ID NO: 9740 - DNA, 20 bp, Artificial Sequence
  chemically synthesized
ggagtttttcctgggtgcac

SEQ ID NO: 9741 - DNA, 20 bp, Artificial Sequence
  chemically synthesized
caaaagcaacctagtgcacc

SEQ ID NO: 9742 - DNA, 20 bp, Artificial Sequence
  chemically synthesized
gagtttttcctgggtgcact

SEQ ID NO: 9743 - DNA, 20 bp, Artificial Sequence
  chemically synthesized
aaaaacaaacaaaagcaacc

SEQ ID NO: 9744 - DNA, 20 bp, Artificial Sequence
  chemically synthesized
gatcattgaaaaacaaacaa

SEQ ID NO: 9745 - DNA, 20 bp, Artificial Sequence
  chemically synthesized
gtttttcaatgatcatttcc

SEQ ID NO: 9746 - DNA, 20 bp, Artificial Sequence
  chemically synthesized
aaagttttaatttgggaact

SEQ ID NO: 9747 - DNA, 20 bp, Artificial Sequence
  chemically synthesized
gaaagttttaatttgggaac

SEQ ID NO: 9748 - DNA, 20 bp, Artificial Sequence
  chemically synthesized
gttacggaaagttttaattt

SEQ ID NO: 9749 - DNA, 20 bp, Artificial Sequence
  chemically synthesized
tgttacggaaagttttaatt

SEQ ID NO: 9750 - DNA, 20 bp, Artificial Sequence
  chemically synthesized
gaggcatctggtgttacgga

SEQ ID NO: 9751 - DNA, 20 bp, Artificial Sequence
  chemically synthesized
attaaaactttccgtaacac

SEQ ID NO: 9752 - DNA, 20 bp, Artificial Sequence
  chemically synthesized
gggggaggcatctggtgtta

SEQ ID NO: 9753 - DNA, 20 bp, Artificial Sequence
  chemically synthesized
aatggagagggggaggcatc

SEQ ID NO: 9754 - DNA, 20 bp, Artificial Sequence
  chemically synthesized
aagggaaaatggagaggggg

SEQ ID NO: 9755 - DNA, 20 bp, Artificial Sequence
  chemically synthesized
caagggaaaatggagagggg

SEQ ID NO: 9756 - DNA, 20 bp, Artificial Sequence
  chemically synthesized
accaagggaaaatggagagg

SEQ ID NO: 9757 - DNA, 20 bp, Artificial Sequence
  chemically synthesized
gaccaagggaaaatggagag

SEQ ID NO: 9758 - DNA, 20 bp, Artificial Sequence
  chemically synthesized
agaccaagggaaaatggaga

SEQ ID NO: 9759 - DNA, 20 bp, Artificial Sequence
  chemically synthesized
gagaccaagggaaaatggag

SEQ ID NO: 9760 - DNA, 20 bp, Artificial Sequence
  chemically synthesized
tgagaccaagggaaaatgga

SEQ ID NO: 9761 - DNA, 20 bp, Artificial Sequence
  chemically synthesized
aatgagaccaagggaaaatg

SEQ ID NO: 9762 - DNA, 20 bp, Artificial Sequence
  chemically synthesized
tgaatgagaccaagggaaaa

SEQ ID NO: 9763 - DNA, 20 bp, Artificial Sequence
  chemically synthesized
tccccctctccattttccct

SEQ ID NO: 9764 - DNA, 20 bp, Artificial Sequence
  chemically synthesized
cactgaatgaatgagaccaa

SEQ ID NO: 9765 - DNA, 20 bp, Artificial Sequence
  chemically synthesized
tcactgaatgaatgagacca

SEQ ID NO: 9766 - DNA, 20 bp, Artificial Sequence
  chemically synthesized
gtcactgaatgaatgagacc

SEQ ID NO: 9767 - DNA, 20 bp, Artificial Sequence
  chemically synthesized
ttcccttggtctcattcatt

SEQ ID NO: 9768 - DNA, 20 bp, Artificial Sequence
  chemically synthesized
tagaaggtcactgaatgaat

SEQ ID NO: 9769 - DNA, 20 bp, Artificial Sequence
  chemically synthesized
aaggggatggagaaattaga

SEQ ID NO: 9770 - DNA, 20 bp, Artificial Sequence
  chemically synthesized
gaaggggatggagaaattag

SEQ ID NO: 9771 - DNA, 20 bp, Artificial Sequence
  chemically synthesized
gaagaaggggatggagaaat

SEQ ID NO: 9772 - DNA, 20 bp, Artificial Sequence
  chemically synthesized
ggcaagtgaagaaggggatg

SEQ ID NO: 9773 - DNA, 20 bp, Artificial Sequence
  chemically synthesized
taggcaagtgaagaagggga

SEQ ID NO: 9774 - DNA, 20 bp, Artificial Sequence
  chemically synthesized
gtcttaggcaagtgaagaag

SEQ ID NO: 9775 - DNA, 20 bp, Artificial Sequence
  chemically synthesized
tgtcttaggcaagtgaagaa

SEQ ID NO: 9776 - DNA, 20 bp, Artificial Sequence
  chemically synthesized
atgtcttaggcaagtgaaga

SEQ ID NO: 9777 - DNA, 20 bp, Artificial Sequence
  chemically synthesized
gatgtcttaggcaagtgaag

SEQ ID NO: 9778 - DNA, 20 bp, Artificial Sequence
  chemically synthesized
aaggatgtcttaggcaagtg

SEQ ID NO: 9779 - DNA, 20 bp, Artificial Sequence
  chemically synthesized
atccccttcttcacttgcct

SEQ ID NO: 9780 - DNA, 20 bp, Artificial Sequence
  chemically synthesized
taactaaggatgtcttaggc

SEQ ID NO: 9781 - DNA, 20 bp, Artificial Sequence
  chemically synthesized
ttcttaactaaggatgtctt

SEQ ID NO: 9782 - DNA, 20 bp, Artificial Sequence
  chemically synthesized
gttcttaactaaggatgtct

SEQ ID NO: 9783 - DNA, 20 bp, Artificial Sequence
  chemically synthesized
tcacttgcctaagacatcct

SEQ ID NO: 9784 - DNA, 20 bp, Artificial Sequence
  chemically synthesized
tgcctaagacatccttagtt

SEQ ID NO: 9785 - DNA, 20 bp, Artificial Sequence
  chemically synthesized
agatgccaggttcttaacta

SEQ ID NO: 9786 - DNA, 20 bp, Artificial Sequence
  chemically synthesized
aagatgccaggttcttaact

SEQ ID NO: 9787 - DNA, 20 bp, Artificial Sequence
  chemically synthesized
gacatccttagttaagaacc

SEQ ID NO: 9788 - DNA, 20 bp, Artificial Sequence
  chemically synthesized
atagtccattaaaagatgcc

SEQ ID NO: 9789 - DNA, 20 bp, Artificial Sequence
  chemically synthesized
aatagtccattaaaagatgc

SEQ ID NO: 9790 - DNA, 20 bp, Artificial Sequence
  chemically synthesized
aagaacctggcatcttttaa

SEQ ID NO: 9791 - DNA, 20 bp, Artificial Sequence
  chemically synthesized
acagtggaatagtccattaa

SEQ ID NO: 9792 - DNA, 20 bp, Artificial Sequence
  chemically synthesized
ttggtagaagcacagtggaa

SEQ ID NO: 9793 - DNA, 20 bp, Artificial Sequence
  chemically synthesized
gaagattggtagaagcacag

SEQ ID NO: 9794 - DNA, 20 bp, Artificial Sequence
  chemically synthesized
catgaagattggtagaagca

SEQ ID NO: 9795 - DNA, 20 bp, Artificial Sequence
  chemically synthesized
aaagccatgaagattggtag

SEQ ID NO: 9796 - DNA, 20 bp, Artificial Sequence
  chemically synthesized
gctaaagccatgaagattgg

SEQ ID NO: 9797 - DNA, 20 bp, Artificial Sequence
  chemically synthesized
tgtgcttctaccaatcttca

SEQ ID NO: 9798 - DNA, 20 bp, Artificial Sequence
  chemically synthesized
aaagctaaagccatgaagat

SEQ ID NO: 9799 - DNA, 20 bp, Artificial Sequence
  chemically synthesized
ggcagaaagctaaagccatg

SEQ ID NO: 9800 - DNA, 20 bp, Artificial Sequence
  chemically synthesized
tctaccaatcttcatggctt

SEQ ID NO: 9801 - DNA, 20 bp, Artificial Sequence
  chemically synthesized
actgacctggcagaaagcta

SEQ ID NO: 9802 - DNA, 20 bp, Artificial Sequence
  chemically synthesized
tcatggctttagctttctgc

SEQ ID NO: 9803 - DNA, 20 bp, Artificial Sequence
  chemically synthesized
catggctttagctttctgcc

SEQ ID NO: 9804 - DNA, 20 bp, Artificial Sequence
  chemically synthesized
aaaataactgacctggcaga

SEQ ID NO: 9805 - DNA, 20 bp, Artificial Sequence
  chemically synthesized
gctttagctttctgccaggt

SEQ ID NO: 9806 - DNA, 20 bp, Artificial Sequence
  chemically synthesized
gagaaaaataactgacctgg

SEQ ID NO: 9807 - DNA, 20 bp, Artificial Sequence
  chemically synthesized
attgagaaaaataactgacc

SEQ ID NO: 9808 - DNA, 20 bp, Artificial Sequence
  chemically synthesized
ttttgacgggggggaggatt

SEQ ID NO: 9809 - DNA, 20 bp, Artificial Sequence
  chemically synthesized
atggctttttgacggggggg

SEQ ID NO: 9810 - DNA, 20 bp, Artificial Sequence
  chemically synthesized
gatggctttttgacgggggg

SEQ ID NO: 9811 - DNA, 20 bp, Artificial Sequence
  chemically synthesized
gtgatggctttttgacgggg

SEQ ID NO: 9812 - DNA, 20 bp, Artificial Sequence
  chemically synthesized
agtgatggctttttgacggg

SEQ ID NO: 9813 - DNA, 20 bp, Artificial Sequence
  chemically synthesized
cagtgatggctttttgacgg

SEQ ID NO: 9814 - DNA, 20 bp, Artificial Sequence
  chemically synthesized
caatcctcccccccgtcaaa

SEQ ID NO: 9815 - DNA, 20 bp, Artificial Sequence
  chemically synthesized
acagtgatggctttttgacg

SEQ ID NO: 9816 - DNA, 20 bp, Artificial Sequence
  chemically synthesized
aacagtgatggctttttgac

SEQ ID NO: 9817 - DNA, 20 bp, Artificial Sequence
  chemically synthesized
gaacagtgatggctttttga

SEQ ID NO: 9818 - DNA, 20 bp, Artificial Sequence
  chemically synthesized
tataagcaggtgaacagtga

SEQ ID NO: 9819 - DNA, 20 bp, Artificial Sequence
  chemically synthesized
ttatcctataagcaggtgaa

SEQ ID NO: 9820 - DNA, 20 bp, Artificial Sequence
  chemically synthesized
catcactgttcacctgctta

SEQ ID NO: 9821 - DNA, 20 bp, Artificial Sequence
  chemically synthesized
atcactgttcacctgcttat

SEQ ID NO: 9822 - DNA, 20 bp, Artificial Sequence
  chemically synthesized
ttgggttttatcctataagc

SEQ ID NO: 9823 - DNA, 20 bp, Artificial Sequence
  chemically synthesized
tttgggttttatcctataag

SEQ ID NO: 9824 - DNA, 20 bp, Artificial Sequence
  chemically synthesized
gagtttgggttttatcctat

SEQ ID NO: 9825 - DNA, 20 bp, Artificial Sequence
  chemically synthesized
tgcatcatactaaggagttt

SEQ ID NO: 9826 - DNA, 20 bp, Artificial Sequence
  chemically synthesized
aggataaaacccaaactcct

SEQ ID NO: 9827 - DNA, 20 bp, Artificial Sequence
  chemically synthesized
gtgcatcatactaaggagtt

SEQ ID NO: 9828 - DNA, 20 bp, Artificial Sequence
  chemically synthesized
actttgtgcatcatactaag

SEQ ID NO: 9829 - DNA, 20 bp, Artificial Sequence
  chemically synthesized
ggactttgtgcatcatacta

SEQ ID NO: 9830 - DNA, 20 bp, Artificial Sequence
  chemically synthesized
aggactttgtgcatcatact

SEQ ID NO: 9831 - DNA, 20 bp, Artificial Sequence
  chemically synthesized
actccttagtatgatgcaca

SEQ ID NO: 9832 - DNA, 20 bp, Artificial Sequence
  chemically synthesized
gatgcacaaagtcctttaaa

SEQ ID NO: 9833 - DNA, 20 bp, Artificial Sequence
  chemically synthesized
aggtggggactactgtttaa

SEQ ID NO: 9834 - DNA, 20 bp, Artificial Sequence
  chemically synthesized
gcacaaagtcctttaaacag

SEQ ID NO: 9835 - DNA, 20 bp, Artificial Sequence
  chemically synthesized
taggtggggactactgttta

SEQ ID NO: 9836 - DNA, 20 bp, Artificial Sequence
  chemically synthesized
gggcagtgggatggtaggtg

SEQ ID NO: 9837 - DNA, 20 bp, Artificial Sequence
  chemically synthesized
agggcagtgggatggtaggt

SEQ ID NO: 9838 - DNA, 20 bp, Artificial Sequence
  chemically synthesized
gagggcagtgggatggtagg

SEQ ID NO: 9839 - DNA, 20 bp, Artificial Sequence
  chemically synthesized
taagagggcagtgggatggt

SEQ ID NO: 9840 - DNA, 20 bp, Artificial Sequence
  chemically synthesized
ataagagggcagtgggatgg

SEQ ID NO: 9841 - DNA, 20 bp, Artificial Sequence
  chemically synthesized
agaataagagggcagtggga

SEQ ID NO: 9842 - DNA, 20 bp, Artificial Sequence
  chemically synthesized
gaggagaataagagggcagt

SEQ ID NO: 9843 - DNA, 20 bp, Artificial Sequence
  chemically synthesized
tgaggagaataagagggcag

SEQ ID NO: 9844 - DNA, 20 bp, Artificial Sequence
  chemically synthesized
gaatgaggagaataagaggg

SEQ ID NO: 9845 - DNA, 20 bp, Artificial Sequence
  chemically synthesized
ttggaatgaggagaataaga

SEQ ID NO: 9846 - DNA, 20 bp, Artificial Sequence
  chemically synthesized
cttggaatgaggagaataag

SEQ ID NO: 9847 - DNA, 20 bp, Artificial Sequence
  chemically synthesized
gcttggaatgaggagaataa

SEQ ID NO: 9848 - DNA, 20 bp, Artificial Sequence
  chemically synthesized
tggcttggaatgaggagaat

SEQ ID NO: 9849 - DNA, 20 bp, Artificial Sequence
  chemically synthesized
aatgtgtggcttggaatgag

SEQ ID NO: 9850 - DNA, 20 bp, Artificial Sequence
  chemically synthesized
cctcttattctcctcattcc

SEQ ID NO: 9851 - DNA, 20 bp, Artificial Sequence
  chemically synthesized
gtaatgtgtggcttggaatg

SEQ ID NO: 9852 - DNA, 20 bp, Artificial Sequence
  chemically synthesized
agtaatgtgtggcttggaat

SEQ ID NO: 9853 - DNA, 20 bp, Artificial Sequence
  chemically synthesized
ccagtgagtaatgtgtggct

SEQ ID NO: 9854 - DNA, 20 bp, Artificial Sequence
  chemically synthesized
gtggaccagtgagtaatgtg

SEQ ID NO: 9855 - DNA, 20 bp, Artificial Sequence
  chemically synthesized
ccaagccacacattactcac

SEQ ID NO: 9856 - DNA, 20 bp, Artificial Sequence
  chemically synthesized
ttccagactggtggaccagt

SEQ ID NO: 9857 - DNA, 20 bp, Artificial Sequence
  chemically synthesized
cacattactcactggtccac

SEQ ID NO: 9858 - DNA, 20 bp, Artificial Sequence
  chemically synthesized
agttttccagactggtggac

SEQ ID NO: 9859 - DNA, 20 bp, Artificial Sequence
  chemically synthesized
tactcactggtccaccagtc

SEQ ID NO: 9860 - DNA, 20 bp, Artificial Sequence
  chemically synthesized
ggatgagttttccagactgg

SEQ ID NO: 9861 - DNA, 20 bp, Artificial Sequence
  chemically synthesized
gaaggatgagttttccagac

SEQ ID NO: 9862 - DNA, 20 bp, Artificial Sequence
  chemically synthesized
tgggggaaggatgagttttc

SEQ ID NO: 9863 - DNA, 20 bp, Artificial Sequence
  chemically synthesized
ctgagagatgggggaaggat

SEQ ID NO: 9864 - DNA, 20 bp, Artificial Sequence
  chemically synthesized
ccagtctgagagatggggga

SEQ ID NO: 9865 - DNA, 20 bp, Artificial Sequence
  chemically synthesized
tccagtctgagagatggggg

SEQ ID NO: 9866 - DNA, 20 bp, Artificial Sequence
  chemically synthesized
ttttccagtctgagagatgg

SEQ ID NO: 9867 - DNA, 20 bp, Artificial Sequence
  chemically synthesized
ctcatccttcccccatctct

SEQ ID NO: 9868 - DNA, 20 bp, Artificial Sequence
  chemically synthesized
gttttccagtctgagagatg

SEQ ID NO: 9869 - DNA, 20 bp, Artificial Sequence
  chemically synthesized
agttttccagtctgagagat

SEQ ID NO: 9870 - DNA, 20 bp, Artificial Sequence
  chemically synthesized
gagttttccagtctgagaga

SEQ ID NO: 9871 - DNA, 20 bp, Artificial Sequence
  chemically synthesized
ccttcccccatctctcagac

SEQ ID NO: 9872 - DNA, 20 bp, Artificial Sequence
  chemically synthesized
atgggagttttccagtctga

SEQ ID NO: 9873 - DNA, 20 bp, Artificial Sequence
  chemically synthesized
gaatgggagttttccagtct

SEQ ID NO: 9874 - DNA, 20 bp, Artificial Sequence
  chemically synthesized
aagactgaatgggagttttc

SEQ ID NO: 9875 - DNA, 20 bp, Artificial Sequence
  chemically synthesized
cagactggaaaactcccatt

SEQ ID NO: 9876 - DNA, 20 bp, Artificial Sequence
  chemically synthesized
aagagttgaagactgaatgg

SEQ ID NO: 9877 - DNA, 20 bp, Artificial Sequence
  chemically synthesized
ttaagagttgaagactgaat

SEQ ID NO: 9878 - DNA, 20 bp, Artificial Sequence
  chemically synthesized
tttaagagttgaagactgaa

SEQ ID NO: 9879 - DNA, 20 bp, Artificial Sequence
  chemically synthesized
caaagagagtttaagagttg

SEQ ID NO: 9880 - DNA, 20 bp, Artificial Sequence
  chemically synthesized
cctttacaaagagagtttaa

SEQ ID NO: 9881 - DNA, 20 bp, Artificial Sequence
  chemically synthesized
ggcctttacaaagagagttt

SEQ ID NO: 9882 - DNA, 20 bp, Artificial Sequence
  chemically synthesized
tagagaggcctttacaaaga

SEQ ID NO: 9883 - DNA, 20 bp, Artificial Sequence
  chemically synthesized
actcttaaactctctttgta

SEQ ID NO: 9884 - DNA, 20 bp, Artificial Sequence
  chemically synthesized
ctcttaaactctctttgtaa

SEQ ID NO: 9885 - DNA, 20 bp, Artificial Sequence
  chemically synthesized
agtagagaggcctttacaaa

SEQ ID NO: 9886 - DNA, 20 bp, Artificial Sequence
  chemically synthesized
ggagtagagaggcctttaca

SEQ ID NO: 9887 - DNA, 20 bp, Artificial Sequence
  chemically synthesized
ttctatcagagggagtagag

SEQ ID NO: 9888 - DNA, 20 bp, Artificial Sequence
  chemically synthesized
attctatcagagggagtaga

SEQ ID NO: 9889 - DNA, 20 bp, Artificial Sequence
  chemically synthesized
ttattctatcagagggagta

SEQ ID NO: 9890 - DNA, 20 bp, Artificial Sequence
  chemically synthesized
atttattctatcagagggag

SEQ ID NO: 9891 - DNA, 20 bp, Artificial Sequence
  chemically synthesized
ggcctctctactccctctga

SEQ ID NO: 9892 - DNA, 20 bp, Artificial Sequence
  chemically synthesized
atgatttattctatcagagg

SEQ ID NO: 9893 - DNA, 20 bp, Artificial Sequence
  chemically synthesized
gaatgatttattctatcaga

SEQ ID NO: 9894 - DNA, 20 bp, Artificial Sequence
  chemically synthesized
tgaatgatttattctatcag

SEQ ID NO: 9895 - DNA, 20 bp, Artificial Sequence
  chemically synthesized
gtgaatgatttattctatca

SEQ ID NO: 9896 - DNA, 20 bp, Artificial Sequence
  chemically synthesized
aggtgaatgatttattctat

SEQ ID NO: 9897 - DNA, 20 bp, Artificial Sequence
  chemically synthesized
caagtgctctgggggcacag

SEQ ID NO: 9898 - DNA, 20 bp, Artificial Sequence
  chemically synthesized
acaagtgctctgggggcaca

SEQ ID NO: 9899 - DNA, 20 bp, Artificial Sequence
  chemically synthesized
atcattcacctctgtgcccc

SEQ ID NO: 9900 - DNA, 20 bp, Artificial Sequence
  chemically synthesized
ttacaagtgctctgggggca

SEQ ID NO: 9901 - DNA, 20 bp, Artificial Sequence
  chemically synthesized
cattcacctctgtgccccca

SEQ ID NO: 9902 - DNA, 20 bp, Artificial Sequence
  chemically synthesized
tactgttacaagtgctctgg

SEQ ID NO: 9903 - DNA, 20 bp, Artificial Sequence
  chemically synthesized
ctactgttacaagtgctctg

SEQ ID NO: 9904 - DNA, 20 bp, Artificial Sequence
  chemically synthesized
cctactgttacaagtgctct

SEQ ID NO: 9905 - DNA, 20 bp, Artificial Sequence
  chemically synthesized
tcctactgttacaagtgctc

SEQ ID NO: 9906 - DNA, 20 bp, Artificial Sequence
  chemically synthesized
tgcccccagagcacttgtaa

SEQ ID NO: 9907 - DNA, 20 bp, Artificial Sequence
  chemically synthesized
ccccagagcacttgtaacag

SEQ ID NO: 9908 - DNA, 20 bp, Artificial Sequence
  chemically synthesized
tacttatatcctactgttac

SEQ ID NO: 9909 - DNA, 20 bp, Artificial Sequence
  chemically synthesized
cccagagcacttgtaacagt

SEQ ID NO: 9910 - DNA, 20 bp, Artificial Sequence
  chemically synthesized
cacttgtaacagtaggatat

SEQ ID NO: 9911 - DNA, 20 bp, Artificial Sequence
  chemically synthesized
ttgtaacagtaggatataag

SEQ ID NO: 9912 - DNA, 20 bp, Artificial Sequence
  chemically synthesized
ttattttaaaaaagttaaaa

SEQ ID NO: 9913 - DNA, 20 bp, Artificial Sequence
  chemically synthesized
gctcaaaatttattttaaaa

SEQ ID NO: 9914 - DNA, 20 bp, Artificial Sequence
  chemically synthesized
acttttttaaaataaatttt

SEQ ID NO: 9915 - DNA, 20 bp, Artificial Sequence
  chemically synthesized
aaataaattttgagctccat

SEQ ID NO: 9916 - DNA, 20 bp, Artificial Sequence
  chemically synthesized
aataaattttgagctccatg

SEQ ID NO: 9917 - DNA, 20 bp, Artificial Sequence
  chemically synthesized
ataaattttgagctccatga

SEQ ID NO: 9918 - DNA, 20 bp, Artificial Sequence
  chemically synthesized
ccttggttcttaccctcatg

SEQ ID NO: 9919 - DNA, 20 bp, Artificial Sequence
  chemically synthesized
attttgagctccatgagggt

SEQ ID NO: 9920 - DNA, 20 bp, Artificial Sequence
  chemically synthesized
agccttggttcttaccctca

SEQ ID NO: 9921 - DNA, 20 bp, Artificial Sequence
  chemically synthesized
gctccatgagggtaagaacc

SEQ ID NO: 9922 - DNA, 20 bp, Artificial Sequence
  chemically synthesized
ctccatgagggtaagaacca

SEQ ID NO: 9923 - DNA, 20 bp, Artificial Sequence
  chemically synthesized
ctacaaagatgaataagcct

SEQ ID NO: 9924 - DNA, 20 bp, Artificial Sequence
  chemically synthesized
atgagactacaaagatgaat

SEQ ID NO: 9925 - DNA, 20 bp, Artificial Sequence
  chemically synthesized
ccaaggcttattcatctttg

SEQ ID NO: 9926 - DNA, 20 bp, Artificial Sequence
  chemically synthesized
tttaaaattatgagactaca

SEQ ID NO: 9927 - DNA, 20 bp, Artificial Sequence
  chemically synthesized
taatgtaattttaaaattat

SEQ ID NO: 9928 - DNA, 20 bp, Artificial Sequence
  chemically synthesized
cataattttaaaattacatt

SEQ ID NO: 9929 - DNA, 20 bp, Artificial Sequence
  chemically synthesized
ttaaaattacattaagcact

SEQ ID NO: 9930 - DNA, 20 bp, Artificial Sequence
  chemically synthesized
caattctgcagatagttact

SEQ ID NO: 9931 - DNA, 20 bp, Artificial Sequence
  chemically synthesized
aagcactcagtaactatctg

SEQ ID NO: 9932 - DNA, 20 bp, Artificial Sequence
  chemically synthesized
attctgttcaattctgcaga

SEQ ID NO: 9933 - DNA, 20 bp, Artificial Sequence
  chemically synthesized
tgtaattctgttcaattctg

SEQ ID NO: 9934 - DNA, 20 bp, Artificial Sequence
  chemically synthesized
taactatctgcagaattgaa

SEQ ID NO: 9935 - DNA, 20 bp, Artificial Sequence
  chemically synthesized
attgaacagaattacatcct

SEQ ID NO: 9936 - DNA, 20 bp, Artificial Sequence
  chemically synthesized
ttgaacagaattacatcctc

SEQ ID NO: 9937 - DNA, 20 bp, Artificial Sequence
  chemically synthesized
cagaattacatcctcaggcc

SEQ ID NO: 9938 - DNA, 20 bp, Artificial Sequence
  chemically synthesized
ttagctactttccaggcctg

SEQ ID NO: 9939 - DNA, 20 bp, Artificial Sequence
  chemically synthesized
tttagctactttccaggcct

SEQ ID NO: 9940 - DNA, 20 bp, Artificial Sequence
  chemically synthesized
attacatcctcaggcctgga

SEQ ID NO: 9941 - DNA, 20 bp, Artificial Sequence
  chemically synthesized
acatcctcaggcctggaaag

SEQ ID NO: 9942 - DNA, 20 bp, Artificial Sequence
  chemically synthesized
agtttctttagctactttcc

SEQ ID NO: 9943 - DNA, 20 bp, Artificial Sequence
  chemically synthesized
gagtttctttagctactttc

SEQ ID NO: 9944 - DNA, 20 bp, Artificial Sequence
  chemically synthesized
tcaggcctggaaagtagcta

SEQ ID NO: 9945 - DNA, 20 bp, Artificial Sequence
  chemically synthesized
attatggtcatgagtttctt

SEQ ID NO: 9946 - DNA, 20 bp, Artificial Sequence
  chemically synthesized
gtagaattgattatggtcat

SEQ ID NO: 9947 - DNA, 20 bp, Artificial Sequence
  chemically synthesized
ctctacagtagaattgatta

SEQ ID NO: 9948 - DNA, 20 bp, Artificial Sequence
  chemically synthesized
gaccataatcaattctactg

SEQ ID NO: 9949 - DNA, 20 bp, Artificial Sequence
  chemically synthesized
ccataatcaattctactgta

SEQ ID NO: 9950 - DNA, 20 bp, Artificial Sequence
  chemically synthesized
cataatcaattctactgtag

SEQ ID NO: 9951 - DNA, 20 bp, Artificial Sequence
  chemically synthesized
ataatcaattctactgtaga

SEQ ID NO: 9952 - DNA, 20 bp, Artificial Sequence
  chemically synthesized
tgccaattgtccctctacag

SEQ ID NO: 9953 - DNA, 20 bp, Artificial Sequence
  chemically synthesized
atttgccaattgtccctcta

SEQ ID NO: 9954 - DNA, 20 bp, Artificial Sequence
  chemically synthesized
ttctactgtagagggacaat

SEQ ID NO: 9955 - DNA, 20 bp, Artificial Sequence
  chemically synthesized
agagggacaattggcaaatg

SEQ ID NO: 9956 - DNA, 20 bp, Artificial Sequence
  chemically synthesized
gagggacaattggcaaatga

SEQ ID NO: 9957 - DNA, 20 bp, Artificial Sequence
  chemically synthesized
aattggcaaatgaaggccaa

SEQ ID NO: 9958 - DNA, 20 bp, Artificial Sequence
  chemically synthesized
attggcaaatgaaggccaac

SEQ ID NO: 9959 - DNA, 20 bp, Artificial Sequence
  chemically synthesized
tggcaaatgaaggccaacag

SEQ ID NO: 9960 - DNA, 20 bp, Artificial Sequence
  chemically synthesized
ggcaaatgaaggccaacagg

SEQ ID NO: 9961 - DNA, 20 bp, Artificial Sequence
  chemically synthesized
gaagaccctcatcctcctgt

SEQ ID NO: 9962 - DNA, 20 bp, Artificial Sequence
  chemically synthesized
atgaaggccaacaggaggat

SEQ ID NO: 9963 - DNA, 20 bp, Artificial Sequence
  chemically synthesized
tgaaggccaacaggaggatg

SEQ ID NO: 9964 - DNA, 20 bp, Artificial Sequence
  chemically synthesized
gaaggccaacaggaggatga

SEQ ID NO: 9965 - DNA, 20 bp, Artificial Sequence
  chemically synthesized
ttttttttagatttttcatg

SEQ ID NO: 9966 - DNA, 20 bp, Artificial Sequence
  chemically synthesized
tttttttttttttttttttt

SEQ ID NO: 9967 - DNA, 20 bp, Artificial Sequence
  chemically synthesized
aaaaaaaaaaaaaaaaaaaa

SEQ ID NO: 9968 - DNA, 20 bp, Artificial Sequence
  chemically synthesized
aaaaaaaaaaaaaaaaaaaa

SEQ ID NO: 9969 - DNA, 20 bp, Artificial Sequence
  chemically synthesized
aaaaaaaaaaaaaaaaaaaa

SEQ ID NO: 9970 - DNA, 20 bp, Artificial Sequence
  chemically synthesized
aaaaaaaaaaaaagggaaat

SEQ ID NO: 9971 - DNA, 20 bp, Artificial Sequence
  chemically synthesized
aaaaagggaaattggattgt

SEQ ID NO: 9972 - DNA, 20 bp, Artificial Sequence
  chemically synthesized
taagaacataaactcttatc

SEQ ID NO: 9973 - DNA, 20 bp, Artificial Sequence
  chemically synthesized
ccctagaacatgctggataa

SEQ ID NO: 9974 - DNA, 20 bp, Artificial Sequence
  chemically synthesized
ctccctagaacatgctggat

SEQ ID NO: 9975 - DNA, 20 bp, Artificial Sequence
  chemically synthesized
gccatctccctagaacatgc

SEQ ID NO: 9976 - DNA, 20 bp, Artificial Sequence
  chemically synthesized
aactcttatccagcatgttc

SEQ ID NO: 9977 - DNA, 20 bp, Artificial Sequence
  chemically synthesized
actcttatccagcatgttct

SEQ ID NO: 9978 - DNA, 20 bp, Artificial Sequence
  chemically synthesized
ctcttatccagcatgttcta

SEQ ID NO: 9979 - DNA, 20 bp, Artificial Sequence
  chemically synthesized
cttatccagcatgttctagg

SEQ ID NO: 9980 - DNA, 20 bp, Artificial Sequence
  chemically synthesized
tccagcatgttctagggaga

SEQ ID NO: 9981 - DNA, 20 bp, Artificial Sequence
  chemically synthesized
aagtacagctgccatctccc

SEQ ID NO: 9982 - DNA, 20 bp, Artificial Sequence
  chemically synthesized
agcatgttctagggagatgg

SEQ ID NO: 9983 - DNA, 20 bp, Artificial Sequence
  chemically synthesized
gagatggcagctgtacttgt

SEQ ID NO: 9984 - DNA, 20 bp, Artificial Sequence
  chemically synthesized
atattcacatcttacaagta

SEQ ID NO: 9985 - DNA, 20 bp, Artificial Sequence
  chemically synthesized
ttagaatattcacatcttac

SEQ ID NO: 9986 - DNA, 20 bp, Artificial Sequence
  chemically synthesized
gatgtgaatattctaatcgc

SEQ ID NO: 9987 - DNA, 20 bp, Artificial Sequence
  chemically synthesized
tgtgaatattctaatcgcca

SEQ ID NO: 9988 - DNA, 20 bp, Artificial Sequence
  chemically synthesized
tgaagcacccctctggcgat

SEQ ID NO: 9989 - DNA, 20 bp, Artificial Sequence
  chemically synthesized
gtgaatattctaatcgccag

SEQ ID NO: 9990 - DNA, 20 bp, Artificial Sequence
  chemically synthesized
tgaatattctaatcgccaga

SEQ ID NO: 9991 - DNA, 20 bp, Artificial Sequence
  chemically synthesized
gaatattctaatcgccagag

SEQ ID NO: 9992 - DNA, 20 bp, Artificial Sequence
  chemically synthesized
aaaaaattgaagcacccctc

SEQ ID NO: 9993 - DNA, 20 bp, Artificial Sequence
  chemically synthesized
ttcatactacaaaaaaattg

SEQ ID NO: 9994 - DNA, 20 bp, Artificial Sequence
  chemically synthesized
ggggtgcttcaatttttttg

SEQ ID NO: 9995 - DNA, 20 bp, Artificial Sequence
  chemically synthesized
ttcaatttttttgtagtatg

SEQ ID NO: 9996 - DNA, 20 bp, Artificial Sequence
  chemically synthesized
aatttttttgtagtatgaag

SEQ ID NO: 9997 - DNA, 20 bp, Artificial Sequence
  chemically synthesized
tctaaaattggatgtttgtg

SEQ ID NO: 9998 - DNA, 20 bp, Artificial Sequence
  chemically synthesized
atctaaaattggatgtttgt

SEQ ID NO: 9999 - DNA, 20 bp, Artificial Sequence
  chemically synthesized
tcctcacaaacatccaattt

SEQ ID NO: 10000 - DNA, 20 bp, Artificial Sequence
  chemically synthesized
agaatcttggcatctaaaat

SEQ ID NO: 10001 - DNA, 20 bp, Artificial Sequence
  chemically synthesized
aacatccaattttagatgcc

SEQ ID NO: 10002 - DNA, 20 bp, Artificial Sequence
  chemically synthesized
aattttagatgccaagattc

SEQ ID NO: 10003 - DNA, 20 bp, Artificial Sequence
  chemically synthesized
attttagatgccaagattct

SEQ ID NO: 10004 - DNA, 20 bp, Artificial Sequence
  chemically synthesized
ttctggtgagcctagaatct

SEQ ID NO: 10005 - DNA, 20 bp, Artificial Sequence
  chemically synthesized
tgccaagattctaggctcac

SEQ ID NO: 10006 - DNA, 20 bp, Artificial Sequence
  chemically synthesized
aaattgtgttctggtgagcc

SEQ ID NO: 10007 - DNA, 20 bp, Artificial Sequence
  chemically synthesized
aaatcaaattgtgttctggt

SEQ ID NO: 10008 - DNA, 20 bp, Artificial Sequence
  chemically synthesized
ataaaaatcaaattgtgttc

SEQ ID NO: 10009 - DNA, 20 bp, Artificial Sequence
  chemically synthesized
tgatttttattgtgattcct

SEQ ID NO: 10010 - DNA, 20 bp, Artificial Sequence
  chemically synthesized
tattgtgattcctaagacac

SEQ ID NO: 10011 - DNA, 20 bp, Artificial Sequence
  chemically synthesized
gtcttagaatccagtgtctt

SEQ ID NO: 10012 - DNA, 20 bp, Artificial Sequence
  chemically synthesized
tgtcttagaatccagtgtct

SEQ ID NO: 10013 - DNA, 20 bp, Artificial Sequence
  chemically synthesized
ttcctaagacactggattct

SEQ ID NO: 10014 - DNA, 20 bp, Artificial Sequence
  chemically synthesized
gcatcctgtgtcttagaatc

SEQ ID NO: 10015 - DNA, 20 bp, Artificial Sequence
  chemically synthesized
agacactggattctaagaca

SEQ ID NO: 10016 - DNA, 20 bp, Artificial Sequence
  chemically synthesized
gacactggattctaagacac

SEQ ID NO: 10017 - DNA, 20 bp, Artificial Sequence
  chemically synthesized
gcacacagcatcctgtgtct

SEQ ID NO: 10018 - DNA, 20 bp, Artificial Sequence
  chemically synthesized
atattcattttttcggcaca

SEQ ID NO: 10019 - DNA, 20 bp, Artificial Sequence
  chemically synthesized
gaggaatatattcatttttt

SEQ ID NO: 10020 - DNA, 20 bp, Artificial Sequence
  chemically synthesized
atactagatctattaaaatg

SEQ ID NO: 10021 - DNA, 20 bp, Artificial Sequence
  chemically synthesized
gaatatattcctcattttaa

SEQ ID NO: 10022 - DNA, 20 bp, Artificial Sequence
  chemically synthesized
aatactagatctattaaaat

SEQ ID NO: 10023 - DNA, 20 bp, Artificial Sequence
  chemically synthesized
attcctcattttaatagatc

SEQ ID NO: 10024 - DNA, 20 bp, Artificial Sequence
  chemically synthesized
tctggtttaagtgcaaatac

SEQ ID NO: 10025 - DNA, 20 bp, Artificial Sequence
  chemically synthesized
tctagtatttgcacttaaac

SEQ ID NO: 10026 - DNA, 20 bp, Artificial Sequence
  chemically synthesized
gaggagacagcatctggttt

SEQ ID NO: 10027 - DNA, 20 bp, Artificial Sequence
  chemically synthesized
ttttaggaggagacagcatc

SEQ ID NO: 10028 - DNA, 20 bp, Artificial Sequence
  chemically synthesized
aaagcttttttaggaggaga

SEQ ID NO: 10029 - DNA, 20 bp, Artificial Sequence
  chemically synthesized
ccttaaagcttttttaggag

SEQ ID NO: 10030 - DNA, 20 bp, Artificial Sequence
  chemically synthesized
gatgctgtctcctcctaaaa

SEQ ID NO: 10031 - DNA, 20 bp, Artificial Sequence
  chemically synthesized
tgccttaaagcttttttagg

SEQ ID NO: 10032 - DNA, 20 bp, Artificial Sequence
  chemically synthesized
ttgccttaaagcttttttag

SEQ ID NO: 10033 - DNA, 20 bp, Artificial Sequence
  chemically synthesized
ggttgccttaaagctttttt

SEQ ID NO: 10034 - DNA, 20 bp, Artificial Sequence
  chemically synthesized
aggttgccttaaagcttttt

SEQ ID NO: 10035 - DNA, 20 bp, Artificial Sequence
  chemically synthesized
tctcctcctaaaaaagcttt

SEQ ID NO: 10036 - DNA, 20 bp, Artificial Sequence
  chemically synthesized
ctcctcctaaaaaagcttta

SEQ ID NO: 10037 - DNA, 20 bp, Artificial Sequence
  chemically synthesized
atgttatcaaggttgcctta

SEQ ID NO: 10038 - DNA, 20 bp, Artificial Sequence
  chemically synthesized
cttgtattaaaatgttatca

SEQ ID NO: 10039 - DNA, 20 bp, Artificial Sequence
  chemically synthesized
ccttgtattaaaatgttatc

SEQ ID NO: 10040 - DNA, 20 bp, Artificial Sequence
  chemically synthesized
ccttgataacattttaatac

SEQ ID NO: 10041 - DNA, 20 bp, Artificial Sequence
  chemically synthesized
cttgataacattttaataca

SEQ ID NO: 10042 - DNA, 20 bp, Artificial Sequence
  chemically synthesized
gataacattttaatacaagg

SEQ ID NO: 10043 - DNA, 20 bp, Artificial Sequence
  chemically synthesized
tttaatacaaggcagttaaa

SEQ ID NO: 10044 - DNA, 20 bp, Artificial Sequence
  chemically synthesized
taatacaaggcagttaaaaa

SEQ ID NO: 10045 - DNA, 20 bp, Artificial Sequence
  chemically synthesized
atacaaggcagttaaaaaga

SEQ ID NO: 10046 - DNA, 20 bp, Artificial Sequence
  chemically synthesized
cagttaaaaagagagataat

SEQ ID NO: 10047 - DNA, 20 bp, Artificial Sequence
  chemically synthesized
agttaaaaagagagataatt

SEQ ID NO: 10048 - DNA, 20 bp, Artificial Sequence
  chemically synthesized
aaagagagataattaggata

SEQ ID NO: 10049 - DNA, 20 bp, Artificial Sequence
  chemically synthesized
aagagagataattaggataa

SEQ ID NO: 10050 - DNA, 20 bp, Artificial Sequence
  chemically synthesized
agagagataattaggataaa

SEQ ID NO: 10051 - DNA, 20 bp, Artificial Sequence
  chemically synthesized
agagataattaggataaagg

SEQ ID NO: 10052 - DNA, 20 bp, Artificial Sequence
  chemically synthesized
ggagaaataaactttcattc

SEQ ID NO: 10053 - DNA, 20 bp, Artificial Sequence
  chemically synthesized
gagaaataaactttcattct

SEQ ID NO: 10054 - DNA, 20 bp, Artificial Sequence
  chemically synthesized
gaatggataacccagaatga

SEQ ID NO: 10055 - DNA, 20 bp, Artificial Sequence
  chemically synthesized
atggcagtgaatggataacc

SEQ ID NO: 10056 - DNA, 20 bp, Artificial Sequence
  chemically synthesized
atgcagttcatggcagtgaa

SEQ ID NO: 10057 - DNA, 20 bp, Artificial Sequence
  chemically synthesized
tcatagtatgcagttcatgg

SEQ ID NO: 10058 - DNA, 20 bp, Artificial Sequence
  chemically synthesized
gattcatagtatgcagttca

SEQ ID NO: 10059 - DNA, 20 bp, Artificial Sequence
  chemically synthesized
ggggactgattcatagtatg

SEQ ID NO: 10060 - DNA, 20 bp, Artificial Sequence
  chemically synthesized
atgaactgcatactatgaat

SEQ ID NO: 10061 - DNA, 20 bp, Artificial Sequence
  chemically synthesized
agtctgaggggactgattca

SEQ ID NO: 10062 - DNA, 20 bp, Artificial Sequence
  chemically synthesized
atactatgaatcagtcccct

SEQ ID NO: 10063 - DNA, 20 bp, Artificial Sequence
  chemically synthesized
aaagttaattgaagtctgag

SEQ ID NO: 10064 - DNA, 20 bp, Artificial Sequence
  chemically synthesized
caaagttaattgaagtctga

SEQ ID NO: 10065 - DNA, 20 bp, Artificial Sequence
  chemically synthesized
ccaaagttaattgaagtctg

SEQ ID NO: 10066 - DNA, 20 bp, Artificial Sequence
  chemically synthesized
tccaaagttaattgaagtct

SEQ ID NO: 10067 - DNA, 20 bp, Artificial Sequence
  chemically synthesized
agtttatccaaagttaattg

SEQ ID NO: 10068 - DNA, 20 bp, Artificial Sequence
  chemically synthesized
cctcagacttcaattaactt

SEQ ID NO: 10069 - DNA, 20 bp, Artificial Sequence
  chemically synthesized
aatttccttcagtttatcca

SEQ ID NO: 10070 - DNA, 20 bp, Artificial Sequence
  chemically synthesized
aattaactttggataaactg

SEQ ID NO: 10071 - DNA, 20 bp, Artificial Sequence
  chemically synthesized
attaactttggataaactga

SEQ ID NO: 10072 - DNA, 20 bp, Artificial Sequence
  chemically synthesized
cagtgtaactaaatttcctt

SEQ ID NO: 10073 - DNA, 20 bp, Artificial Sequence
  chemically synthesized
tggataaactgaaggaaatt

SEQ ID NO: 10074 - DNA, 20 bp, Artificial Sequence
  chemically synthesized
tgaaggaaatttagttacac

SEQ ID NO: 10075 - DNA, 20 bp, Artificial Sequence
  chemically synthesized
tttagttacactggccctgc

SEQ ID NO: 10076 - DNA, 20 bp, Artificial Sequence
  chemically synthesized
cagtttctaactagcagggc

SEQ ID NO: 10077 - DNA, 20 bp, Artificial Sequence
  chemically synthesized
gttacactggccctgctagt

SEQ ID NO: 10078 - DNA, 20 bp, Artificial Sequence
  chemically synthesized
gactcagtttctaactagca

SEQ ID NO: 10079 - DNA, 20 bp, Artificial Sequence
  chemically synthesized
agactcagtttctaactagc

SEQ ID NO: 10080 - DNA, 20 bp, Artificial Sequence
  chemically synthesized
cagactcagtttctaactag

SEQ ID NO: 10081 - DNA, 20 bp, Artificial Sequence
  chemically synthesized
tcacagactcagtttctaac

SEQ ID NO: 10082 - DNA, 20 bp, Artificial Sequence
  chemically synthesized
ggccctgctagttagaaact

SEQ ID NO: 10083 - DNA, 20 bp, Artificial Sequence
  chemically synthesized
atcaccattattcacagact

SEQ ID NO: 10084 - DNA, 20 bp, Artificial Sequence
  chemically synthesized
gaaactgagtctgtgaataa

SEQ ID NO: 10085 - DNA, 20 bp, Artificial Sequence
  chemically synthesized
agtggaatcaccattattca

SEQ ID NO: 10086 - DNA, 20 bp, Artificial Sequence
  chemically synthesized
ggacaggaacatggtagaag

SEQ ID NO: 10087 - DNA, 20 bp, Artificial Sequence
  chemically synthesized
ggaggacaggaacatggtag

SEQ ID NO: 10088 - DNA, 20 bp, Artificial Sequence
  chemically synthesized
cagggaggacaggaacatgg

SEQ ID NO: 10089 - DNA, 20 bp, Artificial Sequence
  chemically synthesized
aggcagggaggacaggaaca

SEQ ID NO: 10090 - DNA, 20 bp, Artificial Sequence
  chemically synthesized
tctactcaggcagggaggac

SEQ ID NO: 10091 - DNA, 20 bp, Artificial Sequence
  chemically synthesized
ctctactcaggcagggagga

SEQ ID NO: 10092 - DNA, 20 bp, Artificial Sequence
  chemically synthesized
tcagctctactcaggcaggg

SEQ ID NO: 10093 - DNA, 20 bp, Artificial Sequence
  chemically synthesized
tgttcctgtcctccctgcct

SEQ ID NO: 10094 - DNA, 20 bp, Artificial Sequence
  chemically synthesized
ctcagctctactcaggcagg

SEQ ID NO: 10095 - DNA, 20 bp, Artificial Sequence
  chemically synthesized
atctcagctctactcaggca

SEQ ID NO: 10096 - DNA, 20 bp, Artificial Sequence
  chemically synthesized
tcctgtcctccctgcctgag

SEQ ID NO: 10097 - DNA, 20 bp, Artificial Sequence
  chemically synthesized
catctcagctctactcaggc

SEQ ID NO: 10098 - DNA, 20 bp, Artificial Sequence
  chemically synthesized
ccatctcagctctactcagg

SEQ ID NO: 10099 - DNA, 20 bp, Artificial Sequence
  chemically synthesized
ctgtcctccctgcctgagta

SEQ ID NO: 10100 - DNA, 20 bp, Artificial Sequence
  chemically synthesized
caaccatctcagctctactc

SEQ ID NO: 10101 - DNA, 20 bp, Artificial Sequence
  chemically synthesized
tcaaccatctcagctctact

SEQ ID NO: 10102 - DNA, 20 bp, Artificial Sequence
  chemically synthesized
ctccctgcctgagtagagct

SEQ ID NO: 10103 - DNA, 20 bp, Artificial Sequence
  chemically synthesized
ctgcctgagtagagctgaga

SEQ ID NO: 10104 - DNA, 20 bp, Artificial Sequence
  chemically synthesized
aagaatggggtcaaccatct

SEQ ID NO: 10105 - DNA, 20 bp, Artificial Sequence
  chemically synthesized
taagaagctgtgtaagaatg

SEQ ID NO: 10106 - DNA, 20 bp, Artificial Sequence
  chemically synthesized
ttaagaagctgtgtaagaat

SEQ ID NO: 10107 - DNA, 20 bp, Artificial Sequence
  chemically synthesized
tttaagaagctgtgtaagaa

SEQ ID NO: 10108 - DNA, 20 bp, Artificial Sequence
  chemically synthesized
tggttgaccccattcttaca

SEQ ID NO: 10109 - DNA, 20 bp, Artificial Sequence
  chemically synthesized
ccacatttaagaagctgtgt

SEQ ID NO: 10110 - DNA, 20 bp, Artificial Sequence
  chemically synthesized
gcatacatgccacatttaag

SEQ ID NO: 10111 - DNA, 20 bp, Artificial Sequence
  chemically synthesized
cttacacagcttcttaaatg

SEQ ID NO: 10112 - DNA, 20 bp, Artificial Sequence
  chemically synthesized
agggcatacatgccacattt

SEQ ID NO: 10113 - DNA, 20 bp, Artificial Sequence
  chemically synthesized
aatgtggcatgtatgccctt

SEQ ID NO: 10114 - DNA, 20 bp, Artificial Sequence
  chemically synthesized
aaggatgaataagagctgaa

SEQ ID NO: 10115 - DNA, 20 bp, Artificial Sequence
  chemically synthesized
caaggatgaataagagctga

SEQ ID NO: 10116 - DNA, 20 bp, Artificial Sequence
  chemically synthesized
gcaaggatgaataagagctg

SEQ ID NO: 10117 - DNA, 20 bp, Artificial Sequence
  chemically synthesized
tttatggcaaggatgaataa

SEQ ID NO: 10118 - DNA, 20 bp, Artificial Sequence
  chemically synthesized
cttttatggcaaggatgaat

SEQ ID NO: 10119 - DNA, 20 bp, Artificial Sequence
  chemically synthesized
agccaagaccttttatggca

SEQ ID NO: 10120 - DNA, 20 bp, Artificial Sequence
  chemically synthesized
cttattcatccttgccataa

SEQ ID NO: 10121 - DNA, 20 bp, Artificial Sequence
  chemically synthesized
aagccaagaccttttatggc

SEQ ID NO: 10122 - DNA, 20 bp, Artificial Sequence
  chemically synthesized
ttattcatccttgccataaa

SEQ ID NO: 10123 - DNA, 20 bp, Artificial Sequence
  chemically synthesized
cagaaagccaagacctttta

SEQ ID NO: 10124 - DNA, 20 bp, Artificial Sequence
  chemically synthesized
atccttgccataaaaggtct

SEQ ID NO: 10125 - DNA, 20 bp, Artificial Sequence
  chemically synthesized
atcacagaaatcagaaagcc

SEQ ID NO: 10126 - DNA, 20 bp, Artificial Sequence
  chemically synthesized
gtttgatcacagaaatcaga

SEQ ID NO: 10127 - DNA, 20 bp, Artificial Sequence
  chemically synthesized
gctagtttgatcacagaaat

SEQ ID NO: 10128 - DNA, 20 bp, Artificial Sequence
  chemically synthesized
aaagggagctagtttgatca

SEQ ID NO: 10129 - DNA, 20 bp, Artificial Sequence
  chemically synthesized
tctgatttctgtgatcaaac

SEQ ID NO: 10130 - DNA, 20 bp, Artificial Sequence
  chemically synthesized
cttcttgagacaaagggagc

SEQ ID NO: 10131 - DNA, 20 bp, Artificial Sequence
  chemically synthesized
agcccttcttgagacaaagg

SEQ ID NO: 10132 - DNA, 20 bp, Artificial Sequence
  chemically synthesized
agagcccttcttgagacaaa

SEQ ID NO: 10133 - DNA, 20 bp, Artificial Sequence
  chemically synthesized
aaactagctccctttgtctc

SEQ ID NO: 10134 - DNA, 20 bp, Artificial Sequence
  chemically synthesized
cagagcccttcttgagacaa

SEQ ID NO: 10135 - DNA, 20 bp, Artificial Sequence
  chemically synthesized
acagagcccttcttgagaca

SEQ ID NO: 10136 - DNA, 20 bp, Artificial Sequence
  chemically synthesized
ctagctccctttgtctcaag

SEQ ID NO: 10137 - DNA, 20 bp, Artificial Sequence
  chemically synthesized
tagctccctttgtctcaaga

SEQ ID NO: 10138 - DNA, 20 bp, Artificial Sequence
  chemically synthesized
agctccctttgtctcaagaa

SEQ ID NO: 10139 - DNA, 20 bp, Artificial Sequence
  chemically synthesized
agggctacagagcccttctt

SEQ ID NO: 10140 - DNA, 20 bp, Artificial Sequence
  chemically synthesized
ttgtctcaagaagggctctg

SEQ ID NO: 10141 - DNA, 20 bp, Artificial Sequence
  chemically synthesized
ccccaaaacaaagggctaca

SEQ ID NO: 10142 - DNA, 20 bp, Artificial Sequence
  chemically synthesized
ggccccaaaacaaagggcta

SEQ ID NO: 10143 - DNA, 20 bp, Artificial Sequence
  chemically synthesized
ggctctgtagccctttgttt

SEQ ID NO: 10144 - DNA, 20 bp, Artificial Sequence
  chemically synthesized
gacatgggccccaaaacaaa

SEQ ID NO: 10145 - DNA, 20 bp, Artificial Sequence
  chemically synthesized
gctctgtagccctttgtttt

SEQ ID NO: 10146 - DNA, 20 bp, Artificial Sequence
  chemically synthesized
tgacatgggccccaaaacaa

SEQ ID NO: 10147 - DNA, 20 bp, Artificial Sequence
  chemically synthesized
ctctgtagccctttgttttg

SEQ ID NO: 10148 - DNA, 20 bp, Artificial Sequence
  chemically synthesized
gtgacatgggccccaaaaca

SEQ ID NO: 10149 - DNA, 20 bp, Artificial Sequence
  chemically synthesized
actatatcatttggtgacat

SEQ ID NO: 10150 - DNA, 20 bp, Artificial Sequence
  chemically synthesized
aactatatcatttggtgaca

SEQ ID NO: 10151 - DNA, 20 bp, Artificial Sequence
  chemically synthesized
gcccatgtcaccaaatgata

SEQ ID NO: 10152 - DNA, 20 bp, Artificial Sequence
  chemically synthesized
tccagccaaactatatcatt

SEQ ID NO: 10153 - DNA, 20 bp, Artificial Sequence
  chemically synthesized
tgtcaccaaatgatatagtt

SEQ ID NO: 10154 - DNA, 20 bp, Artificial Sequence
  chemically synthesized
accaaatgatatagtttggc

SEQ ID NO: 10155 - DNA, 20 bp, Artificial Sequence
  chemically synthesized
atcagatttgggtggagatc

SEQ ID NO: 10156 - DNA, 20 bp, Artificial Sequence
  chemically synthesized
ttcaagatcagatttgggtg

SEQ ID NO: 10157 - DNA, 20 bp, Artificial Sequence
  chemically synthesized
aattcaagatcagatttggg

SEQ ID NO: 10158 - DNA, 20 bp, Artificial Sequence
  chemically synthesized
tataattcaagatcagattt

SEQ ID NO: 10159 - DNA, 20 bp, Artificial Sequence
  chemically synthesized
ctataattcaagatcagatt

SEQ ID NO: 10160 - DNA, 20 bp, Artificial Sequence
  chemically synthesized
tgagagctataattcaagat

SEQ ID NO: 10161 - DNA, 20 bp, Artificial Sequence
  chemically synthesized
ccaaatctgatcttgaatta

SEQ ID NO: 10162 - DNA, 20 bp, Artificial Sequence
  chemically synthesized
gattatgagagctataattc

SEQ ID NO: 10163 - DNA, 20 bp, Artificial Sequence
  chemically synthesized
atgatatgtgcggattatga

SEQ ID NO: 10164 - DNA, 20 bp, Artificial Sequence
  chemically synthesized
ccatgatatgtgcggattat

SEQ ID NO: 10165 - DNA, 20 bp, Artificial Sequence
  chemically synthesized
ggttcctcccatgatatgtg

SEQ ID NO: 10166 - DNA, 20 bp, Artificial Sequence
  chemically synthesized
ctcataatccgcacatatca

SEQ ID NO: 10167 - DNA, 20 bp, Artificial Sequence
  chemically synthesized
tcataatccgcacatatcat

SEQ ID NO: 10168 - DNA, 20 bp, Artificial Sequence
  chemically synthesized
ataatccgcacatatcatgg

SEQ ID NO: 10169 - DNA, 20 bp, Artificial Sequence
  chemically synthesized
taatccgcacatatcatggg

SEQ ID NO: 10170 - DNA, 20 bp, Artificial Sequence
  chemically synthesized
cacatatcatgggaggaacc

SEQ ID NO: 10171 - DNA, 20 bp, Artificial Sequence
  chemically synthesized
atatcatgggaggaacccag

SEQ ID NO: 10172 - DNA, 20 bp, Artificial Sequence
  chemically synthesized
tatcatgggaggaacccagt

SEQ ID NO: 10173 - DNA, 20 bp, Artificial Sequence
  chemically synthesized
tcatgggaggaacccagtgg

SEQ ID NO: 10174 - DNA, 20 bp, Artificial Sequence
  chemically synthesized
catgggaggaacccagtggg

SEQ ID NO: 10175 - DNA, 20 bp, Artificial Sequence
  chemically synthesized
tgattcagttacctcccact

SEQ ID NO: 10176 - DNA, 20 bp, Artificial Sequence
  chemically synthesized
atgattcagttacctcccac

SEQ ID NO: 10177 - DNA, 20 bp, Artificial Sequence
  chemically synthesized
agtgggaggtaactgaatca

SEQ ID NO: 10178 - DNA, 20 bp, Artificial Sequence
  chemically synthesized
gtgggaggtaactgaatcat

SEQ ID NO: 10179 - DNA, 20 bp, Artificial Sequence
  chemically synthesized
tgggaggtaactgaatcatg

SEQ ID NO: 10180 - DNA, 20 bp, Artificial Sequence
  chemically synthesized
aaaaccccacccccatgatt

SEQ ID NO: 10181 - DNA, 20 bp, Artificial Sequence
  chemically synthesized
gggaggtaactgaatcatgg

SEQ ID NO: 10182 - DNA, 20 bp, Artificial Sequence
  chemically synthesized
aggtaactgaatcatggggg

SEQ ID NO: 10183 - DNA, 20 bp, Artificial Sequence
  chemically synthesized
ggtaactgaatcatgggggt

SEQ ID NO: 10184 - DNA, 20 bp, Artificial Sequence
  chemically synthesized
gtaactgaatcatgggggtg

SEQ ID NO: 10185 - DNA, 20 bp, Artificial Sequence
  chemically synthesized
tactatcacaaaaacagcat

SEQ ID NO: 10186 - DNA, 20 bp, Artificial Sequence
  chemically synthesized
ttactatcacaaaaacagca

SEQ ID NO: 10187 - DNA, 20 bp, Artificial Sequence
  chemically synthesized
gagagttactatcacaaaaa

SEQ ID NO: 10188 - DNA, 20 bp, Artificial Sequence
  chemically synthesized
ttcccatgctgtttttgtga

SEQ ID NO: 10189 - DNA, 20 bp, Artificial Sequence
  chemically synthesized
tttgtgatagtaactctcat

SEQ ID NO: 10190 - DNA, 20 bp, Artificial Sequence
  chemically synthesized
aaaaccatcagatctcatga

SEQ ID NO: 10191 - DNA, 20 bp, Artificial Sequence
  chemically synthesized
ttaaaaccatcagatctcat

SEQ ID NO: 10192 - DNA, 20 bp, Artificial Sequence
  chemically synthesized
gtaactctcatgagatctga

SEQ ID NO: 10193 - DNA, 20 bp, Artificial Sequence
  chemically synthesized
actgccctttttaaaaccat

SEQ ID NO: 10194 - DNA, 20 bp, Artificial Sequence
  chemically synthesized
tgagatctgatggttttaaa

SEQ ID NO: 10195 - DNA, 20 bp, Artificial Sequence
  chemically synthesized
gagatctgatggttttaaaa

SEQ ID NO: 10196 - DNA, 20 bp, Artificial Sequence
  chemically synthesized
agatctgatggttttaaaaa

SEQ ID NO: 10197 - DNA, 20 bp, Artificial Sequence
  chemically synthesized
tctgatggttttaaaaaggg

SEQ ID NO: 10198 - DNA, 20 bp, Artificial Sequence
  chemically synthesized
aggcaagagagcatgtgcag

SEQ ID NO: 10199 - DNA, 20 bp, Artificial Sequence
  chemically synthesized
gcaggcaagagagcatgtgc

SEQ ID NO: 10200 - DNA, 20 bp, Artificial Sequence
  chemically synthesized
ggcaggcaagagagcatgtg

SEQ ID NO: 10201 - DNA, 20 bp, Artificial Sequence
  chemically synthesized
ttacacggtggcaggcaaga

SEQ ID NO: 10202 - DNA, 20 bp, Artificial Sequence
  chemically synthesized
tcttacacggtggcaggcaa

SEQ ID NO: 10203 - DNA, 20 bp, Artificial Sequence
  chemically synthesized
tgtcttacacggtggcaggc

SEQ ID NO: 10204 - DNA, 20 bp, Artificial Sequence
  chemically synthesized
ggcatgtcttacacggtggc

SEQ ID NO: 10205 - DNA, 20 bp, Artificial Sequence
  chemically synthesized
aggcatgtcttacacggtgg

SEQ ID NO: 10206 - DNA, 20 bp, Artificial Sequence
  chemically synthesized
tctcttgcctgccaccgtgt

SEQ ID NO: 10207 - DNA, 20 bp, Artificial Sequence
  chemically synthesized
gaaaggcatgtcttacacgg

SEQ ID NO: 10208 - DNA, 20 bp, Artificial Sequence
  chemically synthesized
gaggaaaggcatgtcttaca

SEQ ID NO: 10209 - DNA, 20 bp, Artificial Sequence
  chemically synthesized
agaaggtgaaggaggaggaa

SEQ ID NO: 10210 - DNA, 20 bp, Artificial Sequence
  chemically synthesized
cagaaggtgaaggaggagga

SEQ ID NO: 10211 - DNA, 20 bp, Artificial Sequence
  chemically synthesized
atggcagaaggtgaaggagg

SEQ ID NO: 10212 - DNA, 20 bp, Artificial Sequence
  chemically synthesized
catggcagaaggtgaaggag

SEQ ID NO: 10213 - DNA, 20 bp, Artificial Sequence
  chemically synthesized
atcatggcagaaggtgaagg

SEQ ID NO: 10214 - DNA, 20 bp, Artificial Sequence
  chemically synthesized
aatcatggcagaaggtgaag

SEQ ID NO: 10215 - DNA, 20 bp, Artificial Sequence
  chemically synthesized
acaatcatggcagaaggtga

SEQ ID NO: 10216 - DNA, 20 bp, Artificial Sequence
  chemically synthesized
cacaatcatggcagaaggtg

SEQ ID NO: 10217 - DNA, 20 bp, Artificial Sequence
  chemically synthesized
ggcctcacaatcatggcaga

SEQ ID NO: 10218 - DNA, 20 bp, Artificial Sequence
  chemically synthesized
aggcctcacaatcatggcag

SEQ ID NO: 10219 - DNA, 20 bp, Artificial Sequence
  chemically synthesized
ggaaggcctcacaatcatgg

SEQ ID NO: 10220 - DNA, 20 bp, Artificial Sequence
  chemically synthesized
tcaccttctgccatgattgt

SEQ ID NO: 10221 - DNA, 20 bp, Artificial Sequence
  chemically synthesized
ctgggaaggcctcacaatca

SEQ ID NO: 10222 - DNA, 20 bp, Artificial Sequence
  chemically synthesized
caccttctgccatgattgtg

SEQ ID NO: 10223 - DNA, 20 bp, Artificial Sequence
  chemically synthesized
ccatgattgtgaggccttcc

SEQ ID NO: 10224 - DNA, 20 bp, Artificial Sequence
  chemically synthesized
acagttccgtgtggctggga

SEQ ID NO: 10225 - DNA, 20 bp, Artificial Sequence
  chemically synthesized
cacagttccgtgtggctggg

SEQ ID NO: 10226 - DNA, 20 bp, Artificial Sequence
  chemically synthesized
gtgaggccttcccagccaca

SEQ ID NO: 10227 - DNA, 20 bp, Artificial Sequence
  chemically synthesized
actcacagttccgtgtggct

SEQ ID NO: 10228 - DNA, 20 bp, Artificial Sequence
  chemically synthesized
gactcacagttccgtgtggc

SEQ ID NO: 10229 - DNA, 20 bp, Artificial Sequence
  chemically synthesized
aatggactcacagttccgtg

SEQ ID NO: 10230 - DNA, 20 bp, Artificial Sequence
  chemically synthesized
tcccagccacacggaactgt

SEQ ID NO: 10231 - DNA, 20 bp, Artificial Sequence
  chemically synthesized
aaagaggtttaatggactca

SEQ ID NO: 10232 - DNA, 20 bp, Artificial Sequence
  chemically synthesized
acaaagaaaaagaggtttaa

SEQ ID NO: 10233 - DNA, 20 bp, Artificial Sequence
  chemically synthesized
ggcaatttacaaagaaaaag

SEQ ID NO: 10234 - DNA, 20 bp, Artificial Sequence
  chemically synthesized
gggcaatttacaaagaaaaa

SEQ ID NO: 10235 - DNA, 20 bp, Artificial Sequence
  chemically synthesized
cggggcaatttacaaagaaa

SEQ ID NO: 10236 - DNA, 20 bp, Artificial Sequence
  chemically synthesized
ttcatacggggcaatttaca

SEQ ID NO: 10237 - DNA, 20 bp, Artificial Sequence
  chemically synthesized
tattagtccattttcatacg

SEQ ID NO: 10238 - DNA, 20 bp, Artificial Sequence
  chemically synthesized
gtattagtccattttcatac

SEQ ID NO: 10239 - DNA, 20 bp, Artificial Sequence
  chemically synthesized
tgtattagtccattttcata

SEQ ID NO: 10240 - DNA, 20 bp, Artificial Sequence
  chemically synthesized
taaattgccccgtatgaaaa

SEQ ID NO: 10241 - DNA, 20 bp, Artificial Sequence
  chemically synthesized
tgaaaatggactaatacacc

SEQ ID NO: 10242 - DNA, 20 bp, Artificial Sequence
  chemically synthesized
attcaagttacttggtgtat

SEQ ID NO: 10243 - DNA, 20 bp, Artificial Sequence
  chemically synthesized
aactaggcattcaagttact

SEQ ID NO: 10244 - DNA, 20 bp, Artificial Sequence
  chemically synthesized
caccaagtaacttgaatgcc

SEQ ID NO: 10245 - DNA, 20 bp, Artificial Sequence
  chemically synthesized
tttaacgaaactaggcattc

SEQ ID NO: 10246 - DNA, 20 bp, Artificial Sequence
  chemically synthesized
atgatacatttaacgaaact

SEQ ID NO: 10247 - DNA, 20 bp, Artificial Sequence
  chemically synthesized
tatgatacatttaacgaaac

SEQ ID NO: 10248 - DNA, 20 bp, Artificial Sequence
  chemically synthesized
ttggagtggagaggaaagcg

SEQ ID NO: 10249 - DNA, 20 bp, Artificial Sequence
  chemically synthesized
taaagttggagtggagagga

SEQ ID NO: 10250 - DNA, 20 bp, Artificial Sequence
  chemically synthesized
tttttaaagttggagtggag

SEQ ID NO: 10251 - DNA, 20 bp, Artificial Sequence
  chemically synthesized
gtttttaaagttggagtgga

SEQ ID NO: 10252 - DNA, 20 bp, Artificial Sequence
  chemically synthesized
atgtttttaaagttggagtg

SEQ ID NO: 10253 - DNA, 20 bp, Artificial Sequence
  chemically synthesized
acatgtttttaaagttggag

SEQ ID NO: 10254 - DNA, 20 bp, Artificial Sequence
  chemically synthesized
cccacatgtttttaaagttg

SEQ ID NO: 10255 - DNA, 20 bp, Artificial Sequence
  chemically synthesized
ttcccacatgtttttaaagt

SEQ ID NO: 10256 - DNA, 20 bp, Artificial Sequence
  chemically synthesized
gctgttcccacatgttttta

SEQ ID NO: 10257 - DNA, 20 bp, Artificial Sequence
  chemically synthesized
actccaactttaaaaacatg

SEQ ID NO: 10258 - DNA, 20 bp, Artificial Sequence
  chemically synthesized
ctccaactttaaaaacatgt

SEQ ID NO: 10259 - DNA, 20 bp, Artificial Sequence
  chemically synthesized
actttaaaaacatgtgggaa

SEQ ID NO: 10260 - DNA, 20 bp, Artificial Sequence
  chemically synthesized
aaaacatgtgggaacagccg

SEQ ID NO: 10261 - DNA, 20 bp, Artificial Sequence
  chemically synthesized
aaacatgtgggaacagccgt

SEQ ID NO: 10262 - DNA, 20 bp, Artificial Sequence
  chemically synthesized
gtgggaacagccgtaggaat

SEQ ID NO: 10263 - DNA, 20 bp, Artificial Sequence
  chemically synthesized
taattcaagactgattccta

SEQ ID NO: 10264 - DNA, 20 bp, Artificial Sequence
  chemically synthesized
gacatcactggaaataattc

SEQ ID NO: 10265 - DNA, 20 bp, Artificial Sequence
  chemically synthesized
aatcagtcttgaattatttc

SEQ ID NO: 10266 - DNA, 20 bp, Artificial Sequence
  chemically synthesized
aaatgtccagtagacatcac

SEQ ID NO: 10267 - DNA, 20 bp, Artificial Sequence
  chemically synthesized
ttatttccagtgatgtctac

SEQ ID NO: 10268 - DNA, 20 bp, Artificial Sequence
  chemically synthesized
atgaatgttaaaatgtccag

SEQ ID NO: 10269 - DNA, 20 bp, Artificial Sequence
  chemically synthesized
ggaatgaatgttaaaatgtc

SEQ ID NO: 10270 - DNA, 20 bp, Artificial Sequence
  chemically synthesized
aagggaggaaagaagcataa

SEQ ID NO: 10271 - DNA, 20 bp, Artificial Sequence
  chemically synthesized
gggtaaggaagggaggaaag

SEQ ID NO: 10272 - DNA, 20 bp, Artificial Sequence
  chemically synthesized
ttagggtaaggaagggagga

SEQ ID NO: 10273 - DNA, 20 bp, Artificial Sequence
  chemically synthesized
gaatttagggtaaggaaggg

SEQ ID NO: 10274 - DNA, 20 bp, Artificial Sequence
  chemically synthesized
ggaatttagggtaaggaagg

SEQ ID NO: 10275 - DNA, 20 bp, Artificial Sequence
  chemically synthesized
aaggaatttagggtaaggaa

SEQ ID NO: 10276 - DNA, 20 bp, Artificial Sequence
  chemically synthesized
taaggaatttagggtaagga

SEQ ID NO: 10277 - DNA, 20 bp, Artificial Sequence
  chemically synthesized
gtaaggaatttagggtaagg

SEQ ID NO: 10278 - DNA, 20 bp, Artificial Sequence
  chemically synthesized
taggtaaggaatttagggta

SEQ ID NO: 10279 - DNA, 20 bp, Artificial Sequence
  chemically synthesized
gtaggtaaggaatttagggt

SEQ ID NO: 10280 - DNA, 20 bp, Artificial Sequence
  chemically synthesized
agtggtaggtaaggaattta

SEQ ID NO: 10281 - DNA, 20 bp, Artificial Sequence
  chemically synthesized
aagtggtaggtaaggaattt

SEQ ID NO: 10282 - DNA, 20 bp, Artificial Sequence
  chemically synthesized
aaagtggtaggtaaggaatt

SEQ ID NO: 10283 - DNA, 20 bp, Artificial Sequence
  chemically synthesized
tgaagacaaagtggtaggta

SEQ ID NO: 10284 - DNA, 20 bp, Artificial Sequence
  chemically synthesized
ctgaagacaaagtggtaggt

SEQ ID NO: 10285 - DNA, 20 bp, Artificial Sequence
  chemically synthesized
gcctctgaagacaaagtggt

SEQ ID NO: 10286 - DNA, 20 bp, Artificial Sequence
  chemically synthesized
tgcctctgaagacaaagtgg

SEQ ID NO: 10287 - DNA, 20 bp, Artificial Sequence
  chemically synthesized
gactgcctctgaagacaaag

SEQ ID NO: 10288 - DNA, 20 bp, Artificial Sequence
  chemically synthesized
cttacctaccactttgtctt

SEQ ID NO: 10289 - DNA, 20 bp, Artificial Sequence
  chemically synthesized
aaggactgcctctgaagaca

SEQ ID NO: 10290 - DNA, 20 bp, Artificial Sequence
  chemically synthesized
tacctaccactttgtcttca

SEQ ID NO: 10291 - DNA, 20 bp, Artificial Sequence
  chemically synthesized
acctaccactttgtcttcag

SEQ ID NO: 10292 - DNA, 20 bp, Artificial Sequence
  chemically synthesized
taccactttgtcttcagagg

SEQ ID NO: 10293 - DNA, 20 bp, Artificial Sequence
  chemically synthesized
gagaggaaggactgcctctg

SEQ ID NO: 10294 - DNA, 20 bp, Artificial Sequence
  chemically synthesized
cgtgaccttgaatgagagga

SEQ ID NO: 10295 - DNA, 20 bp, Artificial Sequence
  chemically synthesized
gcgtgaccttgaatgagagg

SEQ ID NO: 10296 - DNA, 20 bp, Artificial Sequence
  chemically synthesized
ggcagtccttcctctcattc

SEQ ID NO: 10297 - DNA, 20 bp, Artificial Sequence
  chemically synthesized
gaggcgtgaccttgaatgag

SEQ ID NO: 10298 - DNA, 20 bp, Artificial Sequence
  chemically synthesized
gcagtccttcctctcattca

SEQ ID NO: 10299 - DNA, 20 bp, Artificial Sequence
  chemically synthesized
ggaggcgtgaccttgaatga

SEQ ID NO: 10300 - DNA, 20 bp, Artificial Sequence
  chemically synthesized
gaggaggcgtgaccttgaat

SEQ ID NO: 10301 - DNA, 20 bp, Artificial Sequence
  chemically synthesized
gggaactaaagtatgggagg

SEQ ID NO: 10302 - DNA, 20 bp, Artificial Sequence
  chemically synthesized
agggaactaaagtatgggag

SEQ ID NO: 10303 - DNA, 20 bp, Artificial Sequence
  chemically synthesized
ttagggaactaaagtatggg

SEQ ID NO: 10304 - DNA, 20 bp, Artificial Sequence
  chemically synthesized
gttagggaactaaagtatgg

SEQ ID NO: 10305 - DNA, 20 bp, Artificial Sequence
  chemically synthesized
tcacgcctcctcccatactt

SEQ ID NO: 10306 - DNA, 20 bp, Artificial Sequence
  chemically synthesized
gggttagggaactaaagtat

SEQ ID NO: 10307 - DNA, 20 bp, Artificial Sequence
  chemically synthesized
agggttagggaactaaagta

SEQ ID NO: 10308 - DNA, 20 bp, Artificial Sequence
  chemically synthesized
agagaagggttagggaacta

SEQ ID NO: 10309 - DNA, 20 bp, Artificial Sequence
  chemically synthesized
ggcaggagagagaagggtta

SEQ ID NO: 10310 - DNA, 20 bp, Artificial Sequence
  chemically synthesized
aggcaggagagagaagggtt

SEQ ID NO: 10311 - DNA, 20 bp, Artificial Sequence
  chemically synthesized
gaggcaggagagagaagggt

SEQ ID NO: 10312 - DNA, 20 bp, Artificial Sequence
  chemically synthesized
acaggaggcaggagagagaa

SEQ ID NO: 10313 - DNA, 20 bp, Artificial Sequence
  chemically synthesized
cacaggaggcaggagagaga

SEQ ID NO: 10314 - DNA, 20 bp, Artificial Sequence
  chemically synthesized
ccacaggaggcaggagagag

SEQ ID NO: 10315 - DNA, 20 bp, Artificial Sequence
  chemically synthesized
ttcccacaggaggcaggaga

SEQ ID NO: 10316 - DNA, 20 bp, Artificial Sequence
  chemically synthesized
ttttcccacaggaggcagga

SEQ ID NO: 10317 - DNA, 20 bp, Artificial Sequence
  chemically synthesized
cattttcccacaggaggcag

SEQ ID NO: 10318 - DNA, 20 bp, Artificial Sequence
  chemically synthesized
agcattttcccacaggaggc

SEQ ID NO: 10319 - DNA, 20 bp, Artificial Sequence
  chemically synthesized
cttctctctcctgcctcctg

SEQ ID NO: 10320 - DNA, 20 bp, Artificial Sequence
  chemically synthesized
gagcattttcccacaggagg

SEQ ID NO: 10321 - DNA, 20 bp, Artificial Sequence
  chemically synthesized
ttctctctcctgcctcctgt

SEQ ID NO: 10322 - DNA, 20 bp, Artificial Sequence
  chemically synthesized
tgggagcattttcccacagg

SEQ ID NO: 10323 - DNA, 20 bp, Artificial Sequence
  chemically synthesized
atgggagcattttcccacag

SEQ ID NO: 10324 - DNA, 20 bp, Artificial Sequence
  chemically synthesized
tgatgggagcattttcccac

SEQ ID NO: 10325 - DNA, 20 bp, Artificial Sequence
  chemically synthesized
atgatgggagcattttccca

SEQ ID NO: 10326 - DNA, 20 bp, Artificial Sequence
  chemically synthesized
gcagagcttgggaatgatgg

SEQ ID NO: 10327 - DNA, 20 bp, Artificial Sequence
  chemically synthesized
gggcagagcttgggaatgat

SEQ ID NO: 10328 - DNA, 20 bp, Artificial Sequence
  chemically synthesized
agggcagagcttgggaatga

SEQ ID NO: 10329 - DNA, 20 bp, Artificial Sequence
  chemically synthesized
aaaatgctcccatcattccc

SEQ ID NO: 10330 - DNA, 20 bp, Artificial Sequence
  chemically synthesized
agaagaggagggcagagctt

SEQ ID NO: 10331 - DNA, 20 bp, Artificial Sequence
  chemically synthesized
aagaagaggagggcagagct

SEQ ID NO: 10332 - DNA, 20 bp, Artificial Sequence
  chemically synthesized
gccagaagaagaggagggca

SEQ ID NO: 10333 - DNA, 20 bp, Artificial Sequence
  chemically synthesized
gtgccagaagaagaggaggg

SEQ ID NO: 10334 - DNA, 20 bp, Artificial Sequence
  chemically synthesized
aatgtgccagaagaagagga

SEQ ID NO: 10335 - DNA, 20 bp, Artificial Sequence
  chemically synthesized
aaatgtgccagaagaagagg

SEQ ID NO: 10336 - DNA, 20 bp, Artificial Sequence
  chemically synthesized
gaaatgtgccagaagaagag

SEQ ID NO: 10337 - DNA, 20 bp, Artificial Sequence
  chemically synthesized
gctctgccctcctcttcttc

SEQ ID NO: 10338 - DNA, 20 bp, Artificial Sequence
  chemically synthesized
gagaaatgtgccagaagaag

SEQ ID NO: 10339 - DNA, 20 bp, Artificial Sequence
  chemically synthesized
ggagaaatgtgccagaagaa

SEQ ID NO: 10340 - DNA, 20 bp, Artificial Sequence
  chemically synthesized
ctggagaaatgtgccagaag

SEQ ID NO: 10341 - DNA, 20 bp, Artificial Sequence
  chemically synthesized
atgctggagaaatgtgccag

SEQ ID NO: 10342 - DNA, 20 bp, Artificial Sequence
  chemically synthesized
cacatgctggagaaatgtgc

SEQ ID NO: 10343 - DNA, 20 bp, Artificial Sequence
  chemically synthesized
cttcttctggcacatttctc

SEQ ID NO: 10344 - DNA, 20 bp, Artificial Sequence
  chemically synthesized
tctctaattttcacatgctg

SEQ ID NO: 10345 - DNA, 20 bp, Artificial Sequence
  chemically synthesized
aatctctaattttcacatgc

SEQ ID NO: 10346 - DNA, 20 bp, Artificial Sequence
  chemically synthesized
tttctccagcatgtgaaaat

SEQ ID NO: 10347 - DNA, 20 bp, Artificial Sequence
  chemically synthesized
tctccagcatgtgaaaatta

SEQ ID NO: 10348 - DNA, 20 bp, Artificial Sequence
  chemically synthesized
tgtgaaaattagagattttt

SEQ ID NO: 10349 - DNA, 20 bp, Artificial Sequence
  chemically synthesized
attagagatttttaagtaaa

SEQ ID NO: 10350 - DNA, 20 bp, Artificial Sequence
  chemically synthesized
tagagatttttaagtaaaaa

SEQ ID NO: 10351 - DNA, 20 bp, Artificial Sequence
  chemically synthesized
tttaagtaaaaagagaaaac

SEQ ID NO: 10352 - DNA, 20 bp, Artificial Sequence
  chemically synthesized
taagtaaaaagagaaaacca

SEQ ID NO: 10353 - DNA, 20 bp, Artificial Sequence
  chemically synthesized
gtgtcgtgcagtgttcactc

SEQ ID NO: 10354 - DNA, 20 bp, Artificial Sequence
  chemically synthesized
ttacttcacacagtgtcgtg

SEQ ID NO: 10355 - DNA, 20 bp, Artificial Sequence
  chemically synthesized
acactgcacgacactgtgtg

SEQ ID NO: 10356 - DNA, 20 bp, Artificial Sequence
  chemically synthesized
gttgttggggttacttcaca

SEQ ID NO: 10357 - DNA, 20 bp, Artificial Sequence
  chemically synthesized
aaacatatttatggttgttg

SEQ ID NO: 10358 - DNA, 20 bp, Artificial Sequence
  chemically synthesized
caaacatatttatggttgtt

SEQ ID NO: 10359 - DNA, 20 bp, Artificial Sequence
  chemically synthesized
gcaaacatatttatggttgt

SEQ ID NO: 10360 - DNA, 20 bp, Artificial Sequence
  chemically synthesized
aatatttgcaaacatattta

SEQ ID NO: 10361 - DNA, 20 bp, Artificial Sequence
  chemically synthesized
tttgcaaatatttgcatatg

SEQ ID NO: 10362 - DNA, 20 bp, Artificial Sequence
  chemically synthesized
tgcaaatatttgcatatgta

SEQ ID NO: 10363 - DNA, 20 bp, Artificial Sequence
  chemically synthesized
caaatatttgcatatgtaga

SEQ ID NO: 10364 - DNA, 20 bp, Artificial Sequence
  chemically synthesized
gcatatgtagagagcatgtt

SEQ ID NO: 10365 - DNA, 20 bp, Artificial Sequence
  chemically synthesized
tatgtagagagcatgtttgg

SEQ ID NO: 10366 - DNA, 20 bp, Artificial Sequence
  chemically synthesized
atgtagagagcatgtttgga

SEQ ID NO: 10367 - DNA, 20 bp, Artificial Sequence
  chemically synthesized
gcatgtttggaaggaaacac

SEQ ID NO: 10368 - DNA, 20 bp, Artificial Sequence
  chemically synthesized
ggaaggaaacacaagaaacc

SEQ ID NO: 10369 - DNA, 20 bp, Artificial Sequence
  chemically synthesized
ggaaacacaagaaaccaaga

SEQ ID NO: 10370 - DNA, 20 bp, Artificial Sequence
  chemically synthesized
acacaagaaaccaagaaaga

SEQ ID NO: 10371 - DNA, 20 bp, Artificial Sequence
  chemically synthesized
ctggaggctgccatctttct

SEQ ID NO: 10372 - DNA, 20 bp, Artificial Sequence
  chemically synthesized
caagaaaccaagaaagatgg

SEQ ID NO: 10373 - DNA, 20 bp, Artificial Sequence
  chemically synthesized
ccaagaaagatggcagcctc

SEQ ID NO: 10374 - DNA, 20 bp, Artificial Sequence
  chemically synthesized
aagaaagatggcagcctcca

SEQ ID NO: 10375 - DNA, 20 bp, Artificial Sequence
  chemically synthesized
aagatggcagcctccagagc

SEQ ID NO: 10376 - DNA, 20 bp, Artificial Sequence
  chemically synthesized
tgtggtgtttccagctctgg

SEQ ID NO: 10377 - DNA, 20 bp, Artificial Sequence
  chemically synthesized
ctgtggtgtttccagctctg

SEQ ID NO: 10378 - DNA, 20 bp, Artificial Sequence
  chemically synthesized
ggctgtggtgtttccagctc

SEQ ID NO: 10379 - DNA, 20 bp, Artificial Sequence
  chemically synthesized
tcccctggctgtggtgtttc

SEQ ID NO: 10380 - DNA, 20 bp, Artificial Sequence
  chemically synthesized
ctccagagctggaaacacca

SEQ ID NO: 10381 - DNA, 20 bp, Artificial Sequence
  chemically synthesized
agagctggaaacaccacagc

SEQ ID NO: 10382 - DNA, 20 bp, Artificial Sequence
  chemically synthesized
gagctggaaacaccacagcc

SEQ ID NO: 10383 - DNA, 20 bp, Artificial Sequence
  chemically synthesized
agctggaaacaccacagcca

SEQ ID NO: 10384 - DNA, 20 bp, Artificial Sequence
  chemically synthesized
gctggaaacaccacagccag

SEQ ID NO: 10385 - DNA, 20 bp, Artificial Sequence
  chemically synthesized
ccaaccttctcccctggctg

SEQ ID NO: 10386 - DNA, 20 bp, Artificial Sequence
  chemically synthesized
tggaaacaccacagccaggg

SEQ ID NO: 10387 - DNA, 20 bp, Artificial Sequence
  chemically synthesized
aaacaccacagccaggggag

SEQ ID NO: 10388 - DNA, 20 bp, Artificial Sequence
  chemically synthesized
aacaccacagccaggggaga

SEQ ID NO: 10389 - DNA, 20 bp, Artificial Sequence
  chemically synthesized
ccttctccaaccttctcccc

SEQ ID NO: 10390 - DNA, 20 bp, Artificial Sequence
  chemically synthesized
ccacagccaggggagaaggt

SEQ ID NO: 10391 - DNA, 20 bp, Artificial Sequence
  chemically synthesized
acagccaggggagaaggttg

SEQ ID NO: 10392 - DNA, 20 bp, Artificial Sequence
  chemically synthesized
gccaggggagaaggttggag

SEQ ID NO: 10393 - DNA, 20 bp, Artificial Sequence
  chemically synthesized
ccaggggagaaggttggaga

SEQ ID NO: 10394 - DNA, 20 bp, Artificial Sequence
  chemically synthesized
tcaaaaagacatatagagaa

SEQ ID NO: 10395 - DNA, 20 bp, Artificial Sequence
  chemically synthesized
agggttcaaaaagacatata

SEQ ID NO: 10396 - DNA, 20 bp, Artificial Sequence
  chemically synthesized
aaagggttcaaaaagacata

SEQ ID NO: 10397 - DNA, 20 bp, Artificial Sequence
  chemically synthesized
caaaatccaaagggttcaaa

SEQ ID NO: 10398 - DNA, 20 bp, Artificial Sequence
  chemically synthesized
atatgtctttttgaaccctt

SEQ ID NO: 10399 - DNA, 20 bp, Artificial Sequence
  chemically synthesized
attattatacaaaatccaaa

SEQ ID NO: 10400 - DNA, 20 bp, Artificial Sequence
  chemically synthesized
tattattatacaaaatccaa

SEQ ID NO: 10401 - DNA, 20 bp, Artificial Sequence
  chemically synthesized
atattattatacaaaatcca

SEQ ID NO: 10402 - DNA, 20 bp, Artificial Sequence
  chemically synthesized
aattacttttatttttagta

SEQ ID NO: 10403 - DNA, 20 bp, Artificial Sequence
  chemically synthesized
ttaattacttttatttttag

SEQ ID NO: 10404 - DNA, 20 bp, Artificial Sequence
  chemically synthesized
gtattctctactaaaaataa

SEQ ID NO: 10405 - DNA, 20 bp, Artificial Sequence
  chemically synthesized
tatttaattacttttatttt

SEQ ID NO: 10406 - DNA, 20 bp, Artificial Sequence
  chemically synthesized
tccggaagatgtgaacatta

SEQ ID NO: 10407 - DNA, 20 bp, Artificial Sequence
  chemically synthesized
actttaatgttcacatcttc

SEQ ID NO: 10408 - DNA, 20 bp, Artificial Sequence
  chemically synthesized
tttaatgttcacatcttccg

SEQ ID NO: 10409 - DNA, 20 bp, Artificial Sequence
  chemically synthesized
tggatttggtagaactccgg

SEQ ID NO: 10410 - DNA, 20 bp, Artificial Sequence
  chemically synthesized
cactggatttggtagaactc

SEQ ID NO: 10411 - DNA, 20 bp, Artificial Sequence
  chemically synthesized
ttccggagttctaccaaatc

SEQ ID NO: 10412 - DNA, 20 bp, Artificial Sequence
  chemically synthesized
aaggagaacactggatttgg

SEQ ID NO: 10413 - DNA, 20 bp, Artificial Sequence
  chemically synthesized
cagaaggagaacactggatt

SEQ ID NO: 10414 - DNA, 20 bp, Artificial Sequence
  chemically synthesized
atgtagcagaaggagaacac

SEQ ID NO: 10415 - DNA, 20 bp, Artificial Sequence
  chemically synthesized
ccgggagcatgtagcagaag

SEQ ID NO: 10416 - DNA, 20 bp, Artificial Sequence
  chemically synthesized
tcccgggagcatgtagcaga

SEQ ID NO: 10417 - DNA, 20 bp, Artificial Sequence
  chemically synthesized
atcccgggagcatgtagcag

SEQ ID NO: 10418 - DNA, 20 bp, Artificial Sequence
  chemically synthesized
tatatcccgggagcatgtag

SEQ ID NO: 10419 - DNA, 20 bp, Artificial Sequence
  chemically synthesized
ttatatatcccgggagcatg

SEQ ID NO: 10420 - DNA, 20 bp, Artificial Sequence
  chemically synthesized
ctccttctgctacatgctcc

SEQ ID NO: 10421 - DNA, 20 bp, Artificial Sequence
  chemically synthesized
tccttctgctacatgctccc

SEQ ID NO: 10422 - DNA, 20 bp, Artificial Sequence
  chemically synthesized
aatgaatttatatatcccgg

SEQ ID NO: 10423 - DNA, 20 bp, Artificial Sequence
  chemically synthesized
agaatgaatttatatatccc

SEQ ID NO: 10424 - DNA, 20 bp, Artificial Sequence
  chemically synthesized
gagaatgaatttatatatcc

SEQ ID NO: 10425 - DNA, 20 bp, Artificial Sequence
  chemically synthesized
gatatataaattcattctca

SEQ ID NO: 10426 - DNA, 20 bp, Artificial Sequence
  chemically synthesized
caggtggtagttgaaaccgt

SEQ ID NO: 10427 - DNA, 20 bp, Artificial Sequence
  chemically synthesized
agtcgccagctcacaggtgg

SEQ ID NO: 10428 - DNA, 20 bp, Artificial Sequence
  chemically synthesized
cggtttcaactaccacctgt

SEQ ID NO: 10429 - DNA, 20 bp, Artificial Sequence
  chemically synthesized
gtgagtcgccagctcacagg

SEQ ID NO: 10430 - DNA, 20 bp, Artificial Sequence
  chemically synthesized
ttcaactaccacctgtgagc

SEQ ID NO: 10431 - DNA, 20 bp, Artificial Sequence
  chemically synthesized
actgtgagtcgccagctcac

SEQ ID NO: 10432 - DNA, 20 bp, Artificial Sequence
  chemically synthesized
gactgtgagtcgccagctca

SEQ ID NO: 10433 - DNA, 20 bp, Artificial Sequence
  chemically synthesized
atattaggactgtgagtcgc

SEQ ID NO: 10434 - DNA, 20 bp, Artificial Sequence
  chemically synthesized
acctgtgagctggcgactca

SEQ ID NO: 10435 - DNA, 20 bp, Artificial Sequence
  chemically synthesized
gcctgagatattaggactgt

SEQ ID NO: 10436 - DNA, 20 bp, Artificial Sequence
  chemically synthesized
gactcacagtcctaatatct

SEQ ID NO: 10437 - DNA, 20 bp, Artificial Sequence
  chemically synthesized
ggatataagcctgagatatt

SEQ ID NO: 10438 - DNA, 20 bp, Artificial Sequence
  chemically synthesized
actcacagtcctaatatctc

SEQ ID NO: 10439 - DNA, 20 bp, Artificial Sequence
  chemically synthesized
aggatataagcctgagatat

SEQ ID NO: 10440 - DNA, 20 bp, Artificial Sequence
  chemically synthesized
tgtagaaaggatataagcct

SEQ ID NO: 10441 - DNA, 20 bp, Artificial Sequence
  chemically synthesized
gatgcttgtagaaaggatat

SEQ ID NO: 10442 - DNA, 20 bp, Artificial Sequence
  chemically synthesized
caggcttatatcctttctac

SEQ ID NO: 10443 - DNA, 20 bp, Artificial Sequence
  chemically synthesized
gaactctgatgcttgtagaa

SEQ ID NO: 10444 - DNA, 20 bp, Artificial Sequence
  chemically synthesized
agaactctgatgcttgtaga

SEQ ID NO: 10445 - DNA, 20 bp, Artificial Sequence
  chemically synthesized
tatatcctttctacaagcat

SEQ ID NO: 10446 - DNA, 20 bp, Artificial Sequence
  chemically synthesized
agatagaactctgatgcttg

SEQ ID NO: 10447 - DNA, 20 bp, Artificial Sequence
  chemically synthesized
tatcctttctacaagcatca

SEQ ID NO: 10448 - DNA, 20 bp, Artificial Sequence
  chemically synthesized
agcatcagagttctatctct

SEQ ID NO: 10449 - DNA, 20 bp, Artificial Sequence
  chemically synthesized
atgtctgacagtctgagaga

SEQ ID NO: 10450 - DNA, 20 bp, Artificial Sequence
  chemically synthesized
gtaaatgtctgacagtctga

SEQ ID NO: 10451 - DNA, 20 bp, Artificial Sequence
  chemically synthesized
agttctatctctcagactgt

SEQ ID NO: 10452 - DNA, 20 bp, Artificial Sequence
  chemically synthesized
gtgtaaatgtctgacagtct

SEQ ID NO: 10453 - DNA, 20 bp, Artificial Sequence
  chemically synthesized
ctccatgtgtaaatgtctga

SEQ ID NO: 10454 - DNA, 20 bp, Artificial Sequence
  chemically synthesized
gactgtcagacatttacaca

SEQ ID NO: 10455 - DNA, 20 bp, Artificial Sequence
  chemically synthesized
ctgtcagacatttacacatg

SEQ ID NO: 10456 - DNA, 20 bp, Artificial Sequence
  chemically synthesized
tttacacatggagatgtcac

SEQ ID NO: 10457 - DNA, 20 bp, Artificial Sequence
  chemically synthesized
ttacacatggagatgtcacc

SEQ ID NO: 10458 - DNA, 20 bp, Artificial Sequence
  chemically synthesized
aagaggtcgagttgaggtcc

SEQ ID NO: 10459 - DNA, 20 bp, Artificial Sequence
  chemically synthesized
gtatggaagaggtcgagttg

SEQ ID NO: 10460 - DNA, 20 bp, Artificial Sequence
  chemically synthesized
ggtatggaagaggtcgagtt

SEQ ID NO: 10461 - DNA, 20 bp, Artificial Sequence
  chemically synthesized
aatgaggtatggaagaggtc

SEQ ID NO: 10462 - DNA, 20 bp, Artificial Sequence
  chemically synthesized
tgataaatgaggtatggaag

SEQ ID NO: 10463 - DNA, 20 bp, Artificial Sequence
  chemically synthesized
gtgataaatgaggtatggaa

SEQ ID NO: 10464 - DNA, 20 bp, Artificial Sequence
  chemically synthesized
aggtgataaatgaggtatgg

SEQ ID NO: 10465 - DNA, 20 bp, Artificial Sequence
  chemically synthesized
ggaaggtgataaatgaggta

SEQ ID NO: 10466 - DNA, 20 bp, Artificial Sequence
  chemically synthesized
tagctggaaggtgataaatg

SEQ ID NO: 10467 - DNA, 20 bp, Artificial Sequence
  chemically synthesized
gtagctggaaggtgataaat

SEQ ID NO: 10468 - DNA, 20 bp, Artificial Sequence
  chemically synthesized
atacctcatttatcaccttc

SEQ ID NO: 10469 - DNA, 20 bp, Artificial Sequence
  chemically synthesized
tgaagggctgagtagctgga

SEQ ID NO: 10470 - DNA, 20 bp, Artificial Sequence
  chemically synthesized
ctgaagggctgagtagctgg

SEQ ID NO: 10471 - DNA, 20 bp, Artificial Sequence
  chemically synthesized
tttatcaccttccagctact

SEQ ID NO: 10472 - DNA, 20 bp, Artificial Sequence
  chemically synthesized
ttcctgaagggctgagtagc

SEQ ID NO: 10473 - DNA, 20 bp, Artificial Sequence
  chemically synthesized
gtccttcctgaagggctgag

SEQ ID NO: 10474 - DNA, 20 bp, Artificial Sequence
  chemically synthesized
cttccagctactcagccctt

SEQ ID NO: 10475 - DNA, 20 bp, Artificial Sequence
  chemically synthesized
gaggtccttcctgaagggct

SEQ ID NO: 10476 - DNA, 20 bp, Artificial Sequence
  chemically synthesized
ttccagctactcagcccttc

SEQ ID NO: 10477 - DNA, 20 bp, Artificial Sequence
  chemically synthesized
cagctactcagcccttcagg

SEQ ID NO: 10478 - DNA, 20 bp, Artificial Sequence
  chemically synthesized
agctactcagcccttcagga

SEQ ID NO: 10479 - DNA, 20 bp, Artificial Sequence
  chemically synthesized
tattagaggtccttcctgaa

SEQ ID NO: 10480 - DNA, 20 bp, Artificial Sequence
  chemically synthesized
ttattagaggtccttcctga

SEQ ID NO: 10481 - DNA, 20 bp, Artificial Sequence
  chemically synthesized
tttattagaggtccttcctg

SEQ ID NO: 10482 - DNA, 20 bp, Artificial Sequence
  chemically synthesized
aatgcagcagtgtttattag

SEQ ID NO: 10483 - DNA, 20 bp, Artificial Sequence
  chemically synthesized
taatgcagcagtgtttatta

SEQ ID NO: 10484 - DNA, 20 bp, Artificial Sequence
  chemically synthesized
tttaatgcagcagtgtttat

SEQ ID NO: 10485 - DNA, 20 bp, Artificial Sequence
  chemically synthesized
aggtccatcctttaatgcag

SEQ ID NO: 10486 - DNA, 20 bp, Artificial Sequence
  chemically synthesized
taataaacactgctgcatta

SEQ ID NO: 10487 - DNA, 20 bp, Artificial Sequence
  chemically synthesized
aataaacactgctgcattaa

SEQ ID NO: 10488 - DNA, 20 bp, Artificial Sequence
  chemically synthesized
agcaggtccatcctttaatg

SEQ ID NO: 10489 - DNA, 20 bp, Artificial Sequence
  chemically synthesized
aacactgctgcattaaagga

SEQ ID NO: 10490 - DNA, 20 bp, Artificial Sequence
  chemically synthesized
aattcaggaggagttgcagc

SEQ ID NO: 10491 - DNA, 20 bp, Artificial Sequence
  chemically synthesized
taattcaggaggagttgcag

SEQ ID NO: 10492 - DNA, 20 bp, Artificial Sequence
  chemically synthesized
tgataattcaggaggagttg

SEQ ID NO: 10493 - DNA, 20 bp, Artificial Sequence
  chemically synthesized
tgggactgataattcaggag

SEQ ID NO: 10494 - DNA, 20 bp, Artificial Sequence
  chemically synthesized
gctgggactgataattcagg

SEQ ID NO: 10495 - DNA, 20 bp, Artificial Sequence
  chemically synthesized
agctgggactgataattcag

SEQ ID NO: 10496 - DNA, 20 bp, Artificial Sequence
  chemically synthesized
tgcaactcctcctgaattat

SEQ ID NO: 10497 - DNA, 20 bp, Artificial Sequence
  chemically synthesized
gcagctgggactgataattc

SEQ ID NO: 10498 - DNA, 20 bp, Artificial Sequence
  chemically synthesized
tgcagctgggactgataatt

SEQ ID NO: 10499 - DNA, 20 bp, Artificial Sequence
  chemically synthesized
tcctcctgaattatcagtcc

SEQ ID NO: 10500 - DNA, 20 bp, Artificial Sequence
  chemically synthesized
gatagtagttatttgcagct

SEQ ID NO: 10501 - DNA, 20 bp, Artificial Sequence
  chemically synthesized
tgatagtagttatttgcagc

SEQ ID NO: 10502 - DNA, 20 bp, Artificial Sequence
  chemically synthesized
aagatgatagtagttatttg

SEQ ID NO: 10503 - DNA, 20 bp, Artificial Sequence
  chemically synthesized
actacaaaacaagatgatag

SEQ ID NO: 10504 - DNA, 20 bp, Artificial Sequence
  chemically synthesized
gtaactacaaaacaagatga

SEQ ID NO: 10505 - DNA, 20 bp, Artificial Sequence
  chemically synthesized
actactatcatcttgttttg

SEQ ID NO: 10506 - DNA, 20 bp, Artificial Sequence
  chemically synthesized
agggctggtaactacaaaac

SEQ ID NO: 10507 - DNA, 20 bp, Artificial Sequence
  chemically synthesized
tcatcttgttttgtagttac

SEQ ID NO: 10508 - DNA, 20 bp, Artificial Sequence
  chemically synthesized
tgttttgtagttaccagccc

SEQ ID NO: 10509 - DNA, 20 bp, Artificial Sequence
  chemically synthesized
gttttgtagttaccagccct

SEQ ID NO: 10510 - DNA, 20 bp, Artificial Sequence
  chemically synthesized
gaaggaatgattcccagggc

SEQ ID NO: 10511 - DNA, 20 bp, Artificial Sequence
  chemically synthesized
gtatgaaggaatgattccca

SEQ ID NO: 10512 - DNA, 20 bp, Artificial Sequence
  chemically synthesized
ggtatgaaggaatgattccc

SEQ ID NO: 10513 - DNA, 20 bp, Artificial Sequence
  chemically synthesized
gggtatgaaggaatgattcc

SEQ ID NO: 10514 - DNA, 20 bp, Artificial Sequence
  chemically synthesized
tctgtgggactagggtatga

SEQ ID NO: 10515 - DNA, 20 bp, Artificial Sequence
  chemically synthesized
ggaatcattccttcataccc

SEQ ID NO: 10516 - DNA, 20 bp, Artificial Sequence
  chemically synthesized
ttctgtgggactagggtatg

SEQ ID NO: 10517 - DNA, 20 bp, Artificial Sequence
  chemically synthesized
tcggtagttctgtgggacta

SEQ ID NO: 10518 - DNA, 20 bp, Artificial Sequence
  chemically synthesized
tccttcataccctagtccca

SEQ ID NO: 10519 - DNA, 20 bp, Artificial Sequence
  chemically synthesized
ttcggtagttctgtgggact

SEQ ID NO: 10520 - DNA, 20 bp, Artificial Sequence
  chemically synthesized
attcggtagttctgtgggac

SEQ ID NO: 10521 - DNA, 20 bp, Artificial Sequence
  chemically synthesized
gtttgattcggtagttctgt

SEQ ID NO: 10522 - DNA, 20 bp, Artificial Sequence
  chemically synthesized
tgtttgattcggtagttctg

SEQ ID NO: 10523 - DNA, 20 bp, Artificial Sequence
  chemically synthesized
gatagagctgtttgattcgg

SEQ ID NO: 10524 - DNA, 20 bp, Artificial Sequence
  chemically synthesized
cacagaactaccgaatcaaa

SEQ ID NO: 10525 - DNA, 20 bp, Artificial Sequence
  chemically synthesized
gaggatagagctgtttgatt

SEQ ID NO: 10526 - DNA, 20 bp, Artificial Sequence
  chemically synthesized
tgatatttcgggggaggata

SEQ ID NO: 10527 - DNA, 20 bp, Artificial Sequence
  chemically synthesized
agtgatatttcgggggagga

SEQ ID NO: 10528 - DNA, 20 bp, Artificial Sequence
  chemically synthesized
tctgagtgatatttcggggg

SEQ ID NO: 10529 - DNA, 20 bp, Artificial Sequence
  chemically synthesized
atctgagtgatatttcgggg

SEQ ID NO: 10530 - DNA, 20 bp, Artificial Sequence
  chemically synthesized
tgatctgagtgatatttcgg

SEQ ID NO: 10531 - DNA, 20 bp, Artificial Sequence
  chemically synthesized
ctgatctgagtgatatttcg

SEQ ID NO: 10532 - DNA, 20 bp, Artificial Sequence
  chemically synthesized
gctgatctgagtgatatttc

SEQ ID NO: 10533 - DNA, 20 bp, Artificial Sequence
  chemically synthesized
ggctgatctgagtgatattt

SEQ ID NO: 10534 - DNA, 20 bp, Artificial Sequence
  chemically synthesized
tcctcccccgaaatatcact

SEQ ID NO: 10535 - DNA, 20 bp, Artificial Sequence
  chemically synthesized
ccccgaaatatcactcagat

SEQ ID NO: 10536 - DNA, 20 bp, Artificial Sequence
  chemically synthesized
tgaagtagacaggctgatct

SEQ ID NO: 10537 - DNA, 20 bp, Artificial Sequence
  chemically synthesized
gtgatagaaatgaagtagac

SEQ ID NO: 10538 - DNA, 20 bp, Artificial Sequence
  chemically synthesized
ggtgatagaaatgaagtaga

SEQ ID NO: 10539 - DNA, 20 bp, Artificial Sequence
  chemically synthesized
gtaaggtgatagaaatgaag

SEQ ID NO: 10540 - DNA, 20 bp, Artificial Sequence
  chemically synthesized
taagtaaggtgatagaaatg

SEQ ID NO: 10541 - DNA, 20 bp, Artificial Sequence
  chemically synthesized
tagagccttaagtaaggtga

SEQ ID NO: 10542 - DNA, 20 bp, Artificial Sequence
  chemically synthesized
tcatttctatcaccttactt

SEQ ID NO: 10543 - DNA, 20 bp, Artificial Sequence
  chemically synthesized
catttctatcaccttactta

SEQ ID NO: 10544 - DNA, 20 bp, Artificial Sequence
  chemically synthesized
gatgattagagccttaagta

SEQ ID NO: 10545 - DNA, 20 bp, Artificial Sequence
  chemically synthesized
agatgattagagccttaagt

SEQ ID NO: 10546 - DNA, 20 bp, Artificial Sequence
  chemically synthesized
aaagagatgattagagcctt

SEQ ID NO: 10547 - DNA, 20 bp, Artificial Sequence
  chemically synthesized
gcccaggaaagagatgatta

SEQ ID NO: 10548 - DNA, 20 bp, Artificial Sequence
  chemically synthesized
gagcccaggaaagagatgat

SEQ ID NO: 10549 - DNA, 20 bp, Artificial Sequence
  chemically synthesized
ggctctaatcatctctttcc

SEQ ID NO: 10550 - DNA, 20 bp, Artificial Sequence
  chemically synthesized
gctctaatcatctctttcct

SEQ ID NO: 10551 - DNA, 20 bp, Artificial Sequence
  chemically synthesized
tcacatgggagcccaggaaa

SEQ ID NO: 10552 - DNA, 20 bp, Artificial Sequence
  chemically synthesized
agtcacatgggagcccagga

SEQ ID NO: 10553 - DNA, 20 bp, Artificial Sequence
  chemically synthesized
ggggagtcacatgggagccc

SEQ ID NO: 10554 - DNA, 20 bp, Artificial Sequence
  chemically synthesized
gggggagtcacatgggagcc

SEQ ID NO: 10555 - DNA, 20 bp, Artificial Sequence
  chemically synthesized
agctggggggagtcacatgg

SEQ ID NO: 10556 - DNA, 20 bp, Artificial Sequence
  chemically synthesized
caagctggggggagtcacat

SEQ ID NO: 10557 - DNA, 20 bp, Artificial Sequence
  chemically synthesized
tcaagctggggggagtcaca

SEQ ID NO: 10558 - DNA, 20 bp, Artificial Sequence
  chemically synthesized
ggctcccatgtgactccccc

SEQ ID NO: 10559 - DNA, 20 bp, Artificial Sequence
  chemically synthesized
cgaggaaatcaagctggggg

SEQ ID NO: 10560 - DNA, 20 bp, Artificial Sequence
  chemically synthesized
aacgaggaaatcaagctggg

SEQ ID NO: 10561 - DNA, 20 bp, Artificial Sequence
  chemically synthesized
gaacgaggaaatcaagctgg

SEQ ID NO: 10562 - DNA, 20 bp, Artificial Sequence
  chemically synthesized
ggaacgaggaaatcaagctg

SEQ ID NO: 10563 - DNA, 20 bp, Artificial Sequence
  chemically synthesized
tggaacgaggaaatcaagct

SEQ ID NO: 10564 - DNA, 20 bp, Artificial Sequence
  chemically synthesized
ctggaacgaggaaatcaagc

SEQ ID NO: 10565 - DNA, 20 bp, Artificial Sequence
  chemically synthesized
gatgctggaacgaggaaatc

SEQ ID NO: 10566 - DNA, 20 bp, Artificial Sequence
  chemically synthesized
ccagcttgatttcctcgttc

SEQ ID NO: 10567 - DNA, 20 bp, Artificial Sequence
  chemically synthesized
aaaagagcgatgctggaacg

SEQ ID NO: 10568 - DNA, 20 bp, Artificial Sequence
  chemically synthesized
gaaaagagcgatgctggaac

SEQ ID NO: 10569 - DNA, 20 bp, Artificial Sequence
  chemically synthesized
aactttgaaaagagcgatgc

SEQ ID NO: 10570 - DNA, 20 bp, Artificial Sequence
  chemically synthesized
ttccagcatcgctcttttca

SEQ ID NO: 10571 - DNA, 20 bp, Artificial Sequence
  chemically synthesized
gcggagggtaactttgaaaa

SEQ ID NO: 10572 - DNA, 20 bp, Artificial Sequence
  chemically synthesized
gtgcggagggtaactttgaa

SEQ ID NO: 10573 - DNA, 20 bp, Artificial Sequence
  chemically synthesized
tttcaaagttaccctccgca

SEQ ID NO: 10574 - DNA, 20 bp, Artificial Sequence
  chemically synthesized
cacacaggcagctgtgcgga

SEQ ID NO: 10575 - DNA, 20 bp, Artificial Sequence
  chemically synthesized
ccacacaggcagctgtgcgg

SEQ ID NO: 10576 - DNA, 20 bp, Artificial Sequence
  chemically synthesized
gccacacaggcagctgtgcg

SEQ ID NO: 10577 - DNA, 20 bp, Artificial Sequence
  chemically synthesized
acgccacacaggcagctgtg

SEQ ID NO: 10578 - DNA, 20 bp, Artificial Sequence
  chemically synthesized
cctccgcacagctgcctgtg

SEQ ID NO: 10579 - DNA, 20 bp, Artificial Sequence
  chemically synthesized
atgaatatacgccacacagg

SEQ ID NO: 10580 - DNA, 20 bp, Artificial Sequence
  chemically synthesized
gacatgaatatacgccacac

SEQ ID NO: 10581 - DNA, 20 bp, Artificial Sequence
  chemically synthesized
tgacatgaatatacgccaca

SEQ ID NO: 10582 - DNA, 20 bp, Artificial Sequence
  chemically synthesized
gtatattcatgtcaatatca

SEQ ID NO: 10583 - DNA, 20 bp, Artificial Sequence
  chemically synthesized
caatatcatggcctgactcc

SEQ ID NO: 10584 - DNA, 20 bp, Artificial Sequence
  chemically synthesized
aagggtgtgatccaggagtc

SEQ ID NO: 10585 - DNA, 20 bp, Artificial Sequence
  chemically synthesized
caagggtgtgatccaggagt

SEQ ID NO: 10586 - DNA, 20 bp, Artificial Sequence
  chemically synthesized
aactcaagggtgtgatccag

SEQ ID NO: 10587 - DNA, 20 bp, Artificial Sequence
  chemically synthesized
gcaactcaagggtgtgatcc

SEQ ID NO: 10588 - DNA, 20 bp, Artificial Sequence
  chemically synthesized
agcaactcaagggtgtgatc

SEQ ID NO: 10589 - DNA, 20 bp, Artificial Sequence
  chemically synthesized
gactcctggatcacaccctt

SEQ ID NO: 10590 - DNA, 20 bp, Artificial Sequence
  chemically synthesized
tagtctagggagcaactcaa

SEQ ID NO: 10591 - DNA, 20 bp, Artificial Sequence
  chemically synthesized
ctagtctagggagcaactca

SEQ ID NO: 10592 - DNA, 20 bp, Artificial Sequence
  chemically synthesized
cctagtctagggagcaactc

SEQ ID NO: 10593 - DNA, 20 bp, Artificial Sequence
  chemically synthesized
cacacccttgagttgctccc

SEQ ID NO: 10594 - DNA, 20 bp, Artificial Sequence
  chemically synthesized
ccttgagttgctccctagac

SEQ ID NO: 10595 - DNA, 20 bp, Artificial Sequence
  chemically synthesized
gcctccgtgcctagtctagg

SEQ ID NO: 10596 - DNA, 20 bp, Artificial Sequence
  chemically synthesized
cttgagttgctccctagact

SEQ ID NO: 10597 - DNA, 20 bp, Artificial Sequence
  chemically synthesized
ctgcctccgtgcctagtcta

SEQ ID NO: 10598 - DNA, 20 bp, Artificial Sequence
  chemically synthesized
gctgcctccgtgcctagtct

SEQ ID NO: 10599 - DNA, 20 bp, Artificial Sequence
  chemically synthesized
tgctgcctccgtgcctagtc

SEQ ID NO: 10600 - DNA, 20 bp, Artificial Sequence
  chemically synthesized
gttgctccctagactaggca

SEQ ID NO: 10601 - DNA, 20 bp, Artificial Sequence
  chemically synthesized
tgctccctagactaggcacg

SEQ ID NO: 10602 - DNA, 20 bp, Artificial Sequence
  chemically synthesized
gctccctagactaggcacgg

SEQ ID NO: 10603 - DNA, 20 bp, Artificial Sequence
  chemically synthesized
agagttgctgcctccgtgcc

SEQ ID NO: 10604 - DNA, 20 bp, Artificial Sequence
  chemically synthesized
ccctagactaggcacggagg

SEQ ID NO: 10605 - DNA, 20 bp, Artificial Sequence
  chemically synthesized
gcacggaggcagcaactctg

SEQ ID NO: 10606 - DNA, 20 bp, Artificial Sequence
  chemically synthesized
cggaggcagcaactctgcag

SEQ ID NO: 10607 - DNA, 20 bp, Artificial Sequence
  chemically synthesized
ggaggcagcaactctgcagt

SEQ ID NO: 10608 - DNA, 20 bp, Artificial Sequence
  chemically synthesized
agggtgtggtacccactgca

SEQ ID NO: 10609 - DNA, 20 bp, Artificial Sequence
  chemically synthesized
gaagggtgtggtacccactg

SEQ ID NO: 10610 - DNA, 20 bp, Artificial Sequence
  chemically synthesized
agggcaggtcgggaagggtg

SEQ ID NO: 10611 - DNA, 20 bp, Artificial Sequence
  chemically synthesized
cagcaagggcaggtcgggaa

SEQ ID NO: 10612 - DNA, 20 bp, Artificial Sequence
  chemically synthesized
tcagcaagggcaggtcggga

SEQ ID NO: 10613 - DNA, 20 bp, Artificial Sequence
  chemically synthesized
gtcagcaagggcaggtcggg

SEQ ID NO: 10614 - DNA, 20 bp, Artificial Sequence
  chemically synthesized
caggtcagcaagggcaggtc

SEQ ID NO: 10615 - DNA, 20 bp, Artificial Sequence
  chemically synthesized
ccaggtcagcaagggcaggt

SEQ ID NO: 10616 - DNA, 20 bp, Artificial Sequence
  chemically synthesized
ctgaccaggtcagcaagggc

SEQ ID NO: 10617 - DNA, 20 bp, Artificial Sequence
  chemically synthesized
gctgaccaggtcagcaaggg

SEQ ID NO: 10618 - DNA, 20 bp, Artificial Sequence
  chemically synthesized
gaggctgaccaggtcagcaa

SEQ ID NO: 10619 - DNA, 20 bp, Artificial Sequence
  chemically synthesized
tgaggctgaccaggtcagca

SEQ ID NO: 10620 - DNA, 20 bp, Artificial Sequence
  chemically synthesized
ccgacctgcccttgctgacc

SEQ ID NO: 10621 - DNA, 20 bp, Artificial Sequence
  chemically synthesized
atgaggctgaccaggtcagc

SEQ ID NO: 10622 - DNA, 20 bp, Artificial Sequence
  chemically synthesized
cctgcccttgctgacctggt

SEQ ID NO: 10623 - DNA, 20 bp, Artificial Sequence
  chemically synthesized
ggagatgaggctgaccaggt

SEQ ID NO: 10624 - DNA, 20 bp, Artificial Sequence
  chemically synthesized
gagaggagatgaggctgacc

SEQ ID NO: 10625 - DNA, 20 bp, Artificial Sequence
  chemically synthesized
tgagaggagatgaggctgac

SEQ ID NO: 10626 - DNA, 20 bp, Artificial Sequence
  chemically synthesized
gcaaagaatgagaggagatg

SEQ ID NO: 10627 - DNA, 20 bp, Artificial Sequence
  chemically synthesized
ggcaaagaatgagaggagat

SEQ ID NO: 10628 - DNA, 20 bp, Artificial Sequence
  chemically synthesized
aagaaggcaaagaatgagag

SEQ ID NO: 10629 - DNA, 20 bp, Artificial Sequence
  chemically synthesized
ttaagaaggcaaagaatgag

SEQ ID NO: 10630 - DNA, 20 bp, Artificial Sequence
  chemically synthesized
tttaagaaggcaaagaatga

SEQ ID NO: 10631 - DNA, 20 bp, Artificial Sequence
  chemically synthesized
tttttaagaaggcaaagaat

SEQ ID NO: 10632 - DNA, 20 bp, Artificial Sequence
  chemically synthesized
ttaccttttttaagaaggca

SEQ ID NO: 10633 - DNA, 20 bp, Artificial Sequence
  chemically synthesized
ttgtattaccttttttaaga

SEQ ID NO: 10634 - DNA, 20 bp, Artificial Sequence
  chemically synthesized
cattctttgccttcttaaaa

SEQ ID NO: 10635 - DNA, 20 bp, Artificial Sequence
  chemically synthesized
gttgtattaccttttttaag

SEQ ID NO: 10636 - DNA, 20 bp, Artificial Sequence
  chemically synthesized
attctttgccttcttaaaaa

SEQ ID NO: 10637 - DNA, 20 bp, Artificial Sequence
  chemically synthesized
gcagttgtattacctttttt

SEQ ID NO: 10638 - DNA, 20 bp, Artificial Sequence
  chemically synthesized
taaaaaaggtaatacaactg

SEQ ID NO: 10639 - DNA, 20 bp, Artificial Sequence
  chemically synthesized
agtttgtttgagggaaactg

SEQ ID NO: 10640 - DNA, 20 bp, Artificial Sequence
  chemically synthesized
gaatggcagagtttgtttga

SEQ ID NO: 10641 - DNA, 20 bp, Artificial Sequence
  chemically synthesized
ggaatggcagagtttgtttg

SEQ ID NO: 10642 - DNA, 20 bp, Artificial Sequence
  chemically synthesized
aggaatggcagagtttgttt

SEQ ID NO: 10643 - DNA, 20 bp, Artificial Sequence
  chemically synthesized
tgtcagggtgaggaatggca

SEQ ID NO: 10644 - DNA, 20 bp, Artificial Sequence
  chemically synthesized
ggtgtcagggtgaggaatgg

SEQ ID NO: 10645 - DNA, 20 bp, Artificial Sequence
  chemically synthesized
aaaggtgtcagggtgaggaa

SEQ ID NO: 10646 - DNA, 20 bp, Artificial Sequence
  chemically synthesized
taaacaaaggtgtcagggtg

SEQ ID NO: 10647 - DNA, 20 bp, Artificial Sequence
  chemically synthesized
ataaacaaaggtgtcagggt

SEQ ID NO: 10648 - DNA, 20 bp, Artificial Sequence
  chemically synthesized
gaatataaacaaaggtgtca

SEQ ID NO: 10649 - DNA, 20 bp, Artificial Sequence
  chemically synthesized
ggaatataaacaaaggtgtc

SEQ ID NO: 10650 - DNA, 20 bp, Artificial Sequence
  chemically synthesized
tggaatataaacaaaggtgt

SEQ ID NO: 10651 - DNA, 20 bp, Artificial Sequence
  chemically synthesized
ttcctatggaatataaacaa

SEQ ID NO: 10652 - DNA, 20 bp, Artificial Sequence
  chemically synthesized
attcctatggaatataaaca

SEQ ID NO: 10653 - DNA, 20 bp, Artificial Sequence
  chemically synthesized
acacctttgtttatattcca

SEQ ID NO: 10654 - DNA, 20 bp, Artificial Sequence
  chemically synthesized
cacctttgtttatattccat

SEQ ID NO: 10655 - DNA, 20 bp, Artificial Sequence
  chemically synthesized
gttaggaatgggcattccta

SEQ ID NO: 10656 - DNA, 20 bp, Artificial Sequence
  chemically synthesized
aatctgaagaggttaggaat

SEQ ID NO: 10657 - DNA, 20 bp, Artificial Sequence
  chemically synthesized
gaatctgaagaggttaggaa

SEQ ID NO: 10658 - DNA, 20 bp, Artificial Sequence
  chemically synthesized
gaagggaatctgaagaggtt

SEQ ID NO: 10659 - DNA, 20 bp, Artificial Sequence
  chemically synthesized
atgcccattcctaacctctt

SEQ ID NO: 10660 - DNA, 20 bp, Artificial Sequence
  chemically synthesized
tgaagggaatctgaagaggt

SEQ ID NO: 10661 - DNA, 20 bp, Artificial Sequence
  chemically synthesized
aaaatgaagggaatctgaag

SEQ ID NO: 10662 - DNA, 20 bp, Artificial Sequence
  chemically synthesized
caaaatgaagggaatctgaa

SEQ ID NO: 10663 - DNA, 20 bp, Artificial Sequence
  chemically synthesized
gccaaaatgaagggaatctg

SEQ ID NO: 10664 - DNA, 20 bp, Artificial Sequence
  chemically synthesized
tcttcagattcccttcattt

SEQ ID NO: 10665 - DNA, 20 bp, Artificial Sequence
  chemically synthesized
gaaaagatggccaaaatgaa

SEQ ID NO: 10666 - DNA, 20 bp, Artificial Sequence
  chemically synthesized
tgaaaagatggccaaaatga

SEQ ID NO: 10667 - DNA, 20 bp, Artificial Sequence
  chemically synthesized
gtgaaaagatggccaaaatg

SEQ ID NO: 10668 - DNA, 20 bp, Artificial Sequence
  chemically synthesized
ctccaatgatggtgaaaaga

SEQ ID NO: 10669 - DNA, 20 bp, Artificial Sequence
  chemically synthesized
aagtctccaatgatggtgaa

SEQ ID NO: 10670 - DNA, 20 bp, Artificial Sequence
  chemically synthesized
ggccatcttttcaccatcat

SEQ ID NO: 10671 - DNA, 20 bp, Artificial Sequence
  chemically synthesized
ccatcttttcaccatcattg

SEQ ID NO: 10672 - DNA, 20 bp, Artificial Sequence
  chemically synthesized
tttgtgcaagtctccaatga

SEQ ID NO: 10673 - DNA, 20 bp, Artificial Sequence
  chemically synthesized
catcattggagacttgcaca

SEQ ID NO: 10674 - DNA, 20 bp, Artificial Sequence
  chemically synthesized
ctttcattaggtctttgtgc

SEQ ID NO: 10675 - DNA, 20 bp, Artificial Sequence
  chemically synthesized
cttgcacaaagacctaatga

SEQ ID NO: 10676 - DNA, 20 bp, Artificial Sequence
  chemically synthesized
ttattcaatgttctttcatt

SEQ ID NO: 10677 - DNA, 20 bp, Artificial Sequence
  chemically synthesized
tttattcaatgttctttcat

SEQ ID NO: 10678 - DNA, 20 bp, Artificial Sequence
  chemically synthesized
taatgaaagaacattgaata

SEQ ID NO: 10679 - DNA, 20 bp, Artificial Sequence
  chemically synthesized
cattgaataaagatttcccg

SEQ ID NO: 10680 - DNA, 20 bp, Artificial Sequence
  chemically synthesized
ctatcaatcttcatagctac

SEQ ID NO: 10681 - DNA, 20 bp, Artificial Sequence
  chemically synthesized
gctatcaatcttcatagcta

SEQ ID NO: 10682 - DNA, 20 bp, Artificial Sequence
  chemically synthesized
aaagatttcccgtagctatg

SEQ ID NO: 10683 - DNA, 20 bp, Artificial Sequence
  chemically synthesized
ctagtagctatcaatcttca

SEQ ID NO: 10684 - DNA, 20 bp, Artificial Sequence
  chemically synthesized
cccgtagctatgaagattga

SEQ ID NO: 10685 - DNA, 20 bp, Artificial Sequence
  chemically synthesized
ctatgaagattgatagctac

SEQ ID NO: 10686 - DNA, 20 bp, Artificial Sequence
  chemically synthesized
aagattgatagctactagac

SEQ ID NO: 10687 - DNA, 20 bp, Artificial Sequence
  chemically synthesized
agattgatagctactagact

SEQ ID NO: 10688 - DNA, 20 bp, Artificial Sequence
  chemically synthesized
tgactttggacctagtctag

SEQ ID NO: 10689 - DNA, 20 bp, Artificial Sequence
  chemically synthesized
tgatgactttggacctagtc

SEQ ID NO: 10690 - DNA, 20 bp, Artificial Sequence
  chemically synthesized
tagctactagactaggtcca

SEQ ID NO: 10691 - DNA, 20 bp, Artificial Sequence
  chemically synthesized
tgacttgatgactttggacc

SEQ ID NO: 10692 - DNA, 20 bp, Artificial Sequence
  chemically synthesized
tgtaattgacttgatgactt

SEQ ID NO: 10693 - DNA, 20 bp, Artificial Sequence
  chemically synthesized
agactaggtccaaagtcatc

SEQ ID NO: 10694 - DNA, 20 bp, Artificial Sequence
  chemically synthesized
aagtcatcaagtcaattaca

SEQ ID NO: 10695 - DNA, 20 bp, Artificial Sequence
  chemically synthesized
atcaagtcaattacaaagta

SEQ ID NO: 10696 - DNA, 20 bp, Artificial Sequence
  chemically synthesized
tcaattacaaagtaaagcaa

SEQ ID NO: 10697 - DNA, 20 bp, Artificial Sequence
  chemically synthesized
caattacaaagtaaagcaac

SEQ ID NO: 10698 - DNA, 20 bp, Artificial Sequence
  chemically synthesized
agcaacgggatcatgatttc

SEQ ID NO: 10699 - DNA, 20 bp, Artificial Sequence
  chemically synthesized
taccactgaattaaagtagc

SEQ ID NO: 10700 - DNA, 20 bp, Artificial Sequence
  chemically synthesized
ctgataccactgaattaaag

SEQ ID NO: 10701 - DNA, 20 bp, Artificial Sequence
  chemically synthesized
gatttccagctactttaatt

SEQ ID NO: 10702 - DNA, 20 bp, Artificial Sequence
  chemically synthesized
ttactgataccactgaatta

SEQ ID NO: 10703 - DNA, 20 bp, Artificial Sequence
  chemically synthesized
ttccagctactttaattcag

SEQ ID NO: 10704 - DNA, 20 bp, Artificial Sequence
  chemically synthesized
ctactttaattcagtggtat

SEQ ID NO: 10705 - DNA, 20 bp, Artificial Sequence
  chemically synthesized
agtggtatcagtaactgatc

SEQ ID NO: 10706 - DNA, 20 bp, Artificial Sequence
  chemically synthesized
cagtcaaagaagttctagat

SEQ ID NO: 10707 - DNA, 20 bp, Artificial Sequence
  chemically synthesized
tgttacagtcaaagaagttc

SEQ ID NO: 10708 - DNA, 20 bp, Artificial Sequence
  chemically synthesized
tattattgttacagtcaaag

SEQ ID NO: 10709 - DNA, 20 bp, Artificial Sequence
  chemically synthesized
gattattattgttacagtca

SEQ ID NO: 10710 - DNA, 20 bp, Artificial Sequence
  chemically synthesized
gtgcaagattattattgtta

SEQ ID NO: 10711 - DNA, 20 bp, Artificial Sequence
  chemically synthesized
aattcctccagtgattgtgc

SEQ ID NO: 10712 - DNA, 20 bp, Artificial Sequence
  chemically synthesized
taataatcttgcacaatcac

SEQ ID NO: 10713 - DNA, 20 bp, Artificial Sequence
  chemically synthesized
ataatcttgcacaatcactg

SEQ ID NO: 10714 - DNA, 20 bp, Artificial Sequence
  chemically synthesized
taatcttgcacaatcactgg

SEQ ID NO: 10715 - DNA, 20 bp, Artificial Sequence
  chemically synthesized
ctttttcctttaaattcctc

SEQ ID NO: 10716 - DNA, 20 bp, Artificial Sequence
  chemically synthesized
acaatcactggaggaattta

SEQ ID NO: 10717 - DNA, 20 bp, Artificial Sequence
  chemically synthesized
caatcactggaggaatttaa

SEQ ID NO: 10718 - DNA, 20 bp, Artificial Sequence
  chemically synthesized
ctggaggaatttaaaggaaa

SEQ ID NO: 10719 - DNA, 20 bp, Artificial Sequence
  chemically synthesized
ggaggaatttaaaggaaaaa

SEQ ID NO: 10720 - DNA, 20 bp, Artificial Sequence
  chemically synthesized
aaaagagaaaactcaaattt

SEQ ID NO: 10721 - DNA, 20 bp, Artificial Sequence
  chemically synthesized
accttatgaagccaaaattt

SEQ ID NO: 10722 - DNA, 20 bp, Artificial Sequence
  chemically synthesized
aactcaaattttggcttcat

SEQ ID NO: 10723 - DNA, 20 bp, Artificial Sequence
  chemically synthesized
actcaaattttggcttcata

SEQ ID NO: 10724 - DNA, 20 bp, Artificial Sequence
  chemically synthesized
ttgggcagtaagaccttatg

SEQ ID NO: 10725 - DNA, 20 bp, Artificial Sequence
  chemically synthesized
catatgtcttgttgggcagt

SEQ ID NO: 10726 - DNA, 20 bp, Artificial Sequence
  chemically synthesized
ataaggtcttactgcccaac

SEQ ID NO: 10727 - DNA, 20 bp, Artificial Sequence
  chemically synthesized
ctttcatatgtcttgttggg

SEQ ID NO: 10728 - DNA, 20 bp, Artificial Sequence
  chemically synthesized
gacctttcatatgtcttgtt

SEQ ID NO: 10729 - DNA, 20 bp, Artificial Sequence
  chemically synthesized
ggacctttcatatgtcttgt

SEQ ID NO: 10730 - DNA, 20 bp, Artificial Sequence
  chemically synthesized
ctgcccaacaagacatatga

SEQ ID NO: 10731 - DNA, 20 bp, Artificial Sequence
  chemically synthesized
tgcccaacaagacatatgaa

SEQ ID NO: 10732 - DNA, 20 bp, Artificial Sequence
  chemically synthesized
caagacatatgaaaggtcct

SEQ ID NO: 10733 - DNA, 20 bp, Artificial Sequence
  chemically synthesized
gacatatgaaaggtcctgag

SEQ ID NO: 10734 - DNA, 20 bp, Artificial Sequence
  chemically synthesized
acatatgaaaggtcctgagt

SEQ ID NO: 10735 - DNA, 20 bp, Artificial Sequence
  chemically synthesized
tagattcttaatacctactc

SEQ ID NO: 10736 - DNA, 20 bp, Artificial Sequence
  chemically synthesized
gtagattcttaatacctact

SEQ ID NO: 10737 - DNA, 20 bp, Artificial Sequence
  chemically synthesized
aaaggtcctgagtaggtatt

SEQ ID NO: 10738 - DNA, 20 bp, Artificial Sequence
  chemically synthesized
gagtaggtattaagaatcta

SEQ ID NO: 10739 - DNA, 20 bp, Artificial Sequence
  chemically synthesized
gtaggtattaagaatctaca

SEQ ID NO: 10740 - DNA, 20 bp, Artificial Sequence
  chemically synthesized
tataacacgagggaactctg

SEQ ID NO: 10741 - DNA, 20 bp, Artificial Sequence
  chemically synthesized
gtagatgttatataacacga

SEQ ID NO: 10742 - DNA, 20 bp, Artificial Sequence
  chemically synthesized
agtagatgttatataacacg

SEQ ID NO: 10743 - DNA, 20 bp, Artificial Sequence
  chemically synthesized
tagtagatgttatataacac

SEQ ID NO: 10744 - DNA, 20 bp, Artificial Sequence
  chemically synthesized
tctaaagttaaagttgttag

SEQ ID NO: 10745 - DNA, 20 bp, Artificial Sequence
  chemically synthesized
aagtctaaagttaaagttgt

SEQ ID NO: 10746 - DNA, 20 bp, Artificial Sequence
  chemically synthesized
tctactaacaactttaactt

SEQ ID NO: 10747 - DNA, 20 bp, Artificial Sequence
  chemically synthesized
caccataaagtctaaagtta

SEQ ID NO: 10748 - DNA, 20 bp, Artificial Sequence
  chemically synthesized
ctaattcaccataaagtcta

SEQ ID NO: 10749 - DNA, 20 bp, Artificial Sequence
  chemically synthesized
aactttaactttagacttta

SEQ ID NO: 10750 - DNA, 20 bp, Artificial Sequence
  chemically synthesized
tattaacctaattcaccata

SEQ ID NO: 10751 - DNA, 20 bp, Artificial Sequence
  chemically synthesized
ctttagactttatggtgaat

SEQ ID NO: 10752 - DNA, 20 bp, Artificial Sequence
  chemically synthesized
tttagactttatggtgaatt

SEQ ID NO: 10753 - DNA, 20 bp, Artificial Sequence
  chemically synthesized
tggtgaattaggttaatatt

SEQ ID NO: 10754 - DNA, 20 bp, Artificial Sequence
  chemically synthesized
ttgttctcaagtcaacaagg

SEQ ID NO: 10755 - DNA, 20 bp, Artificial Sequence
  chemically synthesized
agattgttctcaagtcaaca

SEQ ID NO: 10756 - DNA, 20 bp, Artificial Sequence
  chemically synthesized
tagattgttctcaagtcaac

SEQ ID NO: 10757 - DNA, 20 bp, Artificial Sequence
  chemically synthesized
tttagccaccttgttgactt

SEQ ID NO: 10758 - DNA, 20 bp, Artificial Sequence
  chemically synthesized
aaattgattagattgttctc

SEQ ID NO: 10759 - DNA, 20 bp, Artificial Sequence
  chemically synthesized
tacctgcagagcaaattgat

SEQ ID NO: 10760 - DNA, 20 bp, Artificial Sequence
  chemically synthesized
aatctaatcaatttgctctg

SEQ ID NO: 10761 - DNA, 20 bp, Artificial Sequence
  chemically synthesized
atctaatcaatttgctctgc

SEQ ID NO: 10762 - DNA, 20 bp, Artificial Sequence
  chemically synthesized
taatcaatttgctctgcagg

SEQ ID NO: 10763 - DNA, 20 bp, Artificial Sequence
  chemically synthesized
ttgtcgttctactacctgca

SEQ ID NO: 10764 - DNA, 20 bp, Artificial Sequence
  chemically synthesized
tcaatttgctctgcaggtag

SEQ ID NO: 10765 - DNA, 20 bp, Artificial Sequence
  chemically synthesized
cattgtcgttctactacctg

SEQ ID NO: 10766 - DNA, 20 bp, Artificial Sequence
  chemically synthesized
acgacaatgtctttgtctct

SEQ ID NO: 10767 - DNA, 20 bp, Artificial Sequence
  chemically synthesized
ggtagcctttctgagagaca

SEQ ID NO: 10768 - DNA, 20 bp, Artificial Sequence
  chemically synthesized
caatgtctttgtctctcaga

SEQ ID NO: 10769 - DNA, 20 bp, Artificial Sequence
  chemically synthesized
aatgtctttgtctctcagaa

SEQ ID NO: 10770 - DNA, 20 bp, Artificial Sequence
  chemically synthesized
tgaaaaggtagcctttctga

SEQ ID NO: 10771 - DNA, 20 bp, Artificial Sequence
  chemically synthesized
aatgaaaaggtagcctttct

SEQ ID NO: 10772 - DNA, 20 bp, Artificial Sequence
  chemically synthesized
tgatcctagcaatgaaaagg

SEQ ID NO: 10773 - DNA, 20 bp, Artificial Sequence
  chemically synthesized
gtatgatcctagcaatgaaa

SEQ ID NO: 10774 - DNA, 20 bp, Artificial Sequence
  chemically synthesized
ggtatgatcctagcaatgaa

SEQ ID NO: 10775 - DNA, 20 bp, Artificial Sequence
  chemically synthesized
aaaggctaccttttcattgc

SEQ ID NO: 10776 - DNA, 20 bp, Artificial Sequence
  chemically synthesized
aaggctaccttttcattgct

SEQ ID NO: 10777 - DNA, 20 bp, Artificial Sequence
  chemically synthesized
tgaaattcaaggtatgatcc

SEQ ID NO: 10778 - DNA, 20 bp, Artificial Sequence
  chemically synthesized
taggatcataccttgaattt

SEQ ID NO: 10779 - DNA, 20 bp, Artificial Sequence
  chemically synthesized
aagacttgctctgaaattca

SEQ ID NO: 10780 - DNA, 20 bp, Artificial Sequence
  chemically synthesized
caagacttgctctgaaattc

SEQ ID NO: 10781 - DNA, 20 bp, Artificial Sequence
  chemically synthesized
ggatcataccttgaatttca

SEQ ID NO: 10782 - DNA, 20 bp, Artificial Sequence
  chemically synthesized
cataccttgaatttcagagc

SEQ ID NO: 10783 - DNA, 20 bp, Artificial Sequence
  chemically synthesized
ttgaatttcagagcaagtct

SEQ ID NO: 10784 - DNA, 20 bp, Artificial Sequence
  chemically synthesized
ctgcactgtctaaataaacc

SEQ ID NO: 10785 - DNA, 20 bp, Artificial Sequence
  chemically synthesized
agagcaagtcttggtttatt

SEQ ID NO: 10786 - DNA, 20 bp, Artificial Sequence
  chemically synthesized
caagtcttggtttatttaga

SEQ ID NO: 10787 - DNA, 20 bp, Artificial Sequence
  chemically synthesized
cttggtttatttagacagtg

SEQ ID NO: 10788 - DNA, 20 bp, Artificial Sequence
  chemically synthesized
tggtttatttagacagtgca

SEQ ID NO: 10789 - DNA, 20 bp, Artificial Sequence
  chemically synthesized
gcctgtagtgttcaaataca

SEQ ID NO: 10790 - DNA, 20 bp, Artificial Sequence
  chemically synthesized
aagcctgtagtgttcaaata

SEQ ID NO: 10791 - DNA, 20 bp, Artificial Sequence
  chemically synthesized
atctctgtatttgaacacta

SEQ ID NO: 10792 - DNA, 20 bp, Artificial Sequence
  chemically synthesized
tctctgtatttgaacactac

SEQ ID NO: 10793 - DNA, 20 bp, Artificial Sequence
  chemically synthesized
tatttgaacactacaggctt

SEQ ID NO: 10794 - DNA, 20 bp, Artificial Sequence
  chemically synthesized
agtctcctgacttaagcctg

SEQ ID NO: 10795 - DNA, 20 bp, Artificial Sequence
  chemically synthesized
tgaacactacaggcttaagt

SEQ ID NO: 10796 - DNA, 20 bp, Artificial Sequence
  chemically synthesized
gaacactacaggcttaagtc

SEQ ID NO: 10797 - DNA, 20 bp, Artificial Sequence
  chemically synthesized
acactacaggcttaagtcag

SEQ ID NO: 10798 - DNA, 20 bp, Artificial Sequence
  chemically synthesized
agccttcagtctcctgactt

SEQ ID NO: 10799 - DNA, 20 bp, Artificial Sequence
  chemically synthesized
aggcttaagtcaggagactg

SEQ ID NO: 10800 - DNA, 20 bp, Artificial Sequence
  chemically synthesized
ggcttaagtcaggagactga

SEQ ID NO: 10801 - DNA, 20 bp, Artificial Sequence
  chemically synthesized
cttgcgttgattaaagcctt

SEQ ID NO: 10802 - DNA, 20 bp, Artificial Sequence
  chemically synthesized
tttttttcttgcgttgatta

SEQ ID NO: 10803 - DNA, 20 bp, Artificial Sequence
  chemically synthesized
ctgaaggctttaatcaacgc

SEQ ID NO: 10804 - DNA, 20 bp, Artificial Sequence
  chemically synthesized
ttaatcaacgcaagaaaaaa

SEQ ID NO: 10805 - DNA, 20 bp, Artificial Sequence
  chemically synthesized
aagaaaaaaaagtaaacctt

SEQ ID NO: 10806 - DNA, 20 bp, Artificial Sequence
  chemically synthesized
tccttagcattgcagactca

SEQ ID NO: 10807 - DNA, 20 bp, Artificial Sequence
  chemically synthesized
gtccttagcattgcagactc

SEQ ID NO: 10808 - DNA, 20 bp, Artificial Sequence
  chemically synthesized
aaccttgagtctgcaatgct

SEQ ID NO: 10809 - DNA, 20 bp, Artificial Sequence
  chemically synthesized
attgtgtgtccttagcattg

SEQ ID NO: 10810 - DNA, 20 bp, Artificial Sequence
  chemically synthesized
accttgagtctgcaatgcta

SEQ ID NO: 10811 - DNA, 20 bp, Artificial Sequence
  chemically synthesized
tttgccccattgtgtgtcct

SEQ ID NO: 10812 - DNA, 20 bp, Artificial Sequence
  chemically synthesized
gcaatgctaaggacacacaa

SEQ ID NO: 10813 - DNA, 20 bp, Artificial Sequence
  chemically synthesized
caatgctaaggacacacaat

SEQ ID NO: 10814 - DNA, 20 bp, Artificial Sequence
  chemically synthesized
aatgctaaggacacacaatg

SEQ ID NO: 10815 - DNA, 20 bp, Artificial Sequence
  chemically synthesized
acacaatggggcaaaaaccc

SEQ ID NO: 10816 - DNA, 20 bp, Artificial Sequence
  chemically synthesized
tggggcaaaaacccaagatc

SEQ ID NO: 10817 - DNA, 20 bp, Artificial Sequence
  chemically synthesized
gcaaagagccactggatctt

SEQ ID NO: 10818 - DNA, 20 bp, Artificial Sequence
  chemically synthesized
ggcaaagagccactggatct

SEQ ID NO: 10819 - DNA, 20 bp, Artificial Sequence
  chemically synthesized
ggcaaaaacccaagatccag

SEQ ID NO: 10820 - DNA, 20 bp, Artificial Sequence
  chemically synthesized
tttatttggcaaagagccac

SEQ ID NO: 10821 - DNA, 20 bp, Artificial Sequence
  chemically synthesized
atacatctttatttggcaaa

SEQ ID NO: 10822 - DNA, 20 bp, Artificial Sequence
  chemically synthesized
agatacatctttatttggca

SEQ ID NO: 10823 - DNA, 20 bp, Artificial Sequence
  chemically synthesized
cagtggctctttgccaaata

SEQ ID NO: 10824 - DNA, 20 bp, Artificial Sequence
  chemically synthesized
aattcagatacatctttatt

SEQ ID NO: 10825 - DNA, 20 bp, Artificial Sequence
  chemically synthesized
cctcattaccacatataatt

SEQ ID NO: 10826 - DNA, 20 bp, Artificial Sequence
  chemically synthesized
agatgtatctgaattatatg

SEQ ID NO: 10827 - DNA, 20 bp, Artificial Sequence
  chemically synthesized
tctgaattatatgtggtaat

SEQ ID NO: 10828 - DNA, 20 bp, Artificial Sequence
  chemically synthesized
ctgaattatatgtggtaatg

SEQ ID NO: 10829 - DNA, 20 bp, Artificial Sequence
  chemically synthesized
tgaattatatgtggtaatga

SEQ ID NO: 10830 - DNA, 20 bp, Artificial Sequence
  chemically synthesized
aattatatgtggtaatgagg

SEQ ID NO: 10831 - DNA, 20 bp, Artificial Sequence
  chemically synthesized
aatgagggagaaatatgatg

SEQ ID NO: 10832 - DNA, 20 bp, Artificial Sequence
  chemically synthesized
gagggagaaatatgatgcag

SEQ ID NO: 10833 - DNA, 20 bp, Artificial Sequence
  chemically synthesized
gatgcagaagcgaaatatta

SEQ ID NO: 10834 - DNA, 20 bp, Artificial Sequence
  chemically synthesized
agaagcgaaatattaaagat

SEQ ID NO: 10835 - DNA, 20 bp, Artificial Sequence
  chemically synthesized
ggatgactaatggtgttagt

SEQ ID NO: 10836 - DNA, 20 bp, Artificial Sequence
  chemically synthesized
agatatctcactaacaccat

SEQ ID NO: 10837 - DNA, 20 bp, Artificial Sequence
  chemically synthesized
gtttggatgactaatggtgt

SEQ ID NO: 10838 - DNA, 20 bp, Artificial Sequence
  chemically synthesized
ccataagtttggatgactaa

SEQ ID NO: 10839 - DNA, 20 bp, Artificial Sequence
  chemically synthesized
ccattagtcatccaaactta

SEQ ID NO: 10840 - DNA, 20 bp, Artificial Sequence
  chemically synthesized
cattagtcatccaaacttat

SEQ ID NO: 10841 - DNA, 20 bp, Artificial Sequence
  chemically synthesized
catagtgcctcccataagtt

SEQ ID NO: 10842 - DNA, 20 bp, Artificial Sequence
  chemically synthesized
ttagtcatccaaacttatgg

SEQ ID NO: 10843 - DNA, 20 bp, Artificial Sequence
  chemically synthesized
tagtcatccaaacttatggg

SEQ ID NO: 10844 - DNA, 20 bp, Artificial Sequence
  chemically synthesized
tttcccatagtgcctcccat

SEQ ID NO: 10845 - DNA, 20 bp, Artificial Sequence
  chemically synthesized
caaacttatgggaggcacta

SEQ ID NO: 10846 - DNA, 20 bp, Artificial Sequence
  chemically synthesized
aaacttatgggaggcactat

SEQ ID NO: 10847 - DNA, 20 bp, Artificial Sequence
  chemically synthesized
atctgactgagtttttccca

SEQ ID NO: 10848 - DNA, 20 bp, Artificial Sequence
  chemically synthesized
gaggcactatgggaaaaact

SEQ ID NO: 10849 - DNA, 20 bp, Artificial Sequence
  chemically synthesized
cactatgggaaaaactcagt

SEQ ID NO: 10850 - DNA, 20 bp, Artificial Sequence
  chemically synthesized
agtaaaagctaaatctgact

SEQ ID NO: 10851 - DNA, 20 bp, Artificial Sequence
  chemically synthesized
gggaaaaactcagtcagatt

SEQ ID NO: 10852 - DNA, 20 bp, Artificial Sequence
  chemically synthesized
agtcagatttagcttttact

SEQ ID NO: 10853 - DNA, 20 bp, Artificial Sequence
  chemically synthesized
tcagatttagcttttactca

SEQ ID NO: 10854 - DNA, 20 bp, Artificial Sequence
  chemically synthesized
aaggctaaagctctgagtaa

SEQ ID NO: 10855 - DNA, 20 bp, Artificial Sequence
  chemically synthesized
ttagcttttactcagagctt

SEQ ID NO: 10856 - DNA, 20 bp, Artificial Sequence
  chemically synthesized
agagataaggctaaagctct

SEQ ID NO: 10857 - DNA, 20 bp, Artificial Sequence
  chemically synthesized
atgccacagagataaggcta

SEQ ID NO: 10858 - DNA, 20 bp, Artificial Sequence
  chemically synthesized
tggttgatgccacagagata

SEQ ID NO: 10859 - DNA, 20 bp, Artificial Sequence
  chemically synthesized
gagctttagccttatctctg

SEQ ID NO: 10860 - DNA, 20 bp, Artificial Sequence
  chemically synthesized
ttggttgatgccacagagat

SEQ ID NO: 10861 - DNA, 20 bp, Artificial Sequence
  chemically synthesized
gattcttggttgatgccaca

SEQ ID NO: 10862 - DNA, 20 bp, Artificial Sequence
  chemically synthesized
ctgattcttggttgatgcca

SEQ ID NO: 10863 - DNA, 20 bp, Artificial Sequence
  chemically synthesized
ttatctctgtggcatcaacc

SEQ ID NO: 10864 - DNA, 20 bp, Artificial Sequence
  chemically synthesized
ctgtggcatcaaccaagaat

SEQ ID NO: 10865 - DNA, 20 bp, Artificial Sequence
  chemically synthesized
gtggcatcaaccaagaatca

SEQ ID NO: 10866 - DNA, 20 bp, Artificial Sequence
  chemically synthesized
cattggtgttctctgattct

SEQ ID NO: 10867 - DNA, 20 bp, Artificial Sequence
  chemically synthesized
agaatcagagaacaccaatg

SEQ ID NO: 10868 - DNA, 20 bp, Artificial Sequence
  chemically synthesized
gaatcagagaacaccaatgt

SEQ ID NO: 10869 - DNA, 20 bp, Artificial Sequence
  chemically synthesized
gcactgtatgtatcccacat

SEQ ID NO: 10870 - DNA, 20 bp, Artificial Sequence
  chemically synthesized
acaccaatgtgggatacata

SEQ ID NO: 10871 - DNA, 20 bp, Artificial Sequence
  chemically synthesized
tacatacagtgcctgtgatt

SEQ ID NO: 10872 - DNA, 20 bp, Artificial Sequence
  chemically synthesized
gaacccgttttccaaatcac

SEQ ID NO: 10873 - DNA, 20 bp, Artificial Sequence
  chemically synthesized
agaacccgttttccaaatca

SEQ ID NO: 10874 - DNA, 20 bp, Artificial Sequence
  chemically synthesized
agtgcctgtgatttggaaaa

SEQ ID NO: 10875 - DNA, 20 bp, Artificial Sequence
  chemically synthesized
gtgcctgtgatttggaaaac

SEQ ID NO: 10876 - DNA, 20 bp, Artificial Sequence
  chemically synthesized
tgtcataaatttagaatgtt

SEQ ID NO: 10877 - DNA, 20 bp, Artificial Sequence
  chemically synthesized
gcatggctttgtcataaatt

SEQ ID NO: 10878 - DNA, 20 bp, Artificial Sequence
  chemically synthesized
aacattctaaatttatgaca

SEQ ID NO: 10879 - DNA, 20 bp, Artificial Sequence
  chemically synthesized
atttatgacaaagccatgcc

SEQ ID NO: 10880 - DNA, 20 bp, Artificial Sequence
  chemically synthesized
gccttgattagcaccaggca

SEQ ID NO: 10881 - DNA, 20 bp, Artificial Sequence
  chemically synthesized
aaactgccttgattagcacc

SEQ ID NO: 10882 - DNA, 20 bp, Artificial Sequence
  chemically synthesized
caaactgccttgattagcac

SEQ ID NO: 10883 - DNA, 20 bp, Artificial Sequence
  chemically synthesized
agccatgcctggtgctaatc

SEQ ID NO: 10884 - DNA, 20 bp, Artificial Sequence
  chemically synthesized
gccatgcctggtgctaatca

SEQ ID NO: 10885 - DNA, 20 bp, Artificial Sequence
  chemically synthesized
atgcctggtgctaatcaagg

SEQ ID NO: 10886 - DNA, 20 bp, Artificial Sequence
  chemically synthesized
ctttttcaaactgccttgat

SEQ ID NO: 10887 - DNA, 20 bp, Artificial Sequence
  chemically synthesized
ctaatcaaggcagtttgaaa

SEQ ID NO: 10888 - DNA, 20 bp, Artificial Sequence
  chemically synthesized
taatcaaggcagtttgaaaa

SEQ ID NO: 10889 - DNA, 20 bp, Artificial Sequence
  chemically synthesized
aatcaaggcagtttgaaaaa

SEQ ID NO: 10890 - DNA, 20 bp, Artificial Sequence
  chemically synthesized
atcaaggcagtttgaaaaag

SEQ ID NO: 10891 - DNA, 20 bp, Artificial Sequence
  chemically synthesized
caaggcagtttgaaaaaggg

SEQ ID NO: 10892 - DNA, 20 bp, Artificial Sequence
  chemically synthesized
aaaaaggggagaattttgaa

SEQ ID NO: 10893 - DNA, 20 bp, Artificial Sequence
  chemically synthesized
aggggagaattttgaaaagc

SEQ ID NO: 10894 - DNA, 20 bp, Artificial Sequence
  chemically synthesized
ggagaattttgaaaagcaag

SEQ ID NO: 10895 - DNA, 20 bp, Artificial Sequence
  chemically synthesized
tgaaaagcaagcagaaaaca

SEQ ID NO: 10896 - DNA, 20 bp, Artificial Sequence
  chemically synthesized
gcagaaaacaaagtctttga

SEQ ID NO: 10897 - DNA, 20 bp, Artificial Sequence
  chemically synthesized
cagaaaacaaagtctttgaa

SEQ ID NO: 10898 - DNA, 20 bp, Artificial Sequence
  chemically synthesized
tcgtagagaaaagcctttca

SEQ ID NO: 10899 - DNA, 20 bp, Artificial Sequence
  chemically synthesized
aaacctaatttcgtagagaa

SEQ ID NO: 10900 - DNA, 20 bp, Artificial Sequence
  chemically synthesized
tttacaaacctaatttcgta

SEQ ID NO: 10901 - DNA, 20 bp, Artificial Sequence
  chemically synthesized
aaggcttttctctacgaaat

SEQ ID NO: 10902 - DNA, 20 bp, Artificial Sequence
  chemically synthesized
aggcttttctctacgaaatt

SEQ ID NO: 10903 - DNA, 20 bp, Artificial Sequence
  chemically synthesized
cttttacaaacctaatttcg

SEQ ID NO: 10904 - DNA, 20 bp, Artificial Sequence
  chemically synthesized
ctacgaaattaggtttgtaa

SEQ ID NO: 10905 - DNA, 20 bp, Artificial Sequence
  chemically synthesized
ttaggtttgtaaaagaactt

SEQ ID NO: 10906 - DNA, 20 bp, Artificial Sequence
  chemically synthesized
tgtaaaagaactttagtcaa

SEQ ID NO: 10907 - DNA, 20 bp, Artificial Sequence
  chemically synthesized
catgcatgcacttttgacta

SEQ ID NO: 10908 - DNA, 20 bp, Artificial Sequence
  chemically synthesized
agctgaatttattttaattg

SEQ ID NO: 10909 - DNA, 20 bp, Artificial Sequence
  chemically synthesized
tgctacaattaaaataaatt

SEQ ID NO: 10910 - DNA, 20 bp, Artificial Sequence
  chemically synthesized
attaatgaataaatgaattg

SEQ ID NO: 10911 - DNA, 20 bp, Artificial Sequence
  chemically synthesized
tttctcctggttgttgcaca

SEQ ID NO: 10912 - DNA, 20 bp, Artificial Sequence
  chemically synthesized
tgaatactatgtgcaacaac

SEQ ID NO: 10913 - DNA, 20 bp, Artificial Sequence
  chemically synthesized
gaatactatgtgcaacaacc

SEQ ID NO: 10914 - DNA, 20 bp, Artificial Sequence
  chemically synthesized
atactatgtgcaacaaccag

SEQ ID NO: 10915 - DNA, 20 bp, Artificial Sequence
  chemically synthesized
tgtgcaacaaccaggagaaa

SEQ ID NO: 10916 - DNA, 20 bp, Artificial Sequence
  chemically synthesized
ctttagaattccatttctcc

SEQ ID NO: 10917 - DNA, 20 bp, Artificial Sequence
  chemically synthesized
ccaggagaaatggaattcta

SEQ ID NO: 10918 - DNA, 20 bp, Artificial Sequence
  chemically synthesized
caggagaaatggaattctaa

SEQ ID NO: 10919 - DNA, 20 bp, Artificial Sequence
  chemically synthesized
gagaaatggaattctaaagg

SEQ ID NO: 10920 - DNA, 20 bp, Artificial Sequence
  chemically synthesized
gaaatggaattctaaaggca

SEQ ID NO: 10921 - DNA, 20 bp, Artificial Sequence
  chemically synthesized
aggtatcttatctctgcctt

SEQ ID NO: 10922 - DNA, 20 bp, Artificial Sequence
  chemically synthesized
ggaattctaaaggcagagat

SEQ ID NO: 10923 - DNA, 20 bp, Artificial Sequence
  chemically synthesized
ggcagagataagatacctct

SEQ ID NO: 10924 - DNA, 20 bp, Artificial Sequence
  chemically synthesized
ctgtttgagaagtgtctcag

SEQ ID NO: 10925 - DNA, 20 bp, Artificial Sequence
  chemically synthesized
gctgtttgagaagtgtctca

SEQ ID NO: 10926 - DNA, 20 bp, Artificial Sequence
  chemically synthesized
tggctgtttgagaagtgtct

SEQ ID NO: 10927 - DNA, 20 bp, Artificial Sequence
  chemically synthesized
cctctgagacacttctcaaa

SEQ ID NO: 10928 - DNA, 20 bp, Artificial Sequence
  chemically synthesized
acagaggatggctgtttgag

SEQ ID NO: 10929 - DNA, 20 bp, Artificial Sequence
  chemically synthesized
aaaacagaggatggctgttt

SEQ ID NO: 10930 - DNA, 20 bp, Artificial Sequence
  chemically synthesized
ccccctagaaaaacagagga

SEQ ID NO: 10931 - DNA, 20 bp, Artificial Sequence
  chemically synthesized
acaaccccctagaaaaacag

SEQ ID NO: 10932 - DNA, 20 bp, Artificial Sequence
  chemically synthesized
tacaaccccctagaaaaaca

SEQ ID NO: 10933 - DNA, 20 bp, Artificial Sequence
  chemically synthesized
acagccatcctctgtttttc

SEQ ID NO: 10934 - DNA, 20 bp, Artificial Sequence
  chemically synthesized
cagccatcctctgtttttct

SEQ ID NO: 10935 - DNA, 20 bp, Artificial Sequence
  chemically synthesized
cctacaaccccctagaaaaa

SEQ ID NO: 10936 - DNA, 20 bp, Artificial Sequence
  chemically synthesized
agccatcctctgtttttcta

SEQ ID NO: 10937 - DNA, 20 bp, Artificial Sequence
  chemically synthesized
gccatcctctgtttttctag

SEQ ID NO: 10938 - DNA, 20 bp, Artificial Sequence
  chemically synthesized
ccatcctctgtttttctagg

SEQ ID NO: 10939 - DNA, 20 bp, Artificial Sequence
  chemically synthesized
gacacctccctacaaccccc

SEQ ID NO: 10940 - DNA, 20 bp, Artificial Sequence
  chemically synthesized
tctgtttttctagggggttg

SEQ ID NO: 10941 - DNA, 20 bp, Artificial Sequence
  chemically synthesized
ctgtttttctagggggttgt

SEQ ID NO: 10942 - DNA, 20 bp, Artificial Sequence
  chemically synthesized
tgtttttctagggggttgta

SEQ ID NO: 10943 - DNA, 20 bp, Artificial Sequence
  chemically synthesized
tttttctagggggttgtagg

SEQ ID NO: 10944 - DNA, 20 bp, Artificial Sequence
  chemically synthesized
ttttctagggggttgtaggg

SEQ ID NO: 10945 - DNA, 20 bp, Artificial Sequence
  chemically synthesized
tgtagggaggtgtcatgaat

SEQ ID NO: 10946 - DNA, 20 bp, Artificial Sequence
  chemically synthesized
tcatgaataagaacaattaa

SEQ ID NO: 10947 - DNA, 20 bp, Artificial Sequence
  chemically synthesized
aatggaatttaataaatatc

SEQ ID NO: 10948 - DNA, 20 bp, Artificial Sequence
  chemically synthesized
gaatttaataaatatctagt

SEQ ID NO: 10949 - DNA, 20 bp, Artificial Sequence
  chemically synthesized
aatttaataaatatctagtc

SEQ ID NO: 10950 - DNA, 20 bp, Artificial Sequence
  chemically synthesized
tggagagccccattcctgac

SEQ ID NO: 10951 - DNA, 20 bp, Artificial Sequence
  chemically synthesized
aataaatatctagtcaggaa

SEQ ID NO: 10952 - DNA, 20 bp, Artificial Sequence
  chemically synthesized
ataaatatctagtcaggaat

SEQ ID NO: 10953 - DNA, 20 bp, Artificial Sequence
  chemically synthesized
taaatatctagtcaggaatg

SEQ ID NO: 10954 - DNA, 20 bp, Artificial Sequence
  chemically synthesized
tagtcaggaatggggctctc

SEQ ID NO: 10955 - DNA, 20 bp, Artificial Sequence
  chemically synthesized
agtcaggaatggggctctcc

SEQ ID NO: 10956 - DNA, 20 bp, Artificial Sequence
  chemically synthesized
gcaaaagagagaggcctgga

SEQ ID NO: 10957 - DNA, 20 bp, Artificial Sequence
  chemically synthesized
cagcaaaagagagaggcctg

SEQ ID NO: 10958 - DNA, 20 bp, Artificial Sequence
  chemically synthesized
aacagcaaaagagagaggcc

SEQ ID NO: 10959 - DNA, 20 bp, Artificial Sequence
  chemically synthesized
caaataacagcaaaagagag

SEQ ID NO: 10960 - DNA, 20 bp, Artificial Sequence
  chemically synthesized
ccaaataacagcaaaagaga

SEQ ID NO: 10961 - DNA, 20 bp, Artificial Sequence
  chemically synthesized
ctccaaataacagcaaaaga

SEQ ID NO: 10962 - DNA, 20 bp, Artificial Sequence
  chemically synthesized
atctccaaataacagcaaaa

SEQ ID NO: 10963 - DNA, 20 bp, Artificial Sequence
  chemically synthesized
ttatctccaaataacagcaa

SEQ ID NO: 10964 - DNA, 20 bp, Artificial Sequence
  chemically synthesized
ctctctcttttgctgttatt

SEQ ID NO: 10965 - DNA, 20 bp, Artificial Sequence
  chemically synthesized
ctctcttttgctgttatttg

SEQ ID NO: 10966 - DNA, 20 bp, Artificial Sequence
  chemically synthesized
tgtgatttatctccaaataa

SEQ ID NO: 10967 - DNA, 20 bp, Artificial Sequence
  chemically synthesized
tgttatttggagataaatca

SEQ ID NO: 10968 - DNA, 20 bp, Artificial Sequence
  chemically synthesized
ttggagataaatcacagcta

SEQ ID NO: 10969 - DNA, 20 bp, Artificial Sequence
  chemically synthesized
tggagataaatcacagctaa

SEQ ID NO: 10970 - DNA, 20 bp, Artificial Sequence
  chemically synthesized
atatatattttatgttcctt

SEQ ID NO: 10971 - DNA, 20 bp, Artificial Sequence
  chemically synthesized
acataaaatatatatattaa

SEQ ID NO: 10972 - DNA, 20 bp, Artificial Sequence
  chemically synthesized
atatatattaacagatcaat

SEQ ID NO: 10973 - DNA, 20 bp, Artificial Sequence
  chemically synthesized
gatcaataagtacacatcca

SEQ ID NO: 10974 - DNA, 20 bp, Artificial Sequence
  chemically synthesized
atcaataagtacacatccaa

SEQ ID NO: 10975 - DNA, 20 bp, Artificial Sequence
  chemically synthesized
aagtacacatccaaaggact

SEQ ID NO: 10976 - DNA, 20 bp, Artificial Sequence
  chemically synthesized
tgagattgccccaagtcctt

SEQ ID NO: 10977 - DNA, 20 bp, Artificial Sequence
  chemically synthesized
agtacacatccaaaggactt

SEQ ID NO: 10978 - DNA, 20 bp, Artificial Sequence
  chemically synthesized
gtacacatccaaaggacttg

SEQ ID NO: 10979 - DNA, 20 bp, Artificial Sequence
  chemically synthesized
tttaaaattgagattgcccc

SEQ ID NO: 10980 - DNA, 20 bp, Artificial Sequence
  chemically synthesized
aagaaagtatatttaaaatt

SEQ ID NO: 10981 - DNA, 20 bp, Artificial Sequence
  chemically synthesized
tacttttagagaaaataaga

SEQ ID NO: 10982 - DNA, 20 bp, Artificial Sequence
  chemically synthesized
agcatacttttagagaaaat

SEQ ID NO: 10983 - DNA, 20 bp, Artificial Sequence
  chemically synthesized
tactttcttattttctctaa

SEQ ID NO: 10984 - DNA, 20 bp, Artificial Sequence
  chemically synthesized
caaatacgagcatactttta

SEQ ID NO: 10985 - DNA, 20 bp, Artificial Sequence
  chemically synthesized
gacaaatacgagcatacttt

SEQ ID NO: 10986 - DNA, 20 bp, Artificial Sequence
  chemically synthesized
ctacgcaatctgacaaatac

SEQ ID NO: 10987 - DNA, 20 bp, Artificial Sequence
  chemically synthesized
aaaagtatgctcgtatttgt

SEQ ID NO: 10988 - DNA, 20 bp, Artificial Sequence
  chemically synthesized
ctcgtatttgtcagattgcg

SEQ ID NO: 10989 - DNA, 20 bp, Artificial Sequence
  chemically synthesized
ctatgtcctaagtcagcatt

SEQ ID NO: 10990 - DNA, 20 bp, Artificial Sequence
  chemically synthesized
gctatgtcctaagtcagcat

SEQ ID NO: 10991 - DNA, 20 bp, Artificial Sequence
  chemically synthesized
tgcgtagcccaatgctgact

SEQ ID NO: 10992 - DNA, 20 bp, Artificial Sequence
  chemically synthesized
gcgtagcccaatgctgactt

SEQ ID NO: 10993 - DNA, 20 bp, Artificial Sequence
  chemically synthesized
tagctggctatgtcctaagt

SEQ ID NO: 10994 - DNA, 20 bp, Artificial Sequence
  chemically synthesized
cccaatgctgacttaggaca

SEQ ID NO: 10995 - DNA, 20 bp, Artificial Sequence
  chemically synthesized
tgtctagctggctatgtcct

SEQ ID NO: 10996 - DNA, 20 bp, Artificial Sequence
  chemically synthesized
atgctgacttaggacatagc

SEQ ID NO: 10997 - DNA, 20 bp, Artificial Sequence
  chemically synthesized
tgacttaggacatagccagc

SEQ ID NO: 10998 - DNA, 20 bp, Artificial Sequence
  chemically synthesized
cctctctgtgcatgtctagc

SEQ ID NO: 10999 - DNA, 20 bp, Artificial Sequence
  chemically synthesized
atgccctctctgtgcatgtc

SEQ ID NO: 11000 - DNA, 20 bp, Artificial Sequence
  chemically synthesized
catagccagctagacatgca

SEQ ID NO: 11001 - DNA, 20 bp, Artificial Sequence
  chemically synthesized
tagccagctagacatgcaca

SEQ ID NO: 11002 - DNA, 20 bp, Artificial Sequence
  chemically synthesized
gccagctagacatgcacaga

SEQ ID NO: 11003 - DNA, 20 bp, Artificial Sequence
  chemically synthesized
ccagctagacatgcacagag

SEQ ID NO: 11004 - DNA, 20 bp, Artificial Sequence
  chemically synthesized
cagctagacatgcacagaga

SEQ ID NO: 11005 - DNA, 20 bp, Artificial Sequence
  chemically synthesized
atgcacagagagggcatcta

SEQ ID NO: 11006 - DNA, 20 bp, Artificial Sequence
  chemically synthesized
gagaaaacccaggaattctt

SEQ ID NO: 11007 - DNA, 20 bp, Artificial Sequence
  chemically synthesized
gagggcatctaaagaattcc

SEQ ID NO: 11008 - DNA, 20 bp, Artificial Sequence
  chemically synthesized
agggcatctaaagaattcct

SEQ ID NO: 11009 - DNA, 20 bp, Artificial Sequence
  chemically synthesized
atttcctgttgagaaaaccc

SEQ ID NO: 11010 - DNA, 20 bp, Artificial Sequence
  chemically synthesized
catttcctgttgagaaaacc

SEQ ID NO: 11011 - DNA, 20 bp, Artificial Sequence
  chemically synthesized
gaattcctgggttttctcaa

SEQ ID NO: 11012 - DNA, 20 bp, Artificial Sequence
  chemically synthesized
aattcctgggttttctcaac

SEQ ID NO: 11013 - DNA, 20 bp, Artificial Sequence
  chemically synthesized
ttaatttgccatttcctgtt

SEQ ID NO: 11014 - DNA, 20 bp, Artificial Sequence
  chemically synthesized
tgggttttctcaacaggaaa

SEQ ID NO: 11015 - DNA, 20 bp, Artificial Sequence
  chemically synthesized
caacaggaaatggcaaatta

SEQ ID NO: 11016 - DNA, 20 bp, Artificial Sequence
  chemically synthesized
aacaggaaatggcaaattaa

SEQ ID NO: 11017 - DNA, 20 bp, Artificial Sequence
  chemically synthesized
tggcaaattaaaggctcctt

SEQ ID NO: 11018 - DNA, 20 bp, Artificial Sequence
  chemically synthesized
tgaattcagtgttgcttaag

SEQ ID NO: 11019 - DNA, 20 bp, Artificial Sequence
  chemically synthesized
cttgaattcagtgttgctta

SEQ ID NO: 11020 - DNA, 20 bp, Artificial Sequence
  chemically synthesized
ccttgaattcagtgttgctt

SEQ ID NO: 11021 - DNA, 20 bp, Artificial Sequence
  chemically synthesized
ccttaagcaacactgaattc

SEQ ID NO: 11022 - DNA, 20 bp, Artificial Sequence
  chemically synthesized
cttaagcaacactgaattca

SEQ ID NO: 11023 - DNA, 20 bp, Artificial Sequence
  chemically synthesized
ttaagcaacactgaattcaa

SEQ ID NO: 11024 - DNA, 20 bp, Artificial Sequence
  chemically synthesized
gccttcgctacccttgaatt

SEQ ID NO: 11025 - DNA, 20 bp, Artificial Sequence
  chemically synthesized
agcaacactgaattcaaggg

SEQ ID NO: 11026 - DNA, 20 bp, Artificial Sequence
  chemically synthesized
cactgaattcaagggtagcg

SEQ ID NO: 11027 - DNA, 20 bp, Artificial Sequence
  chemically synthesized
actgaattcaagggtagcga

SEQ ID NO: 11028 - DNA, 20 bp, Artificial Sequence
  chemically synthesized
aagggtagcgaaggcaaatc

SEQ ID NO: 11029 - DNA, 20 bp, Artificial Sequence
  chemically synthesized
agggtagcgaaggcaaatct

SEQ ID NO: 11030 - DNA, 20 bp, Artificial Sequence
  chemically synthesized
gggtagcgaaggcaaatcta

SEQ ID NO: 11031 - DNA, 20 bp, Artificial Sequence
  chemically synthesized
cgcaaggagcttcagagccc

SEQ ID NO: 11032 - DNA, 20 bp, Artificial Sequence
  chemically synthesized
aaggcaaatctagggctctg

SEQ ID NO: 11033 - DNA, 20 bp, Artificial Sequence
  chemically synthesized
gttctgcgcaaggagcttca

SEQ ID NO: 11034 - DNA, 20 bp, Artificial Sequence
  chemically synthesized
cagttctgcgcaaggagctt

SEQ ID NO: 11035 - DNA, 20 bp, Artificial Sequence
  chemically synthesized
gggctctgaagctccttgcg

SEQ ID NO: 11036 - DNA, 20 bp, Artificial Sequence
  chemically synthesized
ttcttgcagttctgcgcaag

SEQ ID NO: 11037 - DNA, 20 bp, Artificial Sequence
  chemically synthesized
tcttcttgcagttctgcgca

SEQ ID NO: 11038 - DNA, 20 bp, Artificial Sequence
  chemically synthesized
gtcttcttgcagttctgcgc

SEQ ID NO: 11039 - DNA, 20 bp, Artificial Sequence
  chemically synthesized
agctccttgcgcagaactgc

SEQ ID NO: 11040 - DNA, 20 bp, Artificial Sequence
  chemically synthesized
tccttgcgcagaactgcaag

SEQ ID NO: 11041 - DNA, 20 bp, Artificial Sequence
  chemically synthesized
tgccctgtcctgtcttcttg

SEQ ID NO: 11042 - DNA, 20 bp, Artificial Sequence
  chemically synthesized
tgcgcagaactgcaagaaga

SEQ ID NO: 11043 - DNA, 20 bp, Artificial Sequence
  chemically synthesized
gcgcagaactgcaagaagac

SEQ ID NO: 11044 - DNA, 20 bp, Artificial Sequence
  chemically synthesized
agaactgcaagaagacagga

SEQ ID NO: 11045 - DNA, 20 bp, Artificial Sequence
  chemically synthesized
gaactgcaagaagacaggac

SEQ ID NO: 11046 - DNA, 20 bp, Artificial Sequence
  chemically synthesized
aactgcaagaagacaggaca

SEQ ID NO: 11047 - DNA, 20 bp, Artificial Sequence
  chemically synthesized
tgcaagaagacaggacaggg

SEQ ID NO: 11048 - DNA, 20 bp, Artificial Sequence
  chemically synthesized
agacaggacagggcagatca

SEQ ID NO: 11049 - DNA, 20 bp, Artificial Sequence
  chemically synthesized
ggcagatcaaagaaaacaca

SEQ ID NO: 11050 - DNA, 20 bp, Artificial Sequence
  chemically synthesized
gcagatcaaagaaaacacac

SEQ ID NO: 11051 - DNA, 20 bp, Artificial Sequence
  chemically synthesized
gaaaacacacgggctgtttt

SEQ ID NO: 11052 - DNA, 20 bp, Artificial Sequence
  chemically synthesized
aaaacacacgggctgttttc

SEQ ID NO: 11053 - DNA, 20 bp, Artificial Sequence
  chemically synthesized
cagagttcccttcctgaaaa

SEQ ID NO: 11054 - DNA, 20 bp, Artificial Sequence
  chemically synthesized
acacacgggctgttttcagg

SEQ ID NO: 11055 - DNA, 20 bp, Artificial Sequence
  chemically synthesized
cacacgggctgttttcagga

SEQ ID NO: 11056 - DNA, 20 bp, Artificial Sequence
  chemically synthesized
acacgggctgttttcaggaa

SEQ ID NO: 11057 - DNA, 20 bp, Artificial Sequence
  chemically synthesized
ttttcaggaagggaactctg

SEQ ID NO: 11058 - DNA, 20 bp, Artificial Sequence
  chemically synthesized
ttcaggaagggaactctgtg

SEQ ID NO: 11059 - DNA, 20 bp, Artificial Sequence
  chemically synthesized
tccaaagaaatgtctccaca

SEQ ID NO: 11060 - DNA, 20 bp, Artificial Sequence
  chemically synthesized
attccaaagaaatgtctcca

SEQ ID NO: 11061 - DNA, 20 bp, Artificial Sequence
  chemically synthesized
actctgtggagacatttctt

SEQ ID NO: 11062 - DNA, 20 bp, Artificial Sequence
  chemically synthesized
ggagacatttctttggaatt

SEQ ID NO: 11063 - DNA, 20 bp, Artificial Sequence
  chemically synthesized
tgaccttctaccaaattcca

SEQ ID NO: 11064 - DNA, 20 bp, Artificial Sequence
  chemically synthesized
gacatttctttggaatttgg

SEQ ID NO: 11065 - DNA, 20 bp, Artificial Sequence
  chemically synthesized
atttctttggaatttggtag

SEQ ID NO: 11066 - DNA, 20 bp, Artificial Sequence
  chemically synthesized
tttctttggaatttggtaga

SEQ ID NO: 11067 - DNA, 20 bp, Artificial Sequence
  chemically synthesized
gaatttggtagaaggtcaaa

SEQ ID NO: 11068 - DNA, 20 bp, Artificial Sequence
  chemically synthesized
aatttggtagaaggtcaaat

SEQ ID NO: 11069 - DNA, 20 bp, Artificial Sequence
  chemically synthesized
aggtcaaataggacaaaatg

SEQ ID NO: 11070 - DNA, 20 bp, Artificial Sequence
  chemically synthesized
ggtcaaataggacaaaatga

SEQ ID NO: 11071 - DNA, 20 bp, Artificial Sequence
  chemically synthesized
gtcaaataggacaaaatgaa

SEQ ID NO: 11072 - DNA, 20 bp, Artificial Sequence
  chemically synthesized
gacaaaatgaagggacaatg

SEQ ID NO: 11073 - DNA, 20 bp, Artificial Sequence
  chemically synthesized
acaaaatgaagggacaatga

SEQ ID NO: 11074 - DNA, 20 bp, Artificial Sequence
  chemically synthesized
aaatgaagggacaatgaagg

SEQ ID NO: 11075 - DNA, 20 bp, Artificial Sequence
  chemically synthesized
cttcacgaaatgatcaggat

SEQ ID NO: 11076 - DNA, 20 bp, Artificial Sequence
  chemically synthesized
ttgaccttcacgaaatgatc

SEQ ID NO: 11077 - DNA, 20 bp, Artificial Sequence
  chemically synthesized
cttgaccttcacgaaatgat

SEQ ID NO: 11078 - DNA, 20 bp, Artificial Sequence
  chemically synthesized
ctcatcctgatcatttcgtg

SEQ ID NO: 11079 - DNA, 20 bp, Artificial Sequence
  chemically synthesized
tcatcctgatcatttcgtga

SEQ ID NO: 11080 - DNA, 20 bp, Artificial Sequence
  chemically synthesized
ctgatcatttcgtgaaggtc

SEQ ID NO: 11081 - DNA, 20 bp, Artificial Sequence
  chemically synthesized
tgatcatttcgtgaaggtca

SEQ ID NO: 11082 - DNA, 20 bp, Artificial Sequence
  chemically synthesized
aggtcaaggtaacttacaca

SEQ ID NO: 11083 - DNA, 20 bp, Artificial Sequence
  chemically synthesized
gttgatgcaaatctttgtgt

SEQ ID NO: 11084 - DNA, 20 bp, Artificial Sequence
  chemically synthesized
acaaagatttgcatcaaccc

SEQ ID NO: 11085 - DNA, 20 bp, Artificial Sequence
  chemically synthesized
aaagatttgcatcaacccca

SEQ ID NO: 11086 - DNA, 20 bp, Artificial Sequence
  chemically synthesized
gctccaaaatgaggactctg

SEQ ID NO: 11087 - DNA, 20 bp, Artificial Sequence
  chemically synthesized
agctccaaaatgaggactct

SEQ ID NO: 11088 - DNA, 20 bp, Artificial Sequence
  chemically synthesized
gagctccaaaatgaggactc

SEQ ID NO: 11089 - DNA, 20 bp, Artificial Sequence
  chemically synthesized
caaccccagagtcctcattt

SEQ ID NO: 11090 - DNA, 20 bp, Artificial Sequence
  chemically synthesized
accccagagtcctcattttg

SEQ ID NO: 11091 - DNA, 20 bp, Artificial Sequence
  chemically synthesized
ctacttagagctccaaaatg

SEQ ID NO: 11092 - DNA, 20 bp, Artificial Sequence
  chemically synthesized
cctacttagagctccaaaat

SEQ ID NO: 11093 - DNA, 20 bp, Artificial Sequence
  chemically synthesized
agtcctcattttggagctct

SEQ ID NO: 11094 - DNA, 20 bp, Artificial Sequence
  chemically synthesized
cctcattttggagctctaag

SEQ ID NO: 11095 - DNA, 20 bp, Artificial Sequence
  chemically synthesized
ctcattttggagctctaagt

SEQ ID NO: 11096 - DNA, 20 bp, Artificial Sequence
  chemically synthesized
cataacaccaggcctactta

SEQ ID NO: 11097 - DNA, 20 bp, Artificial Sequence
  chemically synthesized
aacataacaccaggcctact

SEQ ID NO: 11098 - DNA, 20 bp, Artificial Sequence
  chemically synthesized
tttggagctctaagtaggcc

SEQ ID NO: 11099 - DNA, 20 bp, Artificial Sequence
  chemically synthesized
agaacaaaaaacataacacc

SEQ ID NO: 11100 - DNA, 20 bp, Artificial Sequence
  chemically synthesized
aagaacaaaaaacataacac

SEQ ID NO: 11101 - DNA, 20 bp, Artificial Sequence
  chemically synthesized
tgttatgttttttgttcttt

SEQ ID NO: 11102 - DNA, 20 bp, Artificial Sequence
  chemically synthesized
ttatgttttttgttctttta

SEQ ID NO: 11103 - DNA, 20 bp, Artificial Sequence
  chemically synthesized
tgggatggtttgttctctaa

SEQ ID NO: 11104 - DNA, 20 bp, Artificial Sequence
  chemically synthesized
accattctccaagaatggga

SEQ ID NO: 11105 - DNA, 20 bp, Artificial Sequence
  chemically synthesized
agaacaaaccatcccattct

SEQ ID NO: 11106 - DNA, 20 bp, Artificial Sequence
  chemically synthesized
aacaaaccatcccattcttg

SEQ ID NO: 11107 - DNA, 20 bp, Artificial Sequence
  chemically synthesized
caagaccattctccaagaat

SEQ ID NO: 11108 - DNA, 20 bp, Artificial Sequence
  chemically synthesized
ccaagaccattctccaagaa

SEQ ID NO: 11109 - DNA, 20 bp, Artificial Sequence
  chemically synthesized
accatcccattcttggagaa

SEQ ID NO: 11110 - DNA, 20 bp, Artificial Sequence
  chemically synthesized
gatatccaagaccattctcc

SEQ ID NO: 11111 - DNA, 20 bp, Artificial Sequence
  chemically synthesized
ccattcttggagaatggtct

SEQ ID NO: 11112 - DNA, 20 bp, Artificial Sequence
  chemically synthesized
ctttaccctggaagatatcc

SEQ ID NO: 11113 - DNA, 20 bp, Artificial Sequence
  chemically synthesized
gaatggtcttggatatcttc

SEQ ID NO: 11114 - DNA, 20 bp, Artificial Sequence
  chemically synthesized
aatggtcttggatatcttcc

SEQ ID NO: 11115 - DNA, 20 bp, Artificial Sequence
  chemically synthesized
atggtcttggatatcttcca

SEQ ID NO: 11116 - DNA, 20 bp, Artificial Sequence
  chemically synthesized
cgataaccgctttaccctgg

SEQ ID NO: 11117 - DNA, 20 bp, Artificial Sequence
  chemically synthesized
cttggatatcttccagggta

SEQ ID NO: 11118 - DNA, 20 bp, Artificial Sequence
  chemically synthesized
cagcgataaccgctttaccc

SEQ ID NO: 11119 - DNA, 20 bp, Artificial Sequence
  chemically synthesized
ggatatcttccagggtaaag

SEQ ID NO: 11120 - DNA, 20 bp, Artificial Sequence
  chemically synthesized
agcggttatcgctgtgccac

SEQ ID NO: 11121 - DNA, 20 bp, Artificial Sequence
  chemically synthesized
ctgttcatctacttgtggca

SEQ ID NO: 11122 - DNA, 20 bp, Artificial Sequence
  chemically synthesized
ggttatcgctgtgccacaag

SEQ ID NO: 11123 - DNA, 20 bp, Artificial Sequence
  chemically synthesized
taaacctgttcatctacttg

SEQ ID NO: 11124 - DNA, 20 bp, Artificial Sequence
  chemically synthesized
ctgtgccacaagtagatgaa

SEQ ID NO: 11125 - DNA, 20 bp, Artificial Sequence
  chemically synthesized
tgtgccacaagtagatgaac

SEQ ID NO: 11126 - DNA, 20 bp, Artificial Sequence
  chemically synthesized
gtagatgaacaggtttattc

SEQ ID NO: 11127 - DNA, 20 bp, Artificial Sequence
  chemically synthesized
tagatgaacaggtttattcc

SEQ ID NO: 11128 - DNA, 20 bp, Artificial Sequence
  chemically synthesized
caggtttattccgggacact

SEQ ID NO: 11129 - DNA, 20 bp, Artificial Sequence
  chemically synthesized
tctatgaggactgagtgtcc

SEQ ID NO: 11130 - DNA, 20 bp, Artificial Sequence
  chemically synthesized
agggactatctatgaggact

SEQ ID NO: 11131 - DNA, 20 bp, Artificial Sequence
  chemically synthesized
tccgggacactcagtcctca

SEQ ID NO: 11132 - DNA, 20 bp, Artificial Sequence
  chemically synthesized
ggacactcagtcctcataga

SEQ ID NO: 11133 - DNA, 20 bp, Artificial Sequence
  chemically synthesized
aacttgagggactatctatg

SEQ ID NO: 11134 - DNA, 20 bp, Artificial Sequence
  chemically synthesized
taacttgagggactatctat

SEQ ID NO: 11135 - DNA, 20 bp, Artificial Sequence
  chemically synthesized
gtcctcatagatagtccctc

SEQ ID NO: 11136 - DNA, 20 bp, Artificial Sequence
  chemically synthesized
catagatagtccctcaagtt

SEQ ID NO: 11137 - DNA, 20 bp, Artificial Sequence
  chemically synthesized
cagaatgtgccttaacttga

SEQ ID NO: 11138 - DNA, 20 bp, Artificial Sequence
  chemically synthesized
atagatagtccctcaagtta

SEQ ID NO: 11139 - DNA, 20 bp, Artificial Sequence
  chemically synthesized
ccagaatgtgccttaacttg

SEQ ID NO: 11140 - DNA, 20 bp, Artificial Sequence
  chemically synthesized
cccagaatgtgccttaactt

SEQ ID NO: 11141 - DNA, 20 bp, Artificial Sequence
  chemically synthesized
cctcaagttaaggcacattc

SEQ ID NO: 11142 - DNA, 20 bp, Artificial Sequence
  chemically synthesized
ctcaagttaaggcacattct

SEQ ID NO: 11143 - DNA, 20 bp, Artificial Sequence
  chemically synthesized
tcaagttaaggcacattctg

SEQ ID NO: 11144 - DNA, 20 bp, Artificial Sequence
  chemically synthesized
tagaattgcggcatattccc

SEQ ID NO: 11145 - DNA, 20 bp, Artificial Sequence
  chemically synthesized
atgtcatttacatagaattg

SEQ ID NO: 11146 - DNA, 20 bp, Artificial Sequence
  chemically synthesized
ctctgtgaatgtcatttaca

SEQ ID NO: 11147 - DNA, 20 bp, Artificial Sequence
  chemically synthesized
ttctatgtaaatgacattca

SEQ ID NO: 11148 - DNA, 20 bp, Artificial Sequence
  chemically synthesized
ctatgtaaatgacattcaca

SEQ ID NO: 11149 - DNA, 20 bp, Artificial Sequence
  chemically synthesized
accagataataaagaagagt

SEQ ID NO: 11150 - DNA, 20 bp, Artificial Sequence
  chemically synthesized
ttcaaccagataataaagaa

SEQ ID NO: 11151 - DNA, 20 bp, Artificial Sequence
  chemically synthesized
ccttcaaccagataataaag

SEQ ID NO: 11152 - DNA, 20 bp, Artificial Sequence
  chemically synthesized
acttactcttctttattatc

SEQ ID NO: 11153 - DNA, 20 bp, Artificial Sequence
  chemically synthesized
ctgccttcaaccagataata

SEQ ID NO: 11154 - DNA, 20 bp, Artificial Sequence
  chemically synthesized
tcttctttattatctggttg

SEQ ID NO: 11155 - DNA, 20 bp, Artificial Sequence
  chemically synthesized
cttctttattatctggttga

SEQ ID NO: 11156 - DNA, 20 bp, Artificial Sequence
  chemically synthesized
taggcaactctgccttcaac

SEQ ID NO: 11157 - DNA, 20 bp, Artificial Sequence
  chemically synthesized
ctttattatctggttgaagg

SEQ ID NO: 11158 - DNA, 20 bp, Artificial Sequence
  chemically synthesized
ttattatctggttgaaggca

SEQ ID NO: 11159 - DNA, 20 bp, Artificial Sequence
  chemically synthesized
tgaaggcagagttgcctatt

SEQ ID NO: 11160 - DNA, 20 bp, Artificial Sequence
  chemically synthesized
aaggcagagttgcctattta

SEQ ID NO: 11161 - DNA, 20 bp, Artificial Sequence
  chemically synthesized
agatttttctgactctaaat

SEQ ID NO: 11162 - DNA, 20 bp, Artificial Sequence
  chemically synthesized
cagatttttctgactctaaa

SEQ ID NO: 11163 - DNA, 20 bp, Artificial Sequence
  chemically synthesized
cagagttgcctatttagagt

SEQ ID NO: 11164 - DNA, 20 bp, Artificial Sequence
  chemically synthesized
tatttagagtcagaaaaatc

SEQ ID NO: 11165 - DNA, 20 bp, Artificial Sequence
  chemically synthesized
ggtagaactgaattgaaatc

SEQ ID NO: 11166 - DNA, 20 bp, Artificial Sequence
  chemically synthesized
gaaaaatctggatttcaatt

SEQ ID NO: 11167 - DNA, 20 bp, Artificial Sequence
  chemically synthesized
tttcaattcagttctaccac

SEQ ID NO: 11168 - DNA, 20 bp, Artificial Sequence
  chemically synthesized
atttcccagtcagccagtgg

SEQ ID NO: 11169 - DNA, 20 bp, Artificial Sequence
  chemically synthesized
cagatttcccagtcagccag

SEQ ID NO: 11170 - DNA, 20 bp, Artificial Sequence
  chemically synthesized
cagttctaccactggctgac

SEQ ID NO: 11171 - DNA, 20 bp, Artificial Sequence
  chemically synthesized
agttctaccactggctgact

SEQ ID NO: 11172 - DNA, 20 bp, Artificial Sequence
  chemically synthesized
ccccagatttcccagtcagc

SEQ ID NO: 11173 - DNA, 20 bp, Artificial Sequence
  chemically synthesized
cttgccccagatttcccagt

SEQ ID NO: 11174 - DNA, 20 bp, Artificial Sequence
  chemically synthesized
cactggctgactgggaaatc

SEQ ID NO: 11175 - DNA, 20 bp, Artificial Sequence
  chemically synthesized
acagcttgccccagatttcc

SEQ ID NO: 11176 - DNA, 20 bp, Artificial Sequence
  chemically synthesized
actggctgactgggaaatct

SEQ ID NO: 11177 - DNA, 20 bp, Artificial Sequence
  chemically synthesized
ctggctgactgggaaatctg

SEQ ID NO: 11178 - DNA, 20 bp, Artificial Sequence
  chemically synthesized
ctgactgggaaatctggggc

SEQ ID NO: 11179 - DNA, 20 bp, Artificial Sequence
  chemically synthesized
gaggttcacacagcttgccc

SEQ ID NO: 11180 - DNA, 20 bp, Artificial Sequence
  chemically synthesized
caggttcttagaggttcaca

SEQ ID NO: 11181 - DNA, 20 bp, Artificial Sequence
  chemically synthesized
ggcaagctgtgtgaacctct

SEQ ID NO: 11182 - DNA, 20 bp, Artificial Sequence
  chemically synthesized
aatgagacacaggttcttag

SEQ ID NO: 11183 - DNA, 20 bp, Artificial Sequence
  chemically synthesized
gaatgagacacaggttctta

SEQ ID NO: 11184 - DNA, 20 bp, Artificial Sequence
  chemically synthesized
gtgaatgagacacaggttct

SEQ ID NO: 11185 - DNA, 20 bp, Artificial Sequence
  chemically synthesized
cctttctgtgaatgagacac

SEQ ID NO: 11186 - DNA, 20 bp, Artificial Sequence
  chemically synthesized
gcctttctgtgaatgagaca

SEQ ID NO: 11187 - DNA, 20 bp, Artificial Sequence
  chemically synthesized
aagaacctgtgtctcattca

SEQ ID NO: 11188 - DNA, 20 bp, Artificial Sequence
  chemically synthesized
actgtcgcctttctgtgaat

SEQ ID NO: 11189 - DNA, 20 bp, Artificial Sequence
  chemically synthesized
acctgtgtctcattcacaga

SEQ ID NO: 11190 - DNA, 20 bp, Artificial Sequence
  chemically synthesized
cctgtgtctcattcacagaa

SEQ ID NO: 11191 - DNA, 20 bp, Artificial Sequence
  chemically synthesized
tctcattcacagaaaggcga

SEQ ID NO: 11192 - DNA, 20 bp, Artificial Sequence
  chemically synthesized
aggcgacagtctcttctcca

SEQ ID NO: 11193 - DNA, 20 bp, Artificial Sequence
  chemically synthesized
cttacaaacgctatggagaa

SEQ ID NO: 11194 - DNA, 20 bp, Artificial Sequence
  chemically synthesized
ttcttacaaacgctatggag

SEQ ID NO: 11195 - DNA, 20 bp, Artificial Sequence
  chemically synthesized
atcttcttacaaacgctatg

SEQ ID NO: 11196 - DNA, 20 bp, Artificial Sequence
  chemically synthesized
taatcttcttacaaacgcta

SEQ ID NO: 11197 - DNA, 20 bp, Artificial Sequence
  chemically synthesized
ctcttctccatagcgtttgt

SEQ ID NO: 11198 - DNA, 20 bp, Artificial Sequence
  chemically synthesized
ttctccatagcgtttgtaag

SEQ ID NO: 11199 - DNA, 20 bp, Artificial Sequence
  chemically synthesized
gagtgcacttttacatattt

SEQ ID NO: 11200 - DNA, 20 bp, Artificial Sequence
  chemically synthesized
aaatgatctaaaatatgtaa

SEQ ID NO: 11201 - DNA, 20 bp, Artificial Sequence
  chemically synthesized
atttatcattttatcatttt

SEQ ID NO: 11202 - DNA, 20 bp, Artificial Sequence
  chemically synthesized
ataaaatgataaataaatga

SEQ ID NO: 11203 - DNA, 20 bp, Artificial Sequence
  chemically synthesized
gataaataaatgatagttat

SEQ ID NO: 11204 - DNA, 20 bp, Artificial Sequence
  chemically synthesized
ggtcaaagaatgtttgtaaa

SEQ ID NO: 11205 - DNA, 20 bp, Artificial Sequence
  chemically synthesized
cgggtcaaagaatgtttgta

SEQ ID NO: 11206 - DNA, 20 bp, Artificial Sequence
  chemically synthesized
tttacaaacattctttgacc

SEQ ID NO: 11207 - DNA, 20 bp, Artificial Sequence
  chemically synthesized
ttacaaacattctttgaccc

SEQ ID NO: 11208 - DNA, 20 bp, Artificial Sequence
  chemically synthesized
gtaccattgcacccgggtca

SEQ ID NO: 11209 - DNA, 20 bp, Artificial Sequence
  chemically synthesized
ttctccgtaccattgcaccc

SEQ ID NO: 11210 - DNA, 20 bp, Artificial Sequence
  chemically synthesized
attctttgacccgggtgcaa

SEQ ID NO: 11211 - DNA, 20 bp, Artificial Sequence
  chemically synthesized
tttctccgtaccattgcacc

SEQ ID NO: 11212 - DNA, 20 bp, Artificial Sequence
  chemically synthesized
ttgacccgggtgcaatggta

SEQ ID NO: 11213 - DNA, 20 bp, Artificial Sequence
  chemically synthesized
gacccgggtgcaatggtacg

SEQ ID NO: 11214 - DNA, 20 bp, Artificial Sequence
  chemically synthesized
cgggtgcaatggtacggaga

SEQ ID NO: 11215 - DNA, 20 bp, Artificial Sequence
  chemically synthesized
tgcctcgtttgtggttagca

SEQ ID NO: 11216 - DNA, 20 bp, Artificial Sequence
  chemically synthesized
agccctgcctcgtttgtggt

SEQ ID NO: 11217 - DNA, 20 bp, Artificial Sequence
  chemically synthesized
agactatgctaaccacaaac

SEQ ID NO: 11218 - DNA, 20 bp, Artificial Sequence
  chemically synthesized
gactatgctaaccacaaacg

SEQ ID NO: 11219 - DNA, 20 bp, Artificial Sequence
  chemically synthesized
caagagccctgcctcgtttg

SEQ ID NO: 11220 - DNA, 20 bp, Artificial Sequence
  chemically synthesized
tatgctaaccacaaacgagg

SEQ ID NO: 11221 - DNA, 20 bp, Artificial Sequence
  chemically synthesized
atgctaaccacaaacgaggc

SEQ ID NO: 11222 - DNA, 20 bp, Artificial Sequence
  chemically synthesized
tgctaaccacaaacgaggca

SEQ ID NO: 11223 - DNA, 20 bp, Artificial Sequence
  chemically synthesized
cttttgagctcattggtcaa

SEQ ID NO: 11224 - DNA, 20 bp, Artificial Sequence
  chemically synthesized
aggcagggctcttgaccaat

SEQ ID NO: 11225 - DNA, 20 bp, Artificial Sequence
  chemically synthesized
atcttttgagctcattggtc

SEQ ID NO: 11226 - DNA, 20 bp, Artificial Sequence
  chemically synthesized
aatatatcttttgagctcat

SEQ ID NO: 11227 - DNA, 20 bp, Artificial Sequence
  chemically synthesized
ctcttgaccaatgagctcaa

SEQ ID NO: 11228 - DNA, 20 bp, Artificial Sequence
  chemically synthesized
gatcgtgtaatatatctttt

SEQ ID NO: 11229 - DNA, 20 bp, Artificial Sequence
  chemically synthesized
aaggagtaaatatatttttg

SEQ ID NO: 11230 - DNA, 20 bp, Artificial Sequence
  chemically synthesized
tcaaaaatatatttactcct

SEQ ID NO: 11231 - DNA, 20 bp, Artificial Sequence
  chemically synthesized
tagaatttgatgttaccaag

SEQ ID NO: 11232 - DNA, 20 bp, Artificial Sequence
  chemically synthesized
aatagaatttgatgttacca

SEQ ID NO: 11233 - DNA, 20 bp, Artificial Sequence
  chemically synthesized
aaatagaatttgatgttacc

SEQ ID NO: 11234 - DNA, 20 bp, Artificial Sequence
  chemically synthesized
gtaacatcaaattctattta

SEQ ID NO: 11235 - DNA, 20 bp, Artificial Sequence
  chemically synthesized
gttggaactgacactgtaaa

SEQ ID NO: 11236 - DNA, 20 bp, Artificial Sequence
  chemically synthesized
tcaaattctatttacagtgt

SEQ ID NO: 11237 - DNA, 20 bp, Artificial Sequence
  chemically synthesized
gtcaaatcggaataaaaagt

SEQ ID NO: 11238 - DNA, 20 bp, Artificial Sequence
  chemically synthesized
caaagtcaaatcggaataaa

SEQ ID NO: 11239 - DNA, 20 bp, Artificial Sequence
  chemically synthesized
tgtaggggtcaaagtcaaat

SEQ ID NO: 11240 - DNA, 20 bp, Artificial Sequence
  chemically synthesized
tgtaattattgtaggggtca

SEQ ID NO: 11241 - DNA, 20 bp, Artificial Sequence
  chemically synthesized
taaatctgtaattattgtag

SEQ ID NO: 11242 - DNA, 20 bp, Artificial Sequence
  chemically synthesized
ttaaatctgtaattattgta

SEQ ID NO: 11243 - DNA, 20 bp, Artificial Sequence
  chemically synthesized
gttaaatctgtaattattgt

SEQ ID NO: 11244 - DNA, 20 bp, Artificial Sequence
  chemically synthesized
tgttaaatctgtaattattg

SEQ ID NO: 11245 - DNA, 20 bp, Artificial Sequence
  chemically synthesized
tttgacccctacaataatta

SEQ ID NO: 11246 - DNA, 20 bp, Artificial Sequence
  chemically synthesized
aattacagatttaacataaa

SEQ ID NO: 11247 - DNA, 20 bp, Artificial Sequence
  chemically synthesized
tctactttattgagaataat

SEQ ID NO: 11248 - DNA, 20 bp, Artificial Sequence
  chemically synthesized
attactgattattctcaata

SEQ ID NO: 11249 - DNA, 20 bp, Artificial Sequence
  chemically synthesized
actgattattctcaataaag

SEQ ID NO: 11250 - DNA, 20 bp, Artificial Sequence
  chemically synthesized
gaaaacatttctactttatt

SEQ ID NO: 11251 - DNA, 20 bp, Artificial Sequence
  chemically synthesized
tagaaatgttttctctacca

SEQ ID NO: 11252 - DNA, 20 bp, Artificial Sequence
  chemically synthesized
tgtcagtgaagaccatggta

SEQ ID NO: 11253 - DNA, 20 bp, Artificial Sequence
  chemically synthesized
tttgtcagtgaagaccatgg

SEQ ID NO: 11254 - DNA, 20 bp, Artificial Sequence
  chemically synthesized
tcatttgtcagtgaagacca

SEQ ID NO: 11255 - DNA, 20 bp, Artificial Sequence
  chemically synthesized
tttgagatcatttgtcagtg

SEQ ID NO: 11256 - DNA, 20 bp, Artificial Sequence
  chemically synthesized
gtacttttgagatcatttgt

SEQ ID NO: 11257 - DNA, 20 bp, Artificial Sequence
  chemically synthesized
tcactgacaaatgatctcaa

SEQ ID NO: 11258 - DNA, 20 bp, Artificial Sequence
  chemically synthesized
gacaaatgatctcaaaagta

SEQ ID NO: 11259 - DNA, 20 bp, Artificial Sequence
  chemically synthesized
ttatttttggccgtactttt

SEQ ID NO: 11260 - DNA, 20 bp, Artificial Sequence
  chemically synthesized
caaaagtacggccaaaaata

SEQ ID NO: 11261 - DNA, 20 bp, Artificial Sequence
  chemically synthesized
tttaatgatagctttatttt

SEQ ID NO: 11262 - DNA, 20 bp, Artificial Sequence
  chemically synthesized
tttttttgttgttttaatga

SEQ ID NO: 11263 - DNA, 20 bp, Artificial Sequence
  chemically synthesized
tatcattaaaacaacaaaaa

SEQ ID NO: 11264 - DNA, 20 bp, Artificial Sequence
  chemically synthesized
aaaagttcaatattatctcg

SEQ ID NO: 11265 - DNA, 20 bp, Artificial Sequence
  chemically synthesized
gttcaatattatctcgtgga

SEQ ID NO: 11266 - DNA, 20 bp, Artificial Sequence
  chemically synthesized
atcacatgagtaccatccac

SEQ ID NO: 11267 - DNA, 20 bp, Artificial Sequence
  chemically synthesized
atacagcaagaacatcacat

SEQ ID NO: 11268 - DNA, 20 bp, Artificial Sequence
  chemically synthesized
taaaaacctgaaaatacagc

SEQ ID NO: 11269 - DNA, 20 bp, Artificial Sequence
  chemically synthesized
tgatgttcttgctgtatttt

SEQ ID NO: 11270 - DNA, 20 bp, Artificial Sequence
  chemically synthesized
gatgttcttgctgtattttc

SEQ ID NO: 11271 - DNA, 20 bp, Artificial Sequence
  chemically synthesized
ttgctaaaaacctgaaaata

SEQ ID NO: 11272 - DNA, 20 bp, Artificial Sequence
  chemically synthesized
ttgctgtattttcaggtttt

SEQ ID NO: 11273 - DNA, 20 bp, Artificial Sequence
  chemically synthesized
gtttttagcaaacatttcct

SEQ ID NO: 11274 - DNA, 20 bp, Artificial Sequence
  chemically synthesized
tttagcaaacatttcctgag

SEQ ID NO: 11275 - DNA, 20 bp, Artificial Sequence
  chemically synthesized
tgaatatttaatggctactc

SEQ ID NO: 11276 - DNA, 20 bp, Artificial Sequence
  chemically synthesized
ttgaatatttaatggctact

SEQ ID NO: 11277 - DNA, 20 bp, Artificial Sequence
  chemically synthesized
agcatggtttgaatatttaa

SEQ ID NO: 11278 - DNA, 20 bp, Artificial Sequence
  chemically synthesized
ttaaatattcaaaccatgct

SEQ ID NO: 11279 - DNA, 20 bp, Artificial Sequence
  chemically synthesized
atcctccagagtacttagca

SEQ ID NO: 11280 - DNA, 20 bp, Artificial Sequence
  chemically synthesized
tcaaaccatgctaagtactc

SEQ ID NO: 11281 - DNA, 20 bp, Artificial Sequence
  chemically synthesized
ttcatatcctccagagtact

SEQ ID NO: 11282 - DNA, 20 bp, Artificial Sequence
  chemically synthesized
aaaccatgctaagtactctg

SEQ ID NO: 11283 - DNA, 20 bp, Artificial Sequence
  chemically synthesized
aaccatgctaagtactctgg

SEQ ID NO: 11284 - DNA, 20 bp, Artificial Sequence
  chemically synthesized
aatcatcttcatatcctcca

SEQ ID NO: 11285 - DNA, 20 bp, Artificial Sequence
  chemically synthesized
ttaatcatcttcatatcctc

SEQ ID NO: 11286 - DNA, 20 bp, Artificial Sequence
  chemically synthesized
taagtactctggaggatatg

SEQ ID NO: 11287 - DNA, 20 bp, Artificial Sequence
  chemically synthesized
tggaggatatgaagatgatt

SEQ ID NO: 11288 - DNA, 20 bp, Artificial Sequence
  chemically synthesized
atatgaagatgattaagata

SEQ ID NO: 11289 - DNA, 20 bp, Artificial Sequence
  chemically synthesized
aagatacagtccatgcccca

SEQ ID NO: 11290 - DNA, 20 bp, Artificial Sequence
  chemically synthesized
tagtgtgtgtctttggggca

SEQ ID NO: 11291 - DNA, 20 bp, Artificial Sequence
  chemically synthesized
tgagctagtgtgtgtctttg

SEQ ID NO: 11292 - DNA, 20 bp, Artificial Sequence
  chemically synthesized
atgagctagtgtgtgtcttt

SEQ ID NO: 11293 - DNA, 20 bp, Artificial Sequence
  chemically synthesized
aatgagctagtgtgtgtctt

SEQ ID NO: 11294 - DNA, 20 bp, Artificial Sequence
  chemically synthesized
catgccccaaagacacacac

SEQ ID NO: 11295 - DNA, 20 bp, Artificial Sequence
  chemically synthesized
agtgcctctctttaatgagc

SEQ ID NO: 11296 - DNA, 20 bp, Artificial Sequence
  chemically synthesized
agacacacactagctcatta

SEQ ID NO: 11297 - DNA, 20 bp, Artificial Sequence
  chemically synthesized
acacacactagctcattaaa

SEQ ID NO: 11298 - DNA, 20 bp, Artificial Sequence
  chemically synthesized
taccagtgcctctctttaat

SEQ ID NO: 11299 - DNA, 20 bp, Artificial Sequence
  chemically synthesized
acacactagctcattaaaga

SEQ ID NO: 11300 - DNA, 20 bp, Artificial Sequence
  chemically synthesized
cacactagctcattaaagag

SEQ ID NO: 11301 - DNA, 20 bp, Artificial Sequence
  chemically synthesized
agctcattaaagagaggcac

SEQ ID NO: 11302 - DNA, 20 bp, Artificial Sequence
  chemically synthesized
tcctttttatcagttattac

SEQ ID NO: 11303 - DNA, 20 bp, Artificial Sequence
  chemically synthesized
cactggtaataactgataaa

SEQ ID NO: 11304 - DNA, 20 bp, Artificial Sequence
  chemically synthesized
actggtaataactgataaaa

SEQ ID NO: 11305 - DNA, 20 bp, Artificial Sequence
  chemically synthesized
ttgacagttttcctttttat

SEQ ID NO: 11306 - DNA, 20 bp, Artificial Sequence
  chemically synthesized
tgataaaaaggaaaactgtc

SEQ ID NO: 11307 - DNA, 20 bp, Artificial Sequence
  chemically synthesized
gataaaaaggaaaactgtca

SEQ ID NO: 11308 - DNA, 20 bp, Artificial Sequence
  chemically synthesized
tttctcagaaaattccttga

SEQ ID NO: 11309 - DNA, 20 bp, Artificial Sequence
  chemically synthesized
aaactgtcaaggaattttct

SEQ ID NO: 11310 - DNA, 20 bp, Artificial Sequence
  chemically synthesized
tgtcaaggaattttctgaga

SEQ ID NO: 11311 - DNA, 20 bp, Artificial Sequence
  chemically synthesized
gtcaaggaattttctgagaa

SEQ ID NO: 11312 - DNA, 20 bp, Artificial Sequence
  chemically synthesized
agagcactttggacctttct

SEQ ID NO: 11313 - DNA, 20 bp, Artificial Sequence
  chemically synthesized
aattttctgagaaaggtcca

SEQ ID NO: 11314 - DNA, 20 bp, Artificial Sequence
  chemically synthesized
cctctattcccagagcactt

SEQ ID NO: 11315 - DNA, 20 bp, Artificial Sequence
  chemically synthesized
gagaaaggtccaaagtgctc

SEQ ID NO: 11316 - DNA, 20 bp, Artificial Sequence
  chemically synthesized
agaaaggtccaaagtgctct

SEQ ID NO: 11317 - DNA, 20 bp, Artificial Sequence
  chemically synthesized
ggtccaaagtgctctgggaa

SEQ ID NO: 11318 - DNA, 20 bp, Artificial Sequence
  chemically synthesized
gtcttttgcctctattccca

SEQ ID NO: 11319 - DNA, 20 bp, Artificial Sequence
  chemically synthesized
tccaaagtgctctgggaata

SEQ ID NO: 11320 - DNA, 20 bp, Artificial Sequence
  chemically synthesized
ccaaagtgctctgggaatag

SEQ ID NO: 11321 - DNA, 20 bp, Artificial Sequence
  chemically synthesized
ctgtcttttgcctctattcc

SEQ ID NO: 11322 - DNA, 20 bp, Artificial Sequence
  chemically synthesized
tgctctgggaatagaggcaa

SEQ ID NO: 11323 - DNA, 20 bp, Artificial Sequence
  chemically synthesized
ctgggaatagaggcaaaaga

SEQ ID NO: 11324 - DNA, 20 bp, Artificial Sequence
  chemically synthesized
agacagatttcttccaactg

SEQ ID NO: 11325 - DNA, 20 bp, Artificial Sequence
  chemically synthesized
tgctagatccctgcagttgg

SEQ ID NO: 11326 - DNA, 20 bp, Artificial Sequence
  chemically synthesized
gacagatttcttccaactgc

SEQ ID NO: 11327 - DNA, 20 bp, Artificial Sequence
  chemically synthesized
acagatttcttccaactgca

SEQ ID NO: 11328 - DNA, 20 bp, Artificial Sequence
  chemically synthesized
ccctgctagatccctgcagt

SEQ ID NO: 11329 - DNA, 20 bp, Artificial Sequence
  chemically synthesized
ggagccctgctagatccctg

SEQ ID NO: 11330 - DNA, 20 bp, Artificial Sequence
  chemically synthesized
ttcttccaactgcagggatc

SEQ ID NO: 11331 - DNA, 20 bp, Artificial Sequence
  chemically synthesized
ttccaactgcagggatctag

SEQ ID NO: 11332 - DNA, 20 bp, Artificial Sequence
  chemically synthesized
tccaactgcagggatctagc

SEQ ID NO: 11333 - DNA, 20 bp, Artificial Sequence
  chemically synthesized
ccaactgcagggatctagca

SEQ ID NO: 11334 - DNA, 20 bp, Artificial Sequence
  chemically synthesized
ctttccccatggagccctgc

SEQ ID NO: 11335 - DNA, 20 bp, Artificial Sequence
  chemically synthesized
agggatctagcagggctcca

SEQ ID NO: 11336 - DNA, 20 bp, Artificial Sequence
  chemically synthesized
gggatctagcagggctccat

SEQ ID NO: 11337 - DNA, 20 bp, Artificial Sequence
  chemically synthesized
ggatctagcagggctccatg

SEQ ID NO: 11338 - DNA, 20 bp, Artificial Sequence
  chemically synthesized
tcaaaataactttccccatg

SEQ ID NO: 11339 - DNA, 20 bp, Artificial Sequence
  chemically synthesized
ctagcagggctccatgggga

SEQ ID NO: 11340 - DNA, 20 bp, Artificial Sequence
  chemically synthesized
gctcaaaataactttcccca

SEQ ID NO: 11341 - DNA, 20 bp, Artificial Sequence
  chemically synthesized
tccatggggaaagttatttt

SEQ ID NO: 11342 - DNA, 20 bp, Artificial Sequence
  chemically synthesized
atggggaaagttattttgag

SEQ ID NO: 11343 - DNA, 20 bp, Artificial Sequence
  chemically synthesized
agttattttgagcagtgtga

SEQ ID NO: 11344 - DNA, 20 bp, Artificial Sequence
  chemically synthesized
ttattttgagcagtgtgatg

SEQ ID NO: 11345 - DNA, 20 bp, Artificial Sequence
  chemically synthesized
tattttgagcagtgtgatgg

SEQ ID NO: 11346 - DNA, 20 bp, Artificial Sequence
  chemically synthesized
ttgagcagtgtgatggagga

SEQ ID NO: 11347 - DNA, 20 bp, Artificial Sequence
  chemically synthesized
tgagcagtgtgatggaggat

SEQ ID NO: 11348 - DNA, 20 bp, Artificial Sequence
  chemically synthesized
gcagtgtgatggaggatagg

SEQ ID NO: 11349 - DNA, 20 bp, Artificial Sequence
  chemically synthesized
cagtgtgatggaggataggt

SEQ ID NO: 11350 - DNA, 20 bp, Artificial Sequence
  chemically synthesized
gataggtgggattcctttgt

SEQ ID NO: 11351 - DNA, 20 bp, Artificial Sequence
  chemically synthesized
accactgccgtatctgacaa

SEQ ID NO: 11352 - DNA, 20 bp, Artificial Sequence
  chemically synthesized
caccactgccgtatctgaca

SEQ ID NO: 11353 - DNA, 20 bp, Artificial Sequence
  chemically synthesized
tgggattcctttgtcagata

SEQ ID NO: 11354 - DNA, 20 bp, Artificial Sequence
  chemically synthesized
gattcctttgtcagatacgg

SEQ ID NO: 11355 - DNA, 20 bp, Artificial Sequence
  chemically synthesized
tcctttgtcagatacggcag

SEQ ID NO: 11356 - DNA, 20 bp, Artificial Sequence
  chemically synthesized
tttgtcagatacggcagtgg

SEQ ID NO: 11357 - DNA, 20 bp, Artificial Sequence
  chemically synthesized
ttgtcagatacggcagtggt

SEQ ID NO: 11358 - DNA, 20 bp, Artificial Sequence
  chemically synthesized
cagatacggcagtggtgggt

SEQ ID NO: 11359 - DNA, 20 bp, Artificial Sequence
  chemically synthesized
gatacggcagtggtgggtta

SEQ ID NO: 11360 - DNA, 20 bp, Artificial Sequence
  chemically synthesized
atacggcagtggtgggttag

SEQ ID NO: 11361 - DNA, 20 bp, Artificial Sequence
  chemically synthesized
ggcagtggtgggttagaggt

SEQ ID NO: 11362 - DNA, 20 bp, Artificial Sequence
  chemically synthesized
agtggtgggttagaggttag

SEQ ID NO: 11363 - DNA, 20 bp, Artificial Sequence
  chemically synthesized
gtgggttagaggttagcagt

SEQ ID NO: 11364 - DNA, 20 bp, Artificial Sequence
  chemically synthesized
tgggttagaggttagcagtt

SEQ ID NO: 11365 - DNA, 20 bp, Artificial Sequence
  chemically synthesized
tagaggttagcagttaggct

SEQ ID NO: 11366 - DNA, 20 bp, Artificial Sequence
  chemically synthesized
tagcagttaggctgagactc

SEQ ID NO: 11367 - DNA, 20 bp, Artificial Sequence
  chemically synthesized
tcaagctcaagcttgagtct

SEQ ID NO: 11368 - DNA, 20 bp, Artificial Sequence
  chemically synthesized
ttaggctgagactcaagctt

SEQ ID NO: 11369 - DNA, 20 bp, Artificial Sequence
  chemically synthesized
ttggggtcaagctcaagctt

SEQ ID NO: 11370 - DNA, 20 bp, Artificial Sequence
  chemically synthesized
ctacctttggggtcaagctc

SEQ ID NO: 11371 - DNA, 20 bp, Artificial Sequence
  chemically synthesized
caagcttgagcttgacccca

SEQ ID NO: 11372 - DNA, 20 bp, Artificial Sequence
  chemically synthesized
tctcatctacctttggggtc

SEQ ID NO: 11373 - DNA, 20 bp, Artificial Sequence
  chemically synthesized
aagcttgagcttgaccccaa

SEQ ID NO: 11374 - DNA, 20 bp, Artificial Sequence
  chemically synthesized
cttgagcttgaccccaaagg

SEQ ID NO: 11375 - DNA, 20 bp, Artificial Sequence
  chemically synthesized
cctgctctcatctacctttg

SEQ ID NO: 11376 - DNA, 20 bp, Artificial Sequence
  chemically synthesized
tcctgctctcatctaccttt

SEQ ID NO: 11377 - DNA, 20 bp, Artificial Sequence
  chemically synthesized
atcctgctctcatctacctt

SEQ ID NO: 11378 - DNA, 20 bp, Artificial Sequence
  chemically synthesized
gcttgaccccaaaggtagat

SEQ ID NO: 11379 - DNA, 20 bp, Artificial Sequence
  chemically synthesized
ttgaccccaaaggtagatga

SEQ ID NO: 11380 - DNA, 20 bp, Artificial Sequence
  chemically synthesized
accccaaaggtagatgagag

SEQ ID NO: 11381 - DNA, 20 bp, Artificial Sequence
  chemically synthesized
ccccaaaggtagatgagagc

SEQ ID NO: 11382 - DNA, 20 bp, Artificial Sequence
  chemically synthesized
agatgagagcaggatgtatt

SEQ ID NO: 11383 - DNA, 20 bp, Artificial Sequence
  chemically synthesized
caggatgtattcagaaatac

SEQ ID NO: 11384 - DNA, 20 bp, Artificial Sequence
  chemically synthesized
ttcagaaatactagctacaa

SEQ ID NO: 11385 - DNA, 20 bp, Artificial Sequence
  chemically synthesized
tctggctatgctgttgtagc

SEQ ID NO: 11386 - DNA, 20 bp, Artificial Sequence
  chemically synthesized
gtgttctggctatgctgttg

SEQ ID NO: 11387 - DNA, 20 bp, Artificial Sequence
  chemically synthesized
aaatactagctacaacagca

SEQ ID NO: 11388 - DNA, 20 bp, Artificial Sequence
  chemically synthesized
actagctacaacagcatagc

SEQ ID NO: 11389 - DNA, 20 bp, Artificial Sequence
  chemically synthesized
acaacagcatagccagaaca

SEQ ID NO: 11390 - DNA, 20 bp, Artificial Sequence
  chemically synthesized
caacagcatagccagaacac

SEQ ID NO: 11391 - DNA, 20 bp, Artificial Sequence
  chemically synthesized
aacagcatagccagaacaca

SEQ ID NO: 11392 - DNA, 20 bp, Artificial Sequence
  chemically synthesized
cttttgttctccctgtgttc

SEQ ID NO: 11393 - DNA, 20 bp, Artificial Sequence
  chemically synthesized
cagcatagccagaacacagg

SEQ ID NO: 11394 - DNA, 20 bp, Artificial Sequence
  chemically synthesized
ccagaacacagggagaacaa

SEQ ID NO: 11395 - DNA, 20 bp, Artificial Sequence
  chemically synthesized
gaacacagggagaacaaaag

SEQ ID NO: 11396 - DNA, 20 bp, Artificial Sequence
  chemically synthesized
acagggagaacaaaagaaga

SEQ ID NO: 11397 - DNA, 20 bp, Artificial Sequence
  chemically synthesized
gagaacaaaagaagatggca

SEQ ID NO: 11398 - DNA, 20 bp, Artificial Sequence
  chemically synthesized
aaaagaagatggcatagaaa

SEQ ID NO: 11399 - DNA, 20 bp, Artificial Sequence
  chemically synthesized
gaagatggcatagaaaaagc

SEQ ID NO: 11400 - DNA, 20 bp, Artificial Sequence
  chemically synthesized
tggcatagaaaaagcaagtc

SEQ ID NO: 11401 - DNA, 20 bp, Artificial Sequence
  chemically synthesized
gcatagaaaaagcaagtcaa

SEQ ID NO: 11402 - DNA, 20 bp, Artificial Sequence
  chemically synthesized
agcaagtcaagagaatattg

SEQ ID NO: 11403 - DNA, 20 bp, Artificial Sequence
  chemically synthesized
aagtcaagagaatattgtgg

SEQ ID NO: 11404 - DNA, 20 bp, Artificial Sequence
  chemically synthesized
agtcaagagaatattgtgga

SEQ ID NO: 11405 - DNA, 20 bp, Artificial Sequence
  chemically synthesized
gtcaagagaatattgtggaa

SEQ ID NO: 11406 - DNA, 20 bp, Artificial Sequence
  chemically synthesized
aagggtttgaacgccccact

SEQ ID NO: 11407 - DNA, 20 bp, Artificial Sequence
  chemically synthesized
ggtttgaacgccccactaag

SEQ ID NO: 11408 - DNA, 20 bp, Artificial Sequence
  chemically synthesized
aaaaatcaagcttcttagtg

SEQ ID NO: 11409 - DNA, 20 bp, Artificial Sequence
  chemically synthesized
aaaaaatcaagcttcttagt

SEQ ID NO: 11410 - DNA, 20 bp, Artificial Sequence
  chemically synthesized
aaaaaaatcaagcttcttag

SEQ ID NO: 11411 - DNA, 20 bp, Artificial Sequence
  chemically synthesized
tagaaaaaaatcaagcttct

SEQ ID NO: 11412 - DNA, 20 bp, Artificial Sequence
  chemically synthesized
tctgcatgtagaaaaaaatc

SEQ ID NO: 11413 - DNA, 20 bp, Artificial Sequence
  chemically synthesized
gcttgatttttttctacatg

SEQ ID NO: 11414 - DNA, 20 bp, Artificial Sequence
  chemically synthesized
tttcactggatttctgcatg

SEQ ID NO: 11415 - DNA, 20 bp, Artificial Sequence
  chemically synthesized
tttttctacatgcagaaatc

SEQ ID NO: 11416 - DNA, 20 bp, Artificial Sequence
  chemically synthesized
tacatgcagaaatccagtga

SEQ ID NO: 11417 - DNA, 20 bp, Artificial Sequence
  chemically synthesized
acatgcagaaatccagtgaa

SEQ ID NO: 11418 - DNA, 20 bp, Artificial Sequence
  chemically synthesized
catgcagaaatccagtgaaa

SEQ ID NO: 11419 - DNA, 20 bp, Artificial Sequence
  chemically synthesized
atgcagaaatccagtgaaag

SEQ ID NO: 11420 - DNA, 20 bp, Artificial Sequence
  chemically synthesized
tcatggcattcccctttcac

SEQ ID NO: 11421 - DNA, 20 bp, Artificial Sequence
  chemically synthesized
gtgaaaggggaatgccatga

SEQ ID NO: 11422 - DNA, 20 bp, Artificial Sequence
  chemically synthesized
tgaaaggggaatgccatgat

SEQ ID NO: 11423 - DNA, 20 bp, Artificial Sequence
  chemically synthesized
gccagaaccaagacccatca

SEQ ID NO: 11424 - DNA, 20 bp, Artificial Sequence
  chemically synthesized
gggaatgccatgatgggtct

SEQ ID NO: 11425 - DNA, 20 bp, Artificial Sequence
  chemically synthesized
gccatgatgggtcttggttc

SEQ ID NO: 11426 - DNA, 20 bp, Artificial Sequence
  chemically synthesized
ttgtacatcttgccagaacc

SEQ ID NO: 11427 - DNA, 20 bp, Artificial Sequence
  chemically synthesized
tgatgggtcttggttctggc

SEQ ID NO: 11428 - DNA, 20 bp, Artificial Sequence
  chemically synthesized
actctacttgtacatcttgc

SEQ ID NO: 11429 - DNA, 20 bp, Artificial Sequence
  chemically synthesized
ttggttctggcaagatgtac

SEQ ID NO: 11430 - DNA, 20 bp, Artificial Sequence
  chemically synthesized
gttctggcaagatgtacaag

SEQ ID NO: 11431 - DNA, 20 bp, Artificial Sequence
  chemically synthesized
tctggcaagatgtacaagta

SEQ ID NO: 11432 - DNA, 20 bp, Artificial Sequence
  chemically synthesized
gcaagatgtacaagtagagt

SEQ ID NO: 11433 - DNA, 20 bp, Artificial Sequence
  chemically synthesized
atgtacaagtagagtcagta

SEQ ID NO: 11434 - DNA, 20 bp, Artificial Sequence
  chemically synthesized
gtacaagtagagtcagtatg

SEQ ID NO: 11435 - DNA, 20 bp, Artificial Sequence
  chemically synthesized
tacaagtagagtcagtatgg

SEQ ID NO: 11436 - DNA, 20 bp, Artificial Sequence
  chemically synthesized
cagtatggaggatttattgc

SEQ ID NO: 11437 - DNA, 20 bp, Artificial Sequence
  chemically synthesized
agtatggaggatttattgca

SEQ ID NO: 11438 - DNA, 20 bp, Artificial Sequence
  chemically synthesized
gtatggaggatttattgcaa

SEQ ID NO: 11439 - DNA, 20 bp, Artificial Sequence
  chemically synthesized
tggaggatttattgcaaggg

SEQ ID NO: 11440 - DNA, 20 bp, Artificial Sequence
  chemically synthesized
ggaggatttattgcaagggt

SEQ ID NO: 11441 - DNA, 20 bp, Artificial Sequence
  chemically synthesized
gatttattgcaagggtggga

SEQ ID NO: 11442 - DNA, 20 bp, Artificial Sequence
  chemically synthesized
tttattgcaagggtgggaaa

SEQ ID NO: 11443 - DNA, 20 bp, Artificial Sequence
  chemically synthesized
caagggtgggaaagagacta

SEQ ID NO: 11444 - DNA, 20 bp, Artificial Sequence
  chemically synthesized
aagggtgggaaagagactaa

SEQ ID NO: 11445 - DNA, 20 bp, Artificial Sequence
  chemically synthesized
agggtgggaaagagactaaa

SEQ ID NO: 11446 - DNA, 20 bp, Artificial Sequence
  chemically synthesized
gtgggaaagagactaaaggg

SEQ ID NO: 11447 - DNA, 20 bp, Artificial Sequence
  chemically synthesized
ttatctggttggcttccctt

SEQ ID NO: 11448 - DNA, 20 bp, Artificial Sequence
  chemically synthesized
gagactaaagggaagccaac

SEQ ID NO: 11449 - DNA, 20 bp, Artificial Sequence
  chemically synthesized
taaagggaagccaaccagat

SEQ ID NO: 11450 - DNA, 20 bp, Artificial Sequence
  chemically synthesized
gccatagctccttatctggt

SEQ ID NO: 11451 - DNA, 20 bp, Artificial Sequence
  chemically synthesized
aaagggaagccaaccagata

SEQ ID NO: 11452 - DNA, 20 bp, Artificial Sequence
  chemically synthesized
agggaagccaaccagataag

SEQ ID NO: 11453 - DNA, 20 bp, Artificial Sequence
  chemically synthesized
tatggccatagctccttatc

SEQ ID NO: 11454 - DNA, 20 bp, Artificial Sequence
  chemically synthesized
gccaaccagataaggagcta

SEQ ID NO: 11455 - DNA, 20 bp, Artificial Sequence
  chemically synthesized
cagataaggagctatggcca

SEQ ID NO: 11456 - DNA, 20 bp, Artificial Sequence
  chemically synthesized
agataaggagctatggccat

SEQ ID NO: 11457 - DNA, 20 bp, Artificial Sequence
  chemically synthesized
acaccttttacctatggcca

SEQ ID NO: 11458 - DNA, 20 bp, Artificial Sequence
  chemically synthesized
ggagctatggccataggtaa

SEQ ID NO: 11459 - DNA, 20 bp, Artificial Sequence
  chemically synthesized
ctcttaacaccttttaccta

SEQ ID NO: 11460 - DNA, 20 bp, Artificial Sequence
  chemically synthesized
gagctatggccataggtaaa

SEQ ID NO: 11461 - DNA, 20 bp, Artificial Sequence
  chemically synthesized
ggccataggtaaaaggtgtt

SEQ ID NO: 11462 - DNA, 20 bp, Artificial Sequence
  chemically synthesized
ccataggtaaaaggtgttaa

SEQ ID NO: 11463 - DNA, 20 bp, Artificial Sequence
  chemically synthesized
aggtaaaaggtgttaagagc

SEQ ID NO: 11464 - DNA, 20 bp, Artificial Sequence
  chemically synthesized
taaaaggtgttaagagctag

SEQ ID NO: 11465 - DNA, 20 bp, Artificial Sequence
  chemically synthesized
aaaaggtgttaagagctaga

SEQ ID NO: 11466 - DNA, 20 bp, Artificial Sequence
  chemically synthesized
tgctgccactgcgagccttc

SEQ ID NO: 11467 - DNA, 20 bp, Artificial Sequence
  chemically synthesized
gttaagagctagaaggctcg

SEQ ID NO: 11468 - DNA, 20 bp, Artificial Sequence
  chemically synthesized
aagagctagaaggctcgcag

SEQ ID NO: 11469 - DNA, 20 bp, Artificial Sequence
  chemically synthesized
agctagaaggctcgcagtgg

SEQ ID NO: 11470 - DNA, 20 bp, Artificial Sequence
  chemically synthesized
ttgcttcctgctgccactgc

SEQ ID NO: 11471 - DNA, 20 bp, Artificial Sequence
  chemically synthesized
tagaaggctcgcagtggcag

SEQ ID NO: 11472 - DNA, 20 bp, Artificial Sequence
  chemically synthesized
agaaggctcgcagtggcagc

SEQ ID NO: 11473 - DNA, 20 bp, Artificial Sequence
  chemically synthesized
aggctcgcagtggcagcagg

SEQ ID NO: 11474 - DNA, 20 bp, Artificial Sequence
  chemically synthesized
gcagtggcagcaggaagcaa

SEQ ID NO: 11475 - DNA, 20 bp, Artificial Sequence
  chemically synthesized
gtggcagcaggaagcaatgg

SEQ ID NO: 11476 - DNA, 20 bp, Artificial Sequence
  chemically synthesized
ggcagcaggaagcaatggaa

SEQ ID NO: 11477 - DNA, 20 bp, Artificial Sequence
  chemically synthesized
agcaggaagcaatggaagag

SEQ ID NO: 11478 - DNA, 20 bp, Artificial Sequence
  chemically synthesized
aggaagcaatggaagagtgg

SEQ ID NO: 11479 - DNA, 20 bp, Artificial Sequence
  chemically synthesized
cagtttgttttttcatcctg

SEQ ID NO: 11480 - DNA, 20 bp, Artificial Sequence
  chemically synthesized
tttgttttttcatcctgaag

SEQ ID NO: 11481 - DNA, 20 bp, Artificial Sequence
  chemically synthesized
cctcgggagtatgccacttc

SEQ ID NO: 11482 - DNA, 20 bp, Artificial Sequence
  chemically synthesized
ccctcgggagtatgccactt

SEQ ID NO: 11483 - DNA, 20 bp, Artificial Sequence
  chemically synthesized
tcctgaagtggcatactccc

SEQ ID NO: 11484 - DNA, 20 bp, Artificial Sequence
  chemically synthesized
cctgaagtggcatactcccg

SEQ ID NO: 11485 - DNA, 20 bp, Artificial Sequence
  chemically synthesized
ctgaagtggcatactcccga

SEQ ID NO: 11486 - DNA, 20 bp, Artificial Sequence
  chemically synthesized
tctgagatcagtgccctcgg

SEQ ID NO: 11487 - DNA, 20 bp, Artificial Sequence
  chemically synthesized
tgtctgagatcagtgccctc

SEQ ID NO: 11488 - DNA, 20 bp, Artificial Sequence
  chemically synthesized
gtgtctgagatcagtgccct

SEQ ID NO: 11489 - DNA, 20 bp, Artificial Sequence
  chemically synthesized
actcccgagggcactgatct

SEQ ID NO: 11490 - DNA, 20 bp, Artificial Sequence
  chemically synthesized
caacgcagtgtgtctgagat

SEQ ID NO: 11491 - DNA, 20 bp, Artificial Sequence
  chemically synthesized
gtaggcaacgcagtgtgtct

SEQ ID NO: 11492 - DNA, 20 bp, Artificial Sequence
  chemically synthesized
agctcttaacgtaggcaacg

SEQ ID NO: 11493 - DNA, 20 bp, Artificial Sequence
  chemically synthesized
cacactgcgttgcctacgtt

SEQ ID NO: 11494 - DNA, 20 bp, Artificial Sequence
  chemically synthesized
cactgcgttgcctacgttaa

SEQ ID NO: 11495 - DNA, 20 bp, Artificial Sequence
  chemically synthesized
gcaccaaaagctcttaacgt

SEQ ID NO: 11496 - DNA, 20 bp, Artificial Sequence
  chemically synthesized
ggcaccaaaagctcttaacg

SEQ ID NO: 11497 - DNA, 20 bp, Artificial Sequence
  chemically synthesized
ttgcctacgttaagagcttt

SEQ ID NO: 11498 - DNA, 20 bp, Artificial Sequence
  chemically synthesized
ggttgagcccaaggcaccaa

SEQ ID NO: 11499 - DNA, 20 bp, Artificial Sequence
  chemically synthesized
gttaagagcttttggtgcct

SEQ ID NO: 11500 - DNA, 20 bp, Artificial Sequence
  chemically synthesized
ttaagagcttttggtgcctt

SEQ ID NO: 11501 - DNA, 20 bp, Artificial Sequence
  chemically synthesized
catctctttggttgagccca

SEQ ID NO: 11502 - DNA, 20 bp, Artificial Sequence
  chemically synthesized
tcatctctttggttgagccc

SEQ ID NO: 11503 - DNA, 20 bp, Artificial Sequence
  chemically synthesized
tggtgccttgggctcaacca

SEQ ID NO: 11504 - DNA, 20 bp, Artificial Sequence
  chemically synthesized
gtgccttgggctcaaccaaa

SEQ ID NO: 11505 - DNA, 20 bp, Artificial Sequence
  chemically synthesized
gtactttcatctctttggtt

SEQ ID NO: 11506 - DNA, 20 bp, Artificial Sequence
  chemically synthesized
cttaagtactttcatctctt

SEQ ID NO: 11507 - DNA, 20 bp, Artificial Sequence
  chemically synthesized
gggctcaaccaaagagatga

SEQ ID NO: 11508 - DNA, 20 bp, Artificial Sequence
  chemically synthesized
ccaaagagatgaaagtactt

SEQ ID NO: 11509 - DNA, 20 bp, Artificial Sequence
  chemically synthesized
tgctcagatttgtgggtctt

SEQ ID NO: 11510 - DNA, 20 bp, Artificial Sequence
  chemically synthesized
tagatgttgctcagatttgt

SEQ ID NO: 11511 - DNA, 20 bp, Artificial Sequence
  chemically synthesized
tacttaagacccacaaatct

SEQ ID NO: 11512 - DNA, 20 bp, Artificial Sequence
  chemically synthesized
gtagatgttgctcagatttg

SEQ ID NO: 11513 - DNA, 20 bp, Artificial Sequence
  chemically synthesized
gatttaaagtagatgttgct

SEQ ID NO: 11514 - DNA, 20 bp, Artificial Sequence
  chemically synthesized
caccaagcaaggatttaaag

SEQ ID NO: 11515 - DNA, 20 bp, Artificial Sequence
  chemically synthesized
tgccaccaagcaaggattta

SEQ ID NO: 11516 - DNA, 20 bp, Artificial Sequence
  chemically synthesized
atctactttaaatccttgct

SEQ ID NO: 11517 - DNA, 20 bp, Artificial Sequence
  chemically synthesized
tactttaaatccttgcttgg

SEQ ID NO: 11518 - DNA, 20 bp, Artificial Sequence
  chemically synthesized
cagacagatgccaccaagca

SEQ ID NO: 11519 - DNA, 20 bp, Artificial Sequence
  chemically synthesized
tcagacagatgccaccaagc

SEQ ID NO: 11520 - DNA, 20 bp, Artificial Sequence
  chemically synthesized
ttcttcagacagatgccacc

SEQ ID NO: 11521 - DNA, 20 bp, Artificial Sequence
  chemically synthesized
tgcttggtggcatctgtctg

SEQ ID NO: 11522 - DNA, 20 bp, Artificial Sequence
  chemically synthesized
ttggtggcatctgtctgaag

SEQ ID NO: 11523 - DNA, 20 bp, Artificial Sequence
  chemically synthesized
cacaatgtgccttcttcaga

SEQ ID NO: 11524 - DNA, 20 bp, Artificial Sequence
  chemically synthesized
tggtggcatctgtctgaaga

SEQ ID NO: 11525 - DNA, 20 bp, Artificial Sequence
  chemically synthesized
aactcacaatgtgccttctt

SEQ ID NO: 11526 - DNA, 20 bp, Artificial Sequence
  chemically synthesized
gtctgaagaaggcacattgt

SEQ ID NO: 11527 - DNA, 20 bp, Artificial Sequence
  chemically synthesized
gaagaaggcacattgtgagt

SEQ ID NO: 11528 - DNA, 20 bp, Artificial Sequence
  chemically synthesized
gaaggcacattgtgagttag

SEQ ID NO: 11529 - DNA, 20 bp, Artificial Sequence
  chemically synthesized
tgagttagaagtgatcatgt

SEQ ID NO: 11530 - DNA, 20 bp, Artificial Sequence
  chemically synthesized
gttagaagtgatcatgtgag

SEQ ID NO: 11531 - DNA, 20 bp, Artificial Sequence
  chemically synthesized
cacaggtcccttggtttaaa

SEQ ID NO: 11532 - DNA, 20 bp, Artificial Sequence
  chemically synthesized
gtgagaagactttttaaacc

SEQ ID NO: 11533 - DNA, 20 bp, Artificial Sequence
  chemically synthesized
tgagaagactttttaaacca

SEQ ID NO: 11534 - DNA, 20 bp, Artificial Sequence
  chemically synthesized
gagaagactttttaaaccaa

SEQ ID NO: 11535 - DNA, 20 bp, Artificial Sequence
  chemically synthesized
ttattatgtcacaggtccct

SEQ ID NO: 11536 - DNA, 20 bp, Artificial Sequence
  chemically synthesized
tattacatttattatgtcac

SEQ ID NO: 11537 - DNA, 20 bp, Artificial Sequence
  chemically synthesized
gtattacatttattatgtca

SEQ ID NO: 11538 - DNA, 20 bp, Artificial Sequence
  chemically synthesized
gtgacataataaatgtaata

SEQ ID NO: 11539 - DNA, 20 bp, Artificial Sequence
  chemically synthesized
taaatgtaatacagaactga

SEQ ID NO: 11540 - DNA, 20 bp, Artificial Sequence
  chemically synthesized
aatgcaaatcattggacttt

SEQ ID NO: 11541 - DNA, 20 bp, Artificial Sequence
  chemically synthesized
gtcaggataatgcaaatcat

SEQ ID NO: 11542 - DNA, 20 bp, Artificial Sequence
  chemically synthesized
ctggggtactgtattgtgtc

SEQ ID NO: 11543 - DNA, 20 bp, Artificial Sequence
  chemically synthesized
tctggggtactgtattgtgt

SEQ ID NO: 11544 - DNA, 20 bp, Artificial Sequence
  chemically synthesized
tgcattatcctgacacaata

SEQ ID NO: 11545 - DNA, 20 bp, Artificial Sequence
  chemically synthesized
cctgacacaatacagtaccc

SEQ ID NO: 11546 - DNA, 20 bp, Artificial Sequence
  chemically synthesized
gacaaagatgtaaacatctg

SEQ ID NO: 11547 - DNA, 20 bp, Artificial Sequence
  chemically synthesized
ggacaaagatgtaaacatct

SEQ ID NO: 11548 - DNA, 20 bp, Artificial Sequence
  chemically synthesized
aggacaaagatgtaaacatc

SEQ ID NO: 11549 - DNA, 20 bp, Artificial Sequence
  chemically synthesized
taatgactgcagggaggaca

SEQ ID NO: 11550 - DNA, 20 bp, Artificial Sequence
  chemically synthesized
ttacatctttgtcctccctg

SEQ ID NO: 11551 - DNA, 20 bp, Artificial Sequence
  chemically synthesized
ctctcataatgactgcaggg

SEQ ID NO: 11552 - DNA, 20 bp, Artificial Sequence
  chemically synthesized
actctcataatgactgcagg

SEQ ID NO: 11553 - DNA, 20 bp, Artificial Sequence
  chemically synthesized
gaactctcataatgactgca

SEQ ID NO: 11554 - DNA, 20 bp, Artificial Sequence
  chemically synthesized
agaactctcataatgactgc

SEQ ID NO: 11555 - DNA, 20 bp, Artificial Sequence
  chemically synthesized
aagaactctcataatgactg

SEQ ID NO: 11556 - DNA, 20 bp, Artificial Sequence
  chemically synthesized
gtcctccctgcagtcattat

SEQ ID NO: 11557 - DNA, 20 bp, Artificial Sequence
  chemically synthesized
cctccctgcagtcattatga

SEQ ID NO: 11558 - DNA, 20 bp, Artificial Sequence
  chemically synthesized
cagtcattatgagagttctt

SEQ ID NO: 11559 - DNA, 20 bp, Artificial Sequence
  chemically synthesized
tgtagaagagaaaaaggcta

SEQ ID NO: 11560 - DNA, 20 bp, Artificial Sequence
  chemically synthesized
agaaattgtagaagagaaaa

SEQ ID NO: 11561 - DNA, 20 bp, Artificial Sequence
  chemically synthesized
cagaaattgtagaagagaaa

SEQ ID NO: 11562 - DNA, 20 bp, Artificial Sequence
  chemically synthesized
aaatagcagaaattgtagaa

SEQ ID NO: 11563 - DNA, 20 bp, Artificial Sequence
  chemically synthesized
aaaaatagcagaaattgtag

SEQ ID NO: 11564 - DNA, 20 bp, Artificial Sequence
  chemically synthesized
tgtaaaaatagcagaaattg

SEQ ID NO: 11565 - DNA, 20 bp, Artificial Sequence
  chemically synthesized
agacagtcatgtaaaaatag

SEQ ID NO: 11566 - DNA, 20 bp, Artificial Sequence
  chemically synthesized
aaaagacagtcatgtaaaaa

SEQ ID NO: 11567 - DNA, 20 bp, Artificial Sequence
  chemically synthesized
ttttacatgactgtctttta

SEQ ID NO: 11568 - DNA, 20 bp, Artificial Sequence
  chemically synthesized
cagccatcacctgtaaaaga

SEQ ID NO: 11569 - DNA, 20 bp, Artificial Sequence
  chemically synthesized
tttacatgactgtcttttac

SEQ ID NO: 11570 - DNA, 20 bp, Artificial Sequence
  chemically synthesized
ttgtcagccatcacctgtaa

SEQ ID NO: 11571 - DNA, 20 bp, Artificial Sequence
  chemically synthesized
tgactgtcttttacaggtga

SEQ ID NO: 11572 - DNA, 20 bp, Artificial Sequence
  chemically synthesized
tacaggtgatggctgacaat

SEQ ID NO: 11573 - DNA, 20 bp, Artificial Sequence
  chemically synthesized
agtgagacaattccaattgt

SEQ ID NO: 11574 - DNA, 20 bp, Artificial Sequence
  chemically synthesized
caccatcatagcaggttagt

SEQ ID NO: 11575 - DNA, 20 bp, Artificial Sequence
  chemically synthesized
tgctcaccatcatagcaggt

SEQ ID NO: 11576 - DNA, 20 bp, Artificial Sequence
  chemically synthesized
gtctcactaacctgctatga

SEQ ID NO: 11577 - DNA, 20 bp, Artificial Sequence
  chemically synthesized
tttatgctcaccatcatagc

SEQ ID NO: 11578 - DNA, 20 bp, Artificial Sequence
  chemically synthesized
atttatgctcaccatcatag

SEQ ID NO: 11579 - DNA, 20 bp, Artificial Sequence
  chemically synthesized
cactaacctgctatgatggt

SEQ ID NO: 11580 - DNA, 20 bp, Artificial Sequence
  chemically synthesized
attatttatgctcaccatca

SEQ ID NO: 11581 - DNA, 20 bp, Artificial Sequence
  chemically synthesized
ttatttttcatcatcaaatg

SEQ ID NO: 11582 - DNA, 20 bp, Artificial Sequence
  chemically synthesized
tgcatttgatgatgaaaaat

SEQ ID NO: 11583 - DNA, 20 bp, Artificial Sequence
  chemically synthesized
gaaaaataagatgaaacaat

SEQ ID NO: 11584 - DNA, 20 bp, Artificial Sequence
  chemically synthesized
gttattggcttggtcatatt

SEQ ID NO: 11585 - DNA, 20 bp, Artificial Sequence
  chemically synthesized
ggttattggcttggtcatat

SEQ ID NO: 11586 - DNA, 20 bp, Artificial Sequence
  chemically synthesized
attggtttcccaatatgacc

SEQ ID NO: 11587 - DNA, 20 bp, Artificial Sequence
  chemically synthesized
agaaagtagggttattggct

SEQ ID NO: 11588 - DNA, 20 bp, Artificial Sequence
  chemically synthesized
atttaagaaagtagggttat

SEQ ID NO: 11589 - DNA, 20 bp, Artificial Sequence
  chemically synthesized
ctcaaacatttaagaaagta

SEQ ID NO: 11590 - DNA, 20 bp, Artificial Sequence
  chemically synthesized
cctcaaacatttaagaaagt

SEQ ID NO: 11591 - DNA, 20 bp, Artificial Sequence
  chemically synthesized
acctcaaacatttaagaaag

SEQ ID NO: 11592 - DNA, 20 bp, Artificial Sequence
  chemically synthesized
tctacctcaaacatttaaga

SEQ ID NO: 11593 - DNA, 20 bp, Artificial Sequence
  chemically synthesized
attatctacctcaaacattt

SEQ ID NO: 11594 - DNA, 20 bp, Artificial Sequence
  chemically synthesized
ccctactttcttaaatgttt

SEQ ID NO: 11595 - DNA, 20 bp, Artificial Sequence
  chemically synthesized
cctactttcttaaatgtttg

SEQ ID NO: 11596 - DNA, 20 bp, Artificial Sequence
  chemically synthesized
actttcttaaatgtttgagg

SEQ ID NO: 11597 - DNA, 20 bp, Artificial Sequence
  chemically synthesized
aatgtttgaggtagataata

SEQ ID NO: 11598 - DNA, 20 bp, Artificial Sequence
  chemically synthesized
tgattttttttacatgtgtt

SEQ ID NO: 11599 - DNA, 20 bp, Artificial Sequence
  chemically synthesized
atagaatttaagaaaaaagt

SEQ ID NO: 11600 - DNA, 20 bp, Artificial Sequence
  chemically synthesized
aatagaatttaagaaaaaag

SEQ ID NO: 11601 - DNA, 20 bp, Artificial Sequence
  chemically synthesized
cagaatagaatttaagaaaa

SEQ ID NO: 11602 - DNA, 20 bp, Artificial Sequence
  chemically synthesized
tatatttcagaatagaattt

SEQ ID NO: 11603 - DNA, 20 bp, Artificial Sequence
  chemically synthesized
tttgattttatatttcagaa

SEQ ID NO: 11604 - DNA, 20 bp, Artificial Sequence
  chemically synthesized
aaggctttgattttatattt

SEQ ID NO: 11605 - DNA, 20 bp, Artificial Sequence
  chemically synthesized
tattctgaaatataaaatca

SEQ ID NO: 11606 - DNA, 20 bp, Artificial Sequence
  chemically synthesized
gaaatataaaatcaaagcct

SEQ ID NO: 11607 - DNA, 20 bp, Artificial Sequence
  chemically synthesized
aatataaaatcaaagccttg

SEQ ID NO: 11608 - DNA, 20 bp, Artificial Sequence
  chemically synthesized
acttgttgcatgtgtctcca

SEQ ID NO: 11609 - DNA, 20 bp, Artificial Sequence
  chemically synthesized
gacttgttgcatgtgtctcc

SEQ ID NO: 11610 - DNA, 20 bp, Artificial Sequence
  chemically synthesized
gccttggagacacatgcaac

SEQ ID NO: 11611 - DNA, 20 bp, Artificial Sequence
  chemically synthesized
aacaagtcaaataccaccat

SEQ ID NO: 11612 - DNA, 20 bp, Artificial Sequence
  chemically synthesized
gaaggagttaatgctgatgg

SEQ ID NO: 11613 - DNA, 20 bp, Artificial Sequence
  chemically synthesized
tgtgaaggagttaatgctga

SEQ ID NO: 11614 - DNA, 20 bp, Artificial Sequence
  chemically synthesized
ctcatattttaggtgtgaag

SEQ ID NO: 11615 - DNA, 20 bp, Artificial Sequence
  chemically synthesized
aactcatattttaggtgtga

SEQ ID NO: 11616 - DNA, 20 bp, Artificial Sequence
  chemically synthesized
gaactcatattttaggtgtg

SEQ ID NO: 11617 - DNA, 20 bp, Artificial Sequence
  chemically synthesized
ctccttcacacctaaaatat

SEQ ID NO: 11618 - DNA, 20 bp, Artificial Sequence
  chemically synthesized
tgatgaagaactcatatttt

SEQ ID NO: 11619 - DNA, 20 bp, Artificial Sequence
  chemically synthesized
atgatgaagaactcatattt

SEQ ID NO: 11620 - DNA, 20 bp, Artificial Sequence
  chemically synthesized
atggatgcaatagtatgatg

SEQ ID NO: 11621 - DNA, 20 bp, Artificial Sequence
  chemically synthesized
aaagaagacaatggatgcaa

SEQ ID NO: 11622 - DNA, 20 bp, Artificial Sequence
  chemically synthesized
tgttatctgaaagaagacaa

SEQ ID NO: 11623 - DNA, 20 bp, Artificial Sequence
  chemically synthesized
ttgcatccattgtcttcttt

SEQ ID NO: 11624 - DNA, 20 bp, Artificial Sequence
  chemically synthesized
ttttttttgttatctgaaag

SEQ ID NO: 11625 - DNA, 20 bp, Artificial Sequence
  chemically synthesized
tttttttttttgttatctga

SEQ ID NO: 11626 - DNA, 20 bp, Artificial Sequence
  chemically synthesized
ttcagataacaaaaaaaaaa

SEQ ID NO: 11627 - DNA, 20 bp, Artificial Sequence
  chemically synthesized
cagataacaaaaaaaaaaaa

SEQ ID NO: 11628 - DNA, 20 bp, Artificial Sequence
  chemically synthesized
gataacaaaaaaaaaaaaga

SEQ ID NO: 11629 - DNA, 20 bp, Artificial Sequence
  chemically synthesized
taacaaaaaaaaaaaagaga

SEQ ID NO: 11630 - DNA, 20 bp, Artificial Sequence
  chemically synthesized
acaaaaaaaaaaaagagaga

SEQ ID NO: 11631 - DNA, 20 bp, Artificial Sequence
  chemically synthesized
agagagagagaatctgcaaa

SEQ ID NO: 11632 - DNA, 20 bp, Artificial Sequence
  chemically synthesized
agagagagaatctgcaaatg

SEQ ID NO: 11633 - DNA, 20 bp, Artificial Sequence
  chemically synthesized
aatctgtttagctccatttg

SEQ ID NO: 11634 - DNA, 20 bp, Artificial Sequence
  chemically synthesized
aatctgcaaatggagctaaa

SEQ ID NO: 11635 - DNA, 20 bp, Artificial Sequence
  chemically synthesized
gttttctaaaataatctgtt

SEQ ID NO: 11636 - DNA, 20 bp, Artificial Sequence
  chemically synthesized
tggagctaaacagattattt

SEQ ID NO: 11637 - DNA, 20 bp, Artificial Sequence
  chemically synthesized
agattattttagaaaacaat

SEQ ID NO: 11638 - DNA, 20 bp, Artificial Sequence
  chemically synthesized
attagacataaaatgactct

SEQ ID NO: 11639 - DNA, 20 bp, Artificial Sequence
  chemically synthesized
acataaaatgactctaagtg

SEQ ID NO: 11640 - DNA, 20 bp, Artificial Sequence
  chemically synthesized
gtgccaggaatcttcactta

SEQ ID NO: 11641 - DNA, 20 bp, Artificial Sequence
  chemically synthesized
aagtgccaggaatcttcact

SEQ ID NO: 11642 - DNA, 20 bp, Artificial Sequence
  chemically synthesized
tgactctaagtgaagattcc

SEQ ID NO: 11643 - DNA, 20 bp, Artificial Sequence
  chemically synthesized
tgcacacatagaaaagtgcc

SEQ ID NO: 11644 - DNA, 20 bp, Artificial Sequence
  chemically synthesized
ttgcacacatagaaaagtgc

SEQ ID NO: 11645 - DNA, 20 bp, Artificial Sequence
  chemically synthesized
atacacttgcacacatagaa

SEQ ID NO: 11646 - DNA, 20 bp, Artificial Sequence
  chemically synthesized
tggcacttttctatgtgtgc

SEQ ID NO: 11647 - DNA, 20 bp, Artificial Sequence
  chemically synthesized
agtgcatacacttgcacaca

SEQ ID NO: 11648 - DNA, 20 bp, Artificial Sequence
  chemically synthesized
agctttgtcattggtatgca

SEQ ID NO: 11649 - DNA, 20 bp, Artificial Sequence
  chemically synthesized
ctagctttgtcattggtatg

SEQ ID NO: 11650 - DNA, 20 bp, Artificial Sequence
  chemically synthesized
cactctgcataccaatgaca

SEQ ID NO: 11651 - DNA, 20 bp, Artificial Sequence
  chemically synthesized
tttctttctagctttgtcat

SEQ ID NO: 11652 - DNA, 20 bp, Artificial Sequence
  chemically synthesized
ctgcataccaatgacaaagc

SEQ ID NO: 11653 - DNA, 20 bp, Artificial Sequence
  chemically synthesized
ataccaatgacaaagctaga

SEQ ID NO: 11654 - DNA, 20 bp, Artificial Sequence
  chemically synthesized
aaacaggtgagttttctttc

SEQ ID NO: 11655 - DNA, 20 bp, Artificial Sequence
  chemically synthesized
tcttgaggaagaaaacaggt

SEQ ID NO: 11656 - DNA, 20 bp, Artificial Sequence
  chemically synthesized
cagatcttgaggaagaaaac

SEQ ID NO: 11657 - DNA, 20 bp, Artificial Sequence
  chemically synthesized
gcagatcttgaggaagaaaa

SEQ ID NO: 11658 - DNA, 20 bp, Artificial Sequence
  chemically synthesized
actcacctgttttcttcctc

SEQ ID NO: 11659 - DNA, 20 bp, Artificial Sequence
  chemically synthesized
aatcctagcagatcttgagg

SEQ ID NO: 11660 - DNA, 20 bp, Artificial Sequence
  chemically synthesized
gagaatcctagcagatcttg

SEQ ID NO: 11661 - DNA, 20 bp, Artificial Sequence
  chemically synthesized
agagaatcctagcagatctt

SEQ ID NO: 11662 - DNA, 20 bp, Artificial Sequence
  chemically synthesized
ttttcttcctcaagatctgc

SEQ ID NO: 11663 - DNA, 20 bp, Artificial Sequence
  chemically synthesized
tttcttcctcaagatctgct

SEQ ID NO: 11664 - DNA, 20 bp, Artificial Sequence
  chemically synthesized
ggagctagagagaatcctag

SEQ ID NO: 11665 - DNA, 20 bp, Artificial Sequence
  chemically synthesized
aggggagctagagagaatcc

SEQ ID NO: 11666 - DNA, 20 bp, Artificial Sequence
  chemically synthesized
agatctgctaggattctctc

SEQ ID NO: 11667 - DNA, 20 bp, Artificial Sequence
  chemically synthesized
gaggaaagaggggagctaga

SEQ ID NO: 11668 - DNA, 20 bp, Artificial Sequence
  chemically synthesized
gtgaggaaagaggggagcta

SEQ ID NO: 11669 - DNA, 20 bp, Artificial Sequence
  chemically synthesized
gagtgaggaaagaggggagc

SEQ ID NO: 11670 - DNA, 20 bp, Artificial Sequence
  chemically synthesized
tagagagtgaggaaagaggg

SEQ ID NO: 11671 - DNA, 20 bp, Artificial Sequence
  chemically synthesized
cttagagagtgaggaaagag

SEQ ID NO: 11672 - DNA, 20 bp, Artificial Sequence
  chemically synthesized
ccttagagagtgaggaaaga

SEQ ID NO: 11673 - DNA, 20 bp, Artificial Sequence
  chemically synthesized
tccttagagagtgaggaaag

SEQ ID NO: 11674 - DNA, 20 bp, Artificial Sequence
  chemically synthesized
ttccttagagagtgaggaaa

SEQ ID NO: 11675 - DNA, 20 bp, Artificial Sequence
  chemically synthesized
atttccttagagagtgagga

SEQ ID NO: 11676 - DNA, 20 bp, Artificial Sequence
  chemically synthesized
cttgatttccttagagagtg

SEQ ID NO: 11677 - DNA, 20 bp, Artificial Sequence
  chemically synthesized
cccctctttcctcactctct

SEQ ID NO: 11678 - DNA, 20 bp, Artificial Sequence
  chemically synthesized
tcttgatttccttagagagt

SEQ ID NO: 11679 - DNA, 20 bp, Artificial Sequence
  chemically synthesized
ccctctttcctcactctcta

SEQ ID NO: 11680 - DNA, 20 bp, Artificial Sequence
  chemically synthesized
cagatcttgatttccttaga

SEQ ID NO: 11681 - DNA, 20 bp, Artificial Sequence
  chemically synthesized
cccagatcttgatttcctta

SEQ ID NO: 11682 - DNA, 20 bp, Artificial Sequence
  chemically synthesized
tgcccagatcttgatttcct

SEQ ID NO: 11683 - DNA, 20 bp, Artificial Sequence
  chemically synthesized
cctcactctctaaggaaatc

SEQ ID NO: 11684 - DNA, 20 bp, Artificial Sequence
  chemically synthesized
tctctaaggaaatcaagatc

SEQ ID NO: 11685 - DNA, 20 bp, Artificial Sequence
  chemically synthesized
ctctaaggaaatcaagatct

SEQ ID NO: 11686 - DNA, 20 bp, Artificial Sequence
  chemically synthesized
taaggaaatcaagatctggg

SEQ ID NO: 11687 - DNA, 20 bp, Artificial Sequence
  chemically synthesized
aaggaaatcaagatctgggc

SEQ ID NO: 11688 - DNA, 20 bp, Artificial Sequence
  chemically synthesized
gccagcctcgtagtcctgcc

SEQ ID NO: 11689 - DNA, 20 bp, Artificial Sequence
  chemically synthesized
caagatctgggcaggactac

SEQ ID NO: 11690 - DNA, 20 bp, Artificial Sequence
  chemically synthesized
aagatctgggcaggactacg

SEQ ID NO: 11691 - DNA, 20 bp, Artificial Sequence
  chemically synthesized
tctgggcaggactacgaggc

SEQ ID NO: 11692 - DNA, 20 bp, Artificial Sequence
  chemically synthesized
tcccccctgagccagcctcg

SEQ ID NO: 11693 - DNA, 20 bp, Artificial Sequence
  chemically synthesized
gcaggactacgaggctggct

SEQ ID NO: 11694 - DNA, 20 bp, Artificial Sequence
  chemically synthesized
caggactacgaggctggctc

SEQ ID NO: 11695 - DNA, 20 bp, Artificial Sequence
  chemically synthesized
aggactacgaggctggctca

SEQ ID NO: 11696 - DNA, 20 bp, Artificial Sequence
  chemically synthesized
ggactacgaggctggctcag

SEQ ID NO: 11697 - DNA, 20 bp, Artificial Sequence
  chemically synthesized
gactacgaggctggctcagg

SEQ ID NO: 11698 - DNA, 20 bp, Artificial Sequence
  chemically synthesized
accaggactcccccctgagc

SEQ ID NO: 11699 - DNA, 20 bp, Artificial Sequence
  chemically synthesized
actacgaggctggctcaggg

SEQ ID NO: 11700 - DNA, 20 bp, Artificial Sequence
  chemically synthesized
tacgaggctggctcaggggg

SEQ ID NO: 11701 - DNA, 20 bp, Artificial Sequence
  chemically synthesized
ttgaaccaggactcccccct

SEQ ID NO: 11702 - DNA, 20 bp, Artificial Sequence
  chemically synthesized
gctggctcaggggggagtcc

SEQ ID NO: 11703 - DNA, 20 bp, Artificial Sequence
  chemically synthesized
ttactgccaaagtttgaacc

SEQ ID NO: 11704 - DNA, 20 bp, Artificial Sequence
  chemically synthesized
attactgccaaagtttgaac

SEQ ID NO: 11705 - DNA, 20 bp, Artificial Sequence
  chemically synthesized
gggagtcctggttcaaactt

SEQ ID NO: 11706 - DNA, 20 bp, Artificial Sequence
  chemically synthesized
agtcctggttcaaactttgg

SEQ ID NO: 11707 - DNA, 20 bp, Artificial Sequence
  chemically synthesized
ttaatccagcattactgcca

SEQ ID NO: 11708 - DNA, 20 bp, Artificial Sequence
  chemically synthesized
tcaaactttggcagtaatgc

SEQ ID NO: 11709 - DNA, 20 bp, Artificial Sequence
  chemically synthesized
atgatgaacatttgttaatc

SEQ ID NO: 11710 - DNA, 20 bp, Artificial Sequence
  chemically synthesized
taacaaatgttcatcatctc

SEQ ID NO: 11711 - DNA, 20 bp, Artificial Sequence
  chemically synthesized
acctttgattttattttcca

SEQ ID NO: 11712 - DNA, 20 bp, Artificial Sequence
  chemically synthesized
aaacctttgattttattttc

SEQ ID NO: 11713 - DNA, 20 bp, Artificial Sequence
  chemically synthesized
atctctggaaaataaaatca

SEQ ID NO: 11714 - DNA, 20 bp, Artificial Sequence
  chemically synthesized
tctctggaaaataaaatcaa

SEQ ID NO: 11715 - DNA, 20 bp, Artificial Sequence
  chemically synthesized
gaaaataaaatcaaaggttt

SEQ ID NO: 11716 - DNA, 20 bp, Artificial Sequence
  chemically synthesized
ccccaaagcaaaataagggg

SEQ ID NO: 11717 - DNA, 20 bp, Artificial Sequence
  chemically synthesized
cccccaaagcaaaataaggg

SEQ ID NO: 11718 - DNA, 20 bp, Artificial Sequence
  chemically synthesized
acccccaaagcaaaataagg

SEQ ID NO: 11719 - DNA, 20 bp, Artificial Sequence
  chemically synthesized
aacccccaaagcaaaataag

SEQ ID NO: 11720 - DNA, 20 bp, Artificial Sequence
  chemically synthesized
taacccccaaagcaaaataa

SEQ ID NO: 11721 - DNA, 20 bp, Artificial Sequence
  chemically synthesized
ctaacccccaaagcaaaata

SEQ ID NO: 11722 - DNA, 20 bp, Artificial Sequence
  chemically synthesized
cctaacccccaaagcaaaat

SEQ ID NO: 11723 - DNA, 20 bp, Artificial Sequence
  chemically synthesized
ttcccccccttattttgctt

SEQ ID NO: 11724 - DNA, 20 bp, Artificial Sequence
  chemically synthesized
tcccccccttattttgcttt

SEQ ID NO: 11725 - DNA, 20 bp, Artificial Sequence
  chemically synthesized
cccccccttattttgctttg

SEQ ID NO: 11726 - DNA, 20 bp, Artificial Sequence
  chemically synthesized
ccccccttattttgctttgg

SEQ ID NO: 11727 - DNA, 20 bp, Artificial Sequence
  chemically synthesized
ccttattttgctttgggggt

SEQ ID NO: 11728 - DNA, 20 bp, Artificial Sequence
  chemically synthesized
tcctgagtccctaaccccca

SEQ ID NO: 11729 - DNA, 20 bp, Artificial Sequence
  chemically synthesized
cttattttgctttgggggtt

SEQ ID NO: 11730 - DNA, 20 bp, Artificial Sequence
  chemically synthesized
ttattttgctttgggggtta

SEQ ID NO: 11731 - DNA, 20 bp, Artificial Sequence
  chemically synthesized
tgctttgggggttagggact

SEQ ID NO: 11732 - DNA, 20 bp, Artificial Sequence
  chemically synthesized
gctttgggggttagggactc

SEQ ID NO: 11733 - DNA, 20 bp, Artificial Sequence
  chemically synthesized
tttgggggttagggactcag

SEQ ID NO: 11734 - DNA, 20 bp, Artificial Sequence
  chemically synthesized
ctattttcaaatacactcct

SEQ ID NO: 11735 - DNA, 20 bp, Artificial Sequence
  chemically synthesized
ctcaggagtgtatttgaaaa

SEQ ID NO: 11736 - DNA, 20 bp, Artificial Sequence
  chemically synthesized
aaggtctaattaattgttaa

SEQ ID NO: 11737 - DNA, 20 bp, Artificial Sequence
  chemically synthesized
aaaaggtctaattaattgtt

SEQ ID NO: 11738 - DNA, 20 bp, Artificial Sequence
  chemically synthesized
atttgctcttaacaattaat

SEQ ID NO: 11739 - DNA, 20 bp, Artificial Sequence
  chemically synthesized
gtctttagaagcaggaaaaa

SEQ ID NO: 11740 - DNA, 20 bp, Artificial Sequence
  chemically synthesized
ggtctttagaagcaggaaaa

SEQ ID NO: 11741 - DNA, 20 bp, Artificial Sequence
  chemically synthesized
gaccttttttcctgcttcta

SEQ ID NO: 11742 - DNA, 20 bp, Artificial Sequence
  chemically synthesized
atcaaaaggtctttagaagc

SEQ ID NO: 11743 - DNA, 20 bp, Artificial Sequence
  chemically synthesized
tatcaaaaggtctttagaag

SEQ ID NO: 11744 - DNA, 20 bp, Artificial Sequence
  chemically synthesized
cagtatcaaaaggtctttag

SEQ ID NO: 11745 - DNA, 20 bp, Artificial Sequence
  chemically synthesized
cagcagtatcaaaaggtctt

SEQ ID NO: 11746 - DNA, 20 bp, Artificial Sequence
  chemically synthesized
acaacctcagcagtatcaaa

SEQ ID NO: 11747 - DNA, 20 bp, Artificial Sequence
  chemically synthesized
cacaacctcagcagtatcaa

SEQ ID NO: 11748 - DNA, 20 bp, Artificial Sequence
  chemically synthesized
aaagaccttttgatactgct

SEQ ID NO: 11749 - DNA, 20 bp, Artificial Sequence
  chemically synthesized
aagaccttttgatactgctg

SEQ ID NO: 11750 - DNA, 20 bp, Artificial Sequence
  chemically synthesized
atggtagatcacaacctcag

SEQ ID NO: 11751 - DNA, 20 bp, Artificial Sequence
  chemically synthesized
agaatggtagatcacaacct

SEQ ID NO: 11752 - DNA, 20 bp, Artificial Sequence
  chemically synthesized
aattggtaccagtagaatgg

SEQ ID NO: 11753 - DNA, 20 bp, Artificial Sequence
  chemically synthesized
gttgtgatctaccattctac

SEQ ID NO: 11754 - DNA, 20 bp, Artificial Sequence
  chemically synthesized
ttgaattggtaccagtagaa

SEQ ID NO: 11755 - DNA, 20 bp, Artificial Sequence
  chemically synthesized
acactttgaattggtaccag

SEQ ID NO: 11756 - DNA, 20 bp, Artificial Sequence
  chemically synthesized
aaaacactttgaattggtac

SEQ ID NO: 11757 - DNA, 20 bp, Artificial Sequence
  chemically synthesized
attctactggtaccaattca

SEQ ID NO: 11758 - DNA, 20 bp, Artificial Sequence
  chemically synthesized
agcaagaaaacactttgaat

SEQ ID NO: 11759 - DNA, 20 bp, Artificial Sequence
  chemically synthesized
attcaaagtgttttcttgct

SEQ ID NO: 11760 - DNA, 20 bp, Artificial Sequence
  chemically synthesized
tttcatttgaaaatctgagc

SEQ ID NO: 11761 - DNA, 20 bp, Artificial Sequence
  chemically synthesized
tcaatttcatttgaaaatct

SEQ ID NO: 11762 - DNA, 20 bp, Artificial Sequence
  chemically synthesized
gattttcaaatgaaattgat

SEQ ID NO: 11763 - DNA, 20 bp, Artificial Sequence
  chemically synthesized
aattgattggcctatttaca

SEQ ID NO: 11764 - DNA, 20 bp, Artificial Sequence
  chemically synthesized
tttcatttatccgtgtaaat

SEQ ID NO: 11765 - DNA, 20 bp, Artificial Sequence
  chemically synthesized
ctttcatttatccgtgtaaa

SEQ ID NO: 11766 - DNA, 20 bp, Artificial Sequence
  chemically synthesized
ctatttacacggataaatga

SEQ ID NO: 11767 - DNA, 20 bp, Artificial Sequence
  chemically synthesized
tatttacacggataaatgaa

SEQ ID NO: 11768 - DNA, 20 bp, Artificial Sequence
  chemically synthesized
ttacacggataaatgaaagg

SEQ ID NO: 11769 - DNA, 20 bp, Artificial Sequence
  chemically synthesized
ataaatgaaaggcagaatta

SEQ ID NO: 11770 - DNA, 20 bp, Artificial Sequence
  chemically synthesized
aggcagaattacagaaatac

SEQ ID NO: 11771 - DNA, 20 bp, Artificial Sequence
  chemically synthesized
ggcagaattacagaaatact

SEQ ID NO: 11772 - DNA, 20 bp, Artificial Sequence
  chemically synthesized
ctaacatcaacgtagagtcc

SEQ ID NO: 11773 - DNA, 20 bp, Artificial Sequence
  chemically synthesized
tattgactaacatcaacgta

SEQ ID NO: 11774 - DNA, 20 bp, Artificial Sequence
  chemically synthesized
gctattgactaacatcaacg

SEQ ID NO: 11775 - DNA, 20 bp, Artificial Sequence
  chemically synthesized
ctgggactctacgttgatgt

SEQ ID NO: 11776 - DNA, 20 bp, Artificial Sequence
  chemically synthesized
tctacgttgatgttagtcaa

SEQ ID NO: 11777 - DNA, 20 bp, Artificial Sequence
  chemically synthesized
ttatatcttttaatattttt

SEQ ID NO: 11778 - DNA, 20 bp, Artificial Sequence
  chemically synthesized
caatagctaaaaaatattaa

SEQ ID NO: 11779 - DNA, 20 bp, Artificial Sequence
  chemically synthesized
aatattaaaagatataataa

SEQ ID NO: 11780 - DNA, 20 bp, Artificial Sequence
  chemically synthesized
ttggtggccaaagcattata

SEQ ID NO: 11781 - DNA, 20 bp, Artificial Sequence
  chemically synthesized
ataatggctgtataatgctt

SEQ ID NO: 11782 - DNA, 20 bp, Artificial Sequence
  chemically synthesized
cttgacaggcttggtggcca

SEQ ID NO: 11783 - DNA, 20 bp, Artificial Sequence
  chemically synthesized
tgtataatgctttggccacc

SEQ ID NO: 11784 - DNA, 20 bp, Artificial Sequence
  chemically synthesized
gattatcttgacaggcttgg

SEQ ID NO: 11785 - DNA, 20 bp, Artificial Sequence
  chemically synthesized
acagattatcttgacaggct

SEQ ID NO: 11786 - DNA, 20 bp, Artificial Sequence
  chemically synthesized
ctttggccaccaagcctgtc

SEQ ID NO: 11787 - DNA, 20 bp, Artificial Sequence
  chemically synthesized
agtgaacagattatcttgac

SEQ ID NO: 11788 - DNA, 20 bp, Artificial Sequence
  chemically synthesized
tagtgaacagattatcttga

SEQ ID NO: 11789 - DNA, 20 bp, Artificial Sequence
  chemically synthesized
caatagcgtgggttagtgaa

SEQ ID NO: 11790 - DNA, 20 bp, Artificial Sequence
  chemically synthesized
agtacaacaatagcgtgggt

SEQ ID NO: 11791 - DNA, 20 bp, Artificial Sequence
  chemically synthesized
actcagtacaacaatagcgt

SEQ ID NO: 11792 - DNA, 20 bp, Artificial Sequence
  chemically synthesized
tactcagtacaacaatagcg

SEQ ID NO: 11793 - DNA, 20 bp, Artificial Sequence
  chemically synthesized
tttcctactcagtacaacaa

SEQ ID NO: 11794 - DNA, 20 bp, Artificial Sequence
  chemically synthesized
acccacgctattgttgtact

SEQ ID NO: 11795 - DNA, 20 bp, Artificial Sequence
  chemically synthesized
cacgctattgttgtactgag

SEQ ID NO: 11796 - DNA, 20 bp, Artificial Sequence
  chemically synthesized
acgctattgttgtactgagt

SEQ ID NO: 11797 - DNA, 20 bp, Artificial Sequence
  chemically synthesized
gcaaggtattttttcctact

SEQ ID NO: 11798 - DNA, 20 bp, Artificial Sequence
  chemically synthesized
gagtaggaaaaaataccttg

SEQ ID NO: 11799 - DNA, 20 bp, Artificial Sequence
  chemically synthesized
ctgttacttttagagctgca

SEQ ID NO: 11800 - DNA, 20 bp, Artificial Sequence
  chemically synthesized
tctgttacttttagagctgc

SEQ ID NO: 11801 - DNA, 20 bp, Artificial Sequence
  chemically synthesized
aaaataccttgcagctctaa

SEQ ID NO: 11802 - DNA, 20 bp, Artificial Sequence
  chemically synthesized
tatttcctctgttactttta

SEQ ID NO: 11803 - DNA, 20 bp, Artificial Sequence
  chemically synthesized
ccttgcagctctaaaagtaa

SEQ ID NO: 11804 - DNA, 20 bp, Artificial Sequence
  chemically synthesized
aatatttcctctgttacttt

SEQ ID NO: 11805 - DNA, 20 bp, Artificial Sequence
  chemically synthesized
ttgcagctctaaaagtaaca

SEQ ID NO: 11806 - DNA, 20 bp, Artificial Sequence
  chemically synthesized
tgcagctctaaaagtaacag

SEQ ID NO: 11807 - DNA, 20 bp, Artificial Sequence
  chemically synthesized
aacagaggaaatattttatt

SEQ ID NO: 11808 - DNA, 20 bp, Artificial Sequence
  chemically synthesized
agaggaaatattttattaag

SEQ ID NO: 11809 - DNA, 20 bp, Artificial Sequence
  chemically synthesized
ggaaatattttattaagtgg

SEQ ID NO: 11810 - DNA, 20 bp, Artificial Sequence
  chemically synthesized
gaaatattttattaagtgga

SEQ ID NO: 11811 - DNA, 20 bp, Artificial Sequence
  chemically synthesized
tggaaggcaatgtaaccaaa

SEQ ID NO: 11812 - DNA, 20 bp, Artificial Sequence
  chemically synthesized
cttactgaagcaatactttt

SEQ ID NO: 11813 - DNA, 20 bp, Artificial Sequence
  chemically synthesized
gtaaccaaaaagtattgctt

SEQ ID NO: 11814 - DNA, 20 bp, Artificial Sequence
  chemically synthesized
ccaaaaagtattgcttcagt

SEQ ID NO: 11815 - DNA, 20 bp, Artificial Sequence
  chemically synthesized
aagttaaaactgacttactg

SEQ ID NO: 11816 - DNA, 20 bp, Artificial Sequence
  chemically synthesized
aaagtattgcttcagtaagt

SEQ ID NO: 11817 - DNA, 20 bp, Artificial Sequence
  chemically synthesized
aagtcagttttaacttatat

SEQ ID NO: 11818 - DNA, 20 bp, Artificial Sequence
  chemically synthesized
tctgcctcaatgacttatat

SEQ ID NO: 11819 - DNA, 20 bp, Artificial Sequence
  chemically synthesized
tttaacttatataagtcatt

SEQ ID NO: 11820 - DNA, 20 bp, Artificial Sequence
  chemically synthesized
ttaacttatataagtcattg

SEQ ID NO: 11821 - DNA, 20 bp, Artificial Sequence
  chemically synthesized
acttatataagtcattgagg

SEQ ID NO: 11822 - DNA, 20 bp, Artificial Sequence
  chemically synthesized
aatgacaacaacaattaaac

SEQ ID NO: 11823 - DNA, 20 bp, Artificial Sequence
  chemically synthesized
tgacaacaacaattaaactg

SEQ ID NO: 11824 - DNA, 20 bp, Artificial Sequence
  chemically synthesized
atgaaacaatcatgtatctc

SEQ ID NO: 11825 - DNA, 20 bp, Artificial Sequence
  chemically synthesized
agatacatgattgtttcatt

SEQ ID NO: 11826 - DNA, 20 bp, Artificial Sequence
  chemically synthesized
tgtttcattcagttattgtt

SEQ ID NO: 11827 - DNA, 20 bp, Artificial Sequence
  chemically synthesized
tcattcagttattgtttaga

SEQ ID NO: 11828 - DNA, 20 bp, Artificial Sequence
  chemically synthesized
ttcagttattgtttagacag

SEQ ID NO: 11829 - DNA, 20 bp, Artificial Sequence
  chemically synthesized
tagacagaagaacgaaaatt

SEQ ID NO: 11830 - DNA, 20 bp, Artificial Sequence
  chemically synthesized
agacagaagaacgaaaatta

SEQ ID NO: 11831 - DNA, 20 bp, Artificial Sequence
  chemically synthesized
gacagaagaacgaaaattaa

SEQ ID NO: 11832 - DNA, 20 bp, Artificial Sequence
  chemically synthesized
acagaagaacgaaaattaag

SEQ ID NO: 11833 - DNA, 20 bp, Artificial Sequence
  chemically synthesized
aacgaaaattaaggggaaaa

SEQ ID NO: 11834 - DNA, 20 bp, Artificial Sequence
  chemically synthesized
ttaaggggaaaaaagacatt

SEQ ID NO: 11835 - DNA, 20 bp, Artificial Sequence
  chemically synthesized
taaggggaaaaaagacatta

SEQ ID NO: 11836 - DNA, 20 bp, Artificial Sequence
  chemically synthesized
acattaaggtgactgattaa

SEQ ID NO: 11837 - DNA, 20 bp, Artificial Sequence
  chemically synthesized
atgttcagtcttcttttaat

SEQ ID NO: 11838 - DNA, 20 bp, Artificial Sequence
  chemically synthesized
ttaaggtgactgattaaaag

SEQ ID NO: 11839 - DNA, 20 bp, Artificial Sequence
  chemically synthesized
gccccgaggaatgagatgtt

SEQ ID NO: 11840 - DNA, 20 bp, Artificial Sequence
  chemically synthesized
agactgaacatctcattcct

SEQ ID NO: 11841 - DNA, 20 bp, Artificial Sequence
  chemically synthesized
gactgaacatctcattcctc

SEQ ID NO: 11842 - DNA, 20 bp, Artificial Sequence
  chemically synthesized
aaaactctgccccgaggaat

SEQ ID NO: 11843 - DNA, 20 bp, Artificial Sequence
  chemically synthesized
actgaacatctcattcctcg

SEQ ID NO: 11844 - DNA, 20 bp, Artificial Sequence
  chemically synthesized
gaacatctcattcctcgggg

SEQ ID NO: 11845 - DNA, 20 bp, Artificial Sequence
  chemically synthesized
acatctcattcctcggggca

SEQ ID NO: 11846 - DNA, 20 bp, Artificial Sequence
  chemically synthesized
tttaaaaaaactctgccccg

SEQ ID NO: 11847 - DNA, 20 bp, Artificial Sequence
  chemically synthesized
atttaaaaaaactctgcccc

SEQ ID NO: 11848 - DNA, 20 bp, Artificial Sequence
  chemically synthesized
ggcagagtttttttaaatac

SEQ ID NO: 11849 - DNA, 20 bp, Artificial Sequence
  chemically synthesized
atttttaaatttatacataa

SEQ ID NO: 11850 - DNA, 20 bp, Artificial Sequence
  chemically synthesized
aatttatacataatggtttt

SEQ ID NO: 11851 - DNA, 20 bp, Artificial Sequence
  chemically synthesized
atttatacataatggtttta

SEQ ID NO: 11852 - DNA, 20 bp, Artificial Sequence
  chemically synthesized
ggttttaaggactaatcttg

SEQ ID NO: 11853 - DNA, 20 bp, Artificial Sequence
  chemically synthesized
gttttaaggactaatcttgc

SEQ ID NO: 11854 - DNA, 20 bp, Artificial Sequence
  chemically synthesized
gcctccttttcccgcaagat

SEQ ID NO: 11855 - DNA, 20 bp, Artificial Sequence
  chemically synthesized
aaggactaatcttgcgggaa

SEQ ID NO: 11856 - DNA, 20 bp, Artificial Sequence
  chemically synthesized
tttttgcctccttttcccgc

SEQ ID NO: 11857 - DNA, 20 bp, Artificial Sequence
  chemically synthesized
aggactaatcttgcgggaaa

SEQ ID NO: 11858 - DNA, 20 bp, Artificial Sequence
  chemically synthesized
gactaatcttgcgggaaaag

SEQ ID NO: 11859 - DNA, 20 bp, Artificial Sequence
  chemically synthesized
actaatcttgcgggaaaagg

SEQ ID NO: 11860 - DNA, 20 bp, Artificial Sequence
  chemically synthesized
ttgcgggaaaaggaggcaaa

SEQ ID NO: 11861 - DNA, 20 bp, Artificial Sequence
  chemically synthesized
tgcgggaaaaggaggcaaaa

SEQ ID NO: 11862 - DNA, 20 bp, Artificial Sequence
  chemically synthesized
gaggcaaaaaggcttctatt

SEQ ID NO: 11863 - DNA, 20 bp, Artificial Sequence
  chemically synthesized
aggcaaaaaggcttctattt

SEQ ID NO: 11864 - DNA, 20 bp, Artificial Sequence
  chemically synthesized
ggcaaaaaggcttctatttg

SEQ ID NO: 11865 - DNA, 20 bp, Artificial Sequence
  chemically synthesized
gtagctgcctccccaaatag

SEQ ID NO: 11866 - DNA, 20 bp, Artificial Sequence
  chemically synthesized
caaaaaggcttctatttggg

SEQ ID NO: 11867 - DNA, 20 bp, Artificial Sequence
  chemically synthesized
aaaaaggcttctatttgggg

SEQ ID NO: 11868 - DNA, 20 bp, Artificial Sequence
  chemically synthesized
attgtagctgcctccccaaa

SEQ ID NO: 11869 - DNA, 20 bp, Artificial Sequence
  chemically synthesized
aaggcttctatttggggagg

SEQ ID NO: 11870 - DNA, 20 bp, Artificial Sequence
  chemically synthesized
ctagtttccaggaaagattg

SEQ ID NO: 11871 - DNA, 20 bp, Artificial Sequence
  chemically synthesized
gaggcagctacaatctttcc

SEQ ID NO: 11872 - DNA, 20 bp, Artificial Sequence
  chemically synthesized
agagttcctagtttccagga

SEQ ID NO: 11873 - DNA, 20 bp, Artificial Sequence
  chemically synthesized
ctacaatctttcctggaaac

SEQ ID NO: 11874 - DNA, 20 bp, Artificial Sequence
  chemically synthesized
tacaatctttcctggaaact

SEQ ID NO: 11875 - DNA, 20 bp, Artificial Sequence
  chemically synthesized
ttagagagttcctagtttcc

SEQ ID NO: 11876 - DNA, 20 bp, Artificial Sequence
  chemically synthesized
attagagagttcctagtttc

SEQ ID NO: 11877 - DNA, 20 bp, Artificial Sequence
  chemically synthesized
cctgtgtattagagagttcc

SEQ ID NO: 11878 - DNA, 20 bp, Artificial Sequence
  chemically synthesized
agtttgtcctgtgtattaga

SEQ ID NO: 11879 - DNA, 20 bp, Artificial Sequence
  chemically synthesized
actaggaactctctaataca

SEQ ID NO: 11880 - DNA, 20 bp, Artificial Sequence
  chemically synthesized
aaagtttgtcctgtgtatta

SEQ ID NO: 11881 - DNA, 20 bp, Artificial Sequence
  chemically synthesized
ctaggaactctctaatacac

SEQ ID NO: 11882 - DNA, 20 bp, Artificial Sequence
  chemically synthesized
aaaaagtttgtcctgtgtat

SEQ ID NO: 11883 - DNA, 20 bp, Artificial Sequence
  chemically synthesized
ggagcaatgcattcagaaaa

SEQ ID NO: 11884 - DNA, 20 bp, Artificial Sequence
  chemically synthesized
ggagcttggagcaatgcatt

SEQ ID NO: 11885 - DNA, 20 bp, Artificial Sequence
  chemically synthesized
ttttctgaatgcattgctcc

SEQ ID NO: 11886 - DNA, 20 bp, Artificial Sequence
  chemically synthesized
gaatgcattgctccaagctc

SEQ ID NO: 11887 - DNA, 20 bp, Artificial Sequence
  chemically synthesized
acaggcctttccggagcttg

SEQ ID NO: 11888 - DNA, 20 bp, Artificial Sequence
  chemically synthesized
aaacaggcctttccggagct

SEQ ID NO: 11889 - DNA, 20 bp, Artificial Sequence
  chemically synthesized
gcattgctccaagctccgga

SEQ ID NO: 11890 - DNA, 20 bp, Artificial Sequence
  chemically synthesized
cattgctccaagctccggaa

SEQ ID NO: 11891 - DNA, 20 bp, Artificial Sequence
  chemically synthesized
gaggtaaacaggcctttccg

SEQ ID NO: 11892 - DNA, 20 bp, Artificial Sequence
  chemically synthesized
tggaggtaaacaggcctttc

SEQ ID NO: 11893 - DNA, 20 bp, Artificial Sequence
  chemically synthesized
cttataacttggaggtaaac

SEQ ID NO: 11894 - DNA, 20 bp, Artificial Sequence
  chemically synthesized
tcttataacttggaggtaaa

SEQ ID NO: 11895 - DNA, 20 bp, Artificial Sequence
  chemically synthesized
ggaaaggcctgtttacctcc

SEQ ID NO: 11896 - DNA, 20 bp, Artificial Sequence
  chemically synthesized
agaaaattcttataacttgg

SEQ ID NO: 11897 - DNA, 20 bp, Artificial Sequence
  chemically synthesized
aagaaaattcttataacttg

SEQ ID NO: 11898 - DNA, 20 bp, Artificial Sequence
  chemically synthesized
cctgtttacctccaagttat

SEQ ID NO: 11899 - DNA, 20 bp, Artificial Sequence
  chemically synthesized
agaagaaaattcttataact

SEQ ID NO: 11900 - DNA, 20 bp, Artificial Sequence
  chemically synthesized
tagcctgtcattacggacag

SEQ ID NO: 11901 - DNA, 20 bp, Artificial Sequence
  chemically synthesized
ctttagcctgtcattacgga

SEQ ID NO: 11902 - DNA, 20 bp, Artificial Sequence
  chemically synthesized
ttttcttctgtccgtaatga

SEQ ID NO: 11903 - DNA, 20 bp, Artificial Sequence
  chemically synthesized
tttcttctgtccgtaatgac

SEQ ID NO: 11904 - DNA, 20 bp, Artificial Sequence
  chemically synthesized
tgagctttagcctgtcatta

SEQ ID NO: 11905 - DNA, 20 bp, Artificial Sequence
  chemically synthesized
ctgtccgtaatgacaggcta

SEQ ID NO: 11906 - DNA, 20 bp, Artificial Sequence
  chemically synthesized
taaccagaaacaatgagctt

SEQ ID NO: 11907 - DNA, 20 bp, Artificial Sequence
  chemically synthesized
gatatctaaccagaaacaat

SEQ ID NO: 11908 - DNA, 20 bp, Artificial Sequence
  chemically synthesized
aggctaaagctcattgtttc

SEQ ID NO: 11909 - DNA, 20 bp, Artificial Sequence
  chemically synthesized
taaagctcattgtttctggt

SEQ ID NO: 11910 - DNA, 20 bp, Artificial Sequence
  chemically synthesized
tcatcttaatgatatctaac

SEQ ID NO: 11911 - DNA, 20 bp, Artificial Sequence
  chemically synthesized
gtttctggttagatatcatt

SEQ ID NO: 11912 - DNA, 20 bp, Artificial Sequence
  chemically synthesized
gggtatggagaggagaatat

SEQ ID NO: 11913 - DNA, 20 bp, Artificial Sequence
  chemically synthesized
acttaagtgggtatggagag

SEQ ID NO: 11914 - DNA, 20 bp, Artificial Sequence
  chemically synthesized
caacttaagtgggtatggag

SEQ ID NO: 11915 - DNA, 20 bp, Artificial Sequence
  chemically synthesized
tcaacttaagtgggtatgga

SEQ ID NO: 11916 - DNA, 20 bp, Artificial Sequence
  chemically synthesized
tttcaacttaagtgggtatg

SEQ ID NO: 11917 - DNA, 20 bp, Artificial Sequence
  chemically synthesized
tttttcaacttaagtgggta

SEQ ID NO: 11918 - DNA, 20 bp, Artificial Sequence
  chemically synthesized
tctcctctccatacccactt

SEQ ID NO: 11919 - DNA, 20 bp, Artificial Sequence
  chemically synthesized
tgatatttttcaacttaagt

SEQ ID NO: 11920 - DNA, 20 bp, Artificial Sequence
  chemically synthesized
ctgatatttttcaacttaag

SEQ ID NO: 11921 - DNA, 20 bp, Artificial Sequence
  chemically synthesized
tttctgatatttttcaactt

SEQ ID NO: 11922 - DNA, 20 bp, Artificial Sequence
  chemically synthesized
ccacttaagttgaaaaatat

SEQ ID NO: 11923 - DNA, 20 bp, Artificial Sequence
  chemically synthesized
gttgaaaaatatcagaaatt

SEQ ID NO: 11924 - DNA, 20 bp, Artificial Sequence
  chemically synthesized
ttgaaaaatatcagaaattt

SEQ ID NO: 11925 - DNA, 20 bp, Artificial Sequence
  chemically synthesized
aatatcagaaatttaggaaa

SEQ ID NO: 11926 - DNA, 20 bp, Artificial Sequence
  chemically synthesized
caaaaataattcaaatgaga

SEQ ID NO: 11927 - DNA, 20 bp, Artificial Sequence
  chemically synthesized
acaaaaataattcaaatgag

SEQ ID NO: 11928 - DNA, 20 bp, Artificial Sequence
  chemically synthesized
taaacaaaaataattcaaat

SEQ ID NO: 11929 - DNA, 20 bp, Artificial Sequence
  chemically synthesized
ttgaattatttttgtttatc

SEQ ID NO: 11930 - DNA, 20 bp, Artificial Sequence
  chemically synthesized
attatttttgtttatcaagc

SEQ ID NO: 11931 - DNA, 20 bp, Artificial Sequence
  chemically synthesized
tgtttatcaagccagttacc

SEQ ID NO: 11932 - DNA, 20 bp, Artificial Sequence
  chemically synthesized
tcacatctaaaccaggtaac

SEQ ID NO: 11933 - DNA, 20 bp, Artificial Sequence
  chemically synthesized
atcaagccagttacctggtt

SEQ ID NO: 11934 - DNA, 20 bp, Artificial Sequence
  chemically synthesized
cagcttttcacatctaaacc

SEQ ID NO: 11935 - DNA, 20 bp, Artificial Sequence
  chemically synthesized
tcagcttttcacatctaaac

SEQ ID NO: 11936 - DNA, 20 bp, Artificial Sequence
  chemically synthesized
ttacctggtttagatgtgaa

SEQ ID NO: 11937 - DNA, 20 bp, Artificial Sequence
  chemically synthesized
acccaataattatttttagt

SEQ ID NO: 11938 - DNA, 20 bp, Artificial Sequence
  chemically synthesized
taatacccaataattatttt

SEQ ID NO: 11939 - DNA, 20 bp, Artificial Sequence
  chemically synthesized
agctgactaaaaataattat

SEQ ID NO: 11940 - DNA, 20 bp, Artificial Sequence
  chemically synthesized
gctgactaaaaataattatt

SEQ ID NO: 11941 - DNA, 20 bp, Artificial Sequence
  chemically synthesized
ggtattaaaaacacacattt

SEQ ID NO: 11942 - DNA, 20 bp, Artificial Sequence
  chemically synthesized
taaaaacacacatttaagtg

SEQ ID NO: 11943 - DNA, 20 bp, Artificial Sequence
  chemically synthesized
ggggaagtggtttggtggat

SEQ ID NO: 11944 - DNA, 20 bp, Artificial Sequence
  chemically synthesized
ggtttggggaagtggtttgg

SEQ ID NO: 11945 - DNA, 20 bp, Artificial Sequence
  chemically synthesized
gcaggtttggggaagtggtt

SEQ ID NO: 11946 - DNA, 20 bp, Artificial Sequence
  chemically synthesized
taggggcaggtttggggaag

SEQ ID NO: 11947 - DNA, 20 bp, Artificial Sequence
  chemically synthesized
ttttaggggcaggtttgggg

SEQ ID NO: 11948 - DNA, 20 bp, Artificial Sequence
  chemically synthesized
gcattttaggggcaggtttg

SEQ ID NO: 11949 - DNA, 20 bp, Artificial Sequence
  chemically synthesized
ggcattttaggggcaggttt

SEQ ID NO: 11950 - DNA, 20 bp, Artificial Sequence
  chemically synthesized
tggcattttaggggcaggtt

SEQ ID NO: 11951 - DNA, 20 bp, Artificial Sequence
  chemically synthesized
actcatggcattttaggggc

SEQ ID NO: 11952 - DNA, 20 bp, Artificial Sequence
  chemically synthesized
aactcatggcattttagggg

SEQ ID NO: 11953 - DNA, 20 bp, Artificial Sequence
  chemically synthesized
aaaaactcatggcattttag

SEQ ID NO: 11954 - DNA, 20 bp, Artificial Sequence
  chemically synthesized
caaaaactcatggcatttta

SEQ ID NO: 11955 - DNA, 20 bp, Artificial Sequence
  chemically synthesized
gcaaaaactcatggcatttt

SEQ ID NO: 11956 - DNA, 20 bp, Artificial Sequence
  chemically synthesized
ggcaaaaactcatggcattt

SEQ ID NO: 11957 - DNA, 20 bp, Artificial Sequence
  chemically synthesized
acctgcccctaaaatgccat

SEQ ID NO: 11958 - DNA, 20 bp, Artificial Sequence
  chemically synthesized
tgttggatggcaaaaactca

SEQ ID NO: 11959 - DNA, 20 bp, Artificial Sequence
  chemically synthesized
cattttgactcaatgttgga

SEQ ID NO: 11960 - DNA, 20 bp, Artificial Sequence
  chemically synthesized
agtttttgccatccaacatt

SEQ ID NO: 11961 - DNA, 20 bp, Artificial Sequence
  chemically synthesized
aatccattttgactcaatgt

SEQ ID NO: 11962 - DNA, 20 bp, Artificial Sequence
  chemically synthesized
catccaacattgagtcaaaa

SEQ ID NO: 11963 - DNA, 20 bp, Artificial Sequence
  chemically synthesized
caaaatggattttatgtcct

SEQ ID NO: 11964 - DNA, 20 bp, Artificial Sequence
  chemically synthesized
ggattttatgtcctcagaat

SEQ ID NO: 11965 - DNA, 20 bp, Artificial Sequence
  chemically synthesized
ataagctttagcttattctg

SEQ ID NO: 11966 - DNA, 20 bp, Artificial Sequence
  chemically synthesized
aataagctttagcttattct

SEQ ID NO: 11967 - DNA, 20 bp, Artificial Sequence
  chemically synthesized
tatgtcctcagaataagcta

SEQ ID NO: 11968 - DNA, 20 bp, Artificial Sequence
  chemically synthesized
ttttattttaaaataagctt

SEQ ID NO: 11969 - DNA, 20 bp, Artificial Sequence
  chemically synthesized
cttttgttttattttaaaat

SEQ ID NO: 11970 - DNA, 20 bp, Artificial Sequence
  chemically synthesized
cttattttaaaataaaacaa

SEQ ID NO: 11971 - DNA, 20 bp, Artificial Sequence
  chemically synthesized
attttaaaataaaacaaaag

SEQ ID NO: 11972 - DNA, 20 bp, Artificial Sequence
  chemically synthesized
aatgagtgtgataaattagg

SEQ ID NO: 11973 - DNA, 20 bp, Artificial Sequence
  chemically synthesized
tggaatgagtgtgataaatt

SEQ ID NO: 11974 - DNA, 20 bp, Artificial Sequence
  chemically synthesized
ttggaatgagtgtgataaat

SEQ ID NO: 11975 - DNA, 20 bp, Artificial Sequence
  chemically synthesized
acaacttcagaatttggaat

SEQ ID NO: 11976 - DNA, 20 bp, Artificial Sequence
  chemically synthesized
cacactcattccaaattctg

SEQ ID NO: 11977 - DNA, 20 bp, Artificial Sequence
  chemically synthesized
agcagtacaacttcagaatt

SEQ ID NO: 11978 - DNA, 20 bp, Artificial Sequence
  chemically synthesized
aagttctagcagtacaactt

SEQ ID NO: 11979 - DNA, 20 bp, Artificial Sequence
  chemically synthesized
aaattctgaagttgtactgc

SEQ ID NO: 11980 - DNA, 20 bp, Artificial Sequence
  chemically synthesized
ttaaacatgggaagttctag

SEQ ID NO: 11981 - DNA, 20 bp, Artificial Sequence
  chemically synthesized
taattaaacatgggaagttc

SEQ ID NO: 11982 - DNA, 20 bp, Artificial Sequence
  chemically synthesized
aggttataattaaacatggg

SEQ ID NO: 11983 - DNA, 20 bp, Artificial Sequence
  chemically synthesized
tctaggttataattaaacat

SEQ ID NO: 11984 - DNA, 20 bp, Artificial Sequence
  chemically synthesized
ctctaggttataattaaaca

SEQ ID NO: 11985 - DNA, 20 bp, Artificial Sequence
  chemically synthesized
tcccatgtttaattataacc

SEQ ID NO: 11986 - DNA, 20 bp, Artificial Sequence
  chemically synthesized
ccatgtttaattataaccta

SEQ ID NO: 11987 - DNA, 20 bp, Artificial Sequence
  chemically synthesized
aaaagtgtagttacaactct

SEQ ID NO: 11988 - DNA, 20 bp, Artificial Sequence
  chemically synthesized
gaaaagtgtagttacaactc

SEQ ID NO: 11989 - DNA, 20 bp, Artificial Sequence
  chemically synthesized
agagaacaggaagaaaagtg

SEQ ID NO: 11990 - DNA, 20 bp, Artificial Sequence
  chemically synthesized
gcctaagagaacaggaagaa

SEQ ID NO: 11991 - DNA, 20 bp, Artificial Sequence
  chemically synthesized
tgactgcctaagagaacagg

SEQ ID NO: 11992 - DNA, 20 bp, Artificial Sequence
  chemically synthesized
cacttttcttcctgttctct

SEQ ID NO: 11993 - DNA, 20 bp, Artificial Sequence
  chemically synthesized
cattgactgcctaagagaac

SEQ ID NO: 11994 - DNA, 20 bp, Artificial Sequence
  chemically synthesized
acttttcttcctgttctctt

SEQ ID NO: 11995 - DNA, 20 bp, Artificial Sequence
  chemically synthesized
tcattgactgcctaagagaa

SEQ ID NO: 11996 - DNA, 20 bp, Artificial Sequence
  chemically synthesized
tttcttcctgttctcttagg

SEQ ID NO: 11997 - DNA, 20 bp, Artificial Sequence
  chemically synthesized
gtcattcattgactgcctaa

SEQ ID NO: 11998 - DNA, 20 bp, Artificial Sequence
  chemically synthesized
ctgtcattcattgactgcct

SEQ ID NO: 11999 - DNA, 20 bp, Artificial Sequence
  chemically synthesized
cttaggcagtcaatgaatga

SEQ ID NO: 12000 - DNA, 20 bp, Artificial Sequence
  chemically synthesized
gagttgtatctacgtaacag

SEQ ID NO: 12001 - DNA, 20 bp, Artificial Sequence
  chemically synthesized
gaatgacagccactgttacg

SEQ ID NO: 12002 - DNA, 20 bp, Artificial Sequence
  chemically synthesized
ttcgagttgtatctacgtaa

SEQ ID NO: 12003 - DNA, 20 bp, Artificial Sequence
  chemically synthesized
tagcacattcagattaattc

SEQ ID NO: 12004 - DNA, 20 bp, Artificial Sequence
  chemically synthesized
tcgaattaatctgaatgtgc

SEQ ID NO: 12005 - DNA, 20 bp, Artificial Sequence
  chemically synthesized
attagaagctctagcacatt

SEQ ID NO: 12006 - DNA, 20 bp, Artificial Sequence
  chemically synthesized
gaattaatctgaatgtgcta

SEQ ID NO: 12007 - DNA, 20 bp, Artificial Sequence
  chemically synthesized
gattttggtattagaagctc

SEQ ID NO: 12008 - DNA, 20 bp, Artificial Sequence
  chemically synthesized
ctcactgattttggtattag

SEQ ID NO: 12009 - DNA, 20 bp, Artificial Sequence
  chemically synthesized
tggctcactgattttggtat

SEQ ID NO: 12010 - DNA, 20 bp, Artificial Sequence
  chemically synthesized
agagcttctaataccaaaat

SEQ ID NO: 12011 - DNA, 20 bp, Artificial Sequence
  chemically synthesized
cttctttggctcactgattt

SEQ ID NO: 12012 - DNA, 20 bp, Artificial Sequence
  chemically synthesized
cttctaataccaaaatcagt

SEQ ID NO: 12013 - DNA, 20 bp, Artificial Sequence
  chemically synthesized
ataccaaaatcagtgagcca

SEQ ID NO: 12014 - DNA, 20 bp, Artificial Sequence
  chemically synthesized
ccaaaatcagtgagccaaag

SEQ ID NO: 12015 - DNA, 20 bp, Artificial Sequence
  chemically synthesized
gtaaatagcttgtgcttctt

SEQ ID NO: 12016 - DNA, 20 bp, Artificial Sequence
  chemically synthesized
tcagtgagccaaagaagcac

SEQ ID NO: 12017 - DNA, 20 bp, Artificial Sequence
  chemically synthesized
aagaatcagccaaatgtaaa

SEQ ID NO: 12018 - DNA, 20 bp, Artificial Sequence
  chemically synthesized
aagcacaagctatttacatt

SEQ ID NO: 12019 - DNA, 20 bp, Artificial Sequence
  chemically synthesized
tttacatttggctgattctt

SEQ ID NO: 12020 - DNA, 20 bp, Artificial Sequence
  chemically synthesized
aaaatgtgtggccaaagaat

SEQ ID NO: 12021 - DNA, 20 bp, Artificial Sequence
  chemically synthesized
aacagtaaaatgtgtggcca

SEQ ID NO: 12022 - DNA, 20 bp, Artificial Sequence
  chemically synthesized
tacttcaacagtaaaatgtg

SEQ ID NO: 12023 - DNA, 20 bp, Artificial Sequence
  chemically synthesized
ggccacacattttactgttg

SEQ ID NO: 12024 - DNA, 20 bp, Artificial Sequence
  chemically synthesized
taatatataagatacttcaa

SEQ ID NO: 12025 - DNA, 20 bp, Artificial Sequence
  chemically synthesized
tgttgaagtatcttatatat

SEQ ID NO: 12026 - DNA, 20 bp, Artificial Sequence
  chemically synthesized
tattaatggtactaatatat

SEQ ID NO: 12027 - DNA, 20 bp, Artificial Sequence
  chemically synthesized
gctatgggaaaaagtattaa

SEQ ID NO: 12028 - DNA, 20 bp, Artificial Sequence
  chemically synthesized
accattaatactttttccca

SEQ ID NO: 12029 - DNA, 20 bp, Artificial Sequence
  chemically synthesized
tctttcttagctatgggaaa

SEQ ID NO: 12030 - DNA, 20 bp, Artificial Sequence
  chemically synthesized
taatactttttcccatagct

SEQ ID NO: 12031 - DNA, 20 bp, Artificial Sequence
  chemically synthesized
gccttatctttcttagctat

SEQ ID NO: 12032 - DNA, 20 bp, Artificial Sequence
  chemically synthesized
tgccttatctttcttagcta

SEQ ID NO: 12033 - DNA, 20 bp, Artificial Sequence
  chemically synthesized
actttttcccatagctaaga

SEQ ID NO: 12034 - DNA, 20 bp, Artificial Sequence
  chemically synthesized
ctgtgatgccttatctttct

SEQ ID NO: 12035 - DNA, 20 bp, Artificial Sequence
  chemically synthesized
ttcccatagctaagaaagat

SEQ ID NO: 12036 - DNA, 20 bp, Artificial Sequence
  chemically synthesized
tcccatagctaagaaagata

SEQ ID NO: 12037 - DNA, 20 bp, Artificial Sequence
  chemically synthesized
ctaagaaagataaggcatca

SEQ ID NO: 12038 - DNA, 20 bp, Artificial Sequence
  chemically synthesized
aagataaggcatcacagtta

SEQ ID NO: 12039 - DNA, 20 bp, Artificial Sequence
  chemically synthesized
taaggcatcacagttatggt

SEQ ID NO: 12040 - DNA, 20 bp, Artificial Sequence
  chemically synthesized
aaggcatcacagttatggtt

SEQ ID NO: 12041 - DNA, 20 bp, Artificial Sequence
  chemically synthesized
aggcatcacagttatggttg

SEQ ID NO: 12042 - DNA, 20 bp, Artificial Sequence
  chemically synthesized
atcacagttatggttgggga

SEQ ID NO: 12043 - DNA, 20 bp, Artificial Sequence
  chemically synthesized
tcacagttatggttggggaa

SEQ ID NO: 12044 - DNA, 20 bp, Artificial Sequence
  chemically synthesized
cttcaaacaaacaaacaaaa

SEQ ID NO: 12045 - DNA, 20 bp, Artificial Sequence
  chemically synthesized
cttttttgtttgtttgtttg

SEQ ID NO: 12046 - DNA, 20 bp, Artificial Sequence
  chemically synthesized
ttttttgtttgtttgtttga

SEQ ID NO: 12047 - DNA, 20 bp, Artificial Sequence
  chemically synthesized
tttgtttgtttgtttgaagg

SEQ ID NO: 12048 - DNA, 20 bp, Artificial Sequence
  chemically synthesized
tttgtttgtttgaaggaagt

SEQ ID NO: 12049 - DNA, 20 bp, Artificial Sequence
  chemically synthesized
taagtcatatacaaatgact

SEQ ID NO: 12050 - DNA, 20 bp, Artificial Sequence
  chemically synthesized
aagtcatatacaaatgactg

SEQ ID NO: 12051 - DNA, 20 bp, Artificial Sequence
  chemically synthesized
agtcatatacaaatgactga

SEQ ID NO: 12052 - DNA, 20 bp, Artificial Sequence
  chemically synthesized
taaagaatcaagtcaaccct

SEQ ID NO: 12053 - DNA, 20 bp, Artificial Sequence
  chemically synthesized
caagctaataataaagaatc

SEQ ID NO: 12054 - DNA, 20 bp, Artificial Sequence
  chemically synthesized
ttgacttgattctttattat

SEQ ID NO: 12055 - DNA, 20 bp, Artificial Sequence
  chemically synthesized
aaacgatcaagctaataata

SEQ ID NO: 12056 - DNA, 20 bp, Artificial Sequence
  chemically synthesized
catctggtacataaacgatc

SEQ ID NO: 12057 - DNA, 20 bp, Artificial Sequence
  chemically synthesized
tagcttgatcgtttatgtac

SEQ ID NO: 12058 - DNA, 20 bp, Artificial Sequence
  chemically synthesized
tgatcgtttatgtaccagat

SEQ ID NO: 12059 - DNA, 20 bp, Artificial Sequence
  chemically synthesized
tgagaataaataatctcatc

SEQ ID NO: 12060 - DNA, 20 bp, Artificial Sequence
  chemically synthesized
taactagttattgaagacat

SEQ ID NO: 12061 - DNA, 20 bp, Artificial Sequence
  chemically synthesized
attctcatgtcttcaataac

SEQ ID NO: 12062 - DNA, 20 bp, Artificial Sequence
  chemically synthesized
atatatataactagttattg

SEQ ID NO: 12063 - DNA, 20 bp, Artificial Sequence
  chemically synthesized
caaagtggcatatatataac

SEQ ID NO: 12064 - DNA, 20 bp, Artificial Sequence
  chemically synthesized
caaaagaaatagtatcaaag

SEQ ID NO: 12065 - DNA, 20 bp, Artificial Sequence
  chemically synthesized
ggccaaaagaaatagtatca

SEQ ID NO: 12066 - DNA, 20 bp, Artificial Sequence
  chemically synthesized
cactttgatactatttcttt

SEQ ID NO: 12067 - DNA, 20 bp, Artificial Sequence
  chemically synthesized
aaggattaggccaaaagaaa

SEQ ID NO: 12068 - DNA, 20 bp, Artificial Sequence
  chemically synthesized
cttcataaggattaggccaa

SEQ ID NO: 12069 - DNA, 20 bp, Artificial Sequence
  chemically synthesized
aaagaaccttcataaggatt

SEQ ID NO: 12070 - DNA, 20 bp, Artificial Sequence
  chemically synthesized
aaaagaaccttcataaggat

SEQ ID NO: 12071 - DNA, 20 bp, Artificial Sequence
  chemically synthesized
cttttggcctaatccttatg

SEQ ID NO: 12072 - DNA, 20 bp, Artificial Sequence
  chemically synthesized
ttttggcctaatccttatga

SEQ ID NO: 12073 - DNA, 20 bp, Artificial Sequence
  chemically synthesized
atgagaaaagaaccttcata

SEQ ID NO: 12074 - DNA, 20 bp, Artificial Sequence
  chemically synthesized
gatgagaaaagaaccttcat

SEQ ID NO: 12075 - DNA, 20 bp, Artificial Sequence
  chemically synthesized
aagtcatgctcagatgagaa

SEQ ID NO: 12076 - DNA, 20 bp, Artificial Sequence
  chemically synthesized
tgaaggttcttttctcatct

SEQ ID NO: 12077 - DNA, 20 bp, Artificial Sequence
  chemically synthesized
acacaaagtcatgctcagat

SEQ ID NO: 12078 - DNA, 20 bp, Artificial Sequence
  chemically synthesized
tggcaacacaaagtcatgct

SEQ ID NO: 12079 - DNA, 20 bp, Artificial Sequence
  chemically synthesized
gtagttggtgtggcaacaca

SEQ ID NO: 12080 - DNA, 20 bp, Artificial Sequence
  chemically synthesized
tttatcatatgtagttggtg

SEQ ID NO: 12081 - DNA, 20 bp, Artificial Sequence
  chemically synthesized
gtaaatttatcatatgtagt

SEQ ID NO: 12082 - DNA, 20 bp, Artificial Sequence
  chemically synthesized
aatggtaaatttatcatatg

SEQ ID NO: 12083 - DNA, 20 bp, Artificial Sequence
  chemically synthesized
aatatagacaaagggaagaa

SEQ ID NO: 12084 - DNA, 20 bp, Artificial Sequence
  chemically synthesized
tggagaatatagacaaaggg

SEQ ID NO: 12085 - DNA, 20 bp, Artificial Sequence
  chemically synthesized
tcttggagaatatagacaaa

SEQ ID NO: 12086 - DNA, 20 bp, Artificial Sequence
  chemically synthesized
atcttggagaatatagacaa

SEQ ID NO: 12087 - DNA, 20 bp, Artificial Sequence
  chemically synthesized
catcttggagaatatagaca

SEQ ID NO: 12088 - DNA, 20 bp, Artificial Sequence
  chemically synthesized
ctcacccatcttggagaata

SEQ ID NO: 12089 - DNA, 20 bp, Artificial Sequence
  chemically synthesized
tccctttgtctatattctcc

SEQ ID NO: 12090 - DNA, 20 bp, Artificial Sequence
  chemically synthesized
tttgtctatattctccaaga

SEQ ID NO: 12091 - DNA, 20 bp, Artificial Sequence
  chemically synthesized
ttgtctatattctccaagat

SEQ ID NO: 12092 - DNA, 20 bp, Artificial Sequence
  chemically synthesized
aggatatctcacccatcttg

SEQ ID NO: 12093 - DNA, 20 bp, Artificial Sequence
  chemically synthesized
taaggatatctcacccatct

SEQ ID NO: 12094 - DNA, 20 bp, Artificial Sequence
  chemically synthesized
ctatattctccaagatgggt

SEQ ID NO: 12095 - DNA, 20 bp, Artificial Sequence
  chemically synthesized
ctttttagtttgataaagta

SEQ ID NO: 12096 - DNA, 20 bp, Artificial Sequence
  chemically synthesized
cctttttagtttgataaagt

SEQ ID NO: 12097 - DNA, 20 bp, Artificial Sequence
  chemically synthesized
gatgcctttttagtttgata

SEQ ID NO: 12098 - DNA, 20 bp, Artificial Sequence
  chemically synthesized
ccttactttatcaaactaaa

SEQ ID NO: 12099 - DNA, 20 bp, Artificial Sequence
  chemically synthesized
cttactttatcaaactaaaa

SEQ ID NO: 12100 - DNA, 20 bp, Artificial Sequence
  chemically synthesized
aaagtattacgatgcctttt

SEQ ID NO: 12101 - DNA, 20 bp, Artificial Sequence
  chemically synthesized
aggcatcgtaatactttgac

SEQ ID NO: 12102 - DNA, 20 bp, Artificial Sequence
  chemically synthesized
aaagagaagaaatctagtca

SEQ ID NO: 12103 - DNA, 20 bp, Artificial Sequence
  chemically synthesized
taacataaagagaagaaatc

SEQ ID NO: 12104 - DNA, 20 bp, Artificial Sequence
  chemically synthesized
tgaataaataacataaagag

SEQ ID NO: 12105 - DNA, 20 bp, Artificial Sequence
  chemically synthesized
aagtgaataaataacataaa

SEQ ID NO: 12106 - DNA, 20 bp, Artificial Sequence
  chemically synthesized
ccaagtgaataaataacata

SEQ ID NO: 12107 - DNA, 20 bp, Artificial Sequence
  chemically synthesized
ctttatgttatttattcact

SEQ ID NO: 12108 - DNA, 20 bp, Artificial Sequence
  chemically synthesized
ggaaaaaataaggatttgcc

SEQ ID NO: 12109 - DNA, 20 bp, Artificial Sequence
  chemically synthesized
caaatatgaaggaaaaaata

SEQ ID NO: 12110 - DNA, 20 bp, Artificial Sequence
  chemically synthesized
gcaaatatgaaggaaaaaat

SEQ ID NO: 12111 - DNA, 20 bp, Artificial Sequence
  chemically synthesized
agacattgaagcaaatatga

SEQ ID NO: 12112 - DNA, 20 bp, Artificial Sequence
  chemically synthesized
cagacattgaagcaaatatg

SEQ ID NO: 12113 - DNA, 20 bp, Artificial Sequence
  chemically synthesized
ggtagagagagcagacattg

SEQ ID NO: 12114 - DNA, 20 bp, Artificial Sequence
  chemically synthesized
ggggcttgaggtagagagag

SEQ ID NO: 12115 - DNA, 20 bp, Artificial Sequence
  chemically synthesized
accggggcttgaggtagaga

SEQ ID NO: 12116 - DNA, 20 bp, Artificial Sequence
  chemically synthesized
tgaccggggcttgaggtaga

SEQ ID NO: 12117 - DNA, 20 bp, Artificial Sequence
  chemically synthesized
atgtctgctctctctacctc

SEQ ID NO: 12118 - DNA, 20 bp, Artificial Sequence
  chemically synthesized
gctgaccggggcttgaggta

SEQ ID NO: 12119 - DNA, 20 bp, Artificial Sequence
  chemically synthesized
atgctgaccggggcttgagg

SEQ ID NO: 12120 - DNA, 20 bp, Artificial Sequence
  chemically synthesized
gctctctctacctcaagccc

SEQ ID NO: 12121 - DNA, 20 bp, Artificial Sequence
  chemically synthesized
taaatgctgaccggggcttg

SEQ ID NO: 12122 - DNA, 20 bp, Artificial Sequence
  chemically synthesized
gtaaatgctgaccggggctt

SEQ ID NO: 12123 - DNA, 20 bp, Artificial Sequence
  chemically synthesized
tctctacctcaagccccggt

SEQ ID NO: 12124 - DNA, 20 bp, Artificial Sequence
  chemically synthesized
aaccaagtaaatgctgaccg

SEQ ID NO: 12125 - DNA, 20 bp, Artificial Sequence
  chemically synthesized
gaaccaagtaaatgctgacc

SEQ ID NO: 12126 - DNA, 20 bp, Artificial Sequence
  chemically synthesized
tgaaccaagtaaatgctgac

SEQ ID NO: 12127 - DNA, 20 bp, Artificial Sequence
  chemically synthesized
agccccggtcagcatttact

SEQ ID NO: 12128 - DNA, 20 bp, Artificial Sequence
  chemically synthesized
gtcagcatttacttggttca

SEQ ID NO: 12129 - DNA, 20 bp, Artificial Sequence
  chemically synthesized
aaggaacattgccatgaacc

SEQ ID NO: 12130 - DNA, 20 bp, Artificial Sequence
  chemically synthesized
gttcacaatacagagcacaa

SEQ ID NO: 12131 - DNA, 20 bp, Artificial Sequence
  chemically synthesized
tgttcacaatacagagcaca

SEQ ID NO: 12132 - DNA, 20 bp, Artificial Sequence
  chemically synthesized
agggcagtgttcacaataca

SEQ ID NO: 12133 - DNA, 20 bp, Artificial Sequence
  chemically synthesized
tgagggcagtgttcacaata

SEQ ID NO: 12134 - DNA, 20 bp, Artificial Sequence
  chemically synthesized
gcttcattatagagtgaggg

SEQ ID NO: 12135 - DNA, 20 bp, Artificial Sequence
  chemically synthesized
caggcttcattatagagtga

SEQ ID NO: 12136 - DNA, 20 bp, Artificial Sequence
  chemically synthesized
acaggcttcattatagagtg

SEQ ID NO: 12137 - DNA, 20 bp, Artificial Sequence
  chemically synthesized
aacaggcttcattatagagt

SEQ ID NO: 12138 - DNA, 20 bp, Artificial Sequence
  chemically synthesized
actgccctcactctataatg

SEQ ID NO: 12139 - DNA, 20 bp, Artificial Sequence
  chemically synthesized
gggaaacaggcttcattata

SEQ ID NO: 12140 - DNA, 20 bp, Artificial Sequence
  chemically synthesized
cagggaaacaggcttcatta

SEQ ID NO: 12141 - DNA, 20 bp, Artificial Sequence
  chemically synthesized
cacagctatggcagggaaac

SEQ ID NO: 12142 - DNA, 20 bp, Artificial Sequence
  chemically synthesized
acacagctatggcagggaaa

SEQ ID NO: 12143 - DNA, 20 bp, Artificial Sequence
  chemically synthesized
tgaagcctgtttccctgcca

SEQ ID NO: 12144 - DNA, 20 bp, Artificial Sequence
  chemically synthesized
cagggaacacagctatggca

SEQ ID NO: 12145 - DNA, 20 bp, Artificial Sequence
  chemically synthesized
gcagggaacacagctatggc

SEQ ID NO: 12146 - DNA, 20 bp, Artificial Sequence
  chemically synthesized
agcagggaacacagctatgg

SEQ ID NO: 12147 - DNA, 20 bp, Artificial Sequence
  chemically synthesized
agcagcagggaacacagcta

SEQ ID NO: 12148 - DNA, 20 bp, Artificial Sequence
  chemically synthesized
gctaagagcagcagggaaca

SEQ ID NO: 12149 - DNA, 20 bp, Artificial Sequence
  chemically synthesized
gagcggtgctaagagcagca

SEQ ID NO: 12150 - DNA, 20 bp, Artificial Sequence
  chemically synthesized
agagcggtgctaagagcagc

SEQ ID NO: 12151 - DNA, 20 bp, Artificial Sequence
  chemically synthesized
gctgtgttccctgctgctct

SEQ ID NO: 12152 - DNA, 20 bp, Artificial Sequence
  chemically synthesized
tagagcggtgctaagagcag

SEQ ID NO: 12153 - DNA, 20 bp, Artificial Sequence
  chemically synthesized
agatagagcggtgctaagag

SEQ ID NO: 12154 - DNA, 20 bp, Artificial Sequence
  chemically synthesized
cggagatagagcggtgctaa

SEQ ID NO: 12155 - DNA, 20 bp, Artificial Sequence
  chemically synthesized
gacggagatagagcggtgct

SEQ ID NO: 12156 - DNA, 20 bp, Artificial Sequence
  chemically synthesized
ctttaaggacggagatagag

SEQ ID NO: 12157 - DNA, 20 bp, Artificial Sequence
  chemically synthesized
aaactttaaggacggagata

SEQ ID NO: 12158 - DNA, 20 bp, Artificial Sequence
  chemically synthesized
ttaaactttaaggacggaga

SEQ ID NO: 12159 - DNA, 20 bp, Artificial Sequence
  chemically synthesized
cctgttaaactttaaggacg

SEQ ID NO: 12160 - DNA, 20 bp, Artificial Sequence
  chemically synthesized
ccgctctatctccgtcctta

SEQ ID NO: 12161 - DNA, 20 bp, Artificial Sequence
  chemically synthesized
accctgttaaactttaagga

SEQ ID NO: 12162 - DNA, 20 bp, Artificial Sequence
  chemically synthesized
gccaaccctgttaaacttta

SEQ ID NO: 12163 - DNA, 20 bp, Artificial Sequence
  chemically synthesized
agccaaccctgttaaacttt

SEQ ID NO: 12164 - DNA, 20 bp, Artificial Sequence
  chemically synthesized
tctccgtccttaaagtttaa

SEQ ID NO: 12165 - DNA, 20 bp, Artificial Sequence
  chemically synthesized
ctccgtccttaaagtttaac

SEQ ID NO: 12166 - DNA, 20 bp, Artificial Sequence
  chemically synthesized
tccgtccttaaagtttaaca

SEQ ID NO: 12167 - DNA, 20 bp, Artificial Sequence
  chemically synthesized
tccttaaagtttaacagggt

SEQ ID NO: 12168 - DNA, 20 bp, Artificial Sequence
  chemically synthesized
caggttgttagcaggatgat

SEQ ID NO: 12169 - DNA, 20 bp, Artificial Sequence
  chemically synthesized
tcaggttgcaggttgttagc

SEQ ID NO: 12170 - DNA, 20 bp, Artificial Sequence
  chemically synthesized
ttcaggttgcaggttgttag

SEQ ID NO: 12171 - DNA, 20 bp, Artificial Sequence
  chemically synthesized
caattcaggttgcaggttgt

SEQ ID NO: 12172 - DNA, 20 bp, Artificial Sequence
  chemically synthesized
gaagtaccaattcaggttgc

SEQ ID NO: 12173 - DNA, 20 bp, Artificial Sequence
  chemically synthesized
agaagtaccaattcaggttg

SEQ ID NO: 12174 - DNA, 20 bp, Artificial Sequence
  chemically synthesized
taacaacctgcaacctgaat

SEQ ID NO: 12175 - DNA, 20 bp, Artificial Sequence
  chemically synthesized
cagaggagaagtaccaattc

SEQ ID NO: 12176 - DNA, 20 bp, Artificial Sequence
  chemically synthesized
ccagaggagaagtaccaatt

SEQ ID NO: 12177 - DNA, 20 bp, Artificial Sequence
  chemically synthesized
ctgaattggtacttctcctc

SEQ ID NO: 12178 - DNA, 20 bp, Artificial Sequence
  chemically synthesized
atgaagagtttccagaggag

SEQ ID NO: 12179 - DNA, 20 bp, Artificial Sequence
  chemically synthesized
cttatgaagagtttccagag

SEQ ID NO: 12180 - DNA, 20 bp, Artificial Sequence
  chemically synthesized
atcttatgaagagtttccag

SEQ ID NO: 12181 - DNA, 20 bp, Artificial Sequence
  chemically synthesized
aatcttatgaagagtttcca

SEQ ID NO: 12182 - DNA, 20 bp, Artificial Sequence
  chemically synthesized
gcaatcttatgaagagtttc

SEQ ID NO: 12183 - DNA, 20 bp, Artificial Sequence
  chemically synthesized
ctcctctggaaactcttcat

SEQ ID NO: 12184 - DNA, 20 bp, Artificial Sequence
  chemically synthesized
aagtgaggcaatcttatgaa

SEQ ID NO: 12185 - DNA, 20 bp, Artificial Sequence
  chemically synthesized
taaagtgaggcaatcttatg

SEQ ID NO: 12186 - DNA, 20 bp, Artificial Sequence
  chemically synthesized
ttcacaagataaataaagtg

SEQ ID NO: 12187 - DNA, 20 bp, Artificial Sequence
  chemically synthesized
cttcacaagataaataaagt

SEQ ID NO: 12188 - DNA, 20 bp, Artificial Sequence
  chemically synthesized
gcatcttcacaagataaata

SEQ ID NO: 12189 - DNA, 20 bp, Artificial Sequence
  chemically synthesized
ctcactttatttatcttgtg

SEQ ID NO: 12190 - DNA, 20 bp, Artificial Sequence
  chemically synthesized
ttgtgatttagcatcttcac

SEQ ID NO: 12191 - DNA, 20 bp, Artificial Sequence
  chemically synthesized
agaagtagatttttgtgatt

SEQ ID NO: 12192 - DNA, 20 bp, Artificial Sequence
  chemically synthesized
atcacaaaaatctacttctt

SEQ ID NO: 12193 - DNA, 20 bp, Artificial Sequence
  chemically synthesized
ccttcagaaatccaaagaag

SEQ ID NO: 12194 - DNA, 20 bp, Artificial Sequence
  chemically synthesized
tttccttcagaaatccaaag

SEQ ID NO: 12195 - DNA, 20 bp, Artificial Sequence
  chemically synthesized
cattttccttcagaaatcca

SEQ ID NO: 12196 - DNA, 20 bp, Artificial Sequence
  chemically synthesized
tctacttctttggatttctg

SEQ ID NO: 12197 - DNA, 20 bp, Artificial Sequence
  chemically synthesized
ctacttctttggatttctga

SEQ ID NO: 12198 - DNA, 20 bp, Artificial Sequence
  chemically synthesized
gttagttgggcattttcctt

SEQ ID NO: 12199 - DNA, 20 bp, Artificial Sequence
  chemically synthesized
tcacatatggtaggttagtt

SEQ ID NO: 12200 - DNA, 20 bp, Artificial Sequence
  chemically synthesized
ttcacatatggtaggttagt

SEQ ID NO: 12201 - DNA, 20 bp, Artificial Sequence
  chemically synthesized
gctattcacatatggtaggt

SEQ ID NO: 12202 - DNA, 20 bp, Artificial Sequence
  chemically synthesized
catggctattcacatatggt

SEQ ID NO: 12203 - DNA, 20 bp, Artificial Sequence
  chemically synthesized
gcatggctattcacatatgg

SEQ ID NO: 12204 - DNA, 20 bp, Artificial Sequence
  chemically synthesized
atagcatggctattcacata

SEQ ID NO: 12205 - DNA, 20 bp, Artificial Sequence
  chemically synthesized
actaacctaccatatgtgaa

SEQ ID NO: 12206 - DNA, 20 bp, Artificial Sequence
  chemically synthesized
aacgtgatcttggtatagca

SEQ ID NO: 12207 - DNA, 20 bp, Artificial Sequence
  chemically synthesized
gtgaatagccatgctatacc

SEQ ID NO: 12208 - DNA, 20 bp, Artificial Sequence
  chemically synthesized
gtggaaacgtgatcttggta

SEQ ID NO: 12209 - DNA, 20 bp, Artificial Sequence
  chemically synthesized
ggggagtggaaacgtgatct

SEQ ID NO: 12210 - DNA, 20 bp, Artificial Sequence
  chemically synthesized
ttttctccactcatggggag

SEQ ID NO: 12211 - DNA, 20 bp, Artificial Sequence
  chemically synthesized
atcacgtttccactccccat

SEQ ID NO: 12212 - DNA, 20 bp, Artificial Sequence
  chemically synthesized
ctattttctccactcatggg

SEQ ID NO: 12213 - DNA, 20 bp, Artificial Sequence
  chemically synthesized
acgtttccactccccatgag

SEQ ID NO: 12214 - DNA, 20 bp, Artificial Sequence
  chemically synthesized
tactattttctccactcatg

SEQ ID NO: 12215 - DNA, 20 bp, Artificial Sequence
  chemically synthesized
gtttccactccccatgagtg

SEQ ID NO: 12216 - DNA, 20 bp, Artificial Sequence
  chemically synthesized
gtactattttctccactcat

SEQ ID NO: 12217 - DNA, 20 bp, Artificial Sequence
  chemically synthesized
agtactattttctccactca

SEQ ID NO: 12218 - DNA, 20 bp, Artificial Sequence
  chemically synthesized
ctccccatgagtggagaaaa

SEQ ID NO: 12219 - DNA, 20 bp, Artificial Sequence
  chemically synthesized
tgagtggagaaaatagtact

SEQ ID NO: 12220 - DNA, 20 bp, Artificial Sequence
  chemically synthesized
ttaattttaaagtcatggct

SEQ ID NO: 12221 - DNA, 20 bp, Artificial Sequence
  chemically synthesized
ggatattaattttaaagtca

SEQ ID NO: 12222 - DNA, 20 bp, Artificial Sequence
  chemically synthesized
gggataggatattaatttta

SEQ ID NO: 12223 - DNA, 20 bp, Artificial Sequence
  chemically synthesized
tgccagatatttaaagggat

SEQ ID NO: 12224 - DNA, 20 bp, Artificial Sequence
  chemically synthesized
ctgccagatatttaaaggga

SEQ ID NO: 12225 - DNA, 20 bp, Artificial Sequence
  chemically synthesized
aaacctgccagatatttaaa

SEQ ID NO: 12226 - DNA, 20 bp, Artificial Sequence
  chemically synthesized
caaacctgccagatatttaa

SEQ ID NO: 12227 - DNA, 20 bp, Artificial Sequence
  chemically synthesized
ccaaacctgccagatattta

SEQ ID NO: 12228 - DNA, 20 bp, Artificial Sequence
  chemically synthesized
atcctatccctttaaatatc

SEQ ID NO: 12229 - DNA, 20 bp, Artificial Sequence
  chemically synthesized
ctatccctttaaatatctgg

SEQ ID NO: 12230 - DNA, 20 bp, Artificial Sequence
  chemically synthesized
tatccctttaaatatctggc

SEQ ID NO: 12231 - DNA, 20 bp, Artificial Sequence
  chemically synthesized
ctttaaatatctggcaggtt

SEQ ID NO: 12232 - DNA, 20 bp, Artificial Sequence
  chemically synthesized
taatctttgaccaaacctgc

SEQ ID NO: 12233 - DNA, 20 bp, Artificial Sequence
  chemically synthesized
atatctggcaggtttggtca

SEQ ID NO: 12234 - DNA, 20 bp, Artificial Sequence
  chemically synthesized
ggcaggtttggtcaaagatt

SEQ ID NO: 12235 - DNA, 20 bp, Artificial Sequence
  chemically synthesized
tgcagagtcccaagtattta

SEQ ID NO: 12236 - DNA, 20 bp, Artificial Sequence
  chemically synthesized
taagcattactataaatact

SEQ ID NO: 12237 - DNA, 20 bp, Artificial Sequence
  chemically synthesized
aagcattactataaatactt

SEQ ID NO: 12238 - DNA, 20 bp, Artificial Sequence
  chemically synthesized
attacaaattgcagagtccc

SEQ ID NO: 12239 - DNA, 20 bp, Artificial Sequence
  chemically synthesized
ccatatgattacaaattgca

SEQ ID NO: 12240 - DNA, 20 bp, Artificial Sequence
  chemically synthesized
taccatatgattacaaattg

SEQ ID NO: 12241 - DNA, 20 bp, Artificial Sequence
  chemically synthesized
ctctgcaatttgtaatcata

SEQ ID NO: 12242 - DNA, 20 bp, Artificial Sequence
  chemically synthesized
gtaatcatatggtatgaaat

SEQ ID NO: 12243 - DNA, 20 bp, Artificial Sequence
  chemically synthesized
ggtatgaaataagttcaaat

SEQ ID NO: 12244 - DNA, 20 bp, Artificial Sequence
  chemically synthesized
tatgaaataagttcaaataa

SEQ ID NO: 12245 - DNA, 20 bp, Artificial Sequence
  chemically synthesized
aaataagttcaaataagagt

SEQ ID NO: 12246 - DNA, 20 bp, Artificial Sequence
  chemically synthesized
aataagttcaaataagagta

SEQ ID NO: 12247 - DNA, 20 bp, Artificial Sequence
  chemically synthesized
agtattcagagtagcaaaaa

SEQ ID NO: 12248 - DNA, 20 bp, Artificial Sequence
  chemically synthesized
ggcattattagtattcagag

SEQ ID NO: 12249 - DNA, 20 bp, Artificial Sequence
  chemically synthesized
tctggcattattagtattca

SEQ ID NO: 12250 - DNA, 20 bp, Artificial Sequence
  chemically synthesized
attctggcattattagtatt

SEQ ID NO: 12251 - DNA, 20 bp, Artificial Sequence
  chemically synthesized
actctgaatactaataatgc

SEQ ID NO: 12252 - DNA, 20 bp, Artificial Sequence
  chemically synthesized
catccaaattctggcattat

SEQ ID NO: 12253 - DNA, 20 bp, Artificial Sequence
  chemically synthesized
atactaataatgccagaatt

SEQ ID NO: 12254 - DNA, 20 bp, Artificial Sequence
  chemically synthesized
gaatgagctcatccaaattc

SEQ ID NO: 12255 - DNA, 20 bp, Artificial Sequence
  chemically synthesized
aataatgccagaatttggat

SEQ ID NO: 12256 - DNA, 20 bp, Artificial Sequence
  chemically synthesized
ttaatgccctggcatggaat

SEQ ID NO: 12257 - DNA, 20 bp, Artificial Sequence
  chemically synthesized
tggatgagctcattccatgc

SEQ ID NO: 12258 - DNA, 20 bp, Artificial Sequence
  chemically synthesized
ggatgagctcattccatgcc

SEQ ID NO: 12259 - DNA, 20 bp, Artificial Sequence
  chemically synthesized
gatgagctcattccatgcca

SEQ ID NO: 12260 - DNA, 20 bp, Artificial Sequence
  chemically synthesized
taattcttaatgccctggca

SEQ ID NO: 12261 - DNA, 20 bp, Artificial Sequence
  chemically synthesized
tcattccatgccagggcatt

SEQ ID NO: 12262 - DNA, 20 bp, Artificial Sequence
  chemically synthesized
tcctttaattcttaatgccc

SEQ ID NO: 12263 - DNA, 20 bp, Artificial Sequence
  chemically synthesized
tgccagggcattaagaatta

SEQ ID NO: 12264 - DNA, 20 bp, Artificial Sequence
  chemically synthesized
gccagggcattaagaattaa

SEQ ID NO: 12265 - DNA, 20 bp, Artificial Sequence
  chemically synthesized
cattaagaattaaaggaaaa

SEQ ID NO: 12266 - DNA, 20 bp, Artificial Sequence
  chemically synthesized
aaaggaaaaaagtaaatgaa

SEQ ID NO: 12267 - DNA, 20 bp, Artificial Sequence
  chemically synthesized
gtaaatgaatggctccttaa

SEQ ID NO: 12268 - DNA, 20 bp, Artificial Sequence
  chemically synthesized
tattcatttgatcttttaag

SEQ ID NO: 12269 - DNA, 20 bp, Artificial Sequence
  chemically synthesized
catattcatttgatctttta

SEQ ID NO: 12270 - DNA, 20 bp, Artificial Sequence
  chemically synthesized
tcatattcatttgatctttt

SEQ ID NO: 12271 - DNA, 20 bp, Artificial Sequence
  chemically synthesized
atagcacaggatataggaat

SEQ ID NO: 12272 - DNA, 20 bp, Artificial Sequence
  chemically synthesized
ggtaggatagcacaggatat

SEQ ID NO: 12273 - DNA, 20 bp, Artificial Sequence
  chemically synthesized
aggtaggatagcacaggata

SEQ ID NO: 12274 - DNA, 20 bp, Artificial Sequence
  chemically synthesized
atttagaggtaggatagcac

SEQ ID NO: 12275 - DNA, 20 bp, Artificial Sequence
  chemically synthesized
gatttagaggtaggatagca

SEQ ID NO: 12276 - DNA, 20 bp, Artificial Sequence
  chemically synthesized
tgagggatttagaggtagga

SEQ ID NO: 12277 - DNA, 20 bp, Artificial Sequence
  chemically synthesized
gctttgagggatttagaggt

SEQ ID NO: 12278 - DNA, 20 bp, Artificial Sequence
  chemically synthesized
tgctttgagggatttagagg

SEQ ID NO: 12279 - DNA, 20 bp, Artificial Sequence
  chemically synthesized
aattgctttgagggatttag

SEQ ID NO: 12280 - DNA, 20 bp, Artificial Sequence
  chemically synthesized
aaattgctttgagggattta

SEQ ID NO: 12281 - DNA, 20 bp, Artificial Sequence
  chemically synthesized
tgaaattgctttgagggatt

SEQ ID NO: 12282 - DNA, 20 bp, Artificial Sequence
  chemically synthesized
tcctacctctaaatccctca

SEQ ID NO: 12283 - DNA, 20 bp, Artificial Sequence
  chemically synthesized
tgacaatgaaattgctttga

SEQ ID NO: 12284 - DNA, 20 bp, Artificial Sequence
  chemically synthesized
ctgacaatgaaattgctttg

SEQ ID NO: 12285 - DNA, 20 bp, Artificial Sequence
  chemically synthesized
cctgacaatgaaattgcttt

SEQ ID NO: 12286 - DNA, 20 bp, Artificial Sequence
  chemically synthesized
cctcaaagcaatttcattgt

SEQ ID NO: 12287 - DNA, 20 bp, Artificial Sequence
  chemically synthesized
ctcaaagcaatttcattgtc

SEQ ID NO: 12288 - DNA, 20 bp, Artificial Sequence
  chemically synthesized
tgtcaggaacattttgtaaa

SEQ ID NO: 12289 - DNA, 20 bp, Artificial Sequence
  chemically synthesized
tcaggaacattttgtaaaaa

SEQ ID NO: 12290 - DNA, 20 bp, Artificial Sequence
  chemically synthesized
gaacattttgtaaaaagaga

SEQ ID NO: 12291 - DNA, 20 bp, Artificial Sequence
  chemically synthesized
aacattttgtaaaaagagat

SEQ ID NO: 12292 - DNA, 20 bp, Artificial Sequence
  chemically synthesized
ctctcctaatgagagcatgt

SEQ ID NO: 12293 - DNA, 20 bp, Artificial Sequence
  chemically synthesized
ggatacttacatgctctcat

SEQ ID NO: 12294 - DNA, 20 bp, Artificial Sequence
  chemically synthesized
gatacttacatgctctcatt

SEQ ID NO: 12295 - DNA, 20 bp, Artificial Sequence
  chemically synthesized
tacttacatgctctcattag

SEQ ID NO: 12296 - DNA, 20 bp, Artificial Sequence
  chemically synthesized
gatagcatctctcctaatga

SEQ ID NO: 12297 - DNA, 20 bp, Artificial Sequence
  chemically synthesized
cttacatgctctcattagga

SEQ ID NO: 12298 - DNA, 20 bp, Artificial Sequence
  chemically synthesized
atgatagcatctctcctaat

SEQ ID NO: 12299 - DNA, 20 bp, Artificial Sequence
  chemically synthesized
ttaggagagatgctatcatt

SEQ ID NO: 12300 - DNA, 20 bp, Artificial Sequence
  chemically synthesized
aatggatcttatctaaatga

SEQ ID NO: 12301 - DNA, 20 bp, Artificial Sequence
  chemically synthesized
agagatgctatcatttagat

SEQ ID NO: 12302 - DNA, 20 bp, Artificial Sequence
  chemically synthesized
gcagaaatggaaaacagcaa

SEQ ID NO: 12303 - DNA, 20 bp, Artificial Sequence
  chemically synthesized
aggctagcagaaatggaaaa

SEQ ID NO: 12304 - DNA, 20 bp, Artificial Sequence
  chemically synthesized
ttgctgttttccatttctgc

SEQ ID NO: 12305 - DNA, 20 bp, Artificial Sequence
  chemically synthesized
ttttatcaggctagcagaaa

SEQ ID NO: 12306 - DNA, 20 bp, Artificial Sequence
  chemically synthesized
tacgttttttatcaggctag

SEQ ID NO: 12307 - DNA, 20 bp, Artificial Sequence
  chemically synthesized
ttttacgttttttatcaggc

SEQ ID NO: 12308 - DNA, 20 bp, Artificial Sequence
  chemically synthesized
gagcttttacgttttttatc

SEQ ID NO: 12309 - DNA, 20 bp, Artificial Sequence
  chemically synthesized
tgagcttttacgttttttat

SEQ ID NO: 12310 - DNA, 20 bp, Artificial Sequence
  chemically synthesized
tagcctgataaaaaacgtaa

SEQ ID NO: 12311 - DNA, 20 bp, Artificial Sequence
  chemically synthesized
gacgtcacataagttttaat

SEQ ID NO: 12312 - DNA, 20 bp, Artificial Sequence
  chemically synthesized
tagattctaagacgtcacat

SEQ ID NO: 12313 - DNA, 20 bp, Artificial Sequence
  chemically synthesized
ttaaaacttatgtgacgtct

SEQ ID NO: 12314 - DNA, 20 bp, Artificial Sequence
  chemically synthesized
ttaggtcttgaatagattct

SEQ ID NO: 12315 - DNA, 20 bp, Artificial Sequence
  chemically synthesized
tgacgtcttagaatctattc

SEQ ID NO: 12316 - DNA, 20 bp, Artificial Sequence
  chemically synthesized
atgttcgattaggtcttgaa

SEQ ID NO: 12317 - DNA, 20 bp, Artificial Sequence
  chemically synthesized
gttttcaggaatgttcgatt

SEQ ID NO: 12318 - DNA, 20 bp, Artificial Sequence
  chemically synthesized
agttttcaggaatgttcgat

SEQ ID NO: 12319 - DNA, 20 bp, Artificial Sequence
  chemically synthesized
tgatttatcctttagttttc

SEQ ID NO: 12320 - DNA, 20 bp, Artificial Sequence
  chemically synthesized
tcgaacattcctgaaaacta

SEQ ID NO: 12321 - DNA, 20 bp, Artificial Sequence
  chemically synthesized
atgatttatcctttagtttt

SEQ ID NO: 12322 - DNA, 20 bp, Artificial Sequence
  chemically synthesized
cgaacattcctgaaaactaa

SEQ ID NO: 12323 - DNA, 20 bp, Artificial Sequence
  chemically synthesized
tcttgccatgatttatcctt

SEQ ID NO: 12324 - DNA, 20 bp, Artificial Sequence
  chemically synthesized
gaaaactaaaggataaatca

SEQ ID NO: 12325 - DNA, 20 bp, Artificial Sequence
  chemically synthesized
actaaaggataaatcatggc

SEQ ID NO: 12326 - DNA, 20 bp, Artificial Sequence
  chemically synthesized
aaaggataaatcatggcaag

SEQ ID NO: 12327 - DNA, 20 bp, Artificial Sequence
  chemically synthesized
aggataaatcatggcaagaa

SEQ ID NO: 12328 - DNA, 20 bp, Artificial Sequence
  chemically synthesized
taaatcatggcaagaagaga

SEQ ID NO: 12329 - DNA, 20 bp, Artificial Sequence
  chemically synthesized
aaatcatggcaagaagagaa

SEQ ID NO: 12330 - DNA, 20 bp, Artificial Sequence
  chemically synthesized
acacacatcctttaatttga

SEQ ID NO: 12331 - DNA, 20 bp, Artificial Sequence
  chemically synthesized
gaaaggaatccttcaaatta

SEQ ID NO: 12332 - DNA, 20 bp, Artificial Sequence
  chemically synthesized
cacacacatcctttaatttg

SEQ ID NO: 12333 - DNA, 20 bp, Artificial Sequence
  chemically synthesized
aaaggaatccttcaaattaa

SEQ ID NO: 12334 - DNA, 20 bp, Artificial Sequence
  chemically synthesized
aaattaaaggatgtgtgtgt

SEQ ID NO: 12335 - DNA, 20 bp, Artificial Sequence
  chemically synthesized
acacactgcctcaaatggtt

SEQ ID NO: 12336 - DNA, 20 bp, Artificial Sequence
  chemically synthesized
gtgtgttggcttaaccattt

SEQ ID NO: 12337 - DNA, 20 bp, Artificial Sequence
  chemically synthesized
tgtgttggcttaaccatttg

SEQ ID NO: 12338 - DNA, 20 bp, Artificial Sequence
  chemically synthesized
gttggcttaaccatttgagg

SEQ ID NO: 12339 - DNA, 20 bp, Artificial Sequence
  chemically synthesized
ctaccacacactgcctcaaa

SEQ ID NO: 12340 - DNA, 20 bp, Artificial Sequence
  chemically synthesized
taaccatttgaggcagtgtg

SEQ ID NO: 12341 - DNA, 20 bp, Artificial Sequence
  chemically synthesized
ccatttgaggcagtgtgtgg

SEQ ID NO: 12342 - DNA, 20 bp, Artificial Sequence
  chemically synthesized
aggcagtgtgtggtagacca

SEQ ID NO: 12343 - DNA, 20 bp, Artificial Sequence
  chemically synthesized
agtgtgtggtagaccacagc

SEQ ID NO: 12344 - DNA, 20 bp, Artificial Sequence
  chemically synthesized
gtagtgctactaactagctg

SEQ ID NO: 12345 - DNA, 20 bp, Artificial Sequence
  chemically synthesized
tgtggtagaccacagctagt

SEQ ID NO: 12346 - DNA, 20 bp, Artificial Sequence
  chemically synthesized
ggtagaccacagctagttag

SEQ ID NO: 12347 - DNA, 20 bp, Artificial Sequence
  chemically synthesized
ataaatgtagtgctactaac

SEQ ID NO: 12348 - DNA, 20 bp, Artificial Sequence
  chemically synthesized
tagaatttctatcataaatg

SEQ ID NO: 12349 - DNA, 20 bp, Artificial Sequence
  chemically synthesized
tagtagcactacatttatga

SEQ ID NO: 12350 - DNA, 20 bp, Artificial Sequence
  chemically synthesized
acatttatgatagaaattct

SEQ ID NO: 12351 - DNA, 20 bp, Artificial Sequence
  chemically synthesized
catttatgatagaaattcta

SEQ ID NO: 12352 - DNA, 20 bp, Artificial Sequence
  chemically synthesized
tatgatagaaattctaagga

SEQ ID NO: 12353 - DNA, 20 bp, Artificial Sequence
  chemically synthesized
cagtgaaatataactttcct

SEQ ID NO: 12354 - DNA, 20 bp, Artificial Sequence
  chemically synthesized
actgatctgtagggggaaaa

SEQ ID NO: 12355 - DNA, 20 bp, Artificial Sequence
  chemically synthesized
atttcactgttttcccccta

SEQ ID NO: 12356 - DNA, 20 bp, Artificial Sequence
  chemically synthesized
aagcaagactgatctgtagg

SEQ ID NO: 12357 - DNA, 20 bp, Artificial Sequence
  chemically synthesized
aaagcaagactgatctgtag

SEQ ID NO: 12358 - DNA, 20 bp, Artificial Sequence
  chemically synthesized
actgttttccccctacagat

SEQ ID NO: 12359 - DNA, 20 bp, Artificial Sequence
  chemically synthesized
gaaagcaagactgatctgta

SEQ ID NO: 12360 - DNA, 20 bp, Artificial Sequence
  chemically synthesized
tgaaagcaagactgatctgt

SEQ ID NO: 12361 - DNA, 20 bp, Artificial Sequence
  chemically synthesized
gtgaaagcaagactgatctg

SEQ ID NO: 12362 - DNA, 20 bp, Artificial Sequence
  chemically synthesized
gacctgttctcagtgaaagc

SEQ ID NO: 12363 - DNA, 20 bp, Artificial Sequence
  chemically synthesized
agatcagtcttgctttcact

SEQ ID NO: 12364 - DNA, 20 bp, Artificial Sequence
  chemically synthesized
caaagacctgttctcagtga

SEQ ID NO: 12365 - DNA, 20 bp, Artificial Sequence
  chemically synthesized
agtcttgctttcactgagaa

SEQ ID NO: 12366 - DNA, 20 bp, Artificial Sequence
  chemically synthesized
gtcttgctttcactgagaac

SEQ ID NO: 12367 - DNA, 20 bp, Artificial Sequence
  chemically synthesized
tgaaaacaaagacctgttct

SEQ ID NO: 12368 - DNA, 20 bp, Artificial Sequence
  chemically synthesized
tgagaacaggtctttgtttt

SEQ ID NO: 12369 - DNA, 20 bp, Artificial Sequence
  chemically synthesized
aagcttttcttctgaaaaca

SEQ ID NO: 12370 - DNA, 20 bp, Artificial Sequence
  chemically synthesized
gaacaggtctttgttttcag

SEQ ID NO: 12371 - DNA, 20 bp, Artificial Sequence
  chemically synthesized
ggtctttgttttcagaagaa

SEQ ID NO: 12372 - DNA, 20 bp, Artificial Sequence
  chemically synthesized
gagtgcacttattgttaggg

SEQ ID NO: 12373 - DNA, 20 bp, Artificial Sequence
  chemically synthesized
agaaaagcttccctaacaat

SEQ ID NO: 12374 - DNA, 20 bp, Artificial Sequence
  chemically synthesized
agggagtgcacttattgtta

SEQ ID NO: 12375 - DNA, 20 bp, Artificial Sequence
  chemically synthesized
tagggagtgcacttattgtt

SEQ ID NO: 12376 - DNA, 20 bp, Artificial Sequence
  chemically synthesized
gtagggagtgcacttattgt

SEQ ID NO: 12377 - DNA, 20 bp, Artificial Sequence
  chemically synthesized
aaggggtagtgtaaggtagg

SEQ ID NO: 12378 - DNA, 20 bp, Artificial Sequence
  chemically synthesized
acaaggggtagtgtaaggta

SEQ ID NO: 12379 - DNA, 20 bp, Artificial Sequence
  chemically synthesized
gacaaggggtagtgtaaggt

SEQ ID NO: 12380 - DNA, 20 bp, Artificial Sequence
  chemically synthesized
agacaaggggtagtgtaagg

SEQ ID NO: 12381 - DNA, 20 bp, Artificial Sequence
  chemically synthesized
aaaagacaaggggtagtgta

SEQ ID NO: 12382 - DNA, 20 bp, Artificial Sequence
  chemically synthesized
taaaagacaaggggtagtgt

SEQ ID NO: 12383 - DNA, 20 bp, Artificial Sequence
  chemically synthesized
ttgtcctaaaagacaagggg

SEQ ID NO: 12384 - DNA, 20 bp, Artificial Sequence
  chemically synthesized
taattgtcctaaaagacaag

SEQ ID NO: 12385 - DNA, 20 bp, Artificial Sequence
  chemically synthesized
gtaattgtcctaaaagacaa

SEQ ID NO: 12386 - DNA, 20 bp, Artificial Sequence
  chemically synthesized
ttacactaccccttgtcttt

SEQ ID NO: 12387 - DNA, 20 bp, Artificial Sequence
  chemically synthesized
agtaattgtcctaaaagaca

SEQ ID NO: 12388 - DNA, 20 bp, Artificial Sequence
  chemically synthesized
tacactaccccttgtctttt

SEQ ID NO: 12389 - DNA, 20 bp, Artificial Sequence
  chemically synthesized
tagtaattgtcctaaaagac

SEQ ID NO: 12390 - DNA, 20 bp, Artificial Sequence
  chemically synthesized
gaaagtagtaattgtcctaa

SEQ ID NO: 12391 - DNA, 20 bp, Artificial Sequence
  chemically synthesized
agtctgtcatcagtggaaag

SEQ ID NO: 12392 - DNA, 20 bp, Artificial Sequence
  chemically synthesized
gtaagtctgtcatcagtgga

SEQ ID NO: 12393 - DNA, 20 bp, Artificial Sequence
  chemically synthesized
ttactactttccactgatga

SEQ ID NO: 12394 - DNA, 20 bp, Artificial Sequence
  chemically synthesized
ctgtgtaagtctgtcatcag

SEQ ID NO: 12395 - DNA, 20 bp, Artificial Sequence
  chemically synthesized
tagctgtgtaagtctgtcat

SEQ ID NO: 12396 - DNA, 20 bp, Artificial Sequence
  chemically synthesized
ccactgatgacagacttaca

SEQ ID NO: 12397 - DNA, 20 bp, Artificial Sequence
  chemically synthesized
tgatgacagacttacacagc

SEQ ID NO: 12398 - DNA, 20 bp, Artificial Sequence
  chemically synthesized
aaagcattagctagctgtgt

SEQ ID NO: 12399 - DNA, 20 bp, Artificial Sequence
  chemically synthesized
caatcgtgaaaagcattagc

SEQ ID NO: 12400 - DNA, 20 bp, Artificial Sequence
  chemically synthesized
ttaccaatcgtgaaaagcat

SEQ ID NO: 12401 - DNA, 20 bp, Artificial Sequence
  chemically synthesized
acatgtttaccaatcgtgaa

SEQ ID NO: 12402 - DNA, 20 bp, Artificial Sequence
  chemically synthesized
tagctaatgcttttcacgat

SEQ ID NO: 12403 - DNA, 20 bp, Artificial Sequence
  chemically synthesized
tcacgattggtaaacatgtc

SEQ ID NO: 12404 - DNA, 20 bp, Artificial Sequence
  chemically synthesized
cgattggtaaacatgtccag

SEQ ID NO: 12405 - DNA, 20 bp, Artificial Sequence
  chemically synthesized
tggtaaacatgtccagcagt

SEQ ID NO: 12406 - DNA, 20 bp, Artificial Sequence
  chemically synthesized
tttgtcaatattctaactgc

SEQ ID NO: 12407 - DNA, 20 bp, Artificial Sequence
  chemically synthesized
cagcagttagaatattgaca

SEQ ID NO: 12408 - DNA, 20 bp, Artificial Sequence
  chemically synthesized
agcagttagaatattgacaa

SEQ ID NO: 12409 - DNA, 20 bp, Artificial Sequence
  chemically synthesized
gttagaatattgacaaagga

SEQ ID NO: 12410 - DNA, 20 bp, Artificial Sequence
  chemically synthesized
attgacaaaggatggatgca

SEQ ID NO: 12411 - DNA, 20 bp, Artificial Sequence
  chemically synthesized
acaaaggatggatgcacagt

SEQ ID NO: 12412 - DNA, 20 bp, Artificial Sequence
  chemically synthesized
ttggtggcagaatgtttaga

SEQ ID NO: 12413 - DNA, 20 bp, Artificial Sequence
  chemically synthesized
aattggtggcagaatgttta

SEQ ID NO: 12414 - DNA, 20 bp, Artificial Sequence
  chemically synthesized
aaaattggtggcagaatgtt

SEQ ID NO: 12415 - DNA, 20 bp, Artificial Sequence
  chemically synthesized
ttaaaggtaaaaattggtgg

SEQ ID NO: 12416 - DNA, 20 bp, Artificial Sequence
  chemically synthesized
attttaaaggtaaaaattgg

SEQ ID NO: 12417 - DNA, 20 bp, Artificial Sequence
  chemically synthesized
aagattttaaaggtaaaaat

SEQ ID NO: 12418 - DNA, 20 bp, Artificial Sequence
  chemically synthesized
tgaggtgaagaagattttaa

SEQ ID NO: 12419 - DNA, 20 bp, Artificial Sequence
  chemically synthesized
ctgaggtgaagaagatttta

SEQ ID NO: 12420 - DNA, 20 bp, Artificial Sequence
  chemically synthesized
tataattgcctgaggtgaag

SEQ ID NO: 12421 - DNA, 20 bp, Artificial Sequence
  chemically synthesized
ctttaaaatcttcttcacct

SEQ ID NO: 12422 - DNA, 20 bp, Artificial Sequence
  chemically synthesized
tttaaaatcttcttcacctc

SEQ ID NO: 12423 - DNA, 20 bp, Artificial Sequence
  chemically synthesized
ctgtataattgcctgaggtg

SEQ ID NO: 12424 - DNA, 20 bp, Artificial Sequence
  chemically synthesized
accccctgtataattgcctg

SEQ ID NO: 12425 - DNA, 20 bp, Artificial Sequence
  chemically synthesized
aaccccctgtataattgcct

SEQ ID NO: 12426 - DNA, 20 bp, Artificial Sequence
  chemically synthesized
cttcacctcaggcaattata

SEQ ID NO: 12427 - DNA, 20 bp, Artificial Sequence
  chemically synthesized
ttcacctcaggcaattatac

SEQ ID NO: 12428 - DNA, 20 bp, Artificial Sequence
  chemically synthesized
tcacctcaggcaattataca

SEQ ID NO: 12429 - DNA, 20 bp, Artificial Sequence
  chemically synthesized
cacctcaggcaattatacag

SEQ ID NO: 12430 - DNA, 20 bp, Artificial Sequence
  chemically synthesized
acctcaggcaattatacagg

SEQ ID NO: 12431 - DNA, 20 bp, Artificial Sequence
  chemically synthesized
ttgtttttttacaactaaaa

SEQ ID NO: 12432 - DNA, 20 bp, Artificial Sequence
  chemically synthesized
aagagtttggttaacttttt

SEQ ID NO: 12433 - DNA, 20 bp, Artificial Sequence
  chemically synthesized
ttgttaaatccgtaagagtt

SEQ ID NO: 12434 - DNA, 20 bp, Artificial Sequence
  chemically synthesized
aaaagttaaccaaactctta

SEQ ID NO: 12435 - DNA, 20 bp, Artificial Sequence
  chemically synthesized
tatgcttgttaaatccgtaa

SEQ ID NO: 12436 - DNA, 20 bp, Artificial Sequence
  chemically synthesized
tttatgcttgttaaatccgt

SEQ ID NO: 12437 - DNA, 20 bp, Artificial Sequence
  chemically synthesized
caaactcttacggatttaac

SEQ ID NO: 12438 - DNA, 20 bp, Artificial Sequence
  chemically synthesized
agcataaaatattttaaaat

SEQ ID NO: 12439 - DNA, 20 bp, Artificial Sequence
  chemically synthesized
atattttaaaattagtaatt

SEQ ID NO: 12440 - DNA, 20 bp, Artificial Sequence
  chemically synthesized
aaaattagtaattcagtttt

SEQ ID NO: 12441 - DNA, 20 bp, Artificial Sequence
  chemically synthesized
aaattagtaattcagttttt

SEQ ID NO: 12442 - DNA, 20 bp, Artificial Sequence
  chemically synthesized
taaaaatcatctcaaacaca

SEQ ID NO: 12443 - DNA, 20 bp, Artificial Sequence
  chemically synthesized
gtctcaccttctttgtgttt

SEQ ID NO: 12444 - DNA, 20 bp, Artificial Sequence
  chemically synthesized
aaatcatctcaaacacaaag

SEQ ID NO: 12445 - DNA, 20 bp, Artificial Sequence
  chemically synthesized
aatcatctcaaacacaaaga

SEQ ID NO: 12446 - DNA, 20 bp, Artificial Sequence
  chemically synthesized
atctcaaacacaaagaaggt

SEQ ID NO: 12447 - DNA, 20 bp, Artificial Sequence
  chemically synthesized
caaacacaaagaaggtgaga

SEQ ID NO: 12448 - DNA, 20 bp, Artificial Sequence
  chemically synthesized
acaaagaaggtgagacagaa

SEQ ID NO: 12449 - DNA, 20 bp, Artificial Sequence
  chemically synthesized
aaggtgagacagaaaagtcc

SEQ ID NO: 12450 - DNA, 20 bp, Artificial Sequence
  chemically synthesized
aggtgagacagaaaagtcca

SEQ ID NO: 12451 - DNA, 20 bp, Artificial Sequence
  chemically synthesized
agacagaaaagtccaaggat

SEQ ID NO: 12452 - DNA, 20 bp, Artificial Sequence
  chemically synthesized
gacagaaaagtccaaggatt

SEQ ID NO: 12453 - DNA, 20 bp, Artificial Sequence
  chemically synthesized
taattaattttcctaatcct

SEQ ID NO: 12454 - DNA, 20 bp, Artificial Sequence
  chemically synthesized
attaattattctcttcttta

SEQ ID NO: 12455 - DNA, 20 bp, Artificial Sequence
  chemically synthesized
acatgatatgctgtaaagaa

SEQ ID NO: 12456 - DNA, 20 bp, Artificial Sequence
  chemically synthesized
ttacatgatatgctgtaaag

SEQ ID NO: 12457 - DNA, 20 bp, Artificial Sequence
  chemically synthesized
attttacatgatatgctgta

SEQ ID NO: 12458 - DNA, 20 bp, Artificial Sequence
  chemically synthesized
atgtaaaataaatacacaaa

SEQ ID NO: 12459 - DNA, 20 bp, Artificial Sequence
  chemically synthesized
aaaataaatacacaaacgga

SEQ ID NO: 12460 - DNA, 20 bp, Artificial Sequence
  chemically synthesized
tatggagaatatgaaagcat

SEQ ID NO: 12461 - DNA, 20 bp, Artificial Sequence
  chemically synthesized
atattatatggagaatatga

SEQ ID NO: 12462 - DNA, 20 bp, Artificial Sequence
  chemically synthesized
aaatgatactatattatatg

SEQ ID NO: 12463 - DNA, 20 bp, Artificial Sequence
  chemically synthesized
ttcatattctccatataata

SEQ ID NO: 12464 - DNA, 20 bp, Artificial Sequence
  chemically synthesized
aaaaatgatactatattata

SEQ ID NO: 12465 - DNA, 20 bp, Artificial Sequence
  chemically synthesized
ttttttcatatatgaatgtc

SEQ ID NO: 12466 - DNA, 20 bp, Artificial Sequence
  chemically synthesized
tcatatatgaatgtctggtc

SEQ ID NO: 12467 - DNA, 20 bp, Artificial Sequence
  chemically synthesized
tatatgaatgtctggtctag

SEQ ID NO: 12468 - DNA, 20 bp, Artificial Sequence
  chemically synthesized
tccttagaaaactgctagac

SEQ ID NO: 12469 - DNA, 20 bp, Artificial Sequence
  chemically synthesized
taacctccttagaaaactgc

SEQ ID NO: 12470 - DNA, 20 bp, Artificial Sequence
  chemically synthesized
gtctggtctagcagttttct

SEQ ID NO: 12471 - DNA, 20 bp, Artificial Sequence
  chemically synthesized
tctggtctagcagttttcta

SEQ ID NO: 12472 - DNA, 20 bp, Artificial Sequence
  chemically synthesized
tggtctagcagttttctaag

SEQ ID NO: 12473 - DNA, 20 bp, Artificial Sequence
  chemically synthesized
ggtctagcagttttctaagg

SEQ ID NO: 12474 - DNA, 20 bp, Artificial Sequence
  chemically synthesized
tacaaatagtttaacctcct

SEQ ID NO: 12475 - DNA, 20 bp, Artificial Sequence
  chemically synthesized
aaggaggttaaactatttgt

SEQ ID NO: 12476 - DNA, 20 bp, Artificial Sequence
  chemically synthesized
ttactaaattggcttacaaa

SEQ ID NO: 12477 - DNA, 20 bp, Artificial Sequence
  chemically synthesized
aaactatttgtaagccaatt

SEQ ID NO: 12478 - DNA, 20 bp, Artificial Sequence
  chemically synthesized
actgagcacatttactaaat

SEQ ID NO: 12479 - DNA, 20 bp, Artificial Sequence
  chemically synthesized
gccaatttagtaaatgtgct

SEQ ID NO: 12480 - DNA, 20 bp, Artificial Sequence
  chemically synthesized
ttgctatgtttttttatact

SEQ ID NO: 12481 - DNA, 20 bp, Artificial Sequence
  chemically synthesized
gtgctcagtataaaaaaaca

SEQ ID NO: 12482 - DNA, 20 bp, Artificial Sequence
  chemically synthesized
tcagtataaaaaaacatagc

SEQ ID NO: 12483 - DNA, 20 bp, Artificial Sequence
  chemically synthesized
cagtataaaaaaacatagca

SEQ ID NO: 12484 - DNA, 20 bp, Artificial Sequence
  chemically synthesized
aaaaaacatagcaaggctac

SEQ ID NO: 12485 - DNA, 20 bp, Artificial Sequence
  chemically synthesized
tggcttttaaacatttccgg

SEQ ID NO: 12486 - DNA, 20 bp, Artificial Sequence
  chemically synthesized
ccctggcttttaaacatttc

SEQ ID NO: 12487 - DNA, 20 bp, Artificial Sequence
  chemically synthesized
aggctaccggaaatgtttaa

SEQ ID NO: 12488 - DNA, 20 bp, Artificial Sequence
  chemically synthesized
taccggaaatgtttaaaagc

SEQ ID NO: 12489 - DNA, 20 bp, Artificial Sequence
  chemically synthesized
accggaaatgtttaaaagcc

SEQ ID NO: 12490 - DNA, 20 bp, Artificial Sequence
  chemically synthesized
ccggaaatgtttaaaagcca

SEQ ID NO: 12491 - DNA, 20 bp, Artificial Sequence
  chemically synthesized
aaatgtttaaaagccagggt

SEQ ID NO: 12492 - DNA, 20 bp, Artificial Sequence
  chemically synthesized
aatgtttaaaagccagggtt

SEQ ID NO: 12493 - DNA, 20 bp, Artificial Sequence
  chemically synthesized
atgtttaaaagccagggtta

SEQ ID NO: 12494 - DNA, 20 bp, Artificial Sequence
  chemically synthesized
agaataatcttccctaaccc

SEQ ID NO: 12495 - DNA, 20 bp, Artificial Sequence
  chemically synthesized
tttaaaagccagggttaggg

SEQ ID NO: 12496 - DNA, 20 bp, Artificial Sequence
  chemically synthesized
agggttagggaagattattc

SEQ ID NO: 12497 - DNA, 20 bp, Artificial Sequence
  chemically synthesized
caccaacaagagcattagtc

SEQ ID NO: 12498 - DNA, 20 bp, Artificial Sequence
  chemically synthesized
ttggtcaccaacaagagcat

SEQ ID NO: 12499 - DNA, 20 bp, Artificial Sequence
  chemically synthesized
ttctggactaatgctcttgt

SEQ ID NO: 12500 - DNA, 20 bp, Artificial Sequence
  chemically synthesized
ttgtttttggtcaccaacaa

SEQ ID NO: 12501 - DNA, 20 bp, Artificial Sequence
  chemically synthesized
tgttgtttttggtcaccaac

SEQ ID NO: 12502 - DNA, 20 bp, Artificial Sequence
  chemically synthesized
gttccactgcatgttgtttt

SEQ ID NO: 12503 - DNA, 20 bp, Artificial Sequence
  chemically synthesized
tggtgaccaaaaacaacatg

SEQ ID NO: 12504 - DNA, 20 bp, Artificial Sequence
  chemically synthesized
tgaccaaaaacaacatgcag

SEQ ID NO: 12505 - DNA, 20 bp, Artificial Sequence
  chemically synthesized
aaaaacaacatgcagtggaa

SEQ ID NO: 12506 - DNA, 20 bp, Artificial Sequence
  chemically synthesized
cagtggaacggcatgcacgt

SEQ ID NO: 12507 - DNA, 20 bp, Artificial Sequence
  chemically synthesized
gtggaacggcatgcacgtta

SEQ ID NO: 12508 - DNA, 20 bp, Artificial Sequence
  chemically synthesized
tggaacggcatgcacgttag

SEQ ID NO: 12509 - DNA, 20 bp, Artificial Sequence
  chemically synthesized
ggaacggcatgcacgttaga

SEQ ID NO: 12510 - DNA, 20 bp, Artificial Sequence
  chemically synthesized
cggcatgcacgttagagggc

SEQ ID NO: 12511 - DNA, 20 bp, Artificial Sequence
  chemically synthesized
acgttagagggcaagttgat

SEQ ID NO: 12512 - DNA, 20 bp, Artificial Sequence
  chemically synthesized
ttagagggcaagttgattag

SEQ ID NO: 12513 - DNA, 20 bp, Artificial Sequence
  chemically synthesized
tagagggcaagttgattagt

SEQ ID NO: 12514 - DNA, 20 bp, Artificial Sequence
  chemically synthesized
gcaagttgattagtaggaat

SEQ ID NO: 12515 - DNA, 20 bp, Artificial Sequence
  chemically synthesized
ttgattagtaggaatcagac

SEQ ID NO: 12516 - DNA, 20 bp, Artificial Sequence
  chemically synthesized
tagtaggaatcagacaagtt

SEQ ID NO: 12517 - DNA, 20 bp, Artificial Sequence
  chemically synthesized
agtaggaatcagacaagttt

SEQ ID NO: 12518 - DNA, 20 bp, Artificial Sequence
  chemically synthesized
gtaggaatcagacaagtttg

SEQ ID NO: 12519 - DNA, 20 bp, Artificial Sequence
  chemically synthesized
cagacaagtttggggaaaaa

SEQ ID NO: 12520 - DNA, 20 bp, Artificial Sequence
  chemically synthesized
aagtttggggaaaaaaagaa

SEQ ID NO: 12521 - DNA, 20 bp, Artificial Sequence
  chemically synthesized
aagatttgtttaaaatatca

SEQ ID NO: 12522 - DNA, 20 bp, Artificial Sequence
  chemically synthesized
agatttgtttaaaatatcat

SEQ ID NO: 12523 - DNA, 20 bp, Artificial Sequence
  chemically synthesized
ttgtttaaaatatcataggt

SEQ ID NO: 12524 - DNA, 20 bp, Artificial Sequence
  chemically synthesized
tatcataggttagctttcct

SEQ ID NO: 12525 - DNA, 20 bp, Artificial Sequence
  chemically synthesized
ttgaaataactaaccaagga

SEQ ID NO: 12526 - DNA, 20 bp, Artificial Sequence
  chemically synthesized
ataggttagctttccttggt

SEQ ID NO: 12527 - DNA, 20 bp, Artificial Sequence
  chemically synthesized
ttgattgaaataactaacca

SEQ ID NO: 12528 - DNA, 20 bp, Artificial Sequence
  chemically synthesized
attgattgaaataactaacc

SEQ ID NO: 12529 - DNA, 20 bp, Artificial Sequence
  chemically synthesized
tatttcaatcaatatttgcc

SEQ ID NO: 12530 - DNA, 20 bp, Artificial Sequence
  chemically synthesized
tatgagactagttgtatgcc

SEQ ID NO: 12531 - DNA, 20 bp, Artificial Sequence
  chemically synthesized
gtatgagactagttgtatgc

SEQ ID NO: 12532 - DNA, 20 bp, Artificial Sequence
  chemically synthesized
atatttgcctggcatacaac

SEQ ID NO: 12533 - DNA, 20 bp, Artificial Sequence
  chemically synthesized
tatgctagcaggtatgagac

SEQ ID NO: 12534 - DNA, 20 bp, Artificial Sequence
  chemically synthesized
aacattatgctagcaggtat

SEQ ID NO: 12535 - DNA, 20 bp, Artificial Sequence
  chemically synthesized
acaactagtctcatacctgc

SEQ ID NO: 12536 - DNA, 20 bp, Artificial Sequence
  chemically synthesized
gcattgaacattatgctagc

SEQ ID NO: 12537 - DNA, 20 bp, Artificial Sequence
  chemically synthesized
cgcattgaacattatgctag

SEQ ID NO: 12538 - DNA, 20 bp, Artificial Sequence
  chemically synthesized
tcacgcattgaacattatgc

SEQ ID NO: 12539 - DNA, 20 bp, Artificial Sequence
  chemically synthesized
ataatgttcaatgcgtgaat

SEQ ID NO: 12540 - DNA, 20 bp, Artificial Sequence
  chemically synthesized
gaatgagtatcatcgtgtga

SEQ ID NO: 12541 - DNA, 20 bp, Artificial Sequence
  chemically synthesized
agtatcatcgtgtgaaagct

SEQ ID NO: 12542 - DNA, 20 bp, Artificial Sequence
  chemically synthesized
gtatcatcgtgtgaaagctg

SEQ ID NO: 12543 - DNA, 20 bp, Artificial Sequence
  chemically synthesized
tatcatcgtgtgaaagctga

SEQ ID NO: 12544 - DNA, 20 bp, Artificial Sequence
  chemically synthesized
atcatcgtgtgaaagctgag

SEQ ID NO: 12545 - DNA, 20 bp, Artificial Sequence
  chemically synthesized
cgtgtgaaagctgaggggac

SEQ ID NO: 12546 - DNA, 20 bp, Artificial Sequence
  chemically synthesized
ataggcctgcctcgtcccct

SEQ ID NO: 12547 - DNA, 20 bp, Artificial Sequence
  chemically synthesized
gtgtgaaagctgaggggacg

SEQ ID NO: 12548 - DNA, 20 bp, Artificial Sequence
  chemically synthesized
tgaaagctgaggggacgagg

SEQ ID NO: 12549 - DNA, 20 bp, Artificial Sequence
  chemically synthesized
gaaagctgaggggacgaggc

SEQ ID NO: 12550 - DNA, 20 bp, Artificial Sequence
  chemically synthesized
aggggacgaggcaggcctat

SEQ ID NO: 12551 - DNA, 20 bp, Artificial Sequence
  chemically synthesized
ggggacgaggcaggcctata

SEQ ID NO: 12552 - DNA, 20 bp, Artificial Sequence
  chemically synthesized
gacgaggcaggcctataagg

SEQ ID NO: 12553 - DNA, 20 bp, Artificial Sequence
  chemically synthesized
aatcacattttctgccttat

SEQ ID NO: 12554 - DNA, 20 bp, Artificial Sequence
  chemically synthesized
taatcacattttctgcctta

SEQ ID NO: 12555 - DNA, 20 bp, Artificial Sequence
  chemically synthesized
tataaggcagaaaatgtgat

SEQ ID NO: 12556 - DNA, 20 bp, Artificial Sequence
  chemically synthesized
gcagaaaatgtgattagtca

SEQ ID NO: 12557 - DNA, 20 bp, Artificial Sequence
  chemically synthesized
gttttttctccattaatgga

SEQ ID NO: 12558 - DNA, 20 bp, Artificial Sequence
  chemically synthesized
tcacagataccatccattaa

SEQ ID NO: 12559 - DNA, 20 bp, Artificial Sequence
  chemically synthesized
acagataccatccattaatg

SEQ ID NO: 12560 - DNA, 20 bp, Artificial Sequence
  chemically synthesized
gtgggttttttctccattaa

SEQ ID NO: 12561 - DNA, 20 bp, Artificial Sequence
  chemically synthesized
tggagaaaaaacccaccaca

SEQ ID NO: 12562 - DNA, 20 bp, Artificial Sequence
  chemically synthesized
gtataacataactgtgtggt

SEQ ID NO: 12563 - DNA, 20 bp, Artificial Sequence
  chemically synthesized
tgtataacataactgtgtgg

SEQ ID NO: 12564 - DNA, 20 bp, Artificial Sequence
  chemically synthesized
atgtgtataacataactgtg

SEQ ID NO: 12565 - DNA, 20 bp, Artificial Sequence
  chemically synthesized
acacagttatgttatacaca

SEQ ID NO: 12566 - DNA, 20 bp, Artificial Sequence
  chemically synthesized
gttatgttatacacatggcc

SEQ ID NO: 12567 - DNA, 20 bp, Artificial Sequence
  chemically synthesized
aattagaataaaagcattct

SEQ ID NO: 12568 - DNA, 20 bp, Artificial Sequence
  chemically synthesized
gaattagaataaaagcattc

SEQ ID NO: 12569 - DNA, 20 bp, Artificial Sequence
  chemically synthesized
tatccatagaattagaataa

SEQ ID NO: 12570 - DNA, 20 bp, Artificial Sequence
  chemically synthesized
atgcttttattctaattcta

SEQ ID NO: 12571 - DNA, 20 bp, Artificial Sequence
  chemically synthesized
gtatacattatccatagaat

SEQ ID NO: 12572 - DNA, 20 bp, Artificial Sequence
  chemically synthesized
ctaaatgtatacattatcca

SEQ ID NO: 12573 - DNA, 20 bp, Artificial Sequence
  chemically synthesized
ctatggataatgtatacatt

SEQ ID NO: 12574 - DNA, 20 bp, Artificial Sequence
  chemically synthesized
tgataatatttaagatatag

SEQ ID NO: 12575 - DNA, 20 bp, Artificial Sequence
  chemically synthesized
cttgataatatttaagatat

SEQ ID NO: 12576 - DNA, 20 bp, Artificial Sequence
  chemically synthesized
acttgataatatttaagata

SEQ ID NO: 12577 - DNA, 20 bp, Artificial Sequence
  chemically synthesized
taaaatacttgataatattt

SEQ ID NO: 12578 - DNA, 20 bp, Artificial Sequence
  chemically synthesized
cctatatcttaaatattatc

SEQ ID NO: 12579 - DNA, 20 bp, Artificial Sequence
  chemically synthesized
ttatcaagtattttaaaatc

SEQ ID NO: 12580 - DNA, 20 bp, Artificial Sequence
  chemically synthesized
tatcaagtattttaaaatcc

SEQ ID NO: 12581 - DNA, 20 bp, Artificial Sequence
  chemically synthesized
gtattttaaaatccaggatt

SEQ ID NO: 12582 - DNA, 20 bp, Artificial Sequence
  chemically synthesized
attttaaaatccaggattga

SEQ ID NO: 12583 - DNA, 20 bp, Artificial Sequence
  chemically synthesized
gagaaatcatctctcaatcc

SEQ ID NO: 12584 - DNA, 20 bp, Artificial Sequence
  chemically synthesized
tttaataaaagcagaagtat

SEQ ID NO: 12585 - DNA, 20 bp, Artificial Sequence
  chemically synthesized
atggcttttaataaaagcag

SEQ ID NO: 12586 - DNA, 20 bp, Artificial Sequence
  chemically synthesized
ttcatggcttttaataaaag

SEQ ID NO: 12587 - DNA, 20 bp, Artificial Sequence
  chemically synthesized
catacttctgcttttattaa

SEQ ID NO: 12588 - DNA, 20 bp, Artificial Sequence
  chemically synthesized
ctcttcatggcttttaataa

SEQ ID NO: 12589 - DNA, 20 bp, Artificial Sequence
  chemically synthesized
tgcttttattaaaagccatg

SEQ ID NO: 12590 - DNA, 20 bp, Artificial Sequence
  chemically synthesized
cttttattaaaagccatgaa

SEQ ID NO: 12591 - DNA, 20 bp, Artificial Sequence
  chemically synthesized
tttattaaaagccatgaaga

SEQ ID NO: 12592 - DNA, 20 bp, Artificial Sequence
  chemically synthesized
ttattaaaagccatgaagag

SEQ ID NO: 12593 - DNA, 20 bp, Artificial Sequence
  chemically synthesized
aagattttggcctctcttca

SEQ ID NO: 12594 - DNA, 20 bp, Artificial Sequence
  chemically synthesized
gaattttccagagaagattt

SEQ ID NO: 12595 - DNA, 20 bp, Artificial Sequence
  chemically synthesized
agagaggccaaaatcttctc

SEQ ID NO: 12596 - DNA, 20 bp, Artificial Sequence
  chemically synthesized
acgatgggaattttccagag

SEQ ID NO: 12597 - DNA, 20 bp, Artificial Sequence
  chemically synthesized
tctacgatgggaattttcca

SEQ ID NO: 12598 - DNA, 20 bp, Artificial Sequence
  chemically synthesized
tttctacgatgggaattttc

SEQ ID NO: 12599 - DNA, 20 bp, Artificial Sequence
  chemically synthesized
tctctggaaaattcccatcg

SEQ ID NO: 12600 - DNA, 20 bp, Artificial Sequence
  chemically synthesized
cccccaaccttttctacgat

SEQ ID NO: 12601 - DNA, 20 bp, Artificial Sequence
  chemically synthesized
tcccccaaccttttctacga

SEQ ID NO: 12602 - DNA, 20 bp, Artificial Sequence
  chemically synthesized
ggaaaattcccatcgtagaa

SEQ ID NO: 12603 - DNA, 20 bp, Artificial Sequence
  chemically synthesized
gaaaattcccatcgtagaaa

SEQ ID NO: 12604 - DNA, 20 bp, Artificial Sequence
  chemically synthesized
attcccatcgtagaaaaggt

SEQ ID NO: 12605 - DNA, 20 bp, Artificial Sequence
  chemically synthesized
ttcccatcgtagaaaaggtt

SEQ ID NO: 12606 - DNA, 20 bp, Artificial Sequence
  chemically synthesized
tcccatcgtagaaaaggttg

SEQ ID NO: 12607 - DNA, 20 bp, Artificial Sequence
  chemically synthesized
cccatcgtagaaaaggttgg

SEQ ID NO: 12608 - DNA, 20 bp, Artificial Sequence
  chemically synthesized
catcgtagaaaaggttgggg

SEQ ID NO: 12609 - DNA, 20 bp, Artificial Sequence
  chemically synthesized
gtagaaaaggttgggggaga

SEQ ID NO: 12610 - DNA, 20 bp, Artificial Sequence
  chemically synthesized
aggttgggggagacagtttc

SEQ ID NO: 12611 - DNA, 20 bp, Artificial Sequence
  chemically synthesized
ggttgggggagacagtttct

SEQ ID NO: 12612 - DNA, 20 bp, Artificial Sequence
  chemically synthesized
tgggggagacagtttctagg

SEQ ID NO: 12613 - DNA, 20 bp, Artificial Sequence
  chemically synthesized
taggaggacaaaatgcttcc

SEQ ID NO: 12614 - DNA, 20 bp, Artificial Sequence
  chemically synthesized
gtgagaaattacaaagtagg

SEQ ID NO: 12615 - DNA, 20 bp, Artificial Sequence
  chemically synthesized
tgtgagaaattacaaagtag

SEQ ID NO: 12616 - DNA, 20 bp, Artificial Sequence
  chemically synthesized
gatgtgagaaattacaaagt

SEQ ID NO: 12617 - DNA, 20 bp, Artificial Sequence
  chemically synthesized
ggatgtgagaaattacaaag

SEQ ID NO: 12618 - DNA, 20 bp, Artificial Sequence
  chemically synthesized
ataggatgtgagaaattaca

SEQ ID NO: 12619 - DNA, 20 bp, Artificial Sequence
  chemically synthesized
atttcggaattataggatgt

SEQ ID NO: 12620 - DNA, 20 bp, Artificial Sequence
  chemically synthesized
taacacaatttcggaattat

SEQ ID NO: 12621 - DNA, 20 bp, Artificial Sequence
  chemically synthesized
ctaacacaatttcggaatta

SEQ ID NO: 12622 - DNA, 20 bp, Artificial Sequence
  chemically synthesized
acatagggctaacacaattt

SEQ ID NO: 12623 - DNA, 20 bp, Artificial Sequence
  chemically synthesized
ctataattccgaaattgtgt

SEQ ID NO: 12624 - DNA, 20 bp, Artificial Sequence
  chemically synthesized
gaaattgtgttagccctatg

SEQ ID NO: 12625 - DNA, 20 bp, Artificial Sequence
  chemically synthesized
ttaaaattttaaaccacata

SEQ ID NO: 12626 - DNA, 20 bp, Artificial Sequence
  chemically synthesized
tttaaaattttaaaccacat

SEQ ID NO: 12627 - DNA, 20 bp, Artificial Sequence
  chemically synthesized
atttaaaattttaaaccaca

SEQ ID NO: 12628 - DNA, 20 bp, Artificial Sequence
  chemically synthesized
atgtggtttaaaattttaaa

SEQ ID NO: 12629 - DNA, 20 bp, Artificial Sequence
  chemically synthesized
agatagcctataaatggcgc

SEQ ID NO: 12630 - DNA, 20 bp, Artificial Sequence
  chemically synthesized
aagatagcctataaatggcg

SEQ ID NO: 12631 - DNA, 20 bp, Artificial Sequence
  chemically synthesized
gtttacacctgcgccattta

SEQ ID NO: 12632 - DNA, 20 bp, Artificial Sequence
  chemically synthesized
tttacacctgcgccatttat

SEQ ID NO: 12633 - DNA, 20 bp, Artificial Sequence
  chemically synthesized
ataagaagatagcctataaa

SEQ ID NO: 12634 - DNA, 20 bp, Artificial Sequence
  chemically synthesized
gctttgatccaataagaaga

SEQ ID NO: 12635 - DNA, 20 bp, Artificial Sequence
  chemically synthesized
tttataggctatcttcttat

SEQ ID NO: 12636 - DNA, 20 bp, Artificial Sequence
  chemically synthesized
tacagctttgatccaataag

SEQ ID NO: 12637 - DNA, 20 bp, Artificial Sequence
  chemically synthesized
atatacagctttgatccaat

SEQ ID NO: 12638 - DNA, 20 bp, Artificial Sequence
  chemically synthesized
gctatcttcttattggatca

SEQ ID NO: 12639 - DNA, 20 bp, Artificial Sequence
  chemically synthesized
taagtatctaggcagatata

SEQ ID NO: 12640 - DNA, 20 bp, Artificial Sequence
  chemically synthesized
atcaaagctgtatatctgcc

SEQ ID NO: 12641 - DNA, 20 bp, Artificial Sequence
  chemically synthesized
aataattgtaagtatctagg

SEQ ID NO: 12642 - DNA, 20 bp, Artificial Sequence
  chemically synthesized
taaaataattgtaagtatct

SEQ ID NO: 12643 - DNA, 20 bp, Artificial Sequence
  chemically synthesized
ctaaaataattgtaagtatc

SEQ ID NO: 12644 - DNA, 20 bp, Artificial Sequence
  chemically synthesized
tttgaagctaaaataattgt

SEQ ID NO: 12645 - DNA, 20 bp, Artificial Sequence
  chemically synthesized
ctagatacttacaattattt

SEQ ID NO: 12646 - DNA, 20 bp, Artificial Sequence
  chemically synthesized
ttacaattattttagcttca

SEQ ID NO: 12647 - DNA, 20 bp, Artificial Sequence
  chemically synthesized
acaattattttagcttcaaa

SEQ ID NO: 12648 - DNA, 20 bp, Artificial Sequence
  chemically synthesized
caattattttagcttcaaag

SEQ ID NO: 12649 - DNA, 20 bp, Artificial Sequence
  chemically synthesized
gtactagagtagcctctttg

SEQ ID NO: 12650 - DNA, 20 bp, Artificial Sequence
  chemically synthesized
tagcttcaaagaggctactc

SEQ ID NO: 12651 - DNA, 20 bp, Artificial Sequence
  chemically synthesized
taagaagtcttgtactagag

SEQ ID NO: 12652 - DNA, 20 bp, Artificial Sequence
  chemically synthesized
caaagaggctactctagtac

SEQ ID NO: 12653 - DNA, 20 bp, Artificial Sequence
  chemically synthesized
ttttaagaagtcttgtacta

SEQ ID NO: 12654 - DNA, 20 bp, Artificial Sequence
  chemically synthesized
agttttaagaagtcttgtac

SEQ ID NO: 12655 - DNA, 20 bp, Artificial Sequence
  chemically synthesized
ttgatacatggagttttaag

SEQ ID NO: 12656 - DNA, 20 bp, Artificial Sequence
  chemically synthesized
atcttgatacatggagtttt

SEQ ID NO: 12657 - DNA, 20 bp, Artificial Sequence
  chemically synthesized
tcaagacatcttgatacatg

SEQ ID NO: 12658 - DNA, 20 bp, Artificial Sequence
  chemically synthesized
ttcttaaaactccatgtatc

SEQ ID NO: 12659 - DNA, 20 bp, Artificial Sequence
  chemically synthesized
gatcaagacatcttgataca

SEQ ID NO: 12660 - DNA, 20 bp, Artificial Sequence
  chemically synthesized
tttacaaaattgcatagatc

SEQ ID NO: 12661 - DNA, 20 bp, Artificial Sequence
  chemically synthesized
ttcttctttacaaaattgca

SEQ ID NO: 12662 - DNA, 20 bp, Artificial Sequence
  chemically synthesized
ttgatctatgcaattttgta

SEQ ID NO: 12663 - DNA, 20 bp, Artificial Sequence
  chemically synthesized
atctatgcaattttgtaaag

SEQ ID NO: 12664 - DNA, 20 bp, Artificial Sequence
  chemically synthesized
aagaaatgtatcttccaatt

SEQ ID NO: 12665 - DNA, 20 bp, Artificial Sequence
  chemically synthesized
tagtcttgctgctgaattgg

SEQ ID NO: 12666 - DNA, 20 bp, Artificial Sequence
  chemically synthesized
aaatgtatcttccaattcag

SEQ ID NO: 12667 - DNA, 20 bp, Artificial Sequence
  chemically synthesized
gtatagtcttgctgctgaat

SEQ ID NO: 12668 - DNA, 20 bp, Artificial Sequence
  chemically synthesized
gtatcttccaattcagcagc

SEQ ID NO: 12669 - DNA, 20 bp, Artificial Sequence
  chemically synthesized
tgtgctagaaattagtggta

SEQ ID NO: 12670 - DNA, 20 bp, Artificial Sequence
  chemically synthesized
tattttgtgctagaaattag

SEQ ID NO: 12671 - DNA, 20 bp, Artificial Sequence
  chemically synthesized
aagactataccactaatttc

SEQ ID NO: 12672 - DNA, 20 bp, Artificial Sequence
  chemically synthesized
ttctattttgtgctagaaat

SEQ ID NO: 12673 - DNA, 20 bp, Artificial Sequence
  chemically synthesized
agggtcattctattttgtgc

SEQ ID NO: 12674 - DNA, 20 bp, Artificial Sequence
  chemically synthesized
cactaatttctagcacaaaa

SEQ ID NO: 12675 - DNA, 20 bp, Artificial Sequence
  chemically synthesized
agcacaaaatagaatgaccc

SEQ ID NO: 12676 - DNA, 20 bp, Artificial Sequence
  chemically synthesized
aaacctcacaatataatcca

SEQ ID NO: 12677 - DNA, 20 bp, Artificial Sequence
  chemically synthesized
aaaacctcacaatataatcc

SEQ ID NO: 12678 - DNA, 20 bp, Artificial Sequence
  chemically synthesized
taaaacctcacaatataatc

SEQ ID NO: 12679 - DNA, 20 bp, Artificial Sequence
  chemically synthesized
atgaccctggattatattgt

SEQ ID NO: 12680 - DNA, 20 bp, Artificial Sequence
  chemically synthesized
tgaccctggattatattgtg

SEQ ID NO: 12681 - DNA, 20 bp, Artificial Sequence
  chemically synthesized
tatattgtgaggttttaaaa

SEQ ID NO: 12682 - DNA, 20 bp, Artificial Sequence
  chemically synthesized
aaaagaatgactaaatttca

SEQ ID NO: 12683 - DNA, 20 bp, Artificial Sequence
  chemically synthesized
tcatgacgttctatgaaatt

SEQ ID NO: 12684 - DNA, 20 bp, Artificial Sequence
  chemically synthesized
agtatctctaagaaatattt

SEQ ID NO: 12685 - DNA, 20 bp, Artificial Sequence
  chemically synthesized
atgatatctgaaatatttct

SEQ ID NO: 12686 - DNA, 20 bp, Artificial Sequence
  chemically synthesized
gatatctgaaatatttctta

SEQ ID NO: 12687 - DNA, 20 bp, Artificial Sequence
  chemically synthesized
ttttagcacacagtatctct

SEQ ID NO: 12688 - DNA, 20 bp, Artificial Sequence
  chemically synthesized
ctcacctatgttttagcaca

SEQ ID NO: 12689 - DNA, 20 bp, Artificial Sequence
  chemically synthesized
agatactgtgtgctaaaaca

SEQ ID NO: 12690 - DNA, 20 bp, Artificial Sequence
  chemically synthesized
gatactgtgtgctaaaacat

SEQ ID NO: 12691 - DNA, 20 bp, Artificial Sequence
  chemically synthesized
ttattttctcacctatgttt

SEQ ID NO: 12692 - DNA, 20 bp, Artificial Sequence
  chemically synthesized
ctgtgtgctaaaacataggt

SEQ ID NO: 12693 - DNA, 20 bp, Artificial Sequence
  chemically synthesized
taaaacataggtgagaaaat

SEQ ID NO: 12694 - DNA, 20 bp, Artificial Sequence
  chemically synthesized
aaacataggtgagaaaataa

SEQ ID NO: 12695 - DNA, 20 bp, Artificial Sequence
  chemically synthesized
aacataggtgagaaaataag

SEQ ID NO: 12696 - DNA, 20 bp, Artificial Sequence
  chemically synthesized
cataggtgagaaaataagag

SEQ ID NO: 12697 - DNA, 20 bp, Artificial Sequence
  chemically synthesized
agaaaataagaggagatcat

SEQ ID NO: 12698 - DNA, 20 bp, Artificial Sequence
  chemically synthesized
aaataagaggagatcattag

SEQ ID NO: 12699 - DNA, 20 bp, Artificial Sequence
  chemically synthesized
aataagaggagatcattagc

SEQ ID NO: 12700 - DNA, 20 bp, Artificial Sequence
  chemically synthesized
gaggagatcattagcaggaa

SEQ ID NO: 12701 - DNA, 20 bp, Artificial Sequence
  chemically synthesized
gtttatatacaaaaagcata

SEQ ID NO: 12702 - DNA, 20 bp, Artificial Sequence
  chemically synthesized
gataggtgtttatatacaaa

SEQ ID NO: 12703 - DNA, 20 bp, Artificial Sequence
  chemically synthesized
ctatggagataagaaaagat

SEQ ID NO: 12704 - DNA, 20 bp, Artificial Sequence
  chemically synthesized
cctatggagataagaaaaga

SEQ ID NO: 12705 - DNA, 20 bp, Artificial Sequence
  chemically synthesized
ctagcctatggagataagaa

SEQ ID NO: 12706 - DNA, 20 bp, Artificial Sequence
  chemically synthesized
cctatcttttcttatctcca

SEQ ID NO: 12707 - DNA, 20 bp, Artificial Sequence
  chemically synthesized
gaattctagcctatggagat

SEQ ID NO: 12708 - DNA, 20 bp, Artificial Sequence
  chemically synthesized
ctatcttttcttatctccat

SEQ ID NO: 12709 - DNA, 20 bp, Artificial Sequence
  chemically synthesized
cttttcttatctccataggc

SEQ ID NO: 12710 - DNA, 20 bp, Artificial Sequence
  chemically synthesized
taccagaattctagcctatg

SEQ ID NO: 12711 - DNA, 20 bp, Artificial Sequence
  chemically synthesized
cctaccagaattctagccta

SEQ ID NO: 12712 - DNA, 20 bp, Artificial Sequence
  chemically synthesized
atctccataggctagaattc

SEQ ID NO: 12713 - DNA, 20 bp, Artificial Sequence
  chemically synthesized
tgttaaccctaccagaattc

SEQ ID NO: 12714 - DNA, 20 bp, Artificial Sequence
  chemically synthesized
tccataggctagaattctgg

SEQ ID NO: 12715 - DNA, 20 bp, Artificial Sequence
  chemically synthesized
ccataggctagaattctggt

SEQ ID NO: 12716 - DNA, 20 bp, Artificial Sequence
  chemically synthesized
cataggctagaattctggta

SEQ ID NO: 12717 - DNA, 20 bp, Artificial Sequence
  chemically synthesized
tgaaaaaatgttaaccctac

SEQ ID NO: 12718 - DNA, 20 bp, Artificial Sequence
  chemically synthesized
attaatagatcagatatgaa

SEQ ID NO: 12719 - DNA, 20 bp, Artificial Sequence
  chemically synthesized
aattaatagatcagatatga

SEQ ID NO: 12720 - DNA, 20 bp, Artificial Sequence
  chemically synthesized
ttcaaggataattaatagat

SEQ ID NO: 12721 - DNA, 20 bp, Artificial Sequence
  chemically synthesized
aaaacttcaaggataattaa

SEQ ID NO: 12722 - DNA, 20 bp, Artificial Sequence
  chemically synthesized
tgatctattaattatccttg

SEQ ID NO: 12723 - DNA, 20 bp, Artificial Sequence
  chemically synthesized
aagatactataaaaacttca

SEQ ID NO: 12724 - DNA, 20 bp, Artificial Sequence
  chemically synthesized
aaagatactataaaaacttc

SEQ ID NO: 12725 - DNA, 20 bp, Artificial Sequence
  chemically synthesized
aattatccttgaagttttta

SEQ ID NO: 12726 - DNA, 20 bp, Artificial Sequence
  chemically synthesized
gaagtttttatagtatcttt

SEQ ID NO: 12727 - DNA, 20 bp, Artificial Sequence
  chemically synthesized
ttttcctaaggttaatccaa

SEQ ID NO: 12728 - DNA, 20 bp, Artificial Sequence
  chemically synthesized
agtatcttttggattaacct

SEQ ID NO: 12729 - DNA, 20 bp, Artificial Sequence
  chemically synthesized
gtatcttttggattaacctt

SEQ ID NO: 12730 - DNA, 20 bp, Artificial Sequence
  chemically synthesized
acagatggttttttttccta

SEQ ID NO: 12731 - DNA, 20 bp, Artificial Sequence
  chemically synthesized
aacagatggttttttttcct

SEQ ID NO: 12732 - DNA, 20 bp, Artificial Sequence
  chemically synthesized
aaactggttttcagaacaga

SEQ ID NO: 12733 - DNA, 20 bp, Artificial Sequence
  chemically synthesized
gcctaaactggttttcagaa

SEQ ID NO: 12734 - DNA, 20 bp, Artificial Sequence
  chemically synthesized
aaaccatctgttctgaaaac

SEQ ID NO: 12735 - DNA, 20 bp, Artificial Sequence
  chemically synthesized
tccaagcctaaactggtttt

SEQ ID NO: 12736 - DNA, 20 bp, Artificial Sequence
  chemically synthesized
atctgttctgaaaaccagtt

SEQ ID NO: 12737 - DNA, 20 bp, Artificial Sequence
  chemically synthesized
tctgttctgaaaaccagttt

SEQ ID NO: 12738 - DNA, 20 bp, Artificial Sequence
  chemically synthesized
gaaaaagtccaagcctaaac

SEQ ID NO: 12739 - DNA, 20 bp, Artificial Sequence
  chemically synthesized
tctgaaaaccagtttaggct

SEQ ID NO: 12740 - DNA, 20 bp, Artificial Sequence
  chemically synthesized
ccaattaaaagaaaaagtcc

SEQ ID NO: 12741 - DNA, 20 bp, Artificial Sequence
  chemically synthesized
gctattccaattaaaagaaa

SEQ ID NO: 12742 - DNA, 20 bp, Artificial Sequence
  chemically synthesized
cttggactttttcttttaat

SEQ ID NO: 12743 - DNA, 20 bp, Artificial Sequence
  chemically synthesized
ttttgtgctattccaattaa

SEQ ID NO: 12744 - DNA, 20 bp, Artificial Sequence
  chemically synthesized
actttttcttttaattggaa

SEQ ID NO: 12745 - DNA, 20 bp, Artificial Sequence
  chemically synthesized
ttttaattggaatagcacaa

SEQ ID NO: 12746 - DNA, 20 bp, Artificial Sequence
  chemically synthesized
tttaattggaatagcacaaa

SEQ ID NO: 12747 - DNA, 20 bp, Artificial Sequence
  chemically synthesized
gtgtcagcagagaaatggaa

SEQ ID NO: 12748 - DNA, 20 bp, Artificial Sequence
  chemically synthesized
ctgtgtcagcagagaaatgg

SEQ ID NO: 12749 - DNA, 20 bp, Artificial Sequence
  chemically synthesized
tttctgtgtcagcagagaaa

SEQ ID NO: 12750 - DNA, 20 bp, Artificial Sequence
  chemically synthesized
aagggctttctgtgtcagca

SEQ ID NO: 12751 - DNA, 20 bp, Artificial Sequence
  chemically synthesized
cttccatttctctgctgaca

SEQ ID NO: 12752 - DNA, 20 bp, Artificial Sequence
  chemically synthesized
ctaagggctttctgtgtcag

SEQ ID NO: 12753 - DNA, 20 bp, Artificial Sequence
  chemically synthesized
catttctctgctgacacaga

SEQ ID NO: 12754 - DNA, 20 bp, Artificial Sequence
  chemically synthesized
tacctaagggctttctgtgt

SEQ ID NO: 12755 - DNA, 20 bp, Artificial Sequence
  chemically synthesized
ctgctgacacagaaagccct

SEQ ID NO: 12756 - DNA, 20 bp, Artificial Sequence
  chemically synthesized
tgctgacacagaaagccctt

SEQ ID NO: 12757 - DNA, 20 bp, Artificial Sequence
  chemically synthesized
acacagaaagcccttaggta

SEQ ID NO: 12758 - DNA, 20 bp, Artificial Sequence
  chemically synthesized
ggatttatgcctttacctaa

SEQ ID NO: 12759 - DNA, 20 bp, Artificial Sequence
  chemically synthesized
cacagaaagcccttaggtaa

SEQ ID NO: 12760 - DNA, 20 bp, Artificial Sequence
  chemically synthesized
tggatttatgcctttaccta

SEQ ID NO: 12761 - DNA, 20 bp, Artificial Sequence
  chemically synthesized
ttggatttatgcctttacct

SEQ ID NO: 12762 - DNA, 20 bp, Artificial Sequence
  chemically synthesized
aggtaaaggcataaatccaa

SEQ ID NO: 12763 - DNA, 20 bp, Artificial Sequence
  chemically synthesized
attacattatcgttgacttt

SEQ ID NO: 12764 - DNA, 20 bp, Artificial Sequence
  chemically synthesized
aagtcaacgataatgtaatt

SEQ ID NO: 12765 - DNA, 20 bp, Artificial Sequence
  chemically synthesized
gtcaacgataatgtaattca

SEQ ID NO: 12766 - DNA, 20 bp, Artificial Sequence
  chemically synthesized
caacgataatgtaattcaga

SEQ ID NO: 12767 - DNA, 20 bp, Artificial Sequence
  chemically synthesized
aacgataatgtaattcagag

SEQ ID NO: 12768 - DNA, 20 bp, Artificial Sequence
  chemically synthesized
atgtaattcagagaggaccc

SEQ ID NO: 12769 - DNA, 20 bp, Artificial Sequence
  chemically synthesized
attcagagaggaccctggtt

SEQ ID NO: 12770 - DNA, 20 bp, Artificial Sequence
  chemically synthesized
ttggacactgggctaaacca

SEQ ID NO: 12771 - DNA, 20 bp, Artificial Sequence
  chemically synthesized
cttggacactgggctaaacc

SEQ ID NO: 12772 - DNA, 20 bp, Artificial Sequence
  chemically synthesized
acttggacactgggctaaac

SEQ ID NO: 12773 - DNA, 20 bp, Artificial Sequence
  chemically synthesized
gagaggaccctggtttagcc

SEQ ID NO: 12774 - DNA, 20 bp, Artificial Sequence
  chemically synthesized
cctggtttagcccagtgtcc

SEQ ID NO: 12775 - DNA, 20 bp, Artificial Sequence
  chemically synthesized
ttcaacgctacttggacact

SEQ ID NO: 12776 - DNA, 20 bp, Artificial Sequence
  chemically synthesized
cttcaacgctacttggacac

SEQ ID NO: 12777 - DNA, 20 bp, Artificial Sequence
  chemically synthesized
ggtttagcccagtgtccaag

SEQ ID NO: 12778 - DNA, 20 bp, Artificial Sequence
  chemically synthesized
ccaagtccttcaacgctact

SEQ ID NO: 12779 - DNA, 20 bp, Artificial Sequence
  chemically synthesized
ccagtgtccaagtagcgttg

SEQ ID NO: 12780 - DNA, 20 bp, Artificial Sequence
  chemically synthesized
cagtgtccaagtagcgttga

SEQ ID NO: 12781 - DNA, 20 bp, Artificial Sequence
  chemically synthesized
ccaagtagcgttgaaggact

SEQ ID NO: 12782 - DNA, 20 bp, Artificial Sequence
  chemically synthesized
ttctccttagtgtttcaacc

SEQ ID NO: 12783 - DNA, 20 bp, Artificial Sequence
  chemically synthesized
aaggacttggttgaaacact

SEQ ID NO: 12784 - DNA, 20 bp, Artificial Sequence
  chemically synthesized
aggacttggttgaaacacta

SEQ ID NO: 12785 - DNA, 20 bp, Artificial Sequence
  chemically synthesized
gacttggttgaaacactaag

SEQ ID NO: 12786 - DNA, 20 bp, Artificial Sequence
  chemically synthesized
agaaacaaacacattctcct

SEQ ID NO: 12787 - DNA, 20 bp, Artificial Sequence
  chemically synthesized
tttttcttttttaatgtaag

SEQ ID NO: 12788 - DNA, 20 bp, Artificial Sequence
  chemically synthesized
atctttttcttttttaatgt

SEQ ID NO: 12789 - DNA, 20 bp, Artificial Sequence
  chemically synthesized
tgtttcttcttacattaaaa

SEQ ID NO: 12790 - DNA, 20 bp, Artificial Sequence
  chemically synthesized
ttcttacattaaaaaagaaa

SEQ ID NO: 12791 - DNA, 20 bp, Artificial Sequence
  chemically synthesized
cattaaaaaagaaaaagatg

SEQ ID NO: 12792 - DNA, 20 bp, Artificial Sequence
  chemically synthesized
aaagaaaaagatgcagttac

SEQ ID NO: 12793 - DNA, 20 bp, Artificial Sequence
  chemically synthesized
gaaaaagatgcagttaccag

SEQ ID NO: 12794 - DNA, 20 bp, Artificial Sequence
  chemically synthesized
agatgcagttaccagtagct

SEQ ID NO: 12795 - DNA, 20 bp, Artificial Sequence
  chemically synthesized
tctaatgcaagcttagctac

SEQ ID NO: 12796 - DNA, 20 bp, Artificial Sequence
  chemically synthesized
cacattttctaatgcaagct

SEQ ID NO: 12797 - DNA, 20 bp, Artificial Sequence
  chemically synthesized
accagtagctaagcttgcat

SEQ ID NO: 12798 - DNA, 20 bp, Artificial Sequence
  chemically synthesized
tctggcacattttctaatgc

SEQ ID NO: 12799 - DNA, 20 bp, Artificial Sequence
  chemically synthesized
gcttgcattagaaaatgtgc

SEQ ID NO: 12800 - DNA, 20 bp, Artificial Sequence
  chemically synthesized
tattaagaaatatgaatttc

SEQ ID NO: 12801 - DNA, 20 bp, Artificial Sequence
  chemically synthesized
ttatcttactgtagtatatt

SEQ ID NO: 12802 - DNA, 20 bp, Artificial Sequence
  chemically synthesized
tcatatttcttaatatacta

SEQ ID NO: 12803 - DNA, 20 bp, Artificial Sequence
  chemically synthesized
atttcttaatatactacagt

SEQ ID NO: 12804 - DNA, 20 bp, Artificial Sequence
  chemically synthesized
gtgtcgtaattatcttactg

SEQ ID NO: 12805 - DNA, 20 bp, Artificial Sequence
  chemically synthesized
aagataattacgacacacta

SEQ ID NO: 12806 - DNA, 20 bp, Artificial Sequence
  chemically synthesized
atttccctagttatttgcta

SEQ ID NO: 12807 - DNA, 20 bp, Artificial Sequence
  chemically synthesized
gacacactatagcaaataac

SEQ ID NO: 12808 - DNA, 20 bp, Artificial Sequence
  chemically synthesized
acacactatagcaaataact

SEQ ID NO: 12809 - DNA, 20 bp, Artificial Sequence
  chemically synthesized
cacactatagcaaataacta

SEQ ID NO: 12810 - DNA, 20 bp, Artificial Sequence
  chemically synthesized
atagcaaataactagggaaa

SEQ ID NO: 12811 - DNA, 20 bp, Artificial Sequence
  chemically synthesized
agggaagaattccatttccc

SEQ ID NO: 12812 - DNA, 20 bp, Artificial Sequence
  chemically synthesized
gggaaatggaattcttccct

SEQ ID NO: 12813 - DNA, 20 bp, Artificial Sequence
  chemically synthesized
gaaatggaattcttccctga

SEQ ID NO: 12814 - DNA, 20 bp, Artificial Sequence
  chemically synthesized
aagacctttctctctcaggg

SEQ ID NO: 12815 - DNA, 20 bp, Artificial Sequence
  chemically synthesized
aatggaattcttccctgaga

SEQ ID NO: 12816 - DNA, 20 bp, Artificial Sequence
  chemically synthesized
aataagacctttctctctca

SEQ ID NO: 12817 - DNA, 20 bp, Artificial Sequence
  chemically synthesized
aaataagacctttctctctc

SEQ ID NO: 12818 - DNA, 20 bp, Artificial Sequence
  chemically synthesized
gaattcttccctgagagaga

SEQ ID NO: 12819 - DNA, 20 bp, Artificial Sequence
  chemically synthesized
taaataagacctttctctct

SEQ ID NO: 12820 - DNA, 20 bp, Artificial Sequence
  chemically synthesized
aattcttccctgagagagaa

SEQ ID NO: 12821 - DNA, 20 bp, Artificial Sequence
  chemically synthesized
atgacattggtttcataaat

SEQ ID NO: 12822 - DNA, 20 bp, Artificial Sequence
  chemically synthesized
acacttgacctagatgacat

SEQ ID NO: 12823 - DNA, 20 bp, Artificial Sequence
  chemically synthesized
tttatgaaaccaatgtcatc

SEQ ID NO: 12824 - DNA, 20 bp, Artificial Sequence
  chemically synthesized
ttatgaaaccaatgtcatct

SEQ ID NO: 12825 - DNA, 20 bp, Artificial Sequence
  chemically synthesized
aaaccaatgtcatctaggtc

SEQ ID NO: 12826 - DNA, 20 bp, Artificial Sequence
  chemically synthesized
gattatgattacacttgacc

SEQ ID NO: 12827 - DNA, 20 bp, Artificial Sequence
  chemically synthesized
aatcataatcaaattgaaat

SEQ ID NO: 12828 - DNA, 20 bp, Artificial Sequence
  chemically synthesized
tcaaattgaaatgagttata

SEQ ID NO: 12829 - DNA, 20 bp, Artificial Sequence
  chemically synthesized
ataaagacgtttaaattgtc

SEQ ID NO: 12830 - DNA, 20 bp, Artificial Sequence
  chemically synthesized
aaagacgtttaaattgtcaa

SEQ ID NO: 12831 - DNA, 20 bp, Artificial Sequence
  chemically synthesized
aagacgtttaaattgtcaag

SEQ ID NO: 12832 - DNA, 20 bp, Artificial Sequence
  chemically synthesized
gatctgcttattaaattgag

SEQ ID NO: 12833 - DNA, 20 bp, Artificial Sequence
  chemically synthesized
ttggatctgcttattaaatt

SEQ ID NO: 12834 - DNA, 20 bp, Artificial Sequence
  chemically synthesized
cgatgactactcaatttaat

SEQ ID NO: 12835 - DNA, 20 bp, Artificial Sequence
  chemically synthesized
tgactactcaatttaataag

SEQ ID NO: 12836 - DNA, 20 bp, Artificial Sequence
  chemically synthesized
caatttaataagcagatcca

SEQ ID NO: 12837 - DNA, 20 bp, Artificial Sequence
  chemically synthesized
aagtttcacatggaaatctt

SEQ ID NO: 12838 - DNA, 20 bp, Artificial Sequence
  chemically synthesized
aactatagtgaagtttcaca

SEQ ID NO: 12839 - DNA, 20 bp, Artificial Sequence
  chemically synthesized
ttccatgtgaaacttcacta

SEQ ID NO: 12840 - DNA, 20 bp, Artificial Sequence
  chemically synthesized
aactctccaaaactatagtg

SEQ ID NO: 12841 - DNA, 20 bp, Artificial Sequence
  chemically synthesized
gtgaaacttcactatagttt

SEQ ID NO: 12842 - DNA, 20 bp, Artificial Sequence
  chemically synthesized
agattaactctccaaaacta

SEQ ID NO: 12843 - DNA, 20 bp, Artificial Sequence
  chemically synthesized
gaaacttcactatagttttg

SEQ ID NO: 12844 - DNA, 20 bp, Artificial Sequence
  chemically synthesized
aacttcactatagttttgga

SEQ ID NO: 12845 - DNA, 20 bp, Artificial Sequence
  chemically synthesized
ccagggttctagaagattaa

SEQ ID NO: 12846 - DNA, 20 bp, Artificial Sequence
  chemically synthesized
gagttaatctgttaatcttc

SEQ ID NO: 12847 - DNA, 20 bp, Artificial Sequence
  chemically synthesized
gggctatgccagggttctag

SEQ ID NO: 12848 - DNA, 20 bp, Artificial Sequence
  chemically synthesized
ctgttaatcttctagaaccc

SEQ ID NO: 12849 - DNA, 20 bp, Artificial Sequence
  chemically synthesized
aatgggctatgccagggttc

SEQ ID NO: 12850 - DNA, 20 bp, Artificial Sequence
  chemically synthesized
aatcttctagaaccctggca

SEQ ID NO: 12851 - DNA, 20 bp, Artificial Sequence
  chemically synthesized
tctaataatgggctatgcca

SEQ ID NO: 12852 - DNA, 20 bp, Artificial Sequence
  chemically synthesized
ttctaataatgggctatgcc

SEQ ID NO: 12853 - DNA, 20 bp, Artificial Sequence
  chemically synthesized
tttctaataatgggctatgc

SEQ ID NO: 12854 - DNA, 20 bp, Artificial Sequence
  chemically synthesized
accctggcatagcccattat

SEQ ID NO: 12855 - DNA, 20 bp, Artificial Sequence
  chemically synthesized
cttagcatttttctaataat

SEQ ID NO: 12856 - DNA, 20 bp, Artificial Sequence
  chemically synthesized
ccttagcatttttctaataa

SEQ ID NO: 12857 - DNA, 20 bp, Artificial Sequence
  chemically synthesized
cccattattagaaaaatgct

SEQ ID NO: 12858 - DNA, 20 bp, Artificial Sequence
  chemically synthesized
ccattattagaaaaatgcta

SEQ ID NO: 12859 - DNA, 20 bp, Artificial Sequence
  chemically synthesized
gaagatttcaaaacagacct

SEQ ID NO: 12860 - DNA, 20 bp, Artificial Sequence
  chemically synthesized
ctgcagtgaagatttcaaaa

SEQ ID NO: 12861 - DNA, 20 bp, Artificial Sequence
  chemically synthesized
ctgttttgaaatcttcactg

SEQ ID NO: 12862 - DNA, 20 bp, Artificial Sequence
  chemically synthesized
atttatcttgatctgcagtg

SEQ ID NO: 12863 - DNA, 20 bp, Artificial Sequence
  chemically synthesized
tgaaatcttcactgcagatc

SEQ ID NO: 12864 - DNA, 20 bp, Artificial Sequence
  chemically synthesized
tattaatttatcttgatctg

SEQ ID NO: 12865 - DNA, 20 bp, Artificial Sequence
  chemically synthesized
gatcaagataaattaatact

SEQ ID NO: 12866 - DNA, 20 bp, Artificial Sequence
  chemically synthesized
tcttataatacaaataatcc

SEQ ID NO: 12867 - DNA, 20 bp, Artificial Sequence
  chemically synthesized
acttggattatttgtattat

SEQ ID NO: 12868 - DNA, 20 bp, Artificial Sequence
  chemically synthesized
gtattataagaactatcttt

SEQ ID NO: 12869 - DNA, 20 bp, Artificial Sequence
  chemically synthesized
gactggtctgttccaaaaga

SEQ ID NO: 12870 - DNA, 20 bp, Artificial Sequence
  chemically synthesized
ataagaactatcttttggaa

SEQ ID NO: 12871 - DNA, 20 bp, Artificial Sequence
  chemically synthesized
gaaagactggtctgttccaa

SEQ ID NO: 12872 - DNA, 20 bp, Artificial Sequence
  chemically synthesized
aactatcttttggaacagac

SEQ ID NO: 12873 - DNA, 20 bp, Artificial Sequence
  chemically synthesized
aaaatatgtaattgaaagac

SEQ ID NO: 12874 - DNA, 20 bp, Artificial Sequence
  chemically synthesized
ttaaaaaaatatgtaattga

SEQ ID NO: 12875 - DNA, 20 bp, Artificial Sequence
  chemically synthesized
caattacatatttttttaat

SEQ ID NO: 12876 - DNA, 20 bp, Artificial Sequence
  chemically synthesized
atatttttttaataagcaaa

SEQ ID NO: 12877 - DNA, 20 bp, Artificial Sequence
  chemically synthesized
ataagcaaaaagcctaccat

SEQ ID NO: 12878 - DNA, 20 bp, Artificial Sequence
  chemically synthesized
taagcaaaaagcctaccatc

SEQ ID NO: 12879 - DNA, 20 bp, Artificial Sequence
  chemically synthesized
aagcaaaaagcctaccatca

SEQ ID NO: 12880 - DNA, 20 bp, Artificial Sequence
  chemically synthesized
aatgtattttccctgatggt

SEQ ID NO: 12881 - DNA, 20 bp, Artificial Sequence
  chemically synthesized
taatgtattttccctgatgg

SEQ ID NO: 12882 - DNA, 20 bp, Artificial Sequence
  chemically synthesized
tactaatgtattttccctga

SEQ ID NO: 12883 - DNA, 20 bp, Artificial Sequence
  chemically synthesized
taccatcagggaaaatacat

SEQ ID NO: 12884 - DNA, 20 bp, Artificial Sequence
  chemically synthesized
catcagggaaaatacattag

SEQ ID NO: 12885 - DNA, 20 bp, Artificial Sequence
  chemically synthesized
agtagtgttttcccttgtaa

SEQ ID NO: 12886 - DNA, 20 bp, Artificial Sequence
  chemically synthesized
caggatagcaactattacaa

SEQ ID NO: 12887 - DNA, 20 bp, Artificial Sequence
  chemically synthesized
ccaggatagcaactattaca

SEQ ID NO: 12888 - DNA, 20 bp, Artificial Sequence
  chemically synthesized
tccaggatagcaactattac

SEQ ID NO: 12889 - DNA, 20 bp, Artificial Sequence
  chemically synthesized
ccttgtaatagttgctatcc

SEQ ID NO: 12890 - DNA, 20 bp, Artificial Sequence
  chemically synthesized
tgtaatagttgctatcctgg

SEQ ID NO: 12891 - DNA, 20 bp, Artificial Sequence
  chemically synthesized
tcttgtacacacttccagga

SEQ ID NO: 12892 - DNA, 20 bp, Artificial Sequence
  chemically synthesized
tcattcttgtacacacttcc

SEQ ID NO: 12893 - DNA, 20 bp, Artificial Sequence
  chemically synthesized
ttcattcttgtacacacttc

SEQ ID NO: 12894 - DNA, 20 bp, Artificial Sequence
  chemically synthesized
gctatcctggaagtgtgtac

SEQ ID NO: 12895 - DNA, 20 bp, Artificial Sequence
  chemically synthesized
ggaagtgtgtacaagaatga

SEQ ID NO: 12896 - DNA, 20 bp, Artificial Sequence
  chemically synthesized
gtgtacaagaatgaaagcct

SEQ ID NO: 12897 - DNA, 20 bp, Artificial Sequence
  chemically synthesized
agaatgaaagcctaagacct

SEQ ID NO: 12898 - DNA, 20 bp, Artificial Sequence
  chemically synthesized
tacttatgctccaaggtctt

SEQ ID NO: 12899 - DNA, 20 bp, Artificial Sequence
  chemically synthesized
gtacttatgctccaaggtct

SEQ ID NO: 12900 - DNA, 20 bp, Artificial Sequence
  chemically synthesized
aatgaaagcctaagaccttg

SEQ ID NO: 12901 - DNA, 20 bp, Artificial Sequence
  chemically synthesized
cttggtgtacttatgctcca

SEQ ID NO: 12902 - DNA, 20 bp, Artificial Sequence
  chemically synthesized
agcctaagaccttggagcat

SEQ ID NO: 12903 - DNA, 20 bp, Artificial Sequence
  chemically synthesized
tcttggtgtacttatgctcc

SEQ ID NO: 12904 - DNA, 20 bp, Artificial Sequence
  chemically synthesized
ccttggagcataagtacacc

SEQ ID NO: 12905 - DNA, 20 bp, Artificial Sequence
  chemically synthesized
gagcataagtacaccaagaa

SEQ ID NO: 12906 - DNA, 20 bp, Artificial Sequence
  chemically synthesized
cataagtacaccaagaaaag

SEQ ID NO: 12907 - DNA, 20 bp, Artificial Sequence
  chemically synthesized
atttatatgcctacttttct

SEQ ID NO: 12908 - DNA, 20 bp, Artificial Sequence
  chemically synthesized
ataagtacaccaagaaaagt

SEQ ID NO: 12909 - DNA, 20 bp, Artificial Sequence
  chemically synthesized
aaaatggtattaaagtattt

SEQ ID NO: 12910 - DNA, 20 bp, Artificial Sequence
  chemically synthesized
ttctgtataaaatggtatta

SEQ ID NO: 12911 - DNA, 20 bp, Artificial Sequence
  chemically synthesized
tactttaataccattttata

SEQ ID NO: 12912 - DNA, 20 bp, Artificial Sequence
  chemically synthesized
ataagattttctgtataaaa

SEQ ID NO: 12913 - DNA, 20 bp, Artificial Sequence
  chemically synthesized
tttatacagaaaatcttata

SEQ ID NO: 12914 - DNA, 20 bp, Artificial Sequence
  chemically synthesized
tatacagaaaatcttataca

SEQ ID NO: 12915 - DNA, 20 bp, Artificial Sequence
  chemically synthesized
aaagaattaaagctctgtat

SEQ ID NO: 12916 - DNA, 20 bp, Artificial Sequence
  chemically synthesized
atccttgaggcaaagaatta

SEQ ID NO: 12917 - DNA, 20 bp, Artificial Sequence
  chemically synthesized
gagctttaattctttgcctc

SEQ ID NO: 12918 - DNA, 20 bp, Artificial Sequence
  chemically synthesized
agctttaattctttgcctca

SEQ ID NO: 12919 - DNA, 20 bp, Artificial Sequence
  chemically synthesized
atggaattatccttgaggca

SEQ ID NO: 12920 - DNA, 20 bp, Artificial Sequence
  chemically synthesized
ataacatggaattatccttg

SEQ ID NO: 12921 - DNA, 20 bp, Artificial Sequence
  chemically synthesized
aataacatggaattatcctt

SEQ ID NO: 12922 - DNA, 20 bp, Artificial Sequence
  chemically synthesized
tattaataagaaaaataaca

SEQ ID NO: 12923 - DNA, 20 bp, Artificial Sequence
  chemically synthesized
taggcgccactgatattaat

SEQ ID NO: 12924 - DNA, 20 bp, Artificial Sequence
  chemically synthesized
gttatttttcttattaatat

SEQ ID NO: 12925 - DNA, 20 bp, Artificial Sequence
  chemically synthesized
atttttcttattaatatcag

SEQ ID NO: 12926 - DNA, 20 bp, Artificial Sequence
  chemically synthesized
aatatcagtggcgcctatca

SEQ ID NO: 12927 - DNA, 20 bp, Artificial Sequence
  chemically synthesized
gtgcttatgcatgctgtgat

SEQ ID NO: 12928 - DNA, 20 bp, Artificial Sequence
  chemically synthesized
tgtgcttatgcatgctgtga

SEQ ID NO: 12929 - DNA, 20 bp, Artificial Sequence
  chemically synthesized
gcgcctatcacagcatgcat

SEQ ID NO: 12930 - DNA, 20 bp, Artificial Sequence
  chemically synthesized
atcacagcatgcataagcac

SEQ ID NO: 12931 - DNA, 20 bp, Artificial Sequence
  chemically synthesized
ttaagatttctggttattgt

SEQ ID NO: 12932 - DNA, 20 bp, Artificial Sequence
  chemically synthesized
gcacaagaacttacaataac

SEQ ID NO: 12933 - DNA, 20 bp, Artificial Sequence
  chemically synthesized
tgtatattttttaagatttc

SEQ ID NO: 12934 - DNA, 20 bp, Artificial Sequence
  chemically synthesized
tcttttagtgtatatttttt

SEQ ID NO: 12935 - DNA, 20 bp, Artificial Sequence
  chemically synthesized
tcttaaaaaatatacactaa

SEQ ID NO: 12936 - DNA, 20 bp, Artificial Sequence
  chemically synthesized
ttaaaaaatatacactaaaa

SEQ ID NO: 12937 - DNA, 20 bp, Artificial Sequence
  chemically synthesized
ggtttaataaatgtctcttt

SEQ ID NO: 12938 - DNA, 20 bp, Artificial Sequence
  chemically synthesized
aaaagagacatttattaaac

SEQ ID NO: 12939 - DNA, 20 bp, Artificial Sequence
  chemically synthesized
catttattaaaccagaaaat

SEQ ID NO: 12940 - DNA, 20 bp, Artificial Sequence
  chemically synthesized
ctcccttttggctcattttc

SEQ ID NO: 12941 - DNA, 20 bp, Artificial Sequence
  chemically synthesized
taaaccagaaaatgagccaa

SEQ ID NO: 12942 - DNA, 20 bp, Artificial Sequence
  chemically synthesized
aaaccagaaaatgagccaaa

SEQ ID NO: 12943 - DNA, 20 bp, Artificial Sequence
  chemically synthesized
aaccagaaaatgagccaaaa

SEQ ID NO: 12944 - DNA, 20 bp, Artificial Sequence
  chemically synthesized
ccagaaaatgagccaaaagg

SEQ ID NO: 12945 - DNA, 20 bp, Artificial Sequence
  chemically synthesized
ctctgaccagtactcccttt

SEQ ID NO: 12946 - DNA, 20 bp, Artificial Sequence
  chemically synthesized
aatgagccaaaagggagtac

SEQ ID NO: 12947 - DNA, 20 bp, Artificial Sequence
  chemically synthesized
agccaaaagggagtactggt

SEQ ID NO: 12948 - DNA, 20 bp, Artificial Sequence
  chemically synthesized
ccaaaagggagtactggtca

SEQ ID NO: 12949 - DNA, 20 bp, Artificial Sequence
  chemically synthesized
ttaaatgattcatctctgac

SEQ ID NO: 12950 - DNA, 20 bp, Artificial Sequence
  chemically synthesized
agatgaatcatttaaaaacc

SEQ ID NO: 12951 - DNA, 20 bp, Artificial Sequence
  chemically synthesized
atcatttaaaaaccaagaat

SEQ ID NO: 12952 - DNA, 20 bp, Artificial Sequence
  chemically synthesized
tttgtattttcactaattct

SEQ ID NO: 12953 - DNA, 20 bp, Artificial Sequence
  chemically synthesized
caagaattagtgaaaataca

SEQ ID NO: 12954 - DNA, 20 bp, Artificial Sequence
  chemically synthesized
agtgaaaatacaaagccact

SEQ ID NO: 12955 - DNA, 20 bp, Artificial Sequence
  chemically synthesized
agttttgtttgtggactaag

SEQ ID NO: 12956 - DNA, 20 bp, Artificial Sequence
  chemically synthesized
cttagttttgtttgtggact

SEQ ID NO: 12957 - DNA, 20 bp, Artificial Sequence
  chemically synthesized
tttgcacttagttttgtttg

SEQ ID NO: 12958 - DNA, 20 bp, Artificial Sequence
  chemically synthesized
cttagtccacaaacaaaact

SEQ ID NO: 12959 - DNA, 20 bp, Artificial Sequence
  chemically synthesized
cacaaacaaaactaagtgca

SEQ ID NO: 12960 - DNA, 20 bp, Artificial Sequence
  chemically synthesized
gttttagaaggctttgcact

SEQ ID NO: 12961 - DNA, 20 bp, Artificial Sequence
  chemically synthesized
tcttttggaagtgttttaga

SEQ ID NO: 12962 - DNA, 20 bp, Artificial Sequence
  chemically synthesized
ttcttttggaagtgttttag

SEQ ID NO: 12963 - DNA, 20 bp, Artificial Sequence
  chemically synthesized
accttcttttggaagtgttt

SEQ ID NO: 12964 - DNA, 20 bp, Artificial Sequence
  chemically synthesized
gccttctaaaacacttccaa

SEQ ID NO: 12965 - DNA, 20 bp, Artificial Sequence
  chemically synthesized
ttctaaaacacttccaaaag

SEQ ID NO: 12966 - DNA, 20 bp, Artificial Sequence
  chemically synthesized
gtattattaccttcttttgg

SEQ ID NO: 12967 - DNA, 20 bp, Artificial Sequence
  chemically synthesized
tctaaaacacttccaaaaga

SEQ ID NO: 12968 - DNA, 20 bp, Artificial Sequence
  chemically synthesized
acagtattattaccttcttt

SEQ ID NO: 12969 - DNA, 20 bp, Artificial Sequence
  chemically synthesized
aggaagtgggaagcggggaa

SEQ ID NO: 12970 - DNA, 20 bp, Artificial Sequence
  chemically synthesized
tgtttaggaagtgggaagcg

SEQ ID NO: 12971 - DNA, 20 bp, Artificial Sequence
  chemically synthesized
gtgtttaggaagtgggaagc

SEQ ID NO: 12972 - DNA, 20 bp, Artificial Sequence
  chemically synthesized
tgtgtttaggaagtgggaag

SEQ ID NO: 12973 - DNA, 20 bp, Artificial Sequence
  chemically synthesized
ttttgtgtttaggaagtggg

SEQ ID NO: 12974 - DNA, 20 bp, Artificial Sequence
  chemically synthesized
tggttttgtgtttaggaagt

SEQ ID NO: 12975 - DNA, 20 bp, Artificial Sequence
  chemically synthesized
atggttttgtgtttaggaag

SEQ ID NO: 12976 - DNA, 20 bp, Artificial Sequence
  chemically synthesized
tatatggttttgtgtttagg

SEQ ID NO: 12977 - DNA, 20 bp, Artificial Sequence
  chemically synthesized
gggtatatggttttgtgttt

SEQ ID NO: 12978 - DNA, 20 bp, Artificial Sequence
  chemically synthesized
tgggtatatggttttgtgtt

SEQ ID NO: 12979 - DNA, 20 bp, Artificial Sequence
  chemically synthesized
taaacacaaaaccatatacc

SEQ ID NO: 12980 - DNA, 20 bp, Artificial Sequence
  chemically synthesized
aagtaatccttctgggtata

SEQ ID NO: 12981 - DNA, 20 bp, Artificial Sequence
  chemically synthesized
acacaaaaccatatacccag

SEQ ID NO: 12982 - DNA, 20 bp, Artificial Sequence
  chemically synthesized
cacaaaaccatatacccaga

SEQ ID NO: 12983 - DNA, 20 bp, Artificial Sequence
  chemically synthesized
ttatagtaagtaatccttct

SEQ ID NO: 12984 - DNA, 20 bp, Artificial Sequence
  chemically synthesized
cttatagtaagtaatccttc

SEQ ID NO: 12985 - DNA, 20 bp, Artificial Sequence
  chemically synthesized
ccagaaggattacttactat

SEQ ID NO: 12986 - DNA, 20 bp, Artificial Sequence
  chemically synthesized
agaaggattacttactataa

SEQ ID NO: 12987 - DNA, 20 bp, Artificial Sequence
  chemically synthesized
aggtcattaactcttatagt

SEQ ID NO: 12988 - DNA, 20 bp, Artificial Sequence
  chemically synthesized
aagtaggtcattaactctta

SEQ ID NO: 12989 - DNA, 20 bp, Artificial Sequence
  chemically synthesized
ataagagttaatgacctact

SEQ ID NO: 12990 - DNA, 20 bp, Artificial Sequence
  chemically synthesized
tgggatggaattgaccaagt

SEQ ID NO: 12991 - DNA, 20 bp, Artificial Sequence
  chemically synthesized
gtgggatggaattgaccaag

SEQ ID NO: 12992 - DNA, 20 bp, Artificial Sequence
  chemically synthesized
tgggtgggatggaattgacc

SEQ ID NO: 12993 - DNA, 20 bp, Artificial Sequence
  chemically synthesized
gaaggtggtggtgggtggga

SEQ ID NO: 12994 - DNA, 20 bp, Artificial Sequence
  chemically synthesized
aagagaaggtggtggtgggt

SEQ ID NO: 12995 - DNA, 20 bp, Artificial Sequence
  chemically synthesized
aaagagaaggtggtggtggg

SEQ ID NO: 12996 - DNA, 20 bp, Artificial Sequence
  chemically synthesized
ataaaagagaaggtggtggt

SEQ ID NO: 12997 - DNA, 20 bp, Artificial Sequence
  chemically synthesized
cataaaagagaaggtggtgg

SEQ ID NO: 12998 - DNA, 20 bp, Artificial Sequence
  chemically synthesized
tttcataaaagagaaggtgg

SEQ ID NO: 12999 - DNA, 20 bp, Artificial Sequence
  chemically synthesized
agttttcataaaagagaagg

SEQ ID NO: 13000 - DNA, 20 bp, Artificial Sequence
  chemically synthesized
tagagttttcataaaagaga

SEQ ID NO: 13001 - DNA, 20 bp, Artificial Sequence
  chemically synthesized
atagagttttcataaaagag

SEQ ID NO: 13002 - DNA, 20 bp, Artificial Sequence
  chemically synthesized
ttaatagagttttcataaaa

SEQ ID NO: 13003 - DNA, 20 bp, Artificial Sequence
  chemically synthesized
aattaatagagttttcataa

SEQ ID NO: 13004 - DNA, 20 bp, Artificial Sequence
  chemically synthesized
atgtcagcttttaattaata

SEQ ID NO: 13005 - DNA, 20 bp, Artificial Sequence
  chemically synthesized
gaatgtcagcttttaattaa

SEQ ID NO: 13006 - DNA, 20 bp, Artificial Sequence
  chemically synthesized
atgaaaactctattaattaa

SEQ ID NO: 13007 - DNA, 20 bp, Artificial Sequence
  chemically synthesized
attgaaacctaaatgaatgt

SEQ ID NO: 13008 - DNA, 20 bp, Artificial Sequence
  chemically synthesized
attaaaagctgacattcatt

SEQ ID NO: 13009 - DNA, 20 bp, Artificial Sequence
  chemically synthesized
ttaaaagctgacattcattt

SEQ ID NO: 13010 - DNA, 20 bp, Artificial Sequence
  chemically synthesized
cattcatttaggtttcaatg

SEQ ID NO: 13011 - DNA, 20 bp, Artificial Sequence
  chemically synthesized
tttcaatgcagaatcgctca

SEQ ID NO: 13012 - DNA, 20 bp, Artificial Sequence
  chemically synthesized
ccagtcaaacgatattcttt

SEQ ID NO: 13013 - DNA, 20 bp, Artificial Sequence
  chemically synthesized
ctcaaagaatatcgtttgac

SEQ ID NO: 13014 - DNA, 20 bp, Artificial Sequence
  chemically synthesized
ttgtctgtccataagtgagc

SEQ ID NO: 13015 - DNA, 20 bp, Artificial Sequence
  chemically synthesized
tcgtttgactggctcactta

SEQ ID NO: 13016 - DNA, 20 bp, Artificial Sequence
  chemically synthesized
tacgttgtctgtccataagt

SEQ ID NO: 13017 - DNA, 20 bp, Artificial Sequence
  chemically synthesized
ttgactggctcacttatgga

SEQ ID NO: 13018 - DNA, 20 bp, Artificial Sequence
  chemically synthesized
cctttacgttgtctgtccat

SEQ ID NO: 13019 - DNA, 20 bp, Artificial Sequence
  chemically synthesized
acttatggacagacaacgta

SEQ ID NO: 13020 - DNA, 20 bp, Artificial Sequence
  chemically synthesized
cttatggacagacaacgtaa

SEQ ID NO: 13021 - DNA, 20 bp, Artificial Sequence
  chemically synthesized
gacaacgtaaaggcctatgt

SEQ ID NO: 13022 - DNA, 20 bp, Artificial Sequence
  chemically synthesized
tttaaaactaaagctaacat

SEQ ID NO: 13023 - DNA, 20 bp, Artificial Sequence
  chemically synthesized
ctttaaaactaaagctaaca

SEQ ID NO: 13024 - DNA, 20 bp, Artificial Sequence
  chemically synthesized
gtaaaggcctatgttagctt

SEQ ID NO: 13025 - DNA, 20 bp, Artificial Sequence
  chemically synthesized
gtcatattactttaaaacta

SEQ ID NO: 13026 - DNA, 20 bp, Artificial Sequence
  chemically synthesized
ctatgttagctttagtttta

SEQ ID NO: 13027 - DNA, 20 bp, Artificial Sequence
  chemically synthesized
taaagtaatatgacaaacac

SEQ ID NO: 13028 - DNA, 20 bp, Artificial Sequence
  chemically synthesized
tatgacaaacacaagcaaat

SEQ ID NO: 13029 - DNA, 20 bp, Artificial Sequence
  chemically synthesized
tgacaaacacaagcaaataa

SEQ ID NO: 13030 - DNA, 20 bp, Artificial Sequence
  chemically synthesized
aacacaagcaaataagagtt

SEQ ID NO: 13031 - DNA, 20 bp, Artificial Sequence
  chemically synthesized
agcaaataagagtttagtct

SEQ ID NO: 13032 - DNA, 20 bp, Artificial Sequence
  chemically synthesized
gcaaataagagtttagtcta

SEQ ID NO: 13033 - DNA, 20 bp, Artificial Sequence
  chemically synthesized
acagaccgtttggttttcct

SEQ ID NO: 13034 - DNA, 20 bp, Artificial Sequence
  chemically synthesized
ttagtctaaggaaaaccaaa

SEQ ID NO: 13035 - DNA, 20 bp, Artificial Sequence
  chemically synthesized
ttccagagatacagaccgtt

SEQ ID NO: 13036 - DNA, 20 bp, Artificial Sequence
  chemically synthesized
aaccaaacggtctgtatctc

SEQ ID NO: 13037 - DNA, 20 bp, Artificial Sequence
  chemically synthesized
tttgaaagtttccagagata

SEQ ID NO: 13038 - DNA, 20 bp, Artificial Sequence
  chemically synthesized
acagaatttgaaagtttcca

SEQ ID NO: 13039 - DNA, 20 bp, Artificial Sequence
  chemically synthesized
tcacagaatttgaaagtttc

SEQ ID NO: 13040 - DNA, 20 bp, Artificial Sequence
  chemically synthesized
atatggatcacagaatttga

SEQ ID NO: 13041 - DNA, 20 bp, Artificial Sequence
  chemically synthesized
gatccatttgatatggatca

SEQ ID NO: 13042 - DNA, 20 bp, Artificial Sequence
  chemically synthesized
attctgtgatccatatcaaa

SEQ ID NO: 13043 - DNA, 20 bp, Artificial Sequence
  chemically synthesized
aatatttgatccatttgata

SEQ ID NO: 13044 - DNA, 20 bp, Artificial Sequence
  chemically synthesized
atcaaatattgtaatcatca

SEQ ID NO: 13045 - DNA, 20 bp, Artificial Sequence
  chemically synthesized
tcaaatattgtaatcatcat

SEQ ID NO: 13046 - DNA, 20 bp, Artificial Sequence
  chemically synthesized
atcataggatttgttaacat

SEQ ID NO: 13047 - DNA, 20 bp, Artificial Sequence
  chemically synthesized
gatttgttaacattagatac

SEQ ID NO: 13048 - DNA, 20 bp, Artificial Sequence
  chemically synthesized
cctaacgtgtttcattttgc

SEQ ID NO: 13049 - DNA, 20 bp, Artificial Sequence
  chemically synthesized
tcttgcaaaatgaaacacgt

SEQ ID NO: 13050 - DNA, 20 bp, Artificial Sequence
  chemically synthesized
cttgcaaaatgaaacacgtt

SEQ ID NO: 13051 - DNA, 20 bp, Artificial Sequence
  chemically synthesized
aaatgaaacacgttaggacc

SEQ ID NO: 13052 - DNA, 20 bp, Artificial Sequence
  chemically synthesized
cctattcaggcataagagcc

SEQ ID NO: 13053 - DNA, 20 bp, Artificial Sequence
  chemically synthesized
tcctattcaggcataagagc

SEQ ID NO: 13054 - DNA, 20 bp, Artificial Sequence
  chemically synthesized
gccatcctattcaggcataa

SEQ ID NO: 13055 - DNA, 20 bp, Artificial Sequence
  chemically synthesized
aagccatcctattcaggcat

SEQ ID NO: 13056 - DNA, 20 bp, Artificial Sequence
  chemically synthesized
acctggctcttatgcctgaa

SEQ ID NO: 13057 - DNA, 20 bp, Artificial Sequence
  chemically synthesized
cctggctcttatgcctgaat

SEQ ID NO: 13058 - DNA, 20 bp, Artificial Sequence
  chemically synthesized
attacaaagccatcctattc

SEQ ID NO: 13059 - DNA, 20 bp, Artificial Sequence
  chemically synthesized
gctcttatgcctgaatagga

SEQ ID NO: 13060 - DNA, 20 bp, Artificial Sequence
  chemically synthesized
tattacaaagccatcctatt

SEQ ID NO: 13061 - DNA, 20 bp, Artificial Sequence
  chemically synthesized
actgtataaaatatattaca

SEQ ID NO: 13062 - DNA, 20 bp, Artificial Sequence
  chemically synthesized
gctttgtaatatattttata

SEQ ID NO: 13063 - DNA, 20 bp, Artificial Sequence
  chemically synthesized
tatttaaagtatttattcat

SEQ ID NO: 13064 - DNA, 20 bp, Artificial Sequence
  chemically synthesized
gtatttaaagtatttattca

SEQ ID NO: 13065 - DNA, 20 bp, Artificial Sequence
  chemically synthesized
aatagcagtaattgtattta

SEQ ID NO: 13066 - DNA, 20 bp, Artificial Sequence
  chemically synthesized
aaatacaattactgctatta

SEQ ID NO: 13067 - DNA, 20 bp, Artificial Sequence
  chemically synthesized
gtctgtgttttctttaatag

SEQ ID NO: 13068 - DNA, 20 bp, Artificial Sequence
  chemically synthesized
gaagtctgtgttttctttaa

SEQ ID NO: 13069 - DNA, 20 bp, Artificial Sequence
  chemically synthesized
tactgctattaaagaaaaca

SEQ ID NO: 13070 - DNA, 20 bp, Artificial Sequence
  chemically synthesized
attaaagaaaacacagactt

SEQ ID NO: 13071 - DNA, 20 bp, Artificial Sequence
  chemically synthesized
aaaacaaatctagcagactg

SEQ ID NO: 13072 - DNA, 20 bp, Artificial Sequence
  chemically synthesized
aaacacagacttcagtctgc

SEQ ID NO: 13073 - DNA, 20 bp, Artificial Sequence
  chemically synthesized
gaggaagaaaacaaatctag

SEQ ID NO: 13074 - DNA, 20 bp, Artificial Sequence
  chemically synthesized
tttgaggaagaaaacaaatc

SEQ ID NO: 13075 - DNA, 20 bp, Artificial Sequence
  chemically synthesized
gggaagttttaattttgagg

SEQ ID NO: 13076 - DNA, 20 bp, Artificial Sequence
  chemically synthesized
agtgggaagttttaattttg

SEQ ID NO: 13077 - DNA, 20 bp, Artificial Sequence
  chemically synthesized
tagtgggaagttttaatttt

SEQ ID NO: 13078 - DNA, 20 bp, Artificial Sequence
  chemically synthesized
gattattcagaaatagtggg

SEQ ID NO: 13079 - DNA, 20 bp, Artificial Sequence
  chemically synthesized
ttagattattcagaaatagt

SEQ ID NO: 13080 - DNA, 20 bp, Artificial Sequence
  chemically synthesized
gttagattattcagaaatag

SEQ ID NO: 13081 - DNA, 20 bp, Artificial Sequence
  chemically synthesized
ttggttagattattcagaaa

SEQ ID NO: 13082 - DNA, 20 bp, Artificial Sequence
  chemically synthesized
gaagagttggttagattatt

SEQ ID NO: 13083 - DNA, 20 bp, Artificial Sequence
  chemically synthesized
cctttttatgaagagttggt

SEQ ID NO: 13084 - DNA, 20 bp, Artificial Sequence
  chemically synthesized
tttgcctttttatgaagagt

SEQ ID NO: 13085 - DNA, 20 bp, Artificial Sequence
  chemically synthesized
ccaatttgcctttttatgaa

SEQ ID NO: 13086 - DNA, 20 bp, Artificial Sequence
  chemically synthesized
tctaaccaactcttcataaa

SEQ ID NO: 13087 - DNA, 20 bp, Artificial Sequence
  chemically synthesized
ctaaccaactcttcataaaa

SEQ ID NO: 13088 - DNA, 20 bp, Artificial Sequence
  chemically synthesized
tcccaatttgcctttttatg

SEQ ID NO: 13089 - DNA, 20 bp, Artificial Sequence
  chemically synthesized
ctcttcataaaaaggcaaat

SEQ ID NO: 13090 - DNA, 20 bp, Artificial Sequence
  chemically synthesized
tcttcataaaaaggcaaatt

SEQ ID NO: 13091 - DNA, 20 bp, Artificial Sequence
  chemically synthesized
ttcataaaaaggcaaattgg

SEQ ID NO: 13092 - DNA, 20 bp, Artificial Sequence
  chemically synthesized
tcataaaaaggcaaattggg

SEQ ID NO: 13093 - DNA, 20 bp, Artificial Sequence
  chemically synthesized
gcaaattgggaggtgtgttt

SEQ ID NO: 13094 - DNA, 20 bp, Artificial Sequence
  chemically synthesized
gggaggtgtgttttagttgt

SEQ ID NO: 13095 - DNA, 20 bp, Artificial Sequence
  chemically synthesized
tagaaaatatttttaaataa

SEQ ID NO: 13096 - DNA, 20 bp, Artificial Sequence
  chemically synthesized
aaaagatgttattaatttta

SEQ ID NO: 13097 - DNA, 20 bp, Artificial Sequence
  chemically synthesized
ttgtctgtcttaaacgttga

SEQ ID NO: 13098 - DNA, 20 bp, Artificial Sequence
  chemically synthesized
tttaaagtctttcaacgttt

SEQ ID NO: 13099 - DNA, 20 bp, Artificial Sequence
  chemically synthesized
aagtctttcaacgtttaaga

SEQ ID NO: 13100 - DNA, 20 bp, Artificial Sequence
  chemically synthesized
gattaacttattttaagtag

SEQ ID NO: 13101 - DNA, 20 bp, Artificial Sequence
  chemically synthesized
tcagattaacttattttaag

SEQ ID NO: 13102 - DNA, 20 bp, Artificial Sequence
  chemically synthesized
caaaatcttctacttaaaat

SEQ ID NO: 13103 - DNA, 20 bp, Artificial Sequence
  chemically synthesized
caatcagattaacttatttt

SEQ ID NO: 13104 - DNA, 20 bp, Artificial Sequence
  chemically synthesized
gagaaaaacattatgacaat

SEQ ID NO: 13105 - DNA, 20 bp, Artificial Sequence
  chemically synthesized
tgtcataatgtttttctcat

SEQ ID NO: 13106 - DNA, 20 bp, Artificial Sequence
  chemically synthesized
ggagctacacgtaagctaat

SEQ ID NO: 13107 - DNA, 20 bp, Artificial Sequence
  chemically synthesized
ttttctcattagcttacgtg

SEQ ID NO: 13108 - DNA, 20 bp, Artificial Sequence
  chemically synthesized
ggcaaaaaggagctacacgt

SEQ ID NO: 13109 - DNA, 20 bp, Artificial Sequence
  chemically synthesized
agtccttgaaaggcaaaaag

SEQ ID NO: 13110 - DNA, 20 bp, Artificial Sequence
  chemically synthesized
atagtccttgaaaggcaaaa

SEQ ID NO: 13111 - DNA, 20 bp, Artificial Sequence
  chemically synthesized
aatagtccttgaaaggcaaa

SEQ ID NO: 13112 - DNA, 20 bp, Artificial Sequence
  chemically synthesized
gtagctcctttttgcctttc

SEQ ID NO: 13113 - DNA, 20 bp, Artificial Sequence
  chemically synthesized
tagctcctttttgcctttca

SEQ ID NO: 13114 - DNA, 20 bp, Artificial Sequence
  chemically synthesized
agtaattaatagtccttgaa

SEQ ID NO: 13115 - DNA, 20 bp, Artificial Sequence
  chemically synthesized
gagtaattaatagtccttga

SEQ ID NO: 13116 - DNA, 20 bp, Artificial Sequence
  chemically synthesized
aataaacaaagagtaattaa

SEQ ID NO: 13117 - DNA, 20 bp, Artificial Sequence
  chemically synthesized
agcaccaaataataaacaaa

SEQ ID NO: 13118 - DNA, 20 bp, Artificial Sequence
  chemically synthesized
gtagcaccaaataataaaca

SEQ ID NO: 13119 - DNA, 20 bp, Artificial Sequence
  chemically synthesized
attactctttgtttattatt

SEQ ID NO: 13120 - DNA, 20 bp, Artificial Sequence
  chemically synthesized
tacaaatacatagataaaag

SEQ ID NO: 13121 - DNA, 20 bp, Artificial Sequence
  chemically synthesized
tgttacaaatacatagataa

SEQ ID NO: 13122 - DNA, 20 bp, Artificial Sequence
  chemically synthesized
gaacagttgttacaaataca

SEQ ID NO: 13123 - DNA, 20 bp, Artificial Sequence
  chemically synthesized
tatttgtaacaactgttctt

SEQ ID NO: 13124 - DNA, 20 bp, Artificial Sequence
  chemically synthesized
acgacaaatatgctaaagaa

SEQ ID NO: 13125 - DNA, 20 bp, Artificial Sequence
  chemically synthesized
tccaaacgacaaatatgcta

SEQ ID NO: 13126 - DNA, 20 bp, Artificial Sequence
  chemically synthesized
tctttagcatatttgtcgtt

SEQ ID NO: 13127 - DNA, 20 bp, Artificial Sequence
  chemically synthesized
tgtcgtttggatttcttact

SEQ ID NO: 13128 - DNA, 20 bp, Artificial Sequence
  chemically synthesized
ggaaataagtttaaccgagt

SEQ ID NO: 13129 - DNA, 20 bp, Artificial Sequence
  chemically synthesized
atgtggaaataagtttaacc

SEQ ID NO: 13130 - DNA, 20 bp, Artificial Sequence
  chemically synthesized
gatttactctatgtggaaat

SEQ ID NO: 13131 - DNA, 20 bp, Artificial Sequence
  chemically synthesized
cggttaaacttatttccaca

SEQ ID NO: 13132 - DNA, 20 bp, Artificial Sequence
  chemically synthesized
gttaaacttatttccacata

SEQ ID NO: 13133 - DNA, 20 bp, Artificial Sequence
  chemically synthesized
gggaatggatttactctatg

SEQ ID NO: 13134 - DNA, 20 bp, Artificial Sequence
  chemically synthesized
attggatcctgataagggaa

SEQ ID NO: 13135 - DNA, 20 bp, Artificial Sequence
  chemically synthesized
gagtaaatccattcccttat

SEQ ID NO: 13136 - DNA, 20 bp, Artificial Sequence
  chemically synthesized
agtaaatccattcccttatc

SEQ ID NO: 13137 - DNA, 20 bp, Artificial Sequence
  chemically synthesized
gcttgattggatcctgataa

SEQ ID NO: 13138 - DNA, 20 bp, Artificial Sequence
  chemically synthesized
agcttgattggatcctgata

SEQ ID NO: 13139 - DNA, 20 bp, Artificial Sequence
  chemically synthesized
cagcttgattggatcctgat

SEQ ID NO: 13140 - DNA, 20 bp, Artificial Sequence
  chemically synthesized
tcccttatcaggatccaatc

SEQ ID NO: 13141 - DNA, 20 bp, Artificial Sequence
  chemically synthesized
cactacagtttcagcttgat

SEQ ID NO: 13142 - DNA, 20 bp, Artificial Sequence
  chemically synthesized
atccaatcaagctgaaactg

SEQ ID NO: 13143 - DNA, 20 bp, Artificial Sequence
  chemically synthesized
gagttgatacactacagttt

SEQ ID NO: 13144 - DNA, 20 bp, Artificial Sequence
  chemically synthesized
tttaaagagttgatacacta

SEQ ID NO: 13145 - DNA, 20 bp, Artificial Sequence
  chemically synthesized
gtagtgtatcaactctttaa

SEQ ID NO: 13146 - DNA, 20 bp, Artificial Sequence
  chemically synthesized
ataaataagaaacttttaaa

SEQ ID NO: 13147 - DNA, 20 bp, Artificial Sequence
  chemically synthesized
tcataaataagaaactttta

SEQ ID NO: 13148 - DNA, 20 bp, Artificial Sequence
  chemically synthesized
agttacaaccgttcataaat

SEQ ID NO: 13149 - DNA, 20 bp, Artificial Sequence
  chemically synthesized
aaaagtttcttatttatgaa

SEQ ID NO: 13150 - DNA, 20 bp, Artificial Sequence
  chemically synthesized
aacggttgtaacttctataa

SEQ ID NO: 13151 - DNA, 20 bp, Artificial Sequence
  chemically synthesized
acccaggtagtctgttatag

SEQ ID NO: 13152 - DNA, 20 bp, Artificial Sequence
  chemically synthesized
ctaacccaggtagtctgtta

SEQ ID NO: 13153 - DNA, 20 bp, Artificial Sequence
  chemically synthesized
aacttctataacagactacc

SEQ ID NO: 13154 - DNA, 20 bp, Artificial Sequence
  chemically synthesized
acttctataacagactacct

SEQ ID NO: 13155 - DNA, 20 bp, Artificial Sequence
  chemically synthesized
ctataacagactacctgggt

SEQ ID NO: 13156 - DNA, 20 bp, Artificial Sequence
  chemically synthesized
attgtgtttcctaacccagg

SEQ ID NO: 13157 - DNA, 20 bp, Artificial Sequence
  chemically synthesized
tataacagactacctgggtt

SEQ ID NO: 13158 - DNA, 20 bp, Artificial Sequence
  chemically synthesized
gaaattgtgtttcctaaccc

SEQ ID NO: 13159 - DNA, 20 bp, Artificial Sequence
  chemically synthesized
ggaaattgtgtttcctaacc

SEQ ID NO: 13160 - DNA, 20 bp, Artificial Sequence
  chemically synthesized
ggttaggaaacacaatttcc

SEQ ID NO: 13161 - DNA, 20 bp, Artificial Sequence
  chemically synthesized
ttaggaaacacaatttccaa

SEQ ID NO: 13162 - DNA, 20 bp, Artificial Sequence
  chemically synthesized
taggaaacacaatttccaag

SEQ ID NO: 13163 - DNA, 20 bp, Artificial Sequence
  chemically synthesized
gaaacacaatttccaagagg

SEQ ID NO: 13164 - DNA, 20 bp, Artificial Sequence
  chemically synthesized
aacacaatttccaagaggca

SEQ ID NO: 13165 - DNA, 20 bp, Artificial Sequence
  chemically synthesized
cagttatgtcctctgcctct

SEQ ID NO: 13166 - DNA, 20 bp, Artificial Sequence
  chemically synthesized
acacaatttccaagaggcag

SEQ ID NO: 13167 - DNA, 20 bp, Artificial Sequence
  chemically synthesized
cttagggagttatttaggtt

SEQ ID NO: 13168 - DNA, 20 bp, Artificial Sequence
  chemically synthesized
aagaacttagggagttattt

SEQ ID NO: 13169 - DNA, 20 bp, Artificial Sequence
  chemically synthesized
aaagaacttagggagttatt

SEQ ID NO: 13170 - DNA, 20 bp, Artificial Sequence
  chemically synthesized
ctgaacctaaataactccct

SEQ ID NO: 13171 - DNA, 20 bp, Artificial Sequence
  chemically synthesized
tcatgcttaaagaacttagg

SEQ ID NO: 13172 - DNA, 20 bp, Artificial Sequence
  chemically synthesized
catcatgcttaaagaactta

SEQ ID NO: 13173 - DNA, 20 bp, Artificial Sequence
  chemically synthesized
tcatcatgcttaaagaactt

SEQ ID NO: 13174 - DNA, 20 bp, Artificial Sequence
  chemically synthesized
atcatcatgcttaaagaact

SEQ ID NO: 13175 - DNA, 20 bp, Artificial Sequence
  chemically synthesized
aataactccctaagttcttt

SEQ ID NO: 13176 - DNA, 20 bp, Artificial Sequence
  chemically synthesized
ttatttaatcatcatgctta

SEQ ID NO: 13177 - DNA, 20 bp, Artificial Sequence
  chemically synthesized
agcatgatgattaaataaat

SEQ ID NO: 13178 - DNA, 20 bp, Artificial Sequence
  chemically synthesized
atcagataatatactactta

SEQ ID NO: 13179 - DNA, 20 bp, Artificial Sequence
  chemically synthesized
tgagatatggtagctataag

SEQ ID NO: 13180 - DNA, 20 bp, Artificial Sequence
  chemically synthesized
ttttgagatatggtagctat

SEQ ID NO: 13181 - DNA, 20 bp, Artificial Sequence
  chemically synthesized
cccttaattttgagatatgg

SEQ ID NO: 13182 - DNA, 20 bp, Artificial Sequence
  chemically synthesized
cgccccttaattttgagata

SEQ ID NO: 13183 - DNA, 20 bp, Artificial Sequence
  chemically synthesized
agctaccatatctcaaaatt

SEQ ID NO: 13184 - DNA, 20 bp, Artificial Sequence
  chemically synthesized
gctaccatatctcaaaatta

SEQ ID NO: 13185 - DNA, 20 bp, Artificial Sequence
  chemically synthesized
ttattgcgccccttaatttt

SEQ ID NO: 13186 - DNA, 20 bp, Artificial Sequence
  chemically synthesized
ctaccatatctcaaaattaa

SEQ ID NO: 13187 - DNA, 20 bp, Artificial Sequence
  chemically synthesized
taccatatctcaaaattaag

SEQ ID NO: 13188 - DNA, 20 bp, Artificial Sequence
  chemically synthesized
aattaaggggcgcaataacg

SEQ ID NO: 13189 - DNA, 20 bp, Artificial Sequence
  chemically synthesized
cgcaataacgaagttttaaa

SEQ ID NO: 13190 - DNA, 20 bp, Artificial Sequence
  chemically synthesized
gcaataacgaagttttaaaa

SEQ ID NO: 13191 - DNA, 20 bp, Artificial Sequence
  chemically synthesized
taacgaagttttaaaaagga

SEQ ID NO: 13192 - DNA, 20 bp, Artificial Sequence
  chemically synthesized
aagttttaaaaaggaaagca

SEQ ID NO: 13193 - DNA, 20 bp, Artificial Sequence
  chemically synthesized
ataggcctaaaggaagtgga

SEQ ID NO: 13194 - DNA, 20 bp, Artificial Sequence
  chemically synthesized
aataggcctaaaggaagtgg

SEQ ID NO: 13195 - DNA, 20 bp, Artificial Sequence
  chemically synthesized
gcatagccttccacttcctt

SEQ ID NO: 13196 - DNA, 20 bp, Artificial Sequence
  chemically synthesized
tttaataggcctaaaggaag

SEQ ID NO: 13197 - DNA, 20 bp, Artificial Sequence
  chemically synthesized
catagccttccacttccttt

SEQ ID NO: 13198 - DNA, 20 bp, Artificial Sequence
  chemically synthesized
gtctttaataggcctaaagg

SEQ ID NO: 13199 - DNA, 20 bp, Artificial Sequence
  chemically synthesized
tcagtctttaataggcctaa

SEQ ID NO: 13200 - DNA, 20 bp, Artificial Sequence
  chemically synthesized
ttcagtctttaataggccta

SEQ ID NO: 13201 - DNA, 20 bp, Artificial Sequence
  chemically synthesized
cacttcctttaggcctatta

SEQ ID NO: 13202 - DNA, 20 bp, Artificial Sequence
  chemically synthesized
gtttattttcagtctttaat

SEQ ID NO: 13203 - DNA, 20 bp, Artificial Sequence
  chemically synthesized
ggtttattttcagtctttaa

SEQ ID NO: 13204 - DNA, 20 bp, Artificial Sequence
  chemically synthesized
tattaattgaggtttatttt

SEQ ID NO: 13205 - DNA, 20 bp, Artificial Sequence
  chemically synthesized
taaatgcatattattaattg

SEQ ID NO: 13206 - DNA, 20 bp, Artificial Sequence
  chemically synthesized
ataaatgcatattattaatt

SEQ ID NO: 13207 - DNA, 20 bp, Artificial Sequence
  chemically synthesized
ataatatgcatttatcacga

SEQ ID NO: 13208 - DNA, 20 bp, Artificial Sequence
  chemically synthesized
taatatgcatttatcacgac

SEQ ID NO: 13209 - DNA, 20 bp, Artificial Sequence
  chemically synthesized
aatatgcatttatcacgaca

SEQ ID NO: 13210 - DNA, 20 bp, Artificial Sequence
  chemically synthesized
tcacgacagggtttttaaaa

SEQ ID NO: 13211 - DNA, 20 bp, Artificial Sequence
  chemically synthesized
cacgacagggtttttaaaaa

SEQ ID NO: 13212 - DNA, 20 bp, Artificial Sequence
  chemically synthesized
agggtttttaaaaaaggatc

SEQ ID NO: 13213 - DNA, 20 bp, Artificial Sequence
  chemically synthesized
ttttaaaaaaggatctagtt

SEQ ID NO: 13214 - DNA, 20 bp, Artificial Sequence
  chemically synthesized
ccatataatttaatctaaac

SEQ ID NO: 13215 - DNA, 20 bp, Artificial Sequence
  chemically synthesized
ctagtttagattaaattata

SEQ ID NO: 13216 - DNA, 20 bp, Artificial Sequence
  chemically synthesized
gtttagattaaattatatgg

SEQ ID NO: 13217 - DNA, 20 bp, Artificial Sequence
  chemically synthesized
tatatggtggaacaataaaa

SEQ ID NO: 13218 - DNA, 20 bp, Artificial Sequence
  chemically synthesized
aataaaaaagatttaataaa

SEQ ID NO: 13219 - DNA, 20 bp, Artificial Sequence
  chemically synthesized
aagaaattgaattcttacac

SEQ ID NO: 13220 - DNA, 20 bp, Artificial Sequence
  chemically synthesized
ttcggaagataagcttgtgt

SEQ ID NO: 13221 - DNA, 20 bp, Artificial Sequence
  chemically synthesized
aaatgaccaattcggaagat

SEQ ID NO: 13222 - DNA, 20 bp, Artificial Sequence
  chemically synthesized
cacaagcttatcttccgaat

SEQ ID NO: 13223 - DNA, 20 bp, Artificial Sequence
  chemically synthesized
aggggaaatgaccaattcgg

SEQ ID NO: 13224 - DNA, 20 bp, Artificial Sequence
  chemically synthesized
taaaggggaaatgaccaatt

SEQ ID NO: 13225 - DNA, 20 bp, Artificial Sequence
  chemically synthesized
cagctctgttatggataaag

SEQ ID NO: 13226 - DNA, 20 bp, Artificial Sequence
  chemically synthesized
acagctctgttatggataaa

SEQ ID NO: 13227 - DNA, 20 bp, Artificial Sequence
  chemically synthesized
gacagctctgttatggataa

SEQ ID NO: 13228 - DNA, 20 bp, Artificial Sequence
  chemically synthesized
agacagctctgttatggata

SEQ ID NO: 13229 - DNA, 20 bp, Artificial Sequence
  chemically synthesized
catttcccctttatccataa

SEQ ID NO: 13230 - DNA, 20 bp, Artificial Sequence
  chemically synthesized
tttcccctttatccataaca

SEQ ID NO: 13231 - DNA, 20 bp, Artificial Sequence
  chemically synthesized
aaaatcagacagctctgtta

SEQ ID NO: 13232 - DNA, 20 bp, Artificial Sequence
  chemically synthesized
aatatttattgaaaatcaga

SEQ ID NO: 13233 - DNA, 20 bp, Artificial Sequence
  chemically synthesized
ttaaaatatttattgaaaat

SEQ ID NO: 13234 - DNA, 20 bp, Artificial Sequence
  chemically synthesized
tttcaataaatattttaata

SEQ ID NO: 13235 - DNA, 20 bp, Artificial Sequence
  chemically synthesized
aacaaacttttggtatttca

SEQ ID NO: 13236 - DNA, 20 bp, Artificial Sequence
  chemically synthesized
agcatactttgaaataccaa

SEQ ID NO: 13237 - DNA, 20 bp, Artificial Sequence
  chemically synthesized
gggttgttataacaaacttt

SEQ ID NO: 13238 - DNA, 20 bp, Artificial Sequence
  chemically synthesized
ttttaaaactacattatgta

SEQ ID NO: 13239 - DNA, 20 bp, Artificial Sequence
  chemically synthesized
attttaaaactacattatgt

SEQ ID NO: 13240 - DNA, 20 bp, Artificial Sequence
  chemically synthesized
tataacaaccctacataatg

SEQ ID NO: 13241 - DNA, 20 bp, Artificial Sequence
  chemically synthesized
tattttaaaactacattatg

SEQ ID NO: 13242 - DNA, 20 bp, Artificial Sequence
  chemically synthesized
tacataatgtagttttaaaa

SEQ ID NO: 13243 - DNA, 20 bp, Artificial Sequence
  chemically synthesized
acataatgtagttttaaaat

SEQ ID NO: 13244 - DNA, 20 bp, Artificial Sequence
  chemically synthesized
gatttctatattagcaaaca

SEQ ID NO: 13245 - DNA, 20 bp, Artificial Sequence
  chemically synthesized
aggcactttgtttgctaata

SEQ ID NO: 13246 - DNA, 20 bp, Artificial Sequence
  chemically synthesized
ggggcctgtgatttctatat

SEQ ID NO: 13247 - DNA, 20 bp, Artificial Sequence
  chemically synthesized
gtttgctaatatagaaatca

SEQ ID NO: 13248 - DNA, 20 bp, Artificial Sequence
  chemically synthesized
tttgctaatatagaaatcac

SEQ ID NO: 13249 - DNA, 20 bp, Artificial Sequence
  chemically synthesized
agaaatcacaggccccaaaa

SEQ ID NO: 13250 - DNA, 20 bp, Artificial Sequence
  chemically synthesized
aaatcacaggccccaaaaaa

SEQ ID NO: 13251 - DNA, 20 bp, Artificial Sequence
  chemically synthesized
tgctagaaaactcttttttg

SEQ ID NO: 13252 - DNA, 20 bp, Artificial Sequence
  chemically synthesized
atgctagaaaactctttttt

SEQ ID NO: 13253 - DNA, 20 bp, Artificial Sequence
  chemically synthesized
aatgctagaaaactcttttt

SEQ ID NO: 13254 - DNA, 20 bp, Artificial Sequence
  chemically synthesized
ggccccaaaaaagagttttc

SEQ ID NO: 13255 - DNA, 20 bp, Artificial Sequence
  chemically synthesized
tatctcagagtttataatgc

SEQ ID NO: 13256 - DNA, 20 bp, Artificial Sequence
  chemically synthesized
tttctagcattataaactct

SEQ ID NO: 13257 - DNA, 20 bp, Artificial Sequence
  chemically synthesized
ccagcagatgatttatctca

SEQ ID NO: 13258 - DNA, 20 bp, Artificial Sequence
  chemically synthesized
taccagcagatgatttatct

SEQ ID NO: 13259 - DNA, 20 bp, Artificial Sequence
  chemically synthesized
ctctgagataaatcatctgc

SEQ ID NO: 13260 - DNA, 20 bp, Artificial Sequence
  chemically synthesized
atactgagcttagataccag

SEQ ID NO: 13261 - DNA, 20 bp, Artificial Sequence
  chemically synthesized
taaatcatctgctggtatct

SEQ ID NO: 13262 - DNA, 20 bp, Artificial Sequence
  chemically synthesized
ataatactgagcttagatac

SEQ ID NO: 13263 - DNA, 20 bp, Artificial Sequence
  chemically synthesized
catctgctggtatctaagct

SEQ ID NO: 13264 - DNA, 20 bp, Artificial Sequence
  chemically synthesized
tgtattaataatactgagct

SEQ ID NO: 13265 - DNA, 20 bp, Artificial Sequence
  chemically synthesized
tggtgtgtattaataatact

SEQ ID NO: 13266 - DNA, 20 bp, Artificial Sequence
  chemically synthesized
gtattattaatacacaccaa

SEQ ID NO: 13267 - DNA, 20 bp, Artificial Sequence
  chemically synthesized
tatttctttgttattactat

SEQ ID NO: 13268 - DNA, 20 bp, Artificial Sequence
  chemically synthesized
acacaccaatagtaataaca

SEQ ID NO: 13269 - DNA, 20 bp, Artificial Sequence
  chemically synthesized
acaaagaaatactttcctcc

SEQ ID NO: 13270 - DNA, 20 bp, Artificial Sequence
  chemically synthesized
atacatttgctctaggagga

SEQ ID NO: 13271 - DNA, 20 bp, Artificial Sequence
  chemically synthesized
aaagaaatactttcctccta

SEQ ID NO: 13272 - DNA, 20 bp, Artificial Sequence
  chemically synthesized
aattatacatttgctctagg

SEQ ID NO: 13273 - DNA, 20 bp, Artificial Sequence
  chemically synthesized
caattatacatttgctctag

SEQ ID NO: 13274 - DNA, 20 bp, Artificial Sequence
  chemically synthesized
aacaattatacatttgctct

SEQ ID NO: 13275 - DNA, 20 bp, Artificial Sequence
  chemically synthesized
aaacaattatacatttgctc

SEQ ID NO: 13276 - DNA, 20 bp, Artificial Sequence
  chemically synthesized
gcaaatgtataattgtttat

SEQ ID NO: 13277 - DNA, 20 bp, Artificial Sequence
  chemically synthesized
ttgtttatgagctgaatatt

SEQ ID NO: 13278 - DNA, 20 bp, Artificial Sequence
  chemically synthesized
tcctctccaagctaaatatt

SEQ ID NO: 13279 - DNA, 20 bp, Artificial Sequence
  chemically synthesized
tatgagctgaatatttagct

SEQ ID NO: 13280 - DNA, 20 bp, Artificial Sequence
  chemically synthesized
tgagctgaatatttagcttg

SEQ ID NO: 13281 - DNA, 20 bp, Artificial Sequence
  chemically synthesized
agctgaatatttagcttgga

SEQ ID NO: 13282 - DNA, 20 bp, Artificial Sequence
  chemically synthesized
gctgaatatttagcttggag

SEQ ID NO: 13283 - DNA, 20 bp, Artificial Sequence
  chemically synthesized
tgaatatttagcttggagag

SEQ ID NO: 13284 - DNA, 20 bp, Artificial Sequence
  chemically synthesized
ctcactttgctctcctctcc

SEQ ID NO: 13285 - DNA, 20 bp, Artificial Sequence
  chemically synthesized
aatatttagcttggagagga

SEQ ID NO: 13286 - DNA, 20 bp, Artificial Sequence
  chemically synthesized
ttagcttggagaggagagca

SEQ ID NO: 13287 - DNA, 20 bp, Artificial Sequence
  chemically synthesized
cttggagaggagagcaaagt

SEQ ID NO: 13288 - DNA, 20 bp, Artificial Sequence
  chemically synthesized
agaggagagcaaagtgagtt

SEQ ID NO: 13289 - DNA, 20 bp, Artificial Sequence
  chemically synthesized
agtgagtttagttcaaaatt

SEQ ID NO: 13290 - DNA, 20 bp, Artificial Sequence
  chemically synthesized
tgactaatcattatatacaa

SEQ ID NO: 13291 - DNA, 20 bp, Artificial Sequence
  chemically synthesized
ttgactaatcattatataca

SEQ ID NO: 13292 - DNA, 20 bp, Artificial Sequence
  chemically synthesized
tttgactaatcattatatac

SEQ ID NO: 13293 - DNA, 20 bp, Artificial Sequence
  chemically synthesized
aaacccttgtatataatgat

SEQ ID NO: 13294 - DNA, 20 bp, Artificial Sequence
  chemically synthesized
gtatataatgattagtcaaa

SEQ ID NO: 13295 - DNA, 20 bp, Artificial Sequence
  chemically synthesized
taatgattagtcaaatagca

SEQ ID NO: 13296 - DNA, 20 bp, Artificial Sequence
  chemically synthesized
gcatggcataacctgataaa

SEQ ID NO: 13297 - DNA, 20 bp, Artificial Sequence
  chemically synthesized
aggtgtgcggactgtttatc

SEQ ID NO: 13298 - DNA, 20 bp, Artificial Sequence
  chemically synthesized
gaggtgtgcggactgtttat

SEQ ID NO: 13299 - DNA, 20 bp, Artificial Sequence
  chemically synthesized
aataattttaatgaggtgtg

SEQ ID NO: 13300 - DNA, 20 bp, Artificial Sequence
  chemically synthesized
ttggttgaataattttaatg

SEQ ID NO: 13301 - DNA, 20 bp, Artificial Sequence
  chemically synthesized
tttggttgaataattttaat

SEQ ID NO: 13302 - DNA, 20 bp, Artificial Sequence
  chemically synthesized
taaaattattcaaccaaact

SEQ ID NO: 13303 - DNA, 20 bp, Artificial Sequence
  chemically synthesized
ttaaagtatgatgctgagtt

SEQ ID NO: 13304 - DNA, 20 bp, Artificial Sequence
  chemically synthesized
tcgttttaaagtatgatgct

SEQ ID NO: 13305 - DNA, 20 bp, Artificial Sequence
  chemically synthesized
aatcagcagaattcgtttta

SEQ ID NO: 13306 - DNA, 20 bp, Artificial Sequence
  chemically synthesized
agtggactattaaaaatcag

SEQ ID NO: 13307 - DNA, 20 bp, Artificial Sequence
  chemically synthesized
ataagtggactattaaaaat

SEQ ID NO: 13308 - DNA, 20 bp, Artificial Sequence
  chemically synthesized
cgaattctgctgatttttaa

SEQ ID NO: 13309 - DNA, 20 bp, Artificial Sequence
  chemically synthesized
ttttaatagtccacttataa

SEQ ID NO: 13310 - DNA, 20 bp, Artificial Sequence
  chemically synthesized
tctttagggtctgttataag

SEQ ID NO: 13311 - DNA, 20 bp, Artificial Sequence
  chemically synthesized
gaatctttagggtctgttat

SEQ ID NO: 13312 - DNA, 20 bp, Artificial Sequence
  chemically synthesized
tccacttataacagacccta

SEQ ID NO: 13313 - DNA, 20 bp, Artificial Sequence
  chemically synthesized
gatgctttttagaatcttta

SEQ ID NO: 13314 - DNA, 20 bp, Artificial Sequence
  chemically synthesized
cgatgctttttagaatcttt

SEQ ID NO: 13315 - DNA, 20 bp, Artificial Sequence
  chemically synthesized
tcgatgctttttagaatctt

SEQ ID NO: 13316 - DNA, 20 bp, Artificial Sequence
  chemically synthesized
cagaccctaaagattctaaa

SEQ ID NO: 13317 - DNA, 20 bp, Artificial Sequence
  chemically synthesized
tcttgagattcgatgctttt

SEQ ID NO: 13318 - DNA, 20 bp, Artificial Sequence
  chemically synthesized
tctaaaaagcatcgaatctc

SEQ ID NO: 13319 - DNA, 20 bp, Artificial Sequence
  chemically synthesized
attctttagccatatttctt

SEQ ID NO: 13320 - DNA, 20 bp, Artificial Sequence
  chemically synthesized
gcatcgaatctcaagaaata

SEQ ID NO: 13321 - DNA, 20 bp, Artificial Sequence
  chemically synthesized
aatctcaagaaatatggcta

SEQ ID NO: 13322 - DNA, 20 bp, Artificial Sequence
  chemically synthesized
gattacataataacattctt

SEQ ID NO: 13323 - DNA, 20 bp, Artificial Sequence
  chemically synthesized
aaagaatgttattatgtaat

SEQ ID NO: 13324 - DNA, 20 bp, Artificial Sequence
  chemically synthesized
gaatgttattatgtaatcag

SEQ ID NO: 13325 - DNA, 20 bp, Artificial Sequence
  chemically synthesized
ttcatataaaagcaaggaag

SEQ ID NO: 13326 - DNA, 20 bp, Artificial Sequence
  chemically synthesized
ttcttcatataaaagcaagg

SEQ ID NO: 13327 - DNA, 20 bp, Artificial Sequence
  chemically synthesized
tatttcttcatataaaagca

SEQ ID NO: 13328 - DNA, 20 bp, Artificial Sequence
  chemically synthesized
atatttcttcatataaaagc

SEQ ID NO: 13329 - DNA, 20 bp, Artificial Sequence
  chemically synthesized
ttcttccttgcttttatatg

SEQ ID NO: 13330 - DNA, 20 bp, Artificial Sequence
  chemically synthesized
ttatatatttcttcatataa

SEQ ID NO: 13331 - DNA, 20 bp, Artificial Sequence
  chemically synthesized
aaatatataaacatgtctcc

SEQ ID NO: 13332 - DNA, 20 bp, Artificial Sequence
  chemically synthesized
aatatataaacatgtctccc

SEQ ID NO: 13333 - DNA, 20 bp, Artificial Sequence
  chemically synthesized
agttttagctgtattcctgg

SEQ ID NO: 13334 - DNA, 20 bp, Artificial Sequence
  chemically synthesized
aaacatgtctcccaggaata

SEQ ID NO: 13335 - DNA, 20 bp, Artificial Sequence
  chemically synthesized
ggagttttagctgtattcct

SEQ ID NO: 13336 - DNA, 20 bp, Artificial Sequence
  chemically synthesized
tggagttttagctgtattcc

SEQ ID NO: 13337 - DNA, 20 bp, Artificial Sequence
  chemically synthesized
caaagaagttattggagttt

SEQ ID NO: 13338 - DNA, 20 bp, Artificial Sequence
  chemically synthesized
tataatcaaagaagttattg

SEQ ID NO: 13339 - DNA, 20 bp, Artificial Sequence
  chemically synthesized
attataatcaaagaagttat

SEQ ID NO: 13340 - DNA, 20 bp, Artificial Sequence
  chemically synthesized
aattcaaattataatcaaag

SEQ ID NO: 13341 - DNA, 20 bp, Artificial Sequence
  chemically synthesized
ttgaattcaaattataatca

SEQ ID NO: 13342 - DNA, 20 bp, Artificial Sequence
  chemically synthesized
tttgattataatttgaattc

SEQ ID NO: 13343 - DNA, 20 bp, Artificial Sequence
  chemically synthesized
attataatttgaattcaagc

SEQ ID NO: 13344 - DNA, 20 bp, Artificial Sequence
  chemically synthesized
ttataatttgaattcaagcc

SEQ ID NO: 13345 - DNA, 20 bp, Artificial Sequence
  chemically synthesized
attcaaaccagcagaaatcc

SEQ ID NO: 13346 - DNA, 20 bp, Artificial Sequence
  chemically synthesized
attcaagccaggatttctgc

SEQ ID NO: 13347 - DNA, 20 bp, Artificial Sequence
  chemically synthesized
ccaggtgaaattcaaaccag

SEQ ID NO: 13348 - DNA, 20 bp, Artificial Sequence
  chemically synthesized
ccaccaggtgaaattcaaac

SEQ ID NO: 13349 - DNA, 20 bp, Artificial Sequence
  chemically synthesized
ctgctggtttgaatttcacc

SEQ ID NO: 13350 - DNA, 20 bp, Artificial Sequence
  chemically synthesized
ctggtttgaatttcacctgg

SEQ ID NO: 13351 - DNA, 20 bp, Artificial Sequence
  chemically synthesized
ggtttgaatttcacctggtg

SEQ ID NO: 13352 - DNA, 20 bp, Artificial Sequence
  chemically synthesized
gtttgaatttcacctggtgg

SEQ ID NO: 13353 - DNA, 20 bp, Artificial Sequence
  chemically synthesized
ggttttttggttcctccacc

SEQ ID NO: 13354 - DNA, 20 bp, Artificial Sequence
  chemically synthesized
gggttttttggttcctccac

SEQ ID NO: 13355 - DNA, 20 bp, Artificial Sequence
  chemically synthesized
gagaatcagagtgggttttt

SEQ ID NO: 13356 - DNA, 20 bp, Artificial Sequence
  chemically synthesized
cagatcaggagaatcagagt

SEQ ID NO: 13357 - DNA, 20 bp, Artificial Sequence
  chemically synthesized
acagatcaggagaatcagag

SEQ ID NO: 13358 - DNA, 20 bp, Artificial Sequence
  chemically synthesized
tacacagatcaggagaatca

SEQ ID NO: 13359 - DNA, 20 bp, Artificial Sequence
  chemically synthesized
tctacacagatcaggagaat

SEQ ID NO: 13360 - DNA, 20 bp, Artificial Sequence
  chemically synthesized
gtaccatctacacagatcag

SEQ ID NO: 13361 - DNA, 20 bp, Artificial Sequence
  chemically synthesized
aagtaccatctacacagatc

SEQ ID NO: 13362 - DNA, 20 bp, Artificial Sequence
  chemically synthesized
tctgattctcctgatctgtg

SEQ ID NO: 13363 - DNA, 20 bp, Artificial Sequence
  chemically synthesized
aaagtaccatctacacagat

SEQ ID NO: 13364 - DNA, 20 bp, Artificial Sequence
  chemically synthesized
attctcctgatctgtgtaga

SEQ ID NO: 13365 - DNA, 20 bp, Artificial Sequence
  chemically synthesized
ctttgaaagtaccatctaca

SEQ ID NO: 13366 - DNA, 20 bp, Artificial Sequence
  chemically synthesized
ctgtgtagatggtactttca

SEQ ID NO: 13367 - DNA, 20 bp, Artificial Sequence
  chemically synthesized
ttttcttgatgagactttga

SEQ ID NO: 13368 - DNA, 20 bp, Artificial Sequence
  chemically synthesized
ggtactttcaaagtctcatc

SEQ ID NO: 13369 - DNA, 20 bp, Artificial Sequence
  chemically synthesized
tttttttttcttttcttgat

SEQ ID NO: 13370 - DNA, 20 bp, Artificial Sequence
  chemically synthesized
tttcaaagtctcatcaagaa

SEQ ID NO: 13371 - DNA, 20 bp, Artificial Sequence
  chemically synthesized
gaaaaaaaaaaactgaaatg

SEQ ID NO: 13372 - DNA, 20 bp, Artificial Sequence
  chemically synthesized
aaaaaaaaaaactgaaatga

SEQ ID NO: 13373 - DNA, 20 bp, Artificial Sequence
  chemically synthesized
taattccccttccttcattt

SEQ ID NO: 13374 - DNA, 20 bp, Artificial Sequence
  chemically synthesized
aaaaaaaactgaaatgaagg

SEQ ID NO: 13375 - DNA, 20 bp, Artificial Sequence
  chemically synthesized
aaaaaaactgaaatgaagga

SEQ ID NO: 13376 - DNA, 20 bp, Artificial Sequence
  chemically synthesized
aaaaaactgaaatgaaggaa

SEQ ID NO: 13377 - DNA, 20 bp, Artificial Sequence
  chemically synthesized
aaaaactgaaatgaaggaag

SEQ ID NO: 13378 - DNA, 20 bp, Artificial Sequence
  chemically synthesized
ttttgttttgttttgtttta

SEQ ID NO: 13379 - DNA, 20 bp, Artificial Sequence
  chemically synthesized
cataaaacaaaacaaaacaa

SEQ ID NO: 13380 - DNA, 20 bp, Artificial Sequence
  chemically synthesized
aaagaaaacaaacaaataaa

SEQ ID NO: 13381 - DNA, 20 bp, Artificial Sequence
  chemically synthesized
caaacaaataaacagaacaa

SEQ ID NO: 13382 - DNA, 20 bp, Artificial Sequence
  chemically synthesized
aacaaataaacagaacaaaa

SEQ ID NO: 13383 - DNA, 20 bp, Artificial Sequence
  chemically synthesized
aaacagaacaaaagagaacc

SEQ ID NO: 13384 - DNA, 20 bp, Artificial Sequence
  chemically synthesized
agaacaaaagagaaccaagc

SEQ ID NO: 13385 - DNA, 20 bp, Artificial Sequence
  chemically synthesized
caccaacacattcgctcgct

SEQ ID NO: 13386 - DNA, 20 bp, Artificial Sequence
  chemically synthesized
aaccaagcgagcgaatgtgt

SEQ ID NO: 13387 - DNA, 20 bp, Artificial Sequence
  chemically synthesized
caagcgagcgaatgtgttgg

SEQ ID NO: 13388 - DNA, 20 bp, Artificial Sequence
  chemically synthesized
gcgagcgaatgtgttggtgg

SEQ ID NO: 13389 - DNA, 20 bp, Artificial Sequence
  chemically synthesized
agcgaatgtgttggtggtag

SEQ ID NO: 13390 - DNA, 20 bp, Artificial Sequence
  chemically synthesized
ttggtggtagcagcaccctt

SEQ ID NO: 13391 - DNA, 20 bp, Artificial Sequence
  chemically synthesized
tgagtactttttttgctgaa

SEQ ID NO: 13392 - DNA, 20 bp, Artificial Sequence
  chemically synthesized
gtgagtactttttttgctga

SEQ ID NO: 13393 - DNA, 20 bp, Artificial Sequence
  chemically synthesized
cgtgagtactttttttgctg

SEQ ID NO: 13394 - DNA, 20 bp, Artificial Sequence
  chemically synthesized
gcagcacccttcagcaaaaa

SEQ ID NO: 13395 - DNA, 20 bp, Artificial Sequence
  chemically synthesized
cagcaaaaaaagtactcacg

SEQ ID NO: 13396 - DNA, 20 bp, Artificial Sequence
  chemically synthesized
ctggccagtagattctgcgt

SEQ ID NO: 13397 - DNA, 20 bp, Artificial Sequence
  chemically synthesized
agtactcacgcagaatctac

SEQ ID NO: 13398 - DNA, 20 bp, Artificial Sequence
  chemically synthesized
ctcacgcagaatctactggc

SEQ ID NO: 13399 - DNA, 20 bp, Artificial Sequence
  chemically synthesized
tctgatcaacttctggccag

SEQ ID NO: 13400 - DNA, 20 bp, Artificial Sequence
  chemically synthesized
acgcagaatctactggccag

SEQ ID NO: 13401 - DNA, 20 bp, Artificial Sequence
  chemically synthesized
tactctgatcaacttctggc

SEQ ID NO: 13402 - DNA, 20 bp, Artificial Sequence
  chemically synthesized
ccgttactctgatcaacttc

SEQ ID NO: 13403 - DNA, 20 bp, Artificial Sequence
  chemically synthesized
tctactggccagaagttgat

SEQ ID NO: 13404 - DNA, 20 bp, Artificial Sequence
  chemically synthesized
tactggccagaagttgatca

SEQ ID NO: 13405 - DNA, 20 bp, Artificial Sequence
  chemically synthesized
ccagaagttgatcagagtaa

SEQ ID NO: 13406 - DNA, 20 bp, Artificial Sequence
  chemically synthesized
cagaagttgatcagagtaac

SEQ ID NO: 13407 - DNA, 20 bp, Artificial Sequence
  chemically synthesized
ccacctcattttttgttttg

SEQ ID NO: 13408 - DNA, 20 bp, Artificial Sequence
  chemically synthesized
gggactgcaaaacaaaaaat

SEQ ID NO: 13409 - DNA, 20 bp, Artificial Sequence
  chemically synthesized
ggactgcaaaacaaaaaatg

SEQ ID NO: 13410 - DNA, 20 bp, Artificial Sequence
  chemically synthesized
ctgcaaaacaaaaaatgagg

SEQ ID NO: 13411 - DNA, 20 bp, Artificial Sequence
  chemically synthesized
aaacaaaaaatgaggtggtg

SEQ ID NO: 13412 - DNA, 20 bp, Artificial Sequence
  chemically synthesized
aacaaaaaatgaggtggtga

SEQ ID NO: 13413 - DNA, 20 bp, Artificial Sequence
  chemically synthesized
caaaaaatgaggtggtgaag

SEQ ID NO: 13414 - DNA, 20 bp, Artificial Sequence
  chemically synthesized
gaaggagacacacgcaaact

SEQ ID NO: 13415 - DNA, 20 bp, Artificial Sequence
  chemically synthesized
cagtaaatttttttgcggct

SEQ ID NO: 13416 - DNA, 20 bp, Artificial Sequence
  chemically synthesized
cctttcagtaaatttttttg

SEQ ID NO: 13417 - DNA, 20 bp, Artificial Sequence
  chemically synthesized
gccgcaaaaaaatttactga

SEQ ID NO: 13418 - DNA, 20 bp, Artificial Sequence
  chemically synthesized
ccgcaaaaaaatttactgaa

SEQ ID NO: 13419 - DNA, 20 bp, Artificial Sequence
  chemically synthesized
ttttatttattttgaccttt

SEQ ID NO: 13420 - DNA, 20 bp, Artificial Sequence
  chemically synthesized
aggtcaaaataaataaaatc

SEQ ID NO: 13421 - DNA, 20 bp, Artificial Sequence
  chemically synthesized
taaataaaatccagccaatt

SEQ ID NO: 13422 - DNA, 20 bp, Artificial Sequence
  chemically synthesized
atggttcatacttaattggc

SEQ ID NO: 13423 - DNA, 20 bp, Artificial Sequence
  chemically synthesized
ttccatggttcatacttaat

SEQ ID NO: 13424 - DNA, 20 bp, Artificial Sequence
  chemically synthesized
agccaattaagtatgaacca

SEQ ID NO: 13425 - DNA, 20 bp, Artificial Sequence
  chemically synthesized
aattaagtatgaaccatgga

SEQ ID NO: 13426 - DNA, 20 bp, Artificial Sequence
  chemically synthesized
ggtttggctattgctttcca

SEQ ID NO: 13427 - DNA, 20 bp, Artificial Sequence
  chemically synthesized
gtatgaaccatggaaagcaa

SEQ ID NO: 13428 - DNA, 20 bp, Artificial Sequence
  chemically synthesized
tggaaagcaatagccaaacc

SEQ ID NO: 13429 - DNA, 20 bp, Artificial Sequence
  chemically synthesized
ggaaagcaatagccaaacca

SEQ ID NO: 13430 - DNA, 20 bp, Artificial Sequence
  chemically synthesized
attcactttacaccttggtt

SEQ ID NO: 13431 - DNA, 20 bp, Artificial Sequence
  chemically synthesized
aatagccaaaccaaggtgta

SEQ ID NO: 13432 - DNA, 20 bp, Artificial Sequence
  chemically synthesized
ttttaattcactttacacct

SEQ ID NO: 13433 - DNA, 20 bp, Artificial Sequence
  chemically synthesized
caaggtgtaaagtgaattaa

SEQ ID NO: 13434 - DNA, 20 bp, Artificial Sequence
  chemically synthesized
tgaattaaaagaaaaacaca

SEQ ID NO: 13435 - DNA, 20 bp, Artificial Sequence
  chemically synthesized
cacagttgtgtgactgccat

SEQ ID NO: 13436 - DNA, 20 bp, Artificial Sequence
  chemically synthesized
cagttgtgtgactgccatca

SEQ ID NO: 13437 - DNA, 20 bp, Artificial Sequence
  chemically synthesized
ttttgccttaactctgatgg

SEQ ID NO: 13438 - DNA, 20 bp, Artificial Sequence
  chemically synthesized
cttttttgccttaactctga

SEQ ID NO: 13439 - DNA, 20 bp, Artificial Sequence
  chemically synthesized
gtgtgactgccatcagagtt

SEQ ID NO: 13440 - DNA, 20 bp, Artificial Sequence
  chemically synthesized
tgtgactgccatcagagtta

SEQ ID NO: 13441 - DNA, 20 bp, Artificial Sequence
  chemically synthesized
ccatcagagttaaggcaaaa

SEQ ID NO: 13442 - DNA, 20 bp, Artificial Sequence
  chemically synthesized
atcagagttaaggcaaaaaa

SEQ ID NO: 13443 - DNA, 20 bp, Artificial Sequence
  chemically synthesized
tcagagttaaggcaaaaaag

SEQ ID NO: 13444 - DNA, 20 bp, Artificial Sequence
  chemically synthesized
agagttaaggcaaaaaagag

SEQ ID NO: 13445 - DNA, 20 bp, Artificial Sequence
  chemically synthesized
gttaaggcaaaaaagaggag

SEQ ID NO: 13446 - DNA, 20 bp, Artificial Sequence
  chemically synthesized
ttaaggcaaaaaagaggagc

SEQ ID NO: 13447 - DNA, 20 bp, Artificial Sequence
  chemically synthesized
aaaaagaggagcaggttgaa

SEQ ID NO: 13448 - DNA, 20 bp, Artificial Sequence
  chemically synthesized
aaagaggagcaggttgaaaa

SEQ ID NO: 13449 - DNA, 20 bp, Artificial Sequence
  chemically synthesized
aagaggagcaggttgaaaag

SEQ ID NO: 13450 - DNA, 20 bp, Artificial Sequence
  chemically synthesized
gagcaggttgaaaagaggtg

SEQ ID NO: 13451 - DNA, 20 bp, Artificial Sequence
  chemically synthesized
aatgattctcaagatcaaag

SEQ ID NO: 13452 - DNA, 20 bp, Artificial Sequence
  chemically synthesized
taatgattctcaagatcaaa

SEQ ID NO: 13453 - DNA, 20 bp, Artificial Sequence
  chemically synthesized
gtaatgattctcaagatcaa

SEQ ID NO: 13454 - DNA, 20 bp, Artificial Sequence
  chemically synthesized
aagacgtcccctttgatctt

SEQ ID NO: 13455 - DNA, 20 bp, Artificial Sequence
  chemically synthesized
agtaatgattctcaagatca

SEQ ID NO: 13456 - DNA, 20 bp, Artificial Sequence
  chemically synthesized
agtaagtagtaatgattctc

SEQ ID NO: 13457 - DNA, 20 bp, Artificial Sequence
  chemically synthesized
ggaaactacttcacagtaag

SEQ ID NO: 13458 - DNA, 20 bp, Artificial Sequence
  chemically synthesized
aatcattactacttactgtg

SEQ ID NO: 13459 - DNA, 20 bp, Artificial Sequence
  chemically synthesized
acaggaaactacttcacagt

SEQ ID NO: 13460 - DNA, 20 bp, Artificial Sequence
  chemically synthesized
cattactacttactgtgaag

SEQ ID NO: 13461 - DNA, 20 bp, Artificial Sequence
  chemically synthesized
agtcacaggaaactacttca

SEQ ID NO: 13462 - DNA, 20 bp, Artificial Sequence
  chemically synthesized
tcaaaagaaaatatagtcac

SEQ ID NO: 13463 - DNA, 20 bp, Artificial Sequence
  chemically synthesized
ctcaaaagaaaatatagtca

SEQ ID NO: 13464 - DNA, 20 bp, Artificial Sequence
  chemically synthesized
tttctactcaaaagaaaata

SEQ ID NO: 13465 - DNA, 20 bp, Artificial Sequence
  chemically synthesized
ctgtgactatattttctttt

SEQ ID NO: 13466 - DNA, 20 bp, Artificial Sequence
  chemically synthesized
tgactatattttcttttgag

SEQ ID NO: 13467 - DNA, 20 bp, Artificial Sequence
  chemically synthesized
agtcacttgtttctactcaa

SEQ ID NO: 13468 - DNA, 20 bp, Artificial Sequence
  chemically synthesized
attttcttttgagtagaaac

SEQ ID NO: 13469 - DNA, 20 bp, Artificial Sequence
  chemically synthesized
tttgagtagaaacaagtgac

SEQ ID NO: 13470 - DNA, 20 bp, Artificial Sequence
  chemically synthesized
tctcattgtgtggtcatatc

SEQ ID NO: 13471 - DNA, 20 bp, Artificial Sequence
  chemically synthesized
actagatatgaccacacaat

SEQ ID NO: 13472 - DNA, 20 bp, Artificial Sequence
  chemically synthesized
tctttttgtatctcattgtg

SEQ ID NO: 13473 - DNA, 20 bp, Artificial Sequence
  chemically synthesized
accacacaatgagatacaaa

SEQ ID NO: 13474 - DNA, 20 bp, Artificial Sequence
  chemically synthesized
acacacatttactgatttgt

SEQ ID NO: 13475 - DNA, 20 bp, Artificial Sequence
  chemically synthesized
gattttcctctctcacaaat

SEQ ID NO: 13476 - DNA, 20 bp, Artificial Sequence
  chemically synthesized
acacatttactgatttgtga

SEQ ID NO: 13477 - DNA, 20 bp, Artificial Sequence
  chemically synthesized
acatttactgatttgtgaga

SEQ ID NO: 13478 - DNA, 20 bp, Artificial Sequence
  chemically synthesized
catttactgatttgtgagag

SEQ ID NO: 13479 - DNA, 20 bp, Artificial Sequence
  chemically synthesized
ggaaaatcaaaatgaaatac

SEQ ID NO: 13480 - DNA, 20 bp, Artificial Sequence
  chemically synthesized
tgtttacaaatgagtgattc

SEQ ID NO: 13481 - DNA, 20 bp, Artificial Sequence
  chemically synthesized
atatgggactgtttacaaat

SEQ ID NO: 13482 - DNA, 20 bp, Artificial Sequence
  chemically synthesized
tggaatcactcatttgtaaa

SEQ ID NO: 13483 - DNA, 20 bp, Artificial Sequence
  chemically synthesized
acaagccttataagaaatat

SEQ ID NO: 13484 - DNA, 20 bp, Artificial Sequence
  chemically synthesized
tacaagccttataagaaata

SEQ ID NO: 13485 - DNA, 20 bp, Artificial Sequence
  chemically synthesized
aacagtcccatatttcttat

SEQ ID NO: 13486 - DNA, 20 bp, Artificial Sequence
  chemically synthesized
acagtcccatatttcttata

SEQ ID NO: 13487 - DNA, 20 bp, Artificial Sequence
  chemically synthesized
aattgccttacaagccttat

SEQ ID NO: 13488 - DNA, 20 bp, Artificial Sequence
  chemically synthesized
atatttcttataaggcttgt

SEQ ID NO: 13489 - DNA, 20 bp, Artificial Sequence
  chemically synthesized
tatttcttataaggcttgta

SEQ ID NO: 13490 - DNA, 20 bp, Artificial Sequence
  chemically synthesized
acagccactaattgccttac

SEQ ID NO: 13491 - DNA, 20 bp, Artificial Sequence
  chemically synthesized
tataaggcttgtaaggcaat

SEQ ID NO: 13492 - DNA, 20 bp, Artificial Sequence
  chemically synthesized
aaggcttgtaaggcaattag

SEQ ID NO: 13493 - DNA, 20 bp, Artificial Sequence
  chemically synthesized
aaaaaaaccacaacacaata

SEQ ID NO: 13494 - DNA, 20 bp, Artificial Sequence
  chemically synthesized
ttagtggctgtattgtgttg

SEQ ID NO: 13495 - DNA, 20 bp, Artificial Sequence
  chemically synthesized
ttttttttttttccccctgt

SEQ ID NO: 13496 - DNA, 20 bp, Artificial Sequence
  chemically synthesized
gttaaactttatctcacagg

SEQ ID NO: 13497 - DNA, 20 bp, Artificial Sequence
  chemically synthesized
agttaaactttatctcacag

SEQ ID NO: 13498 - DNA, 20 bp, Artificial Sequence
  chemically synthesized
aagttaaactttatctcaca

SEQ ID NO: 13499 - DNA, 20 bp, Artificial Sequence
  chemically synthesized
aaagttaaactttatctcac

SEQ ID NO: 13500 - DNA, 20 bp, Artificial Sequence
  chemically synthesized
ttttttccccctgtgagata

SEQ ID NO: 13501 - DNA, 20 bp, Artificial Sequence
  chemically synthesized
aaaagttaaactttatctca

SEQ ID NO: 13502 - DNA, 20 bp, Artificial Sequence
  chemically synthesized
gtgagataaagtttaacttt

SEQ ID NO: 13503 - DNA, 20 bp, Artificial Sequence
  chemically synthesized
taaagtttaacttttggaaa

SEQ ID NO: 13504 - DNA, 20 bp, Artificial Sequence
  chemically synthesized
ttgacaatttctttttccaa

SEQ ID NO: 13505 - DNA, 20 bp, Artificial Sequence
  chemically synthesized
ttttggaaaaagaaattgtc

SEQ ID NO: 13506 - DNA, 20 bp, Artificial Sequence
  chemically synthesized
aaagaaattgtcaagtgacg

SEQ ID NO: 13507 - DNA, 20 bp, Artificial Sequence
  chemically synthesized
aagaaattgtcaagtgacgt

SEQ ID NO: 13508 - DNA, 20 bp, Artificial Sequence
  chemically synthesized
aattgtcaagtgacgtggga

SEQ ID NO: 13509 - DNA, 20 bp, Artificial Sequence
  chemically synthesized
tgtcaagtgacgtgggaaag

SEQ ID NO: 13510 - DNA, 20 bp, Artificial Sequence
  chemically synthesized
tgacgtgggaaagtggcaac

SEQ ID NO: 13511 - DNA, 20 bp, Artificial Sequence
  chemically synthesized
ggaaagtggcaactggacat

SEQ ID NO: 13512 - DNA, 20 bp, Artificial Sequence
  chemically synthesized
gagaaaaataagctgatgtc

SEQ ID NO: 13513 - DNA, 20 bp, Artificial Sequence
  chemically synthesized
ttagctgaaaagagaaaaat

SEQ ID NO: 13514 - DNA, 20 bp, Artificial Sequence
  chemically synthesized
tcagcttatttttctctttt

SEQ ID NO: 13515 - DNA, 20 bp, Artificial Sequence
  chemically synthesized
ttatttacattagctgaaaa

SEQ ID NO: 13516 - DNA, 20 bp, Artificial Sequence
  chemically synthesized
ttttatttacattagctgaa

SEQ ID NO: 13517 - DNA, 20 bp, Artificial Sequence
  chemically synthesized
ttctttctttttatttacat

SEQ ID NO: 13518 - DNA, 20 bp, Artificial Sequence
  chemically synthesized
tttcagctaatgtaaataaa

SEQ ID NO: 13519 - DNA, 20 bp, Artificial Sequence
  chemically synthesized
agctaatgtaaataaaaaga

SEQ ID NO: 13520 - DNA, 20 bp, Artificial Sequence
  chemically synthesized
tgtaaataaaaagaaagaaa

SEQ ID NO: 13521 - DNA, 20 bp, Artificial Sequence
  chemically synthesized
aaataaaaagaaagaaatag

SEQ ID NO: 13522 - DNA, 20 bp, Artificial Sequence
  chemically synthesized
ataaaaagaaagaaatagaa

SEQ ID NO: 13523 - DNA, 20 bp, Artificial Sequence
  chemically synthesized
ccttcactcccaaatgcaaa

SEQ ID NO: 13524 - DNA, 20 bp, Artificial Sequence
  chemically synthesized
tagaagagactgtttgcatt

SEQ ID NO: 13525 - DNA, 20 bp, Artificial Sequence
  chemically synthesized
agaagagactgtttgcattt

SEQ ID NO: 13526 - DNA, 20 bp, Artificial Sequence
  chemically synthesized
aagagactgtttgcatttgg

SEQ ID NO: 13527 - DNA, 20 bp, Artificial Sequence
  chemically synthesized
actgtttgcatttgggagtg

SEQ ID NO: 13528 - DNA, 20 bp, Artificial Sequence
  chemically synthesized
ctgtttgcatttgggagtga

SEQ ID NO: 13529 - DNA, 20 bp, Artificial Sequence
  chemically synthesized
gtttgcatttgggagtgaag

SEQ ID NO: 13530 - DNA, 20 bp, Artificial Sequence
  chemically synthesized
tttgcatttgggagtgaagg

SEQ ID NO: 13531 - DNA, 20 bp, Artificial Sequence
  chemically synthesized
ttgcatttgggagtgaagga

SEQ ID NO: 13532 - DNA, 20 bp, Artificial Sequence
  chemically synthesized
tgggagtgaaggagggtgtt

SEQ ID NO: 13533 - DNA, 20 bp, Artificial Sequence
  chemically synthesized
gtgaaggagggtgttcagct

SEQ ID NO: 13534 - DNA, 20 bp, Artificial Sequence
  chemically synthesized
gaaggagggtgttcagctga

SEQ ID NO: 13535 - DNA, 20 bp, Artificial Sequence
  chemically synthesized
aaggagggtgttcagctgag

SEQ ID NO: 13536 - DNA, 20 bp, Artificial Sequence
  chemically synthesized
ggagggtgttcagctgagag

SEQ ID NO: 13537 - DNA, 20 bp, Artificial Sequence
  chemically synthesized
atgtatatttgaactcctct

SEQ ID NO: 13538 - DNA, 20 bp, Artificial Sequence
  chemically synthesized
agttcaaatatacatcaaac

SEQ ID NO: 13539 - DNA, 20 bp, Artificial Sequence
  chemically synthesized
ttcaaatatacatcaaacaa

SEQ ID NO: 13540 - DNA, 20 bp, Artificial Sequence
  chemically synthesized
aacgtgagtagtagcaaaag

SEQ ID NO: 13541 - DNA, 20 bp, Artificial Sequence
  chemically synthesized
ggaaacgtgagtagtagcaa

SEQ ID NO: 13542 - DNA, 20 bp, Artificial Sequence
  chemically synthesized
caacatggaaacgtgagtag

SEQ ID NO: 13543 - DNA, 20 bp, Artificial Sequence
  chemically synthesized
ggacaacatggaaacgtgag

SEQ ID NO: 13544 - DNA, 20 bp, Artificial Sequence
  chemically synthesized
gggggacaacatggaaacgt

SEQ ID NO: 13545 - DNA, 20 bp, Artificial Sequence
  chemically synthesized
tgtcttagagggggacaaca

SEQ ID NO: 13546 - DNA, 20 bp, Artificial Sequence
  chemically synthesized
tttccatgttgtccccctct

SEQ ID NO: 13547 - DNA, 20 bp, Artificial Sequence
  chemically synthesized
agtgcagactgtcttagagg

SEQ ID NO: 13548 - DNA, 20 bp, Artificial Sequence
  chemically synthesized
cagtgcagactgtcttagag

SEQ ID NO: 13549 - DNA, 20 bp, Artificial Sequence
  chemically synthesized
catgttgtccccctctaaga

SEQ ID NO: 13550 - DNA, 20 bp, Artificial Sequence
  chemically synthesized
ccagtgcagactgtcttaga

SEQ ID NO: 13551 - DNA, 20 bp, Artificial Sequence
  chemically synthesized
gccagtgcagactgtcttag

SEQ ID NO: 13552 - DNA, 20 bp, Artificial Sequence
  chemically synthesized
tgccagtgcagactgtctta

SEQ ID NO: 13553 - DNA, 20 bp, Artificial Sequence
  chemically synthesized
cctgccagtgcagactgtct

SEQ ID NO: 13554 - DNA, 20 bp, Artificial Sequence
  chemically synthesized
ccctctaagacagtctgcac

SEQ ID NO: 13555 - DNA, 20 bp, Artificial Sequence
  chemically synthesized
tctaagacagtctgcactgg

SEQ ID NO: 13556 - DNA, 20 bp, Artificial Sequence
  chemically synthesized
ctaagacagtctgcactggc

SEQ ID NO: 13557 - DNA, 20 bp, Artificial Sequence
  chemically synthesized
gaatgggctacctgccagtg

SEQ ID NO: 13558 - DNA, 20 bp, Artificial Sequence
  chemically synthesized
agacagtctgcactggcagg

SEQ ID NO: 13559 - DNA, 20 bp, Artificial Sequence
  chemically synthesized
tccccgaatgggctacctgc

SEQ ID NO: 13560 - DNA, 20 bp, Artificial Sequence
  chemically synthesized
gcactggcaggtagcccatt

SEQ ID NO: 13561 - DNA, 20 bp, Artificial Sequence
  chemically synthesized
cactggcaggtagcccattc

SEQ ID NO: 13562 - DNA, 20 bp, Artificial Sequence
  chemically synthesized
actggcaggtagcccattcg

SEQ ID NO: 13563 - DNA, 20 bp, Artificial Sequence
  chemically synthesized
tttgcgaagcatccccgaat

SEQ ID NO: 13564 - DNA, 20 bp, Artificial Sequence
  chemically synthesized
ttttgcgaagcatccccgaa

SEQ ID NO: 13565 - DNA, 20 bp, Artificial Sequence
  chemically synthesized
gaaccaaaaggtattttgcg

SEQ ID NO: 13566 - DNA, 20 bp, Artificial Sequence
  chemically synthesized
atgcttcgcaaaataccttt

SEQ ID NO: 13567 - DNA, 20 bp, Artificial Sequence
  chemically synthesized
aaaacaaatttcgaaccaaa

SEQ ID NO: 13568 - DNA, 20 bp, Artificial Sequence
  chemically synthesized
aaaaacaaatttcgaaccaa

SEQ ID NO: 13569 - DNA, 20 bp, Artificial Sequence
  chemically synthesized
ttggttcgaaatttgttttt

SEQ ID NO: 13570 - DNA, 20 bp, Artificial Sequence
  chemically synthesized
aaatttgttttttagtacct

SEQ ID NO: 13571 - DNA, 20 bp, Artificial Sequence
  chemically synthesized
tgttttttagtaccttggca

SEQ ID NO: 13572 - DNA, 20 bp, Artificial Sequence
  chemically synthesized
agatgttcgagactttgcca

SEQ ID NO: 13573 - DNA, 20 bp, Artificial Sequence
  chemically synthesized
aagatgttcgagactttgcc

SEQ ID NO: 13574 - DNA, 20 bp, Artificial Sequence
  chemically synthesized
tacatcaggagaagatgttc

SEQ ID NO: 13575 - DNA, 20 bp, Artificial Sequence
  chemically synthesized
cttttagactacatcaggag

SEQ ID NO: 13576 - DNA, 20 bp, Artificial Sequence
  chemically synthesized
tcgaacatcttctcctgatg

SEQ ID NO: 13577 - DNA, 20 bp, Artificial Sequence
  chemically synthesized
tcccttttagactacatcag

SEQ ID NO: 13578 - DNA, 20 bp, Artificial Sequence
  chemically synthesized
tctcccttttagactacatc

SEQ ID NO: 13579 - DNA, 20 bp, Artificial Sequence
  chemically synthesized
atctcccttttagactacat

SEQ ID NO: 13580 - DNA, 20 bp, Artificial Sequence
  chemically synthesized
cttctcctgatgtagtctaa

SEQ ID NO: 13581 - DNA, 20 bp, Artificial Sequence
  chemically synthesized
ttctcctgatgtagtctaaa

SEQ ID NO: 13582 - DNA, 20 bp, Artificial Sequence
  chemically synthesized
tctcctgatgtagtctaaaa

SEQ ID NO: 13583 - DNA, 20 bp, Artificial Sequence
  chemically synthesized
tcctgatgtagtctaaaagg

SEQ ID NO: 13584 - DNA, 20 bp, Artificial Sequence
  chemically synthesized
tctcaccatgatctcccttt

SEQ ID NO: 13585 - DNA, 20 bp, Artificial Sequence
  chemically synthesized
gtagtctaaaagggagatca

SEQ ID NO: 13586 - DNA, 20 bp, Artificial Sequence
  chemically synthesized
tctaaaagggagatcatggt

SEQ ID NO: 13587 - DNA, 20 bp, Artificial Sequence
  chemically synthesized
aagggagatcatggtgagat

SEQ ID NO: 13588 - DNA, 20 bp, Artificial Sequence
  chemically synthesized
gatcatggtgagatcagatt

SEQ ID NO: 13589 - DNA, 20 bp, Artificial Sequence
  chemically synthesized
atcatggtgagatcagattt

SEQ ID NO: 13590 - DNA, 20 bp, Artificial Sequence
  chemically synthesized
tggtgagatcagatttagga

SEQ ID NO: 13591 - DNA, 20 bp, Artificial Sequence
  chemically synthesized
ggtgagatcagatttaggac

SEQ ID NO: 13592 - DNA, 20 bp, Artificial Sequence
  chemically synthesized
cagaagactggagtggtcat

SEQ ID NO: 13593 - DNA, 20 bp, Artificial Sequence
  chemically synthesized
ttcaaaactaatgaccactc

SEQ ID NO: 13594 - DNA, 20 bp, Artificial Sequence
  chemically synthesized
catggggcagaagactggag

SEQ ID NO: 13595 - DNA, 20 bp, Artificial Sequence
  chemically synthesized
tgtcatggggcagaagactg

SEQ ID NO: 13596 - DNA, 20 bp, Artificial Sequence
  chemically synthesized
agtgtcatggggcagaagac

SEQ ID NO: 13597 - DNA, 20 bp, Artificial Sequence
  chemically synthesized
aaacaagtgtcatggggcag

SEQ ID NO: 13598 - DNA, 20 bp, Artificial Sequence
  chemically synthesized
acaaaacaagtgtcatgggg

SEQ ID NO: 13599 - DNA, 20 bp, Artificial Sequence
  chemically synthesized
attacaaaacaagtgtcatg

SEQ ID NO: 13600 - DNA, 20 bp, Artificial Sequence
  chemically synthesized
aattacaaaacaagtgtcat

SEQ ID NO: 13601 - DNA, 20 bp, Artificial Sequence
  chemically synthesized
taattacaaaacaagtgtca

SEQ ID NO: 13602 - DNA, 20 bp, Artificial Sequence
  chemically synthesized
actctccttaattacaaaac

SEQ ID NO: 13603 - DNA, 20 bp, Artificial Sequence
  chemically synthesized
atgacacttgttttgtaatt

SEQ ID NO: 13604 - DNA, 20 bp, Artificial Sequence
  chemically synthesized
tgacacttgttttgtaatta

SEQ ID NO: 13605 - DNA, 20 bp, Artificial Sequence
  chemically synthesized
acacttgttttgtaattaag

SEQ ID NO: 13606 - DNA, 20 bp, Artificial Sequence
  chemically synthesized
acttgttttgtaattaagga

SEQ ID NO: 13607 - DNA, 20 bp, Artificial Sequence
  chemically synthesized
tgtaattaaggagagtgttg

SEQ ID NO: 13608 - DNA, 20 bp, Artificial Sequence
  chemically synthesized
aaggagagtgttgtggttgt

SEQ ID NO: 13609 - DNA, 20 bp, Artificial Sequence
  chemically synthesized
gagtgttgtggttgtgagca

SEQ ID NO: 13610 - DNA, 20 bp, Artificial Sequence
  chemically synthesized
agtgttgtggttgtgagcaa

SEQ ID NO: 13611 - DNA, 20 bp, Artificial Sequence
  chemically synthesized
gtggttgtgagcaaaggctt

SEQ ID NO: 13612 - DNA, 20 bp, Artificial Sequence
  chemically synthesized
gtgagcaaaggctttggaat

SEQ ID NO: 13613 - DNA, 20 bp, Artificial Sequence
  chemically synthesized
gccccatttgtctgattcca

SEQ ID NO: 13614 - DNA, 20 bp, Artificial Sequence
  chemically synthesized
aggctttggaatcagacaaa

SEQ ID NO: 13615 - DNA, 20 bp, Artificial Sequence
  chemically synthesized
ggctttggaatcagacaaat

SEQ ID NO: 13616 - DNA, 20 bp, Artificial Sequence
  chemically synthesized
gctttggaatcagacaaatg

SEQ ID NO: 13617 - DNA, 20 bp, Artificial Sequence
  chemically synthesized
gacaaatggggctctgaaac

SEQ ID NO: 13618 - DNA, 20 bp, Artificial Sequence
  chemically synthesized
acaaatggggctctgaaacc

SEQ ID NO: 13619 - DNA, 20 bp, Artificial Sequence
  chemically synthesized
acatgccaggcctggtttca

SEQ ID NO: 13620 - DNA, 20 bp, Artificial Sequence
  chemically synthesized
gtacatgccaggcctggttt

SEQ ID NO: 13621 - DNA, 20 bp, Artificial Sequence
  chemically synthesized
tggggctctgaaaccaggcc

SEQ ID NO: 13622 - DNA, 20 bp, Artificial Sequence
  chemically synthesized
aaattagtacatgccaggcc

SEQ ID NO: 13623 - DNA, 20 bp, Artificial Sequence
  chemically synthesized
cagccaaattagtacatgcc

SEQ ID NO: 13624 - DNA, 20 bp, Artificial Sequence
  chemically synthesized
tcagccaaattagtacatgc

SEQ ID NO: 13625 - DNA, 20 bp, Artificial Sequence
  chemically synthesized
aggcctggcatgtactaatt

SEQ ID NO: 13626 - DNA, 20 bp, Artificial Sequence
  chemically synthesized
agtaaataactcagccaaat

SEQ ID NO: 13627 - DNA, 20 bp, Artificial Sequence
  chemically synthesized
tggcatgtactaatttggct

SEQ ID NO: 13628 - DNA, 20 bp, Artificial Sequence
  chemically synthesized
cctctgagaagtaaataact

SEQ ID NO: 13629 - DNA, 20 bp, Artificial Sequence
  chemically synthesized
tggctgagttatttacttct

SEQ ID NO: 13630 - DNA, 20 bp, Artificial Sequence
  chemically synthesized
gctgagttatttacttctca

SEQ ID NO: 13631 - DNA, 20 bp, Artificial Sequence
  chemically synthesized
ctgagttatttacttctcag

SEQ ID NO: 13632 - DNA, 20 bp, Artificial Sequence
  chemically synthesized
tgatgatcagagcctctgag

SEQ ID NO: 13633 - DNA, 20 bp, Artificial Sequence
  chemically synthesized
tactgatgatcagagcctct

SEQ ID NO: 13634 - DNA, 20 bp, Artificial Sequence
  chemically synthesized
ttctcagaggctctgatcat

SEQ ID NO: 13635 - DNA, 20 bp, Artificial Sequence
  chemically synthesized
tcccattttactgatgatca

SEQ ID NO: 13636 - DNA, 20 bp, Artificial Sequence
  chemically synthesized
gctcccattttactgatgat

SEQ ID NO: 13637 - DNA, 20 bp, Artificial Sequence
  chemically synthesized
ggctctgatcatcagtaaaa

SEQ ID NO: 13638 - DNA, 20 bp, Artificial Sequence
  chemically synthesized
gctctgatcatcagtaaaat

SEQ ID NO: 13639 - DNA, 20 bp, Artificial Sequence
  chemically synthesized
tctgatcatcagtaaaatgg

SEQ ID NO: 13640 - DNA, 20 bp, Artificial Sequence
  chemically synthesized
tttatcataacaacgtgttg

SEQ ID NO: 13641 - DNA, 20 bp, Artificial Sequence
  chemically synthesized
atttatcataacaacgtgtt

SEQ ID NO: 13642 - DNA, 20 bp, Artificial Sequence
  chemically synthesized
cacgttgttatgataaataa

SEQ ID NO: 13643 - DNA, 20 bp, Artificial Sequence
  chemically synthesized
gataaataaaagaaacatac

SEQ ID NO: 13644 - DNA, 20 bp, Artificial Sequence
  chemically synthesized
aaagaaacatacaagcttac

SEQ ID NO: 13645 - DNA, 20 bp, Artificial Sequence
  chemically synthesized
aagaaacatacaagcttact

SEQ ID NO: 13646 - DNA, 20 bp, Artificial Sequence
  chemically synthesized
catttattgagtagcctagt

SEQ ID NO: 13647 - DNA, 20 bp, Artificial Sequence
  chemically synthesized
ctaccatttattgagtagcc

SEQ ID NO: 13648 - DNA, 20 bp, Artificial Sequence
  chemically synthesized
ataaactaccatttattgag

SEQ ID NO: 13649 - DNA, 20 bp, Artificial Sequence
  chemically synthesized
ttactaggctactcaataaa

SEQ ID NO: 13650 - DNA, 20 bp, Artificial Sequence
  chemically synthesized
cctataaactaccatttatt

SEQ ID NO: 13651 - DNA, 20 bp, Artificial Sequence
  chemically synthesized
ctaggctactcaataaatgg

SEQ ID NO: 13652 - DNA, 20 bp, Artificial Sequence
  chemically synthesized
actcaataaatggtagttta

SEQ ID NO: 13653 - DNA, 20 bp, Artificial Sequence
  chemically synthesized
ctcaataaatggtagtttat

SEQ ID NO: 13654 - DNA, 20 bp, Artificial Sequence
  chemically synthesized
aatggtagtttataggtctt

SEQ ID NO: 13655 - DNA, 20 bp, Artificial Sequence
  chemically synthesized
atggtagtttataggtctta

SEQ ID NO: 13656 - DNA, 20 bp, Artificial Sequence
  chemically synthesized
aatgtcacctttttgacctt

SEQ ID NO: 13657 - DNA, 20 bp, Artificial Sequence
  chemically synthesized
ttataggtcttaaggtcaaa

SEQ ID NO: 13658 - DNA, 20 bp, Artificial Sequence
  chemically synthesized
tataggtcttaaggtcaaaa

SEQ ID NO: 13659 - DNA, 20 bp, Artificial Sequence
  chemically synthesized
ttaaattttaccacacttta

SEQ ID NO: 13660 - DNA, 20 bp, Artificial Sequence
  chemically synthesized
ttttaaaataccataaagtg

SEQ ID NO: 13661 - DNA, 20 bp, Artificial Sequence
  chemically synthesized
gtagtttttaaaataccata

SEQ ID NO: 13662 - DNA, 20 bp, Artificial Sequence
  chemically synthesized
atggtattttaaaaactact

SEQ ID NO: 13663 - DNA, 20 bp, Artificial Sequence
  chemically synthesized
tgctatcattttgtactaag

SEQ ID NO: 13664 - DNA, 20 bp, Artificial Sequence
  chemically synthesized
gcatgctatcattttgtact

SEQ ID NO: 13665 - DNA, 20 bp, Artificial Sequence
  chemically synthesized
aactacttagtacaaaatga

SEQ ID NO: 13666 - DNA, 20 bp, Artificial Sequence
  chemically synthesized
agaccgaaatttagtgggtg

SEQ ID NO: 13667 - DNA, 20 bp, Artificial Sequence
  chemically synthesized
tgaatagaccgaaatttagt

SEQ ID NO: 13668 - DNA, 20 bp, Artificial Sequence
  chemically synthesized
atgaatagaccgaaatttag

SEQ ID NO: 13669 - DNA, 20 bp, Artificial Sequence
  chemically synthesized
atgcttcacccactaaattt

SEQ ID NO: 13670 - DNA, 20 bp, Artificial Sequence
  chemically synthesized
gctatgaatagaccgaaatt

SEQ ID NO: 13671 - DNA, 20 bp, Artificial Sequence
  chemically synthesized
actaaatttcggtctattca

SEQ ID NO: 13672 - DNA, 20 bp, Artificial Sequence
  chemically synthesized
agaatgtaccatgctatgaa

SEQ ID NO: 13673 - DNA, 20 bp, Artificial Sequence
  chemically synthesized
atttcggtctattcatagca

SEQ ID NO: 13674 - DNA, 20 bp, Artificial Sequence
  chemically synthesized
tatagagatggtcagtgatt

SEQ ID NO: 13675 - DNA, 20 bp, Artificial Sequence
  chemically synthesized
attcctcttatagagatggt

SEQ ID NO: 13676 - DNA, 20 bp, Artificial Sequence
  chemically synthesized
caatcactgaccatctctat

SEQ ID NO: 13677 - DNA, 20 bp, Artificial Sequence
  chemically synthesized
ttttattcctcttatagaga

SEQ ID NO: 13678 - DNA, 20 bp, Artificial Sequence
  chemically synthesized
atcactgaccatctctataa

SEQ ID NO: 13679 - DNA, 20 bp, Artificial Sequence
  chemically synthesized
tcactgaccatctctataag

SEQ ID NO: 13680 - DNA, 20 bp, Artificial Sequence
  chemically synthesized
tcacttttattcctcttata

SEQ ID NO: 13681 - DNA, 20 bp, Artificial Sequence
  chemically synthesized
tctcacttttattcctctta

SEQ ID NO: 13682 - DNA, 20 bp, Artificial Sequence
  chemically synthesized
catctctataagaggaataa

SEQ ID NO: 13683 - DNA, 20 bp, Artificial Sequence
  chemically synthesized
tctataagaggaataaaagt

SEQ ID NO: 13684 - DNA, 20 bp, Artificial Sequence
  chemically synthesized
taagaggaataaaagtgaga

SEQ ID NO: 13685 - DNA, 20 bp, Artificial Sequence
  chemically synthesized
aagaggaataaaagtgagac

SEQ ID NO: 13686 - DNA, 20 bp, Artificial Sequence
  chemically synthesized
aagtgagacaggcaaatatc

SEQ ID NO: 13687 - DNA, 20 bp, Artificial Sequence
  chemically synthesized
agtgagacaggcaaatatct

SEQ ID NO: 13688 - DNA, 20 bp, Artificial Sequence
  chemically synthesized
tgagacaggcaaatatctgg

SEQ ID NO: 13689 - DNA, 20 bp, Artificial Sequence
  chemically synthesized
gagacaggcaaatatctggg

SEQ ID NO: 13690 - DNA, 20 bp, Artificial Sequence
  chemically synthesized
catcatcagagtgatcctcc

SEQ ID NO: 13691 - DNA, 20 bp, Artificial Sequence
  chemically synthesized
tgggaggatcactctgatga

SEQ ID NO: 13692 - DNA, 20 bp, Artificial Sequence
  chemically synthesized
atctctctcttccatcatca

SEQ ID NO: 13693 - DNA, 20 bp, Artificial Sequence
  chemically synthesized
gaggatcactctgatgatgg

SEQ ID NO: 13694 - DNA, 20 bp, Artificial Sequence
  chemically synthesized
gcatctctctcttccatcat

SEQ ID NO: 13695 - DNA, 20 bp, Artificial Sequence
  chemically synthesized
ggatcactctgatgatggaa

SEQ ID NO: 13696 - DNA, 20 bp, Artificial Sequence
  chemically synthesized
atcactctgatgatggaaga

SEQ ID NO: 13697 - DNA, 20 bp, Artificial Sequence
  chemically synthesized
cactctgatgatggaagaga

SEQ ID NO: 13698 - DNA, 20 bp, Artificial Sequence
  chemically synthesized
tggaagagagagatgctcta

SEQ ID NO: 13699 - DNA, 20 bp, Artificial Sequence
  chemically synthesized
aagagagagatgctctaaag

SEQ ID NO: 13700 - DNA, 20 bp, Artificial Sequence
  chemically synthesized
gagagagatgctctaaagca

SEQ ID NO: 13701 - DNA, 20 bp, Artificial Sequence
  chemically synthesized
gtatgagaagctctgcttta

SEQ ID NO: 13702 - DNA, 20 bp, Artificial Sequence
  chemically synthesized
aagtatgagaagctctgctt

SEQ ID NO: 13703 - DNA, 20 bp, Artificial Sequence
  chemically synthesized
catacacaacaaagtatgag

SEQ ID NO: 13704 - DNA, 20 bp, Artificial Sequence
  chemically synthesized
tcccatacacaacaaagtat

SEQ ID NO: 13705 - DNA, 20 bp, Artificial Sequence
  chemically synthesized
gctggttcccatacacaaca

SEQ ID NO: 13706 - DNA, 20 bp, Artificial Sequence
  chemically synthesized
ttctcatactttgttgtgta

SEQ ID NO: 13707 - DNA, 20 bp, Artificial Sequence
  chemically synthesized
tctcatactttgttgtgtat

SEQ ID NO: 13708 - DNA, 20 bp, Artificial Sequence
  chemically synthesized
actttgttgtgtatgggaac

SEQ ID NO: 13709 - DNA, 20 bp, Artificial Sequence
  chemically synthesized
ttgtgtatgggaaccagctg

SEQ ID NO: 13710 - DNA, 20 bp, Artificial Sequence
  chemically synthesized
attttagcgagatctgcagc

SEQ ID NO: 13711 - DNA, 20 bp, Artificial Sequence
  chemically synthesized
ccacattttagcgagatctg

SEQ ID NO: 13712 - DNA, 20 bp, Artificial Sequence
  chemically synthesized
atcaaaacccacattttagc

SEQ ID NO: 13713 - DNA, 20 bp, Artificial Sequence
  chemically synthesized
ctgcagatctcgctaaaatg

SEQ ID NO: 13714 - DNA, 20 bp, Artificial Sequence
  chemically synthesized
tgcagatctcgctaaaatgt

SEQ ID NO: 13715 - DNA, 20 bp, Artificial Sequence
  chemically synthesized
ctaaatcaaaacccacattt

SEQ ID NO: 13716 - DNA, 20 bp, Artificial Sequence
  chemically synthesized
ctaaaatgtgggttttgatt

SEQ ID NO: 13717 - DNA, 20 bp, Artificial Sequence
  chemically synthesized
aaaatgtgggttttgattta

SEQ ID NO: 13718 - DNA, 20 bp, Artificial Sequence
  chemically synthesized
tgggttttgatttagagcat

SEQ ID NO: 13719 - DNA, 20 bp, Artificial Sequence
  chemically synthesized
gggttttgatttagagcatc

SEQ ID NO: 13720 - DNA, 20 bp, Artificial Sequence
  chemically synthesized
gttttgatttagagcatcag

SEQ ID NO: 13721 - DNA, 20 bp, Artificial Sequence
  chemically synthesized
tgatttagagcatcaggagt

SEQ ID NO: 13722 - DNA, 20 bp, Artificial Sequence
  chemically synthesized
gatttagagcatcaggagtt

SEQ ID NO: 13723 - DNA, 20 bp, Artificial Sequence
  chemically synthesized
atttagagcatcaggagttg

SEQ ID NO: 13724 - DNA, 20 bp, Artificial Sequence
  chemically synthesized
gcatcaggagttggggcctg

SEQ ID NO: 13725 - DNA, 20 bp, Artificial Sequence
  chemically synthesized
tattagaaatgtgaaaccac

SEQ ID NO: 13726 - DNA, 20 bp, Artificial Sequence
  chemically synthesized
ttattagaaatgtgaaacca

SEQ ID NO: 13727 - DNA, 20 bp, Artificial Sequence
  chemically synthesized
gtggtttcacatttctaata

SEQ ID NO: 13728 - DNA, 20 bp, Artificial Sequence
  chemically synthesized
ggcattaccttggtctttat

SEQ ID NO: 13729 - DNA, 20 bp, Artificial Sequence
  chemically synthesized
tcacatttctaataaagacc

SEQ ID NO: 13730 - DNA, 20 bp, Artificial Sequence
  chemically synthesized
cacatttctaataaagacca

SEQ ID NO: 13731 - DNA, 20 bp, Artificial Sequence
  chemically synthesized
tatgtctattggcattacct

SEQ ID NO: 13732 - DNA, 20 bp, Artificial Sequence
  chemically synthesized
aaagaccaaggtaatgccaa

SEQ ID NO: 13733 - DNA, 20 bp, Artificial Sequence
  chemically synthesized
actaatcatcatatgtctat

SEQ ID NO: 13734 - DNA, 20 bp, Artificial Sequence
  chemically synthesized
gccaatagacatatgatgat

SEQ ID NO: 13735 - DNA, 20 bp, Artificial Sequence
  chemically synthesized
gacatatgatgattagtcaa

SEQ ID NO: 13736 - DNA, 20 bp, Artificial Sequence
  chemically synthesized
catgcttgctattcaagata

SEQ ID NO: 13737 - DNA, 20 bp, Artificial Sequence
  chemically synthesized
tcaacagaccgtatcttgaa

SEQ ID NO: 13738 - DNA, 20 bp, Artificial Sequence
  chemically synthesized
cagaccgtatcttgaatagc

SEQ ID NO: 13739 - DNA, 20 bp, Artificial Sequence
  chemically synthesized
actttgcatgcttgctattc

SEQ ID NO: 13740 - DNA, 20 bp, Artificial Sequence
  chemically synthesized
tcttgaatagcaagcatgca

SEQ ID NO: 13741 - DNA, 20 bp, Artificial Sequence
  chemically synthesized
aatagcaagcatgcaaagtt

SEQ ID NO: 13742 - DNA, 20 bp, Artificial Sequence
  chemically synthesized
tagcaagcatgcaaagttta

SEQ ID NO: 13743 - DNA, 20 bp, Artificial Sequence
  chemically synthesized
caagcatgcaaagtttagag

SEQ ID NO: 13744 - DNA, 20 bp, Artificial Sequence
  chemically synthesized
agcatgcaaagtttagagaa

SEQ ID NO: 13745 - DNA, 20 bp, Artificial Sequence
  chemically synthesized
gcatgcaaagtttagagaag

SEQ ID NO: 13746 - DNA, 20 bp, Artificial Sequence
  chemically synthesized
atgcaaagtttagagaagag

SEQ ID NO: 13747 - DNA, 20 bp, Artificial Sequence
  chemically synthesized
tttagagaagaggagactgt

SEQ ID NO: 13748 - DNA, 20 bp, Artificial Sequence
  chemically synthesized
ttctctttctttaattctta

SEQ ID NO: 13749 - DNA, 20 bp, Artificial Sequence
  chemically synthesized
agaggagactgtaagaatta

SEQ ID NO: 13750 - DNA, 20 bp, Artificial Sequence
  chemically synthesized
gagactgtaagaattaaaga

SEQ ID NO: 13751 - DNA, 20 bp, Artificial Sequence
  chemically synthesized
gactgtaagaattaaagaaa

SEQ ID NO: 13752 - DNA, 20 bp, Artificial Sequence
  chemically synthesized
tgtaagaattaaagaaagag

SEQ ID NO: 13753 - DNA, 20 bp, Artificial Sequence
  chemically synthesized
taagaattaaagaaagagaa

SEQ ID NO: 13754 - DNA, 20 bp, Artificial Sequence
  chemically synthesized
agaaagagaagagaaacacg

SEQ ID NO: 13755 - DNA, 20 bp, Artificial Sequence
  chemically synthesized
gaaagagaagagaaacacga

SEQ ID NO: 13756 - DNA, 20 bp, Artificial Sequence
  chemically synthesized
aaagagaagagaaacacgaa

SEQ ID NO: 13757 - DNA, 20 bp, Artificial Sequence
  chemically synthesized
gagaagagaaacacgaaggg

SEQ ID NO: 13758 - DNA, 20 bp, Artificial Sequence
  chemically synthesized
aaacacgaagggtggctcta

SEQ ID NO: 13759 - DNA, 20 bp, Artificial Sequence
  chemically synthesized
acctgtccctgttgactgta

SEQ ID NO: 13760 - DNA, 20 bp, Artificial Sequence
  chemically synthesized
aagggtggctctacagtcaa

SEQ ID NO: 13761 - DNA, 20 bp, Artificial Sequence
  chemically synthesized
aaacctgtccctgttgactg

SEQ ID NO: 13762 - DNA, 20 bp, Artificial Sequence
  chemically synthesized
agggtggctctacagtcaac

SEQ ID NO: 13763 - DNA, 20 bp, Artificial Sequence
  chemically synthesized
gggtggctctacagtcaaca

SEQ ID NO: 13764 - DNA, 20 bp, Artificial Sequence
  chemically synthesized
ggctctacagtcaacaggga

SEQ ID NO: 13765 - DNA, 20 bp, Artificial Sequence
  chemically synthesized
gctctacagtcaacagggac

SEQ ID NO: 13766 - DNA, 20 bp, Artificial Sequence
  chemically synthesized
caacagggacaggtttattt

SEQ ID NO: 13767 - DNA, 20 bp, Artificial Sequence
  chemically synthesized
attttagaaaaaacaaacct

SEQ ID NO: 13768 - DNA, 20 bp, Artificial Sequence
  chemically synthesized
tttagaaaaaacaaacctga

SEQ ID NO: 13769 - DNA, 20 bp, Artificial Sequence
  chemically synthesized
ttagaaaaaacaaacctgag

SEQ ID NO: 13770 - DNA, 20 bp, Artificial Sequence
  chemically synthesized
agaaaaaacaaacctgagag

SEQ ID NO: 13771 - DNA, 20 bp, Artificial Sequence
  chemically synthesized
attaaagacaggctcctctc

SEQ ID NO: 13772 - DNA, 20 bp, Artificial Sequence
  chemically synthesized
aattaaagacaggctcctct

SEQ ID NO: 13773 - DNA, 20 bp, Artificial Sequence
  chemically synthesized
tctgcctaagaattaaagac

SEQ ID NO: 13774 - DNA, 20 bp, Artificial Sequence
  chemically synthesized
atctgcctaagaattaaaga

SEQ ID NO: 13775 - DNA, 20 bp, Artificial Sequence
  chemically synthesized
aggagcctgtctttaattct

SEQ ID NO: 13776 - DNA, 20 bp, Artificial Sequence
  chemically synthesized
acaaatctgcctaagaatta

SEQ ID NO: 13777 - DNA, 20 bp, Artificial Sequence
  chemically synthesized
ggagcctgtctttaattctt

SEQ ID NO: 13778 - DNA, 20 bp, Artificial Sequence
  chemically synthesized
gcctgtctttaattcttagg

SEQ ID NO: 13779 - DNA, 20 bp, Artificial Sequence
  chemically synthesized
acctgagtacaaatctgcct

SEQ ID NO: 13780 - DNA, 20 bp, Artificial Sequence
  chemically synthesized
ttcttaggcagatttgtact

SEQ ID NO: 13781 - DNA, 20 bp, Artificial Sequence
  chemically synthesized
tcttaggcagatttgtactc

SEQ ID NO: 13782 - DNA, 20 bp, Artificial Sequence
  chemically synthesized
cttggtggccagacagacct

SEQ ID NO: 13783 - DNA, 20 bp, Artificial Sequence
  chemically synthesized
gatttgtactcaggtctgtc

SEQ ID NO: 13784 - DNA, 20 bp, Artificial Sequence
  chemically synthesized
atgtagacttggtggccaga

SEQ ID NO: 13785 - DNA, 20 bp, Artificial Sequence
  chemically synthesized
ctcaggtctgtctggccacc

SEQ ID NO: 13786 - DNA, 20 bp, Artificial Sequence
  chemically synthesized
aaggatgtagacttggtggc

SEQ ID NO: 13787 - DNA, 20 bp, Artificial Sequence
  chemically synthesized
tggcaaggatgtagacttgg

SEQ ID NO: 13788 - DNA, 20 bp, Artificial Sequence
  chemically synthesized
aaatggcaaggatgtagact

SEQ ID NO: 13789 - DNA, 20 bp, Artificial Sequence
  chemically synthesized
ctagggaaatggcaaggatg

SEQ ID NO: 13790 - DNA, 20 bp, Artificial Sequence
  chemically synthesized
aaatcactagggaaatggca

SEQ ID NO: 13791 - DNA, 20 bp, Artificial Sequence
  chemically synthesized
aaaatcactagggaaatggc

SEQ ID NO: 13792 - DNA, 20 bp, Artificial Sequence
  chemically synthesized
ctacatccttgccatttccc

SEQ ID NO: 13793 - DNA, 20 bp, Artificial Sequence
  chemically synthesized
gtgaaaaatcactagggaaa

SEQ ID NO: 13794 - DNA, 20 bp, Artificial Sequence
  chemically synthesized
agaactgtgaaaaatcacta

SEQ ID NO: 13795 - DNA, 20 bp, Artificial Sequence
  chemically synthesized
tagaactgtgaaaaatcact

SEQ ID NO: 13796 - DNA, 20 bp, Artificial Sequence
  chemically synthesized
atagaactgtgaaaaatcac

SEQ ID NO: 13797 - DNA, 20 bp, Artificial Sequence
  chemically synthesized
atttccctagtgatttttca

SEQ ID NO: 13798 - DNA, 20 bp, Artificial Sequence
  chemically synthesized
gtgatttttcacagttctat

SEQ ID NO: 13799 - DNA, 20 bp, Artificial Sequence
  chemically synthesized
ggaaaatgttaagtggccaa

SEQ ID NO: 13800 - DNA, 20 bp, Artificial Sequence
  chemically synthesized
tattttaggaaaatgttaag

SEQ ID NO: 13801 - DNA, 20 bp, Artificial Sequence
  chemically synthesized
tgttattttaggaaaatgtt

SEQ ID NO: 13802 - DNA, 20 bp, Artificial Sequence
  chemically synthesized
atctcctaagatgttatttt

SEQ ID NO: 13803 - DNA, 20 bp, Artificial Sequence
  chemically synthesized
catctcctaagatgttattt

SEQ ID NO: 13804 - DNA, 20 bp, Artificial Sequence
  chemically synthesized
attttcctaaaataacatct

SEQ ID NO: 13805 - DNA, 20 bp, Artificial Sequence
  chemically synthesized
ttttcctaaaataacatctt

SEQ ID NO: 13806 - DNA, 20 bp, Artificial Sequence
  chemically synthesized
ttcctaaaataacatcttag

SEQ ID NO: 13807 - DNA, 20 bp, Artificial Sequence
  chemically synthesized
taaaataacatcttaggaga

SEQ ID NO: 13808 - DNA, 20 bp, Artificial Sequence
  chemically synthesized
aagagttgaagccatctcct

SEQ ID NO: 13809 - DNA, 20 bp, Artificial Sequence
  chemically synthesized
ggttctataagtaagagttg

SEQ ID NO: 13810 - DNA, 20 bp, Artificial Sequence
  chemically synthesized
atggcttcaactcttactta

SEQ ID NO: 13811 - DNA, 20 bp, Artificial Sequence
  chemically synthesized
actcaaggttctataagtaa

SEQ ID NO: 13812 - DNA, 20 bp, Artificial Sequence
  chemically synthesized
ttactcaaggttctataagt

SEQ ID NO: 13813 - DNA, 20 bp, Artificial Sequence
  chemically synthesized
taatttactcaaggttctat

SEQ ID NO: 13814 - DNA, 20 bp, Artificial Sequence
  chemically synthesized
actcttacttatagaacctt

SEQ ID NO: 13815 - DNA, 20 bp, Artificial Sequence
  chemically synthesized
gaggttaaataatttactca

SEQ ID NO: 13816 - DNA, 20 bp, Artificial Sequence
  chemically synthesized
tgaggttaaataatttactc

SEQ ID NO: 13817 - DNA, 20 bp, Artificial Sequence
  chemically synthesized
ttgagtaaattatttaacct

SEQ ID NO: 13818 - DNA, 20 bp, Artificial Sequence
  chemically synthesized
tgagtaaattatttaacctc

SEQ ID NO: 13819 - DNA, 20 bp, Artificial Sequence
  chemically synthesized
atgaggaccctgaggtcctg

SEQ ID NO: 13820 - DNA, 20 bp, Artificial Sequence
  chemically synthesized
attatttaacctcaggacct

SEQ ID NO: 13821 - DNA, 20 bp, Artificial Sequence
  chemically synthesized
gatgaggaccctgaggtcct

SEQ ID NO: 13822 - DNA, 20 bp, Artificial Sequence
  chemically synthesized
ttatttaacctcaggacctc

SEQ ID NO: 13823 - DNA, 20 bp, Artificial Sequence
  chemically synthesized
tatttaacctcaggacctca

SEQ ID NO: 13824 - DNA, 20 bp, Artificial Sequence
  chemically synthesized
ctatacagatgaggaccctg

SEQ ID NO: 13825 - DNA, 20 bp, Artificial Sequence
  chemically synthesized
tctatacagatgaggaccct

SEQ ID NO: 13826 - DNA, 20 bp, Artificial Sequence
  chemically synthesized
ttatcccctctatacagatg

SEQ ID NO: 13827 - DNA, 20 bp, Artificial Sequence
  chemically synthesized
cctcagggtcctcatctgta

SEQ ID NO: 13828 - DNA, 20 bp, Artificial Sequence
  chemically synthesized
tttatcccctctatacagat

SEQ ID NO: 13829 - DNA, 20 bp, Artificial Sequence
  chemically synthesized
tcagggtcctcatctgtata

SEQ ID NO: 13830 - DNA, 20 bp, Artificial Sequence
  chemically synthesized
cagggtcctcatctgtatag

SEQ ID NO: 13831 - DNA, 20 bp, Artificial Sequence
  chemically synthesized
agggtcctcatctgtataga

SEQ ID NO: 13832 - DNA, 20 bp, Artificial Sequence
  chemically synthesized
gggtcctcatctgtatagag

SEQ ID NO: 13833 - DNA, 20 bp, Artificial Sequence
  chemically synthesized
tgatttttatcccctctata

SEQ ID NO: 13834 - DNA, 20 bp, Artificial Sequence
  chemically synthesized
tatagaggggataaaaatca

SEQ ID NO: 13835 - DNA, 20 bp, Artificial Sequence
  chemically synthesized
taaactaccctgtgtaaaat

SEQ ID NO: 13836 - DNA, 20 bp, Artificial Sequence
  chemically synthesized
atcatagtacttattttaca

SEQ ID NO: 13837 - DNA, 20 bp, Artificial Sequence
  chemically synthesized
tcatagtacttattttacac

SEQ ID NO: 13838 - DNA, 20 bp, Artificial Sequence
  chemically synthesized
catagtacttattttacaca

SEQ ID NO: 13839 - DNA, 20 bp, Artificial Sequence
  chemically synthesized
agtacttattttacacaggg

SEQ ID NO: 13840 - DNA, 20 bp, Artificial Sequence
  chemically synthesized
ttttacacagggtagtttaa

SEQ ID NO: 13841 - DNA, 20 bp, Artificial Sequence
  chemically synthesized
tttacacagggtagtttaaa

SEQ ID NO: 13842 - DNA, 20 bp, Artificial Sequence
  chemically synthesized
tagtttaaaaggtaaatgcc

SEQ ID NO: 13843 - DNA, 20 bp, Artificial Sequence
  chemically synthesized
aaaggtaaatgcctagcatt

SEQ ID NO: 13844 - DNA, 20 bp, Artificial Sequence
  chemically synthesized
gctaacacttactaaatgct

SEQ ID NO: 13845 - DNA, 20 bp, Artificial Sequence
  chemically synthesized
tgctaacacttactaaatgc

SEQ ID NO: 13846 - DNA, 20 bp, Artificial Sequence
  chemically synthesized
gtaaatgcctagcatttagt

SEQ ID NO: 13847 - DNA, 20 bp, Artificial Sequence
  chemically synthesized
gcctagcatttagtaagtgt

SEQ ID NO: 13848 - DNA, 20 bp, Artificial Sequence
  chemically synthesized
gtaagtgttagcatataaaa

SEQ ID NO: 13849 - DNA, 20 bp, Artificial Sequence
  chemically synthesized
atggatttttaaaatgtcac

SEQ ID NO: 13850 - DNA, 20 bp, Artificial Sequence
  chemically synthesized
tttaaaatgtcactagtata

SEQ ID NO: 13851 - DNA, 20 bp, Artificial Sequence
  chemically synthesized
ttaaaatgtcactagtatac

SEQ ID NO: 13852 - DNA, 20 bp, Artificial Sequence
  chemically synthesized
ctattatctgtcctgtatac

SEQ ID NO: 13853 - DNA, 20 bp, Artificial Sequence
  chemically synthesized
aatgtcactagtatacagga

SEQ ID NO: 13854 - DNA, 20 bp, Artificial Sequence
  chemically synthesized
ctagtatacaggacagataa

SEQ ID NO: 13855 - DNA, 20 bp, Artificial Sequence
  chemically synthesized
tagtatacaggacagataat

SEQ ID NO: 13856 - DNA, 20 bp, Artificial Sequence
  chemically synthesized
atacaggacagataataggt

SEQ ID NO: 13857 - DNA, 20 bp, Artificial Sequence
  chemically synthesized
aggtgagcaacattgattaa

SEQ ID NO: 13858 - DNA, 20 bp, Artificial Sequence
  chemically synthesized
tgagcaacattgattaaaag

SEQ ID NO: 13859 - DNA, 20 bp, Artificial Sequence
  chemically synthesized
gcaacattgattaaaagtgg

SEQ ID NO: 13860 - DNA, 20 bp, Artificial Sequence
  chemically synthesized
aaagtggtagtttatgaatt

SEQ ID NO: 13861 - DNA, 20 bp, Artificial Sequence
  chemically synthesized
aagtggtagtttatgaattt

SEQ ID NO: 13862 - DNA, 20 bp, Artificial Sequence
  chemically synthesized
agtggtagtttatgaatttg

SEQ ID NO: 13863 - DNA, 20 bp, Artificial Sequence
  chemically synthesized
gtggtagtttatgaatttgg

SEQ ID NO: 13864 - DNA, 20 bp, Artificial Sequence
  chemically synthesized
tttatgaatttgggggaacc

SEQ ID NO: 13865 - DNA, 20 bp, Artificial Sequence
  chemically synthesized
tgagtatgggggatggttct

SEQ ID NO: 13866 - DNA, 20 bp, Artificial Sequence
  chemically synthesized
ttgagtatgggggatggttc

SEQ ID NO: 13867 - DNA, 20 bp, Artificial Sequence
  chemically synthesized
ggcatgttgagtatggggga

SEQ ID NO: 13868 - DNA, 20 bp, Artificial Sequence
  chemically synthesized
atgaggcatgttgagtatgg

SEQ ID NO: 13869 - DNA, 20 bp, Artificial Sequence
  chemically synthesized
catgaggcatgttgagtatg

SEQ ID NO: 13870 - DNA, 20 bp, Artificial Sequence
  chemically synthesized
ccatgaggcatgttgagtat

SEQ ID NO: 13871 - DNA, 20 bp, Artificial Sequence
  chemically synthesized
gccatgaggcatgttgagta

SEQ ID NO: 13872 - DNA, 20 bp, Artificial Sequence
  chemically synthesized
ttatggccatgaggcatgtt

SEQ ID NO: 13873 - DNA, 20 bp, Artificial Sequence
  chemically synthesized
cccatactcaacatgcctca

SEQ ID NO: 13874 - DNA, 20 bp, Artificial Sequence
  chemically synthesized
ggggcgatcttatggccatg

SEQ ID NO: 13875 - DNA, 20 bp, Artificial Sequence
  chemically synthesized
tggggcgatcttatggccat

SEQ ID NO: 13876 - DNA, 20 bp, Artificial Sequence
  chemically synthesized
tcaacatgcctcatggccat

SEQ ID NO: 13877 - DNA, 20 bp, Artificial Sequence
  chemically synthesized
ggttgtgtggggcgatctta

SEQ ID NO: 13878 - DNA, 20 bp, Artificial Sequence
  chemically synthesized
acagccttagaggttgtgtg

SEQ ID NO: 13879 - DNA, 20 bp, Artificial Sequence
  chemically synthesized
cacagccttagaggttgtgt

SEQ ID NO: 13880 - DNA, 20 bp, Artificial Sequence
  chemically synthesized
gcacagccttagaggttgtg

SEQ ID NO: 13881 - DNA, 20 bp, Artificial Sequence
  chemically synthesized
gatcgccccacacaacctct

SEQ ID NO: 13882 - DNA, 20 bp, Artificial Sequence
  chemically synthesized
atcgccccacacaacctcta

SEQ ID NO: 13883 - DNA, 20 bp, Artificial Sequence
  chemically synthesized
tttattttgcacagccttag

SEQ ID NO: 13884 - DNA, 20 bp, Artificial Sequence
  chemically synthesized
gtttattttgcacagcctta

SEQ ID NO: 13885 - DNA, 20 bp, Artificial Sequence
  chemically synthesized
acgtttattttgcacagcct

SEQ ID NO: 13886 - DNA, 20 bp, Artificial Sequence
  chemically synthesized
gttttcacgtttattttgca

SEQ ID NO: 13887 - DNA, 20 bp, Artificial Sequence
  chemically synthesized
ctgtgtgcatggttgtattg

SEQ ID NO: 13888 - DNA, 20 bp, Artificial Sequence
  chemically synthesized
cttcaatacaaccatgcaca

SEQ ID NO: 13889 - DNA, 20 bp, Artificial Sequence
  chemically synthesized
gggttttcattctgtgtgca

SEQ ID NO: 13890 - DNA, 20 bp, Artificial Sequence
  chemically synthesized
tattgttggatgaataaata

SEQ ID NO: 13891 - DNA, 20 bp, Artificial Sequence
  chemically synthesized
atattgttggatgaataaat

SEQ ID NO: 13892 - DNA, 20 bp, Artificial Sequence
  chemically synthesized
aatattgttggatgaataaa

SEQ ID NO: 13893 - DNA, 20 bp, Artificial Sequence
  chemically synthesized
agaccctcaataaatattgt

SEQ ID NO: 13894 - DNA, 20 bp, Artificial Sequence
  chemically synthesized
ttcatccaacaatatttatt

SEQ ID NO: 13895 - DNA, 20 bp, Artificial Sequence
  chemically synthesized
tcatccaacaatatttattg

SEQ ID NO: 13896 - DNA, 20 bp, Artificial Sequence
  chemically synthesized
catccaacaatatttattga

SEQ ID NO: 13897 - DNA, 20 bp, Artificial Sequence
  chemically synthesized
ctggcacatatggaacatga

SEQ ID NO: 13898 - DNA, 20 bp, Artificial Sequence
  chemically synthesized
ctatcatgttccatatgtgc

SEQ ID NO: 13899 - DNA, 20 bp, Artificial Sequence
  chemically synthesized
aggggagtgcctggcacata

SEQ ID NO: 13900 - DNA, 20 bp, Artificial Sequence
  chemically synthesized
tatcatgttccatatgtgcc

SEQ ID NO: 13901 - DNA, 20 bp, Artificial Sequence
  chemically synthesized
ctggtgcctaggggagtgcc

SEQ ID NO: 13902 - DNA, 20 bp, Artificial Sequence
  chemically synthesized
atatgtgccaggcactcccc

SEQ ID NO: 13903 - DNA, 20 bp, Artificial Sequence
  chemically synthesized
tatgtgccaggcactcccct

SEQ ID NO: 13904 - DNA, 20 bp, Artificial Sequence
  chemically synthesized
cctatccctggtgcctaggg

SEQ ID NO: 13905 - DNA, 20 bp, Artificial Sequence
  chemically synthesized
accctatccctggtgcctag

SEQ ID NO: 13906 - DNA, 20 bp, Artificial Sequence
  chemically synthesized
ccaggcactcccctaggcac

SEQ ID NO: 13907 - DNA, 20 bp, Artificial Sequence
  chemically synthesized
taccctatccctggtgccta

SEQ ID NO: 13908 - DNA, 20 bp, Artificial Sequence
  chemically synthesized
caggcactcccctaggcacc

SEQ ID NO: 13909 - DNA, 20 bp, Artificial Sequence
  chemically synthesized
ttaccctatccctggtgcct

SEQ ID NO: 13910 - DNA, 20 bp, Artificial Sequence
  chemically synthesized
aggcactcccctaggcacca

SEQ ID NO: 13911 - DNA, 20 bp, Artificial Sequence
  chemically synthesized
tttaccctatccctggtgcc

SEQ ID NO: 13912 - DNA, 20 bp, Artificial Sequence
  chemically synthesized
actcccctaggcaccaggga

SEQ ID NO: 13913 - DNA, 20 bp, Artificial Sequence
  chemically synthesized
ctcccctaggcaccagggat

SEQ ID NO: 13914 - DNA, 20 bp, Artificial Sequence
  chemically synthesized
tcccctaggcaccagggata

SEQ ID NO: 13915 - DNA, 20 bp, Artificial Sequence
  chemically synthesized
ttcaggatttaccctatccc

SEQ ID NO: 13916 - DNA, 20 bp, Artificial Sequence
  chemically synthesized
cagggatagggtaaatcctg

SEQ ID NO: 13917 - DNA, 20 bp, Artificial Sequence
  chemically synthesized
ggctctcaactgtaggcttc

SEQ ID NO: 13918 - DNA, 20 bp, Artificial Sequence
  chemically synthesized
agggtaaatcctgaagccta

SEQ ID NO: 13919 - DNA, 20 bp, Artificial Sequence
  chemically synthesized
tggctctcaactgtaggctt

SEQ ID NO: 13920 - DNA, 20 bp, Artificial Sequence
  chemically synthesized
aaatcctgaagcctacagtt

SEQ ID NO: 13921 - DNA, 20 bp, Artificial Sequence
  chemically synthesized
ctaaagtggctctcaactgt

SEQ ID NO: 13922 - DNA, 20 bp, Artificial Sequence
  chemically synthesized
atcctgaagcctacagttga

SEQ ID NO: 13923 - DNA, 20 bp, Artificial Sequence
  chemically synthesized
gctaaagtggctctcaactg

SEQ ID NO: 13924 - DNA, 20 bp, Artificial Sequence
  chemically synthesized
cctacagttgagagccactt

SEQ ID NO: 13925 - DNA, 20 bp, Artificial Sequence
  chemically synthesized
cagttgagagccactttagc

SEQ ID NO: 13926 - DNA, 20 bp, Artificial Sequence
  chemically synthesized
cagatgttccccagctaaag

SEQ ID NO: 13927 - DNA, 20 bp, Artificial Sequence
  chemically synthesized
agttgagagccactttagct

SEQ ID NO: 13928 - DNA, 20 bp, Artificial Sequence
  chemically synthesized
gttgagagccactttagctg

SEQ ID NO: 13929 - DNA, 20 bp, Artificial Sequence
  chemically synthesized
ccccagatgttccccagcta

SEQ ID NO: 13930 - DNA, 20 bp, Artificial Sequence
  chemically synthesized
tcacttccccagatgttccc

SEQ ID NO: 13931 - DNA, 20 bp, Artificial Sequence
  chemically synthesized
cactttagctggggaacatc

SEQ ID NO: 13932 - DNA, 20 bp, Artificial Sequence
  chemically synthesized
actttagctggggaacatct

SEQ ID NO: 13933 - DNA, 20 bp, Artificial Sequence
  chemically synthesized
ctttagctggggaacatctg

SEQ ID NO: 13934 - DNA, 20 bp, Artificial Sequence
  chemically synthesized
tagctggggaacatctgggg

SEQ ID NO: 13935 - DNA, 20 bp, Artificial Sequence
  chemically synthesized
gctgtgatttgtcacttccc

SEQ ID NO: 13936 - DNA, 20 bp, Artificial Sequence
  chemically synthesized
tctggggaagtgacaaatca

SEQ ID NO: 13937 - DNA, 20 bp, Artificial Sequence
  chemically synthesized
acagcattatacatgatctg

SEQ ID NO: 13938 - DNA, 20 bp, Artificial Sequence
  chemically synthesized
ttcagttttgtacaatactg

SEQ ID NO: 13939 - DNA, 20 bp, Artificial Sequence
  chemically synthesized
agttcacctgggataaattt

SEQ ID NO: 13940 - DNA, 20 bp, Artificial Sequence
  chemically synthesized
tacaaaactgaaatttatcc

SEQ ID NO: 13941 - DNA, 20 bp, Artificial Sequence
  chemically synthesized
acaaaactgaaatttatccc

SEQ ID NO: 13942 - DNA, 20 bp, Artificial Sequence
  chemically synthesized
acgtgagagttagttcacct

SEQ ID NO: 13943 - DNA, 20 bp, Artificial Sequence
  chemically synthesized
gacgtgagagttagttcacc

SEQ ID NO: 13944 - DNA, 20 bp, Artificial Sequence
  chemically synthesized
cgccagcctgacgtgagagt

SEQ ID NO: 13945 - DNA, 20 bp, Artificial Sequence
  chemically synthesized
aggtgaactaactctcacgt

SEQ ID NO: 13946 - DNA, 20 bp, Artificial Sequence
  chemically synthesized
ggtgaactaactctcacgtc

SEQ ID NO: 13947 - DNA, 20 bp, Artificial Sequence
  chemically synthesized
ttgacgccagcctgacgtga

SEQ ID NO: 13948 - DNA, 20 bp, Artificial Sequence
  chemically synthesized
gtttgacgccagcctgacgt

SEQ ID NO: 13949 - DNA, 20 bp, Artificial Sequence
  chemically synthesized
aactaactctcacgtcaggc

SEQ ID NO: 13950 - DNA, 20 bp, Artificial Sequence
  chemically synthesized
cactccggtaagtttgacgc

SEQ ID NO: 13951 - DNA, 20 bp, Artificial Sequence
  chemically synthesized
caggctggcgtcaaacttac

SEQ ID NO: 13952 - DNA, 20 bp, Artificial Sequence
  chemically synthesized
ggctggcgtcaaacttaccg

SEQ ID NO: 13953 - DNA, 20 bp, Artificial Sequence
  chemically synthesized
gtggaatattgcactccggt

SEQ ID NO: 13954 - DNA, 20 bp, Artificial Sequence
  chemically synthesized
catggtggaatattgcactc

SEQ ID NO: 13955 - DNA, 20 bp, Artificial Sequence
  chemically synthesized
cggagtgcaatattccacca

SEQ ID NO: 13956 - DNA, 20 bp, Artificial Sequence
  chemically synthesized
ggagtgcaatattccaccat

SEQ ID NO: 13957 - DNA, 20 bp, Artificial Sequence
  chemically synthesized
taaaatgcactatcccatgg

SEQ ID NO: 13958 - DNA, 20 bp, Artificial Sequence
  chemically synthesized
tgcaatattccaccatggga

SEQ ID NO: 13959 - DNA, 20 bp, Artificial Sequence
  chemically synthesized
ccataaaatgcactatccca

SEQ ID NO: 13960 - DNA, 20 bp, Artificial Sequence
  chemically synthesized
ccatgggatagtgcatttta

SEQ ID NO: 13961 - DNA, 20 bp, Artificial Sequence
  chemically synthesized
ttttctggtcgagttgcaaa

SEQ ID NO: 13962 - DNA, 20 bp, Artificial Sequence
  chemically synthesized
tttttctggtcgagttgcaa

SEQ ID NO: 13963 - DNA, 20 bp, Artificial Sequence
  chemically synthesized
atggccttttgcaactcgac

SEQ ID NO: 13964 - DNA, 20 bp, Artificial Sequence
  chemically synthesized
aagctgctttttttctggtc

SEQ ID NO: 13965 - DNA, 20 bp, Artificial Sequence
  chemically synthesized
ttgcaactcgaccagaaaaa

SEQ ID NO: 13966 - DNA, 20 bp, Artificial Sequence
  chemically synthesized
tgccaaagctgctttttttc

SEQ ID NO: 13967 - DNA, 20 bp, Artificial Sequence
  chemically synthesized
caactcgaccagaaaaaaag

SEQ ID NO: 13968 - DNA, 20 bp, Artificial Sequence
  chemically synthesized
gaccagaaaaaaagcagctt

SEQ ID NO: 13969 - DNA, 20 bp, Artificial Sequence
  chemically synthesized
cagaaaaaaagcagctttgg

SEQ ID NO: 13970 - DNA, 20 bp, Artificial Sequence
  chemically synthesized
tttaattatgacatctgcca

SEQ ID NO: 13971 - DNA, 20 bp, Artificial Sequence
  chemically synthesized
tttggcagatgtcataatta

SEQ ID NO: 13972 - DNA, 20 bp, Artificial Sequence
  chemically synthesized
atgtcataattaaagtgctt

SEQ ID NO: 13973 - DNA, 20 bp, Artificial Sequence
  chemically synthesized
ttatcaggtacaggagtcta

SEQ ID NO: 13974 - DNA, 20 bp, Artificial Sequence
  chemically synthesized
ttgctctttatcaggtacag

SEQ ID NO: 13975 - DNA, 20 bp, Artificial Sequence
  chemically synthesized
ttttgctctttatcaggtac

SEQ ID NO: 13976 - DNA, 20 bp, Artificial Sequence
  chemically synthesized
tttttgctctttatcaggta

SEQ ID NO: 13977 - DNA, 20 bp, Artificial Sequence
  chemically synthesized
ttagactcctgtacctgata

SEQ ID NO: 13978 - DNA, 20 bp, Artificial Sequence
  chemically synthesized
agactcctgtacctgataaa

SEQ ID NO: 13979 - DNA, 20 bp, Artificial Sequence
  chemically synthesized
gtttgtttttgctctttatc

SEQ ID NO: 13980 - DNA, 20 bp, Artificial Sequence
  chemically synthesized
tgtttgtttttgctctttat

SEQ ID NO: 13981 - DNA, 20 bp, Artificial Sequence
  chemically synthesized
ttctttgggaatttgattcg

SEQ ID NO: 13982 - DNA, 20 bp, Artificial Sequence
  chemically synthesized
ttcttcgaatcaaattccca

SEQ ID NO: 13983 - DNA, 20 bp, Artificial Sequence
  chemically synthesized
tttattaaagagtgttcttt

SEQ ID NO: 13984 - DNA, 20 bp, Artificial Sequence
  chemically synthesized
gtttattaaagagtgttctt

SEQ ID NO: 13985 - DNA, 20 bp, Artificial Sequence
  chemically synthesized
gtggtagaaggtttattaaa

SEQ ID NO: 13986 - DNA, 20 bp, Artificial Sequence
  chemically synthesized
acgtggtagaaggtttatta

SEQ ID NO: 13987 - DNA, 20 bp, Artificial Sequence
  chemically synthesized
tcaaattagaacgtggtaga

SEQ ID NO: 13988 - DNA, 20 bp, Artificial Sequence
  chemically synthesized
ctcaaattagaacgtggtag

SEQ ID NO: 13989 - DNA, 20 bp, Artificial Sequence
  chemically synthesized
tttctcaaattagaacgtgg

SEQ ID NO: 13990 - DNA, 20 bp, Artificial Sequence
  chemically synthesized
ctgtttctcaaattagaacg

SEQ ID NO: 13991 - DNA, 20 bp, Artificial Sequence
  chemically synthesized
cttctaccacgttctaattt

SEQ ID NO: 13992 - DNA, 20 bp, Artificial Sequence
  chemically synthesized
ttgctttctgtttctcaaat

SEQ ID NO: 13993 - DNA, 20 bp, Artificial Sequence
  chemically synthesized
ccacgttctaatttgagaaa

SEQ ID NO: 13994 - DNA, 20 bp, Artificial Sequence
  chemically synthesized
gttctaatttgagaaacaga

SEQ ID NO: 13995 - DNA, 20 bp, Artificial Sequence
  chemically synthesized
aaacagaaagcaatgttcat

SEQ ID NO: 13996 - DNA, 20 bp, Artificial Sequence
  chemically synthesized
gcaatgttcattagtcccac

SEQ ID NO: 13997 - DNA, 20 bp, Artificial Sequence
  chemically synthesized
caatgttcattagtcccaca

SEQ ID NO: 13998 - DNA, 20 bp, Artificial Sequence
  chemically synthesized
gttcattagtcccacaaggt

SEQ ID NO: 13999 - DNA, 20 bp, Artificial Sequence
  chemically synthesized
aagttaatcacttaccttgt

SEQ ID NO: 14000 - DNA, 20 bp, Artificial Sequence
  chemically synthesized
aaagttaatcacttaccttg

SEQ ID NO: 14001 - DNA, 20 bp, Artificial Sequence
  chemically synthesized
cggaaaaatctggaggcaga

SEQ ID NO: 14002 - DNA, 20 bp, Artificial Sequence
  chemically synthesized
agtgattaactttctgcctc

SEQ ID NO: 14003 - DNA, 20 bp, Artificial Sequence
  chemically synthesized
gcaccggaaaaatctggagg

SEQ ID NO: 14004 - DNA, 20 bp, Artificial Sequence
  chemically synthesized
gaggcaccggaaaaatctgg

SEQ ID NO: 14005 - DNA, 20 bp, Artificial Sequence
  chemically synthesized
agaggcaccggaaaaatctg

SEQ ID NO: 14006 - DNA, 20 bp, Artificial Sequence
  chemically synthesized
ggagaggcaccggaaaaatc

SEQ ID NO: 14007 - DNA, 20 bp, Artificial Sequence
  chemically synthesized
tttctgcctccagatttttc

SEQ ID NO: 14008 - DNA, 20 bp, Artificial Sequence
  chemically synthesized
tggtactgtaggagaggcac

SEQ ID NO: 14009 - DNA, 20 bp, Artificial Sequence
  chemically synthesized
tttttccggtgcctctccta

SEQ ID NO: 14010 - DNA, 20 bp, Artificial Sequence
  chemically synthesized
atgttttggtactgtaggag

SEQ ID NO: 14011 - DNA, 20 bp, Artificial Sequence
  chemically synthesized
aatgttttggtactgtagga

SEQ ID NO: 14012 - DNA, 20 bp, Artificial Sequence
  chemically synthesized
aaaatgttttggtactgtag

SEQ ID NO: 14013 - DNA, 20 bp, Artificial Sequence
  chemically synthesized
ccaaaatgttttggtactgt

SEQ ID NO: 14014 - DNA, 20 bp, Artificial Sequence
  chemically synthesized
gccaaaatgttttggtactg

SEQ ID NO: 14015 - DNA, 20 bp, Artificial Sequence
  chemically synthesized
atctttctgccaaaatgttt

SEQ ID NO: 14016 - DNA, 20 bp, Artificial Sequence
  chemically synthesized
cctacagtaccaaaacattt

SEQ ID NO: 14017 - DNA, 20 bp, Artificial Sequence
  chemically synthesized
acagtaccaaaacattttgg

SEQ ID NO: 14018 - DNA, 20 bp, Artificial Sequence
  chemically synthesized
taccaaaacattttggcaga

SEQ ID NO: 14019 - DNA, 20 bp, Artificial Sequence
  chemically synthesized
ccctccttccatatgtttat

SEQ ID NO: 14020 - DNA, 20 bp, Artificial Sequence
  chemically synthesized
tccctccttccatatgttta

SEQ ID NO: 14021 - DNA, 20 bp, Artificial Sequence
  chemically synthesized
aagattatcctataaacata

SEQ ID NO: 14022 - DNA, 20 bp, Artificial Sequence
  chemically synthesized
attatcctataaacatatgg

SEQ ID NO: 14023 - DNA, 20 bp, Artificial Sequence
  chemically synthesized
ttatcctataaacatatgga

SEQ ID NO: 14024 - DNA, 20 bp, Artificial Sequence
  chemically synthesized
atcctataaacatatggaag

SEQ ID NO: 14025 - DNA, 20 bp, Artificial Sequence
  chemically synthesized
tcctataaacatatggaagg

SEQ ID NO: 14026 - DNA, 20 bp, Artificial Sequence
  chemically synthesized
cctataaacatatggaagga

SEQ ID NO: 14027 - DNA, 20 bp, Artificial Sequence
  chemically synthesized
ataaacatatggaaggaggg

SEQ ID NO: 14028 - DNA, 20 bp, Artificial Sequence
  chemically synthesized
ggaaggagggaagaaaaact

SEQ ID NO: 14029 - DNA, 20 bp, Artificial Sequence
  chemically synthesized
gtggagtttaaataaaagct

SEQ ID NO: 14030 - DNA, 20 bp, Artificial Sequence
  chemically synthesized
tcctagtggagtttaaataa

SEQ ID NO: 14031 - DNA, 20 bp, Artificial Sequence
  chemically synthesized
agcttttatttaaactccac

SEQ ID NO: 14032 - DNA, 20 bp, Artificial Sequence
  chemically synthesized
gcttttatttaaactccact

SEQ ID NO: 14033 - DNA, 20 bp, Artificial Sequence
  chemically synthesized
atctcaaagagttcctagtg

SEQ ID NO: 14034 - DNA, 20 bp, Artificial Sequence
  chemically synthesized
taatctcaaagagttcctag

SEQ ID NO: 14035 - DNA, 20 bp, Artificial Sequence
  chemically synthesized
acttaatctcaaagagttcc

SEQ ID NO: 14036 - DNA, 20 bp, Artificial Sequence
  chemically synthesized
aactccactaggaactcttt

SEQ ID NO: 14037 - DNA, 20 bp, Artificial Sequence
  chemically synthesized
ccttcctacttaatctcaaa

SEQ ID NO: 14038 - DNA, 20 bp, Artificial Sequence
  chemically synthesized
actaggaactctttgagatt

SEQ ID NO: 14039 - DNA, 20 bp, Artificial Sequence
  chemically synthesized
taccttcctacttaatctca

SEQ ID NO: 14040 - DNA, 20 bp, Artificial Sequence
  chemically synthesized
aggaactctttgagattaag

SEQ ID NO: 14041 - DNA, 20 bp, Artificial Sequence
  chemically synthesized
ggaactctttgagattaagt

SEQ ID NO: 14042 - DNA, 20 bp, Artificial Sequence
  chemically synthesized
actctttgagattaagtagg

SEQ ID NO: 14043 - DNA, 20 bp, Artificial Sequence
  chemically synthesized
ctctttgagattaagtagga

SEQ ID NO: 14044 - DNA, 20 bp, Artificial Sequence
  chemically synthesized
gagattaagtaggaaggtac

SEQ ID NO: 14045 - DNA, 20 bp, Artificial Sequence
  chemically synthesized
tcaaaagactggaaattttc

SEQ ID NO: 14046 - DNA, 20 bp, Artificial Sequence
  chemically synthesized
ggaaggtactggaaaatttc

SEQ ID NO: 14047 - DNA, 20 bp, Artificial Sequence
  chemically synthesized
gtatttggttttcaaaagac

SEQ ID NO: 14048 - DNA, 20 bp, Artificial Sequence
  chemically synthesized
tttgagtatttggttttcaa

SEQ ID NO: 14049 - DNA, 20 bp, Artificial Sequence
  chemically synthesized
ttcttttaaatttgagtatt

SEQ ID NO: 14050 - DNA, 20 bp, Artificial Sequence
  chemically synthesized
ctggaagttcttttaaattt

SEQ ID NO: 14051 - DNA, 20 bp, Artificial Sequence
  chemically synthesized
aaccaaatactcaaatttaa

SEQ ID NO: 14052 - DNA, 20 bp, Artificial Sequence
  chemically synthesized
ctcaaatttaaaagaacttc

SEQ ID NO: 14053 - DNA, 20 bp, Artificial Sequence
  chemically synthesized
tcaaatttaaaagaacttcc

SEQ ID NO: 14054 - DNA, 20 bp, Artificial Sequence
  chemically synthesized
aaatttaaaagaacttccag

SEQ ID NO: 14055 - DNA, 20 bp, Artificial Sequence
  chemically synthesized
cgtaagtctgtcgctcctgg

SEQ ID NO: 14056 - DNA, 20 bp, Artificial Sequence
  chemically synthesized
aaaagaacttccaggagcga

SEQ ID NO: 14057 - DNA, 20 bp, Artificial Sequence
  chemically synthesized
cagcgtaagtctgtcgctcc

SEQ ID NO: 14058 - DNA, 20 bp, Artificial Sequence
  chemically synthesized
gtaaggggcatgcacagcgt

SEQ ID NO: 14059 - DNA, 20 bp, Artificial Sequence
  chemically synthesized
tgatgggtaaggggcatgca

SEQ ID NO: 14060 - DNA, 20 bp, Artificial Sequence
  chemically synthesized
tttgtcccatgatgggtaag

SEQ ID NO: 14061 - DNA, 20 bp, Artificial Sequence
  chemically synthesized
ttttgtcccatgatgggtaa

SEQ ID NO: 14062 - DNA, 20 bp, Artificial Sequence
  chemically synthesized
cttttgtcccatgatgggta

SEQ ID NO: 14063 - DNA, 20 bp, Artificial Sequence
  chemically synthesized
acttttgtcccatgatgggt

SEQ ID NO: 14064 - DNA, 20 bp, Artificial Sequence
  chemically synthesized
tgcatgccccttacccatca

SEQ ID NO: 14065 - DNA, 20 bp, Artificial Sequence
  chemically synthesized
gcatgccccttacccatcat

SEQ ID NO: 14066 - DNA, 20 bp, Artificial Sequence
  chemically synthesized
gaaaacttttgtcccatgat

SEQ ID NO: 14067 - DNA, 20 bp, Artificial Sequence
  chemically synthesized
agaaaacttttgtcccatga

SEQ ID NO: 14068 - DNA, 20 bp, Artificial Sequence
  chemically synthesized
ccttacccatcatgggacaa

SEQ ID NO: 14069 - DNA, 20 bp, Artificial Sequence
  chemically synthesized
catgggacaaaagttttctg

SEQ ID NO: 14070 - DNA, 20 bp, Artificial Sequence
  chemically synthesized
tgttttgaaaataattgctt

SEQ ID NO: 14071 - DNA, 20 bp, Artificial Sequence
  chemically synthesized
attattttcaaaacattgtc

SEQ ID NO: 14072 - DNA, 20 bp, Artificial Sequence
  chemically synthesized
ttcaaaacattgtcaagata

SEQ ID NO: 14073 - DNA, 20 bp, Artificial Sequence
  chemically synthesized
tcaagataaagcaatttcac

SEQ ID NO: 14074 - DNA, 20 bp, Artificial Sequence
  chemically synthesized
aaagcaatttcacaagacaa

SEQ ID NO: 14075 - DNA, 20 bp, Artificial Sequence
  chemically synthesized
aagacaaaagaaatgtgaac

SEQ ID NO: 14076 - DNA, 20 bp, Artificial Sequence
  chemically synthesized
gcgagacttgttttaattga

SEQ ID NO: 14077 - DNA, 20 bp, Artificial Sequence
  chemically synthesized
caagaactttcaattaaaac

SEQ ID NO: 14078 - DNA, 20 bp, Artificial Sequence
  chemically synthesized
ttagaaaacattattaaagc

SEQ ID NO: 14079 - DNA, 20 bp, Artificial Sequence
  chemically synthesized
tcaattagaaaacattatta

SEQ ID NO: 14080 - DNA, 20 bp, Artificial Sequence
  chemically synthesized
gatgaatcgtatcagtcaat

SEQ ID NO: 14081 - DNA, 20 bp, Artificial Sequence
  chemically synthesized
tgtttgaagatgaatcgtat

SEQ ID NO: 14082 - DNA, 20 bp, Artificial Sequence
  chemically synthesized
tgatacgattcatcttcaaa

SEQ ID NO: 14083 - DNA, 20 bp, Artificial Sequence
  chemically synthesized
ttcattcgagtaactgtttg

SEQ ID NO: 14084 - DNA, 20 bp, Artificial Sequence
  chemically synthesized
agagataaaagagttcattc

SEQ ID NO: 14085 - DNA, 20 bp, Artificial Sequence
  chemically synthesized
ctgaagagatagagataaaa

SEQ ID NO: 14086 - DNA, 20 bp, Artificial Sequence
  chemically synthesized
ttctgaagagatagagataa

SEQ ID NO: 14087 - DNA, 20 bp, Artificial Sequence
  chemically synthesized
gagagatttctgaagagata

SEQ ID NO: 14088 - DNA, 20 bp, Artificial Sequence
  chemically synthesized
ctcttttatctctatctctt

SEQ ID NO: 14089 - DNA, 20 bp, Artificial Sequence
  chemically synthesized
gtgagagatttctgaagaga

SEQ ID NO: 14090 - DNA, 20 bp, Artificial Sequence
  chemically synthesized
tggggtgagagatttctgaa

SEQ ID NO: 14091 - DNA, 20 bp, Artificial Sequence
  chemically synthesized
aatggggtgagagatttctg

SEQ ID NO: 14092 - DNA, 20 bp, Artificial Sequence
  chemically synthesized
atttgtaggtaatggggtga

SEQ ID NO: 14093 - DNA, 20 bp, Artificial Sequence
  chemically synthesized
tcatttgtaggtaatggggt

SEQ ID NO: 14094 - DNA, 20 bp, Artificial Sequence
  chemically synthesized
gttatcatttgtaggtaatg

SEQ ID NO: 14095 - DNA, 20 bp, Artificial Sequence
  chemically synthesized
agttatcatttgtaggtaat

SEQ ID NO: 14096 - DNA, 20 bp, Artificial Sequence
  chemically synthesized
cagttatcatttgtaggtaa

SEQ ID NO: 14097 - DNA, 20 bp, Artificial Sequence
  chemically synthesized
gggcttcagttatcatttgt

SEQ ID NO: 14098 - DNA, 20 bp, Artificial Sequence
  chemically synthesized
ggggcttcagttatcatttg

SEQ ID NO: 14099 - DNA, 20 bp, Artificial Sequence
  chemically synthesized
ttacctacaaatgataactg

SEQ ID NO: 14100 - DNA, 20 bp, Artificial Sequence
  chemically synthesized
caaatgataactgaagcccc

SEQ ID NO: 14101 - DNA, 20 bp, Artificial Sequence
  chemically synthesized
ttcatgttctcttggggctt

SEQ ID NO: 14102 - DNA, 20 bp, Artificial Sequence
  chemically synthesized
aatgataactgaagccccaa

SEQ ID NO: 14103 - DNA, 20 bp, Artificial Sequence
  chemically synthesized
ccaaatttcatgttctcttg

SEQ ID NO: 14104 - DNA, 20 bp, Artificial Sequence
  chemically synthesized
tccaaatttcatgttctctt

SEQ ID NO: 14105 - DNA, 20 bp, Artificial Sequence
  chemically synthesized
atccaaatttcatgttctct

SEQ ID NO: 14106 - DNA, 20 bp, Artificial Sequence
  chemically synthesized
ccccaagagaacatgaaatt

SEQ ID NO: 14107 - DNA, 20 bp, Artificial Sequence
  chemically synthesized
agagaacatgaaatttggat

SEQ ID NO: 14108 - DNA, 20 bp, Artificial Sequence
  chemically synthesized
aacatgaaatttggattaga

SEQ ID NO: 14109 - DNA, 20 bp, Artificial Sequence
  chemically synthesized
atgaaatttggattagatgg

SEQ ID NO: 14110 - DNA, 20 bp, Artificial Sequence
  chemically synthesized
aatttataatctgtaaatac

SEQ ID NO: 14111 - DNA, 20 bp, Artificial Sequence
  chemically synthesized
aatgtaccaactagtattta

SEQ ID NO: 14112 - DNA, 20 bp, Artificial Sequence
  chemically synthesized
tataatctgtaaatactagt

SEQ ID NO: 14113 - DNA, 20 bp, Artificial Sequence
  chemically synthesized
aatggaggaaatgtaccaac

SEQ ID NO: 14114 - DNA, 20 bp, Artificial Sequence
  chemically synthesized
tggtacatttcctccattat

SEQ ID NO: 14115 - DNA, 20 bp, Artificial Sequence
  chemically synthesized
atatcgcattctgataatgg

SEQ ID NO: 14116 - DNA, 20 bp, Artificial Sequence
  chemically synthesized
aatatcgcattctgataatg

SEQ ID NO: 14117 - DNA, 20 bp, Artificial Sequence
  chemically synthesized
agaatatcgcattctgataa

SEQ ID NO: 14118 - DNA, 20 bp, Artificial Sequence
  chemically synthesized
aggcaggagagtatgaaaca

SEQ ID NO: 14119 - DNA, 20 bp, Artificial Sequence
  chemically synthesized
tgagaaagcaaaaggcagga

SEQ ID NO: 14120 - DNA, 20 bp, Artificial Sequence
  chemically synthesized
tctgagaaagcaaaaggcag

SEQ ID NO: 14121 - DNA, 20 bp, Artificial Sequence
  chemically synthesized
tatctgagaaagcaaaaggc

SEQ ID NO: 14122 - DNA, 20 bp, Artificial Sequence
  chemically synthesized
ttatctgagaaagcaaaagg

SEQ ID NO: 14123 - DNA, 20 bp, Artificial Sequence
  chemically synthesized
ttcttatctgagaaagcaaa

SEQ ID NO: 14124 - DNA, 20 bp, Artificial Sequence
  chemically synthesized
gttcttatctgagaaagcaa

SEQ ID NO: 14125 - DNA, 20 bp, Artificial Sequence
  chemically synthesized
tctcctgccttttgctttct

SEQ ID NO: 14126 - DNA, 20 bp, Artificial Sequence
  chemically synthesized
gctaaggttcttatctgaga

SEQ ID NO: 14127 - DNA, 20 bp, Artificial Sequence
  chemically synthesized
tgccttttgctttctcagat

SEQ ID NO: 14128 - DNA, 20 bp, Artificial Sequence
  chemically synthesized
attggctaaggttcttatct

SEQ ID NO: 14129 - DNA, 20 bp, Artificial Sequence
  chemically synthesized
gctttctcagataagaacct

SEQ ID NO: 14130 - DNA, 20 bp, Artificial Sequence
  chemically synthesized
atgtttatttgaattggcta

SEQ ID NO: 14131 - DNA, 20 bp, Artificial Sequence
  chemically synthesized
tatgtttatttgaattggct

SEQ ID NO: 14132 - DNA, 20 bp, Artificial Sequence
  chemically synthesized
agaaatatgtttatttgaat

SEQ ID NO: 14133 - DNA, 20 bp, Artificial Sequence
  chemically synthesized
cacttccccatatgtgacat

SEQ ID NO: 14134 - DNA, 20 bp, Artificial Sequence
  chemically synthesized
catatttcttatgtcacata

SEQ ID NO: 14135 - DNA, 20 bp, Artificial Sequence
  chemically synthesized
atatttcttatgtcacatat

SEQ ID NO: 14136 - DNA, 20 bp, Artificial Sequence
  chemically synthesized
tatttcttatgtcacatatg

SEQ ID NO: 14137 - DNA, 20 bp, Artificial Sequence
  chemically synthesized
ttcttatgtcacatatgggg

SEQ ID NO: 14138 - DNA, 20 bp, Artificial Sequence
  chemically synthesized
ttatgtcacatatggggaag

SEQ ID NO: 14139 - DNA, 20 bp, Artificial Sequence
  chemically synthesized
tatgtcacatatggggaagt

SEQ ID NO: 14140 - DNA, 20 bp, Artificial Sequence
  chemically synthesized
gtcacatatggggaagtggg

SEQ ID NO: 14141 - DNA, 20 bp, Artificial Sequence
  chemically synthesized
tcacatatggggaagtggga

SEQ ID NO: 14142 - DNA, 20 bp, Artificial Sequence
  chemically synthesized
atatggggaagtgggaagga

SEQ ID NO: 14143 - DNA, 20 bp, Artificial Sequence
  chemically synthesized
ggaaggaaagctatcttttt

SEQ ID NO: 14144 - DNA, 20 bp, Artificial Sequence
  chemically synthesized
tggctggaatctaaaaaaga

SEQ ID NO: 14145 - DNA, 20 bp, Artificial Sequence
  chemically synthesized
aagatggctggaatctaaaa

SEQ ID NO: 14146 - DNA, 20 bp, Artificial Sequence
  chemically synthesized
aagctatcttttttagattc

SEQ ID NO: 14147 - DNA, 20 bp, Artificial Sequence
  chemically synthesized
tccccctcttgaaagatggc

SEQ ID NO: 14148 - DNA, 20 bp, Artificial Sequence
  chemically synthesized
ttagattccagccatctttc

SEQ ID NO: 14149 - DNA, 20 bp, Artificial Sequence
  chemically synthesized
cctgtccccctcttgaaaga

SEQ ID NO: 14150 - DNA, 20 bp, Artificial Sequence
  chemically synthesized
agattccagccatctttcaa

SEQ ID NO: 14151 - DNA, 20 bp, Artificial Sequence
  chemically synthesized
gattccagccatctttcaag

SEQ ID NO: 14152 - DNA, 20 bp, Artificial Sequence
  chemically synthesized
attccagccatctttcaaga

SEQ ID NO: 14153 - DNA, 20 bp, Artificial Sequence
  chemically synthesized
ttccagccatctttcaagag

SEQ ID NO: 14154 - DNA, 20 bp, Artificial Sequence
  chemically synthesized
tcctcctgtccccctcttga

SEQ ID NO: 14155 - DNA, 20 bp, Artificial Sequence
  chemically synthesized
tccagccatctttcaagagg

SEQ ID NO: 14156 - DNA, 20 bp, Artificial Sequence
  chemically synthesized
gccatctttcaagaggggga

SEQ ID NO: 14157 - DNA, 20 bp, Artificial Sequence
  chemically synthesized
ccatctttcaagagggggac

SEQ ID NO: 14158 - DNA, 20 bp, Artificial Sequence
  chemically synthesized
atctttcaagagggggacag

SEQ ID NO: 14159 - DNA, 20 bp, Artificial Sequence
  chemically synthesized
tctttcaagagggggacagg

SEQ ID NO: 14160 - DNA, 20 bp, Artificial Sequence
  chemically synthesized
aagagggggacaggaggaat

SEQ ID NO: 14161 - DNA, 20 bp, Artificial Sequence
  chemically synthesized
agggggacaggaggaatgag

SEQ ID NO: 14162 - DNA, 20 bp, Artificial Sequence
  chemically synthesized
acaggaggaatgagaagtgc

SEQ ID NO: 14163 - DNA, 20 bp, Artificial Sequence
  chemically synthesized
caggaggaatgagaagtgct

SEQ ID NO: 14164 - DNA, 20 bp, Artificial Sequence
  chemically synthesized
tattatattattttaggacc

SEQ ID NO: 14165 - DNA, 20 bp, Artificial Sequence
  chemically synthesized
ttatcatattatattatttt

SEQ ID NO: 14166 - DNA, 20 bp, Artificial Sequence
  chemically synthesized
cttatcatattatattattt

SEQ ID NO: 14167 - DNA, 20 bp, Artificial Sequence
  chemically synthesized
ctaaaataatataatatgat

SEQ ID NO: 14168 - DNA, 20 bp, Artificial Sequence
  chemically synthesized
taaaataatataatatgata

SEQ ID NO: 14169 - DNA, 20 bp, Artificial Sequence
  chemically synthesized
aaaataatataatatgataa

SEQ ID NO: 14170 - DNA, 20 bp, Artificial Sequence
  chemically synthesized
atataatatgataagggcaa

SEQ ID NO: 14171 - DNA, 20 bp, Artificial Sequence
  chemically synthesized
tgataagggcaaaagaattg

SEQ ID NO: 14172 - DNA, 20 bp, Artificial Sequence
  chemically synthesized
gataagggcaaaagaattga

SEQ ID NO: 14173 - DNA, 20 bp, Artificial Sequence
  chemically synthesized
ggcaaaagaattgaaggtga

SEQ ID NO: 14174 - DNA, 20 bp, Artificial Sequence
  chemically synthesized
tgaaggtgaaagtgctcttt

SEQ ID NO: 14175 - DNA, 20 bp, Artificial Sequence
  chemically synthesized
atgccttggaggatctgaaa

SEQ ID NO: 14176 - DNA, 20 bp, Artificial Sequence
  chemically synthesized
gaatgccttggaggatctga

SEQ ID NO: 14177 - DNA, 20 bp, Artificial Sequence
  chemically synthesized
agtgctctttcagatcctcc

SEQ ID NO: 14178 - DNA, 20 bp, Artificial Sequence
  chemically synthesized
gtgctctttcagatcctcca

SEQ ID NO: 14179 - DNA, 20 bp, Artificial Sequence
  chemically synthesized
aaagaagaagaatgccttgg

SEQ ID NO: 14180 - DNA, 20 bp, Artificial Sequence
  chemically synthesized
taaagaagaagaatgccttg

SEQ ID NO: 14181 - DNA, 20 bp, Artificial Sequence
  chemically synthesized
aataaagaagaagaatgcct

SEQ ID NO: 14182 - DNA, 20 bp, Artificial Sequence
  chemically synthesized
atttttataaaataaagaag

SEQ ID NO: 14183 - DNA, 20 bp, Artificial Sequence
  chemically synthesized
gaaatttttataaaataaag

SEQ ID NO: 14184 - DNA, 20 bp, Artificial Sequence
  chemically synthesized
agggaaatttttataaaata

SEQ ID NO: 14185 - DNA, 20 bp, Artificial Sequence
  chemically synthesized
ctagtgggctttgtatacaa

SEQ ID NO: 14186 - DNA, 20 bp, Artificial Sequence
  chemically synthesized
gctagtgggctttgtataca

SEQ ID NO: 14187 - DNA, 20 bp, Artificial Sequence
  chemically synthesized
aaaaatttcccttgtataca

SEQ ID NO: 14188 - DNA, 20 bp, Artificial Sequence
  chemically synthesized
agctagtgggctttgtatac

SEQ ID NO: 14189 - DNA, 20 bp, Artificial Sequence
  chemically synthesized
cccttgtatacaaagcccac

SEQ ID NO: 14190 - DNA, 20 bp, Artificial Sequence
  chemically synthesized
gtatacaaagcccactagct

SEQ ID NO: 14191 - DNA, 20 bp, Artificial Sequence
  chemically synthesized
tctctgcttccttagctagt

SEQ ID NO: 14192 - DNA, 20 bp, Artificial Sequence
  chemically synthesized
tatacaaagcccactagcta

SEQ ID NO: 14193 - DNA, 20 bp, Artificial Sequence
  chemically synthesized
ttctctgcttccttagctag

SEQ ID NO: 14194 - DNA, 20 bp, Artificial Sequence
  chemically synthesized
acaaagcccactagctaagg

SEQ ID NO: 14195 - DNA, 20 bp, Artificial Sequence
  chemically synthesized
cttttctctgcttccttagc

SEQ ID NO: 14196 - DNA, 20 bp, Artificial Sequence
  chemically synthesized
aagcccactagctaaggaag

SEQ ID NO: 14197 - DNA, 20 bp, Artificial Sequence
  chemically synthesized
ctaccttttctctgcttcct

SEQ ID NO: 14198 - DNA, 20 bp, Artificial Sequence
  chemically synthesized
gcccactagctaaggaagca

SEQ ID NO: 14199 - DNA, 20 bp, Artificial Sequence
  chemically synthesized
ctagctaaggaagcagagaa

SEQ ID NO: 14200 - DNA, 20 bp, Artificial Sequence
  chemically synthesized
tagctaaggaagcagagaaa

SEQ ID NO: 14201 - DNA, 20 bp, Artificial Sequence
  chemically synthesized
ctaaggaagcagagaaaagg

SEQ ID NO: 14202 - DNA, 20 bp, Artificial Sequence
  chemically synthesized
gaagcagagaaaaggtagct

SEQ ID NO: 14203 - DNA, 20 bp, Artificial Sequence
  chemically synthesized
agtgactgcattagatttct

SEQ ID NO: 14204 - DNA, 20 bp, Artificial Sequence
  chemically synthesized
ggtagcttagaaatctaatg

SEQ ID NO: 14205 - DNA, 20 bp, Artificial Sequence
  chemically synthesized
ggaagccacagtgactgcat

SEQ ID NO: 14206 - DNA, 20 bp, Artificial Sequence
  chemically synthesized
gaaatctaatgcagtcactg

SEQ ID NO: 14207 - DNA, 20 bp, Artificial Sequence
  chemically synthesized
ggagtggggaagggaagcca

SEQ ID NO: 14208 - DNA, 20 bp, Artificial Sequence
  chemically synthesized
gggtggggagtggggaaggg

SEQ ID NO: 14209 - DNA, 20 bp, Artificial Sequence
  chemically synthesized
tgggggtggggagtggggaa

SEQ ID NO: 14210 - DNA, 20 bp, Artificial Sequence
  chemically synthesized
atgggggtggggagtgggga

SEQ ID NO: 14211 - DNA, 20 bp, Artificial Sequence
  chemically synthesized
catgggggtggggagtgggg

SEQ ID NO: 14212 - DNA, 20 bp, Artificial Sequence
  chemically synthesized
taccatgggggtggggagtg

SEQ ID NO: 14213 - DNA, 20 bp, Artificial Sequence
  chemically synthesized
ataccatgggggtggggagt

SEQ ID NO: 14214 - DNA, 20 bp, Artificial Sequence
  chemically synthesized
gataccatgggggtggggag

SEQ ID NO: 14215 - DNA, 20 bp, Artificial Sequence
  chemically synthesized
aatgataccatgggggtggg

SEQ ID NO: 14216 - DNA, 20 bp, Artificial Sequence
  chemically synthesized
aaaatgataccatgggggtg

SEQ ID NO: 14217 - DNA, 20 bp, Artificial Sequence
  chemically synthesized
ttccccactccccaccccca

SEQ ID NO: 14218 - DNA, 20 bp, Artificial Sequence
  chemically synthesized
aaaaatgataccatgggggt

SEQ ID NO: 14219 - DNA, 20 bp, Artificial Sequence
  chemically synthesized
taaaaatgataccatggggg

SEQ ID NO: 14220 - DNA, 20 bp, Artificial Sequence
  chemically synthesized
aggtaaaaatgataccatgg

SEQ ID NO: 14221 - DNA, 20 bp, Artificial Sequence
  chemically synthesized
caggtaaaaatgataccatg

SEQ ID NO: 14222 - DNA, 20 bp, Artificial Sequence
  chemically synthesized
gcaggtaaaaatgataccat

SEQ ID NO: 14223 - DNA, 20 bp, Artificial Sequence
  chemically synthesized
ggcaggtaaaaatgatacca

SEQ ID NO: 14224 - DNA, 20 bp, Artificial Sequence
  chemically synthesized
tggtatcatttttacctgcc

SEQ ID NO: 14225 - DNA, 20 bp, Artificial Sequence
  chemically synthesized
ttccttcccggtttcttggc

SEQ ID NO: 14226 - DNA, 20 bp, Artificial Sequence
  chemically synthesized
tttccttcccggtttcttgg

SEQ ID NO: 14227 - DNA, 20 bp, Artificial Sequence
  chemically synthesized
atttttacctgccaagaaac

SEQ ID NO: 14228 - DNA, 20 bp, Artificial Sequence
  chemically synthesized
tttttacctgccaagaaacc

SEQ ID NO: 14229 - DNA, 20 bp, Artificial Sequence
  chemically synthesized
ttctttccttcccggtttct

SEQ ID NO: 14230 - DNA, 20 bp, Artificial Sequence
  chemically synthesized
ttacctgccaagaaaccggg

SEQ ID NO: 14231 - DNA, 20 bp, Artificial Sequence
  chemically synthesized
tacctgccaagaaaccggga

SEQ ID NO: 14232 - DNA, 20 bp, Artificial Sequence
  chemically synthesized
tgccaagaaaccgggaagga

SEQ ID NO: 14233 - DNA, 20 bp, Artificial Sequence
  chemically synthesized
aggtcaccttctttccttcc

SEQ ID NO: 14234 - DNA, 20 bp, Artificial Sequence
  chemically synthesized
caagaaaccgggaaggaaag

SEQ ID NO: 14235 - DNA, 20 bp, Artificial Sequence
  chemically synthesized
aagaaaccgggaaggaaaga

SEQ ID NO: 14236 - DNA, 20 bp, Artificial Sequence
  chemically synthesized
ggaaagaaggtgacctttgc

SEQ ID NO: 14237 - DNA, 20 bp, Artificial Sequence
  chemically synthesized
aagaaggtgacctttgcaag

SEQ ID NO: 14238 - DNA, 20 bp, Artificial Sequence
  chemically synthesized
tgagtaggtactgcttgcaa

SEQ ID NO: 14239 - DNA, 20 bp, Artificial Sequence
  chemically synthesized
gtgagtaggtactgcttgca

SEQ ID NO: 14240 - DNA, 20 bp, Artificial Sequence
  chemically synthesized
ctagatagacaacagtgagt

SEQ ID NO: 14241 - DNA, 20 bp, Artificial Sequence
  chemically synthesized
cctagatagacaacagtgag

SEQ ID NO: 14242 - DNA, 20 bp, Artificial Sequence
  chemically synthesized
aagcctagatagacaacagt

SEQ ID NO: 14243 - DNA, 20 bp, Artificial Sequence
  chemically synthesized
tctgaagcctagatagacaa

SEQ ID NO: 14244 - DNA, 20 bp, Artificial Sequence
  chemically synthesized
cctactcactgttgtctatc

SEQ ID NO: 14245 - DNA, 20 bp, Artificial Sequence
  chemically synthesized
ctactcactgttgtctatct

SEQ ID NO: 14246 - DNA, 20 bp, Artificial Sequence
  chemically synthesized
agaggtttctgaagcctaga

SEQ ID NO: 14247 - DNA, 20 bp, Artificial Sequence
  chemically synthesized
actgttgtctatctaggctt

SEQ ID NO: 14248 - DNA, 20 bp, Artificial Sequence
  chemically synthesized
ttttagaggtttctgaagcc

SEQ ID NO: 14249 - DNA, 20 bp, Artificial Sequence
  chemically synthesized
aaaacttttagaggtttctg

SEQ ID NO: 14250 - DNA, 20 bp, Artificial Sequence
  chemically synthesized
taggcttcagaaacctctaa

SEQ ID NO: 14251 - DNA, 20 bp, Artificial Sequence
  chemically synthesized
ggttttacaaaaacttttag

SEQ ID NO: 14252 - DNA, 20 bp, Artificial Sequence
  chemically synthesized
aggttttacaaaaactttta

SEQ ID NO: 14253 - DNA, 20 bp, Artificial Sequence
  chemically synthesized
agaggttttacaaaaacttt

SEQ ID NO: 14254 - DNA, 20 bp, Artificial Sequence
  chemically synthesized
tagtcatgctgtttacaaag

SEQ ID NO: 14255 - DNA, 20 bp, Artificial Sequence
  chemically synthesized
atagtcatgctgtttacaaa

SEQ ID NO: 14256 - DNA, 20 bp, Artificial Sequence
  chemically synthesized
ttgtaaaacctctttgtaaa

SEQ ID NO: 14257 - DNA, 20 bp, Artificial Sequence
  chemically synthesized
ccatagtcatgctgtttaca

SEQ ID NO: 14258 - DNA, 20 bp, Artificial Sequence
  chemically synthesized
ctttgtaaacagcatgacta

SEQ ID NO: 14259 - DNA, 20 bp, Artificial Sequence
  chemically synthesized
ttttggtgtttattgttcca

SEQ ID NO: 14260 - DNA, 20 bp, Artificial Sequence
  chemically synthesized
tatggaacaataaacaccaa

SEQ ID NO: 14261 - DNA, 20 bp, Artificial Sequence
  chemically synthesized
tcatagtgcttttttacttt

SEQ ID NO: 14262 - DNA, 20 bp, Artificial Sequence
  chemically synthesized
aataaacaccaaaagtaaaa

SEQ ID NO: 14263 - DNA, 20 bp, Artificial Sequence
  chemically synthesized
tgttgcgtgctttttattca

SEQ ID NO: 14264 - DNA, 20 bp, Artificial Sequence
  chemically synthesized
aaaaaagcactatgaataaa

SEQ ID NO: 14265 - DNA, 20 bp, Artificial Sequence
  chemically synthesized
tatgaataaaaagcacgcaa

SEQ ID NO: 14266 - DNA, 20 bp, Artificial Sequence
  chemically synthesized
taaaaagcacgcaacagtac

SEQ ID NO: 14267 - DNA, 20 bp, Artificial Sequence
  chemically synthesized
aaaaagcacgcaacagtaca

SEQ ID NO: 14268 - DNA, 20 bp, Artificial Sequence
  chemically synthesized
aagcacgcaacagtacaagg

SEQ ID NO: 14269 - DNA, 20 bp, Artificial Sequence
  chemically synthesized
caacagtacaaggtagttat

SEQ ID NO: 14270 - DNA, 20 bp, Artificial Sequence
  chemically synthesized
aaggtagttattagaaaata

SEQ ID NO: 14271 - DNA, 20 bp, Artificial Sequence
  chemically synthesized
agaaaataaagtaacaaaac

SEQ ID NO: 14272 - DNA, 20 bp, Artificial Sequence
  chemically synthesized
ttttccagttacgtgtgaac

SEQ ID NO: 14273 - DNA, 20 bp, Artificial Sequence
  chemically synthesized
aaaaccagttcacacgtaac

SEQ ID NO: 14274 - DNA, 20 bp, Artificial Sequence
  chemically synthesized
cagttcacacgtaactggaa

SEQ ID NO: 14275 - DNA, 20 bp, Artificial Sequence
  chemically synthesized
gttcacacgtaactggaaaa

SEQ ID NO: 14276 - DNA, 20 bp, Artificial Sequence
  chemically synthesized
gcaaagtaaacactcttttc

SEQ ID NO: 14277 - DNA, 20 bp, Artificial Sequence
  chemically synthesized
agagtgtttactttgctgct

SEQ ID NO: 14278 - DNA, 20 bp, Artificial Sequence
  chemically synthesized
gcagaatccacttagcagca

SEQ ID NO: 14279 - DNA, 20 bp, Artificial Sequence
  chemically synthesized
gtgtttactttgctgctaag

SEQ ID NO: 14280 - DNA, 20 bp, Artificial Sequence
  chemically synthesized
cctgtgcagaatccacttag

SEQ ID NO: 14281 - DNA, 20 bp, Artificial Sequence
  chemically synthesized
atgcctgtgcagaatccact

SEQ ID NO: 14282 - DNA, 20 bp, Artificial Sequence
  chemically synthesized
gctgctaagtggattctgca

SEQ ID NO: 14283 - DNA, 20 bp, Artificial Sequence
  chemically synthesized
ctgctaagtggattctgcac

SEQ ID NO: 14284 - DNA, 20 bp, Artificial Sequence
  chemically synthesized
ctctatggtctatgcctgtg

SEQ ID NO: 14285 - DNA, 20 bp, Artificial Sequence
  chemically synthesized
aagtggattctgcacaggca

SEQ ID NO: 14286 - DNA, 20 bp, Artificial Sequence
  chemically synthesized
ttctgcacaggcatagacca

SEQ ID NO: 14287 - DNA, 20 bp, Artificial Sequence
  chemically synthesized
ctgcacaggcatagaccata

SEQ ID NO: 14288 - DNA, 20 bp, Artificial Sequence
  chemically synthesized
acaggcatagaccatagagc

SEQ ID NO: 14289 - DNA, 20 bp, Artificial Sequence
  chemically synthesized
aaagttgtaaactagctcta

SEQ ID NO: 14290 - DNA, 20 bp, Artificial Sequence
  chemically synthesized
taagccacaaagttgtaaac

SEQ ID NO: 14291 - DNA, 20 bp, Artificial Sequence
  chemically synthesized
agagctagtttacaactttg

SEQ ID NO: 14292 - DNA, 20 bp, Artificial Sequence
  chemically synthesized
atagtgatgaataagccaca

SEQ ID NO: 14293 - DNA, 20 bp, Artificial Sequence
  chemically synthesized
aggtttctatagtgatgaat

SEQ ID NO: 14294 - DNA, 20 bp, Artificial Sequence
  chemically synthesized
ttgtggcttattcatcacta

SEQ ID NO: 14295 - DNA, 20 bp, Artificial Sequence
  chemically synthesized
aatcaacatcaaggtttcta

SEQ ID NO: 14296 - DNA, 20 bp, Artificial Sequence
  chemically synthesized
aaatgtgtgaatcaacatca

SEQ ID NO: 14297 - DNA, 20 bp, Artificial Sequence
  chemically synthesized
taaatgtgtgaatcaacatc

SEQ ID NO: 14298 - DNA, 20 bp, Artificial Sequence
  chemically synthesized
tgatgttgattcacacattt

SEQ ID NO: 14299 - DNA, 20 bp, Artificial Sequence
  chemically synthesized
gatgttgattcacacattta

SEQ ID NO: 14300 - DNA, 20 bp, Artificial Sequence
  chemically synthesized
tcacacatttaaggacatcg

SEQ ID NO: 14301 - DNA, 20 bp, Artificial Sequence
  chemically synthesized
atttaaggacatcgcagttt

SEQ ID NO: 14302 - DNA, 20 bp, Artificial Sequence
  chemically synthesized
ggacatcgcagtttcagaat

SEQ ID NO: 14303 - DNA, 20 bp, Artificial Sequence
  chemically synthesized
gacatcgcagtttcagaatt

SEQ ID NO: 14304 - DNA, 20 bp, Artificial Sequence
  chemically synthesized
gcagtttcagaattaggatt

SEQ ID NO: 14305 - DNA, 20 bp, Artificial Sequence
  chemically synthesized
cagtttcagaattaggattt

SEQ ID NO: 14306 - DNA, 20 bp, Artificial Sequence
  chemically synthesized
taggatttaggattaatgtt

SEQ ID NO: 14307 - DNA, 20 bp, Artificial Sequence
  chemically synthesized
atttaggattaatgttaagt

SEQ ID NO: 14308 - DNA, 20 bp, Artificial Sequence
  chemically synthesized
gctgacctgtttggggagac

SEQ ID NO: 14309 - DNA, 20 bp, Artificial Sequence
  chemically synthesized
tgctgacctgtttggggaga

SEQ ID NO: 14310 - DNA, 20 bp, Artificial Sequence
  chemically synthesized
aaaaatcctgtctccccaaa

SEQ ID NO: 14311 - DNA, 20 bp, Artificial Sequence
  chemically synthesized
aaaatcctgtctccccaaac

SEQ ID NO: 14312 - DNA, 20 bp, Artificial Sequence
  chemically synthesized
gccctgctgacctgtttggg

SEQ ID NO: 14313 - DNA, 20 bp, Artificial Sequence
  chemically synthesized
tagccctgctgacctgtttg

SEQ ID NO: 14314 - DNA, 20 bp, Artificial Sequence
  chemically synthesized
ttagccctgctgacctgttt

SEQ ID NO: 14315 - DNA, 20 bp, Artificial Sequence
  chemically synthesized
tcctgtctccccaaacaggt

SEQ ID NO: 14316 - DNA, 20 bp, Artificial Sequence
  chemically synthesized
tttagccctgctgacctgtt

SEQ ID NO: 14317 - DNA, 20 bp, Artificial Sequence
  chemically synthesized
tgtctccccaaacaggtcag

SEQ ID NO: 14318 - DNA, 20 bp, Artificial Sequence
  chemically synthesized
gtctccccaaacaggtcagc

SEQ ID NO: 14319 - DNA, 20 bp, Artificial Sequence
  chemically synthesized
tctccccaaacaggtcagca

SEQ ID NO: 14320 - DNA, 20 bp, Artificial Sequence
  chemically synthesized
caaacaggtcagcagggcta

SEQ ID NO: 14321 - DNA, 20 bp, Artificial Sequence
  chemically synthesized
aacaaggccaaataaatctt

SEQ ID NO: 14322 - DNA, 20 bp, Artificial Sequence
  chemically synthesized
agcagggctaaagatttatt

SEQ ID NO: 14323 - DNA, 20 bp, Artificial Sequence
  chemically synthesized
ttaaaatatcatggaaaaca

SEQ ID NO: 14324 - DNA, 20 bp, Artificial Sequence
  chemically synthesized
cttaaaatatcatggaaaac

SEQ ID NO: 14325 - DNA, 20 bp, Artificial Sequence
  chemically synthesized
ctgatagtcttaaaatatca

SEQ ID NO: 14326 - DNA, 20 bp, Artificial Sequence
  chemically synthesized
cttgttttccatgatatttt

SEQ ID NO: 14327 - DNA, 20 bp, Artificial Sequence
  chemically synthesized
ccatgatattttaagactat

SEQ ID NO: 14328 - DNA, 20 bp, Artificial Sequence
  chemically synthesized
aacgtagcaggttattctga

SEQ ID NO: 14329 - DNA, 20 bp, Artificial Sequence
  chemically synthesized
aaagagataggaaacgtagc

SEQ ID NO: 14330 - DNA, 20 bp, Artificial Sequence
  chemically synthesized
gaaagagataggaaacgtag

SEQ ID NO: 14331 - DNA, 20 bp, Artificial Sequence
  chemically synthesized
agtgaaagagataggaaacg

SEQ ID NO: 14332 - DNA, 20 bp, Artificial Sequence
  chemically synthesized
catttagaagtgaaagagat

SEQ ID NO: 14333 - DNA, 20 bp, Artificial Sequence
  chemically synthesized
acatttagaagtgaaagaga

SEQ ID NO: 14334 - DNA, 20 bp, Artificial Sequence
  chemically synthesized
ttatacatttagaagtgaaa

SEQ ID NO: 14335 - DNA, 20 bp, Artificial Sequence
  chemically synthesized
ccttatacatttagaagtga

SEQ ID NO: 14336 - DNA, 20 bp, Artificial Sequence
  chemically synthesized
accagtccttatacatttag

SEQ ID NO: 14337 - DNA, 20 bp, Artificial Sequence
  chemically synthesized
tctttcacttctaaatgtat

SEQ ID NO: 14338 - DNA, 20 bp, Artificial Sequence
  chemically synthesized
acaaccagtccttatacatt

SEQ ID NO: 14339 - DNA, 20 bp, Artificial Sequence
  chemically synthesized
ctttcacttctaaatgtata

SEQ ID NO: 14340 - DNA, 20 bp, Artificial Sequence
  chemically synthesized
acttctaaatgtataaggac

SEQ ID NO: 14341 - DNA, 20 bp, Artificial Sequence
  chemically synthesized
caaagcagctaaaaaacaac

SEQ ID NO: 14342 - DNA, 20 bp, Artificial Sequence
  chemically synthesized
tataaggactggttgttttt

SEQ ID NO: 14343 - DNA, 20 bp, Artificial Sequence
  chemically synthesized
taaatggaagattcacaaag

SEQ ID NO: 14344 - DNA, 20 bp, Artificial Sequence
  chemically synthesized
aagtaaatggaagattcaca

SEQ ID NO: 14345 - DNA, 20 bp, Artificial Sequence
  chemically synthesized
aaaagtaggcaagtaaatgg

SEQ ID NO: 14346 - DNA, 20 bp, Artificial Sequence
  chemically synthesized
ataaaaagtaggcaagtaaa

SEQ ID NO: 14347 - DNA, 20 bp, Artificial Sequence
  chemically synthesized
taaaggaataaaaagtaggc

SEQ ID NO: 14348 - DNA, 20 bp, Artificial Sequence
  chemically synthesized
cttctaaaggaataaaaagt

SEQ ID NO: 14349 - DNA, 20 bp, Artificial Sequence
  chemically synthesized
acttctaaaggaataaaaag

SEQ ID NO: 14350 - DNA, 20 bp, Artificial Sequence
  chemically synthesized
tgaacttctaaaggaataaa

SEQ ID NO: 14351 - DNA, 20 bp, Artificial Sequence
  chemically synthesized
ttgcctactttttattcctt

SEQ ID NO: 14352 - DNA, 20 bp, Artificial Sequence
  chemically synthesized
cctactttttattcctttag

SEQ ID NO: 14353 - DNA, 20 bp, Artificial Sequence
  chemically synthesized
gtatcccagtgaacttctaa

SEQ ID NO: 14354 - DNA, 20 bp, Artificial Sequence
  chemically synthesized
agtatcccagtgaacttcta

SEQ ID NO: 14355 - DNA, 20 bp, Artificial Sequence
  chemically synthesized
ttattcctttagaagttcac

SEQ ID NO: 14356 - DNA, 20 bp, Artificial Sequence
  chemically synthesized
tattcctttagaagttcact

SEQ ID NO: 14357 - DNA, 20 bp, Artificial Sequence
  chemically synthesized
acattctttgtatagtatcc

SEQ ID NO: 14358 - DNA, 20 bp, Artificial Sequence
  chemically synthesized
gttcactgggatactataca

SEQ ID NO: 14359 - DNA, 20 bp, Artificial Sequence
  chemically synthesized
atctgattacattctttgta

SEQ ID NO: 14360 - DNA, 20 bp, Artificial Sequence
  chemically synthesized
tactatacaaagaatgtaat

SEQ ID NO: 14361 - DNA, 20 bp, Artificial Sequence
  chemically synthesized
aaagaatgtaatcagattca

SEQ ID NO: 14362 - DNA, 20 bp, Artificial Sequence
  chemically synthesized
tgtaatcagattcacagata

SEQ ID NO: 14363 - DNA, 20 bp, Artificial Sequence
  chemically synthesized
aatcagattcacagataaag

SEQ ID NO: 14364 - DNA, 20 bp, Artificial Sequence
  chemically synthesized
agattcacagataaagaagc

SEQ ID NO: 14365 - DNA, 20 bp, Artificial Sequence
  chemically synthesized
cagataaagaagcaagttct

SEQ ID NO: 14366 - DNA, 20 bp, Artificial Sequence
  chemically synthesized
aagaattgttttcagcatct

SEQ ID NO: 14367 - DNA, 20 bp, Artificial Sequence
  chemically synthesized
taagtaacaagaattgtttt

SEQ ID NO: 14368 - DNA, 20 bp, Artificial Sequence
  chemically synthesized
gaaaacaattcttgttactt

SEQ ID NO: 14369 - DNA, 20 bp, Artificial Sequence
  chemically synthesized
ttttttctcccttaagtaac

SEQ ID NO: 14370 - DNA, 20 bp, Artificial Sequence
  chemically synthesized
aaaacaattcttgttactta

SEQ ID NO: 14371 - DNA, 20 bp, Artificial Sequence
  chemically synthesized
aaacaattcttgttacttaa

SEQ ID NO: 14372 - DNA, 20 bp, Artificial Sequence
  chemically synthesized
acaattcttgttacttaagg

SEQ ID NO: 14373 - DNA, 20 bp, Artificial Sequence
  chemically synthesized
accatttttttttctccctt

SEQ ID NO: 14374 - DNA, 20 bp, Artificial Sequence
  chemically synthesized
acttaagggagaaaaaaaaa

SEQ ID NO: 14375 - DNA, 20 bp, Artificial Sequence
  chemically synthesized
ggagaaaaaaaaatggtgca

SEQ ID NO: 14376 - DNA, 20 bp, Artificial Sequence
  chemically synthesized
aaaaatggtgcaaagtgaat

SEQ ID NO: 14377 - DNA, 20 bp, Artificial Sequence
  chemically synthesized
aaatggtgcaaagtgaatga

SEQ ID NO: 14378 - DNA, 20 bp, Artificial Sequence
  chemically synthesized
tgcaaagtgaatgagagact

SEQ ID NO: 14379 - DNA, 20 bp, Artificial Sequence
  chemically synthesized
gaggaaccataatagtagct

SEQ ID NO: 14380 - DNA, 20 bp, Artificial Sequence
  chemically synthesized
gagagactgagctactatta

SEQ ID NO: 14381 - DNA, 20 bp, Artificial Sequence
  chemically synthesized
tctgggaggaaccataatag

SEQ ID NO: 14382 - DNA, 20 bp, Artificial Sequence
  chemically synthesized
tattctgggaggaaccataa

SEQ ID NO: 14383 - DNA, 20 bp, Artificial Sequence
  chemically synthesized
gctactattatggttcctcc

SEQ ID NO: 14384 - DNA, 20 bp, Artificial Sequence
  chemically synthesized
tattatggttcctcccagaa

SEQ ID NO: 14385 - DNA, 20 bp, Artificial Sequence
  chemically synthesized
agagatgattctattctggg

SEQ ID NO: 14386 - DNA, 20 bp, Artificial Sequence
  chemically synthesized
gagagatgattctattctgg

SEQ ID NO: 14387 - DNA, 20 bp, Artificial Sequence
  chemically synthesized
ctgagagatgattctattct

SEQ ID NO: 14388 - DNA, 20 bp, Artificial Sequence
  chemically synthesized
actgagagatgattctattc

SEQ ID NO: 14389 - DNA, 20 bp, Artificial Sequence
  chemically synthesized
cccagaatagaatcatctct

SEQ ID NO: 14390 - DNA, 20 bp, Artificial Sequence
  chemically synthesized
agaatcagttataaaactga

SEQ ID NO: 14391 - DNA, 20 bp, Artificial Sequence
  chemically synthesized
caagaatcagttataaaact

SEQ ID NO: 14392 - DNA, 20 bp, Artificial Sequence
  chemically synthesized
tcagttttataactgattct

SEQ ID NO: 14393 - DNA, 20 bp, Artificial Sequence
  chemically synthesized
cagttttataactgattctt

SEQ ID NO: 14394 - DNA, 20 bp, Artificial Sequence
  chemically synthesized
tatagaaacttcccaagaat

SEQ ID NO: 14395 - DNA, 20 bp, Artificial Sequence
  chemically synthesized
ttttataactgattcttggg

SEQ ID NO: 14396 - DNA, 20 bp, Artificial Sequence
  chemically synthesized
cctgtttatagaaacttccc

SEQ ID NO: 14397 - DNA, 20 bp, Artificial Sequence
  chemically synthesized
tcttgggaagtttctataaa

SEQ ID NO: 14398 - DNA, 20 bp, Artificial Sequence
  chemically synthesized
cttgggaagtttctataaac

SEQ ID NO: 14399 - DNA, 20 bp, Artificial Sequence
  chemically synthesized
ttcacggtctttcctgttta

SEQ ID NO: 14400 - DNA, 20 bp, Artificial Sequence
  chemically synthesized
ggaagtttctataaacagga

SEQ ID NO: 14401 - DNA, 20 bp, Artificial Sequence
  chemically synthesized
aaacaggaaagaccgtgaaa

SEQ ID NO: 14402 - DNA, 20 bp, Artificial Sequence
  chemically synthesized
aacaggaaagaccgtgaaaa

SEQ ID NO: 14403 - DNA, 20 bp, Artificial Sequence
  chemically synthesized
ttaccatctttcctttttca

SEQ ID NO: 14404 - DNA, 20 bp, Artificial Sequence
  chemically synthesized
ggaaagaccgtgaaaaagga

SEQ ID NO: 14405 - DNA, 20 bp, Artificial Sequence
  chemically synthesized
agaccgtgaaaaaggaaaga

SEQ ID NO: 14406 - DNA, 20 bp, Artificial Sequence
  chemically synthesized
gaaagatggtaaaaatgttt

SEQ ID NO: 14407 - DNA, 20 bp, Artificial Sequence
  chemically synthesized
tggtaaaaatgttttggttc

SEQ ID NO: 14408 - DNA, 20 bp, Artificial Sequence
  chemically synthesized
ggtaaaaatgttttggttcc

SEQ ID NO: 14409 - DNA, 20 bp, Artificial Sequence
  chemically synthesized
aaaaatgttttggttccagg

SEQ ID NO: 14410 - DNA, 20 bp, Artificial Sequence
  chemically synthesized
aaaatgttttggttccagga

SEQ ID NO: 14411 - DNA, 20 bp, Artificial Sequence
  chemically synthesized
aatgttttggttccaggaag

SEQ ID NO: 14412 - DNA, 20 bp, Artificial Sequence
  chemically synthesized
atgttttggttccaggaagg

SEQ ID NO: 14413 - DNA, 20 bp, Artificial Sequence
  chemically synthesized
gaactgtacctcctccttcc

SEQ ID NO: 14414 - DNA, 20 bp, Artificial Sequence
  chemically synthesized
gttttggttccaggaaggag

SEQ ID NO: 14415 - DNA, 20 bp, Artificial Sequence
  chemically synthesized
ttttggttccaggaaggagg

SEQ ID NO: 14416 - DNA, 20 bp, Artificial Sequence
  chemically synthesized
gttccaggaaggaggaggta

SEQ ID NO: 14417 - DNA, 20 bp, Artificial Sequence
  chemically synthesized
gtgtcttcacggaggtatta

SEQ ID NO: 14418 - DNA, 20 bp, Artificial Sequence
  chemically synthesized
tcatctgtaatacctccgtg

SEQ ID NO: 14419 - DNA, 20 bp, Artificial Sequence
  chemically synthesized
caaagtgcgtgtcttcacgg

SEQ ID NO: 14420 - DNA, 20 bp, Artificial Sequence
  chemically synthesized
ccaaagtgcgtgtcttcacg

SEQ ID NO: 14421 - DNA, 20 bp, Artificial Sequence
  chemically synthesized
ggccaaagtgcgtgtcttca

SEQ ID NO: 14422 - DNA, 20 bp, Artificial Sequence
  chemically synthesized
ctccgtgaagacacgcactt

SEQ ID NO: 14423 - DNA, 20 bp, Artificial Sequence
  chemically synthesized
atttttggttgagcaggcca

SEQ ID NO: 14424 - DNA, 20 bp, Artificial Sequence
  chemically synthesized
agccacatttttggttgagc

SEQ ID NO: 14425 - DNA, 20 bp, Artificial Sequence
  chemically synthesized
gagccacatttttggttgag

SEQ ID NO: 14426 - DNA, 20 bp, Artificial Sequence
  chemically synthesized
tcggagccacatttttggtt

SEQ ID NO: 14427 - DNA, 20 bp, Artificial Sequence
  chemically synthesized
ggcctgctcaaccaaaaatg

SEQ ID NO: 14428 - DNA, 20 bp, Artificial Sequence
  chemically synthesized
gctcttcggagccacatttt

SEQ ID NO: 14429 - DNA, 20 bp, Artificial Sequence
  chemically synthesized
caaccaaaaatgtggctccg

SEQ ID NO: 14430 - DNA, 20 bp, Artificial Sequence
  chemically synthesized
accaaaaatgtggctccgaa

SEQ ID NO: 14431 - DNA, 20 bp, Artificial Sequence
  chemically synthesized
cttcactcttcagctcttcg

SEQ ID NO: 14432 - DNA, 20 bp, Artificial Sequence
  chemically synthesized
accttcactcttcagctctt

SEQ ID NO: 14433 - DNA, 20 bp, Artificial Sequence
  chemically synthesized
aatgtggctccgaagagctg

SEQ ID NO: 14434 - DNA, 20 bp, Artificial Sequence
  chemically synthesized
tgtggctccgaagagctgaa

SEQ ID NO: 14435 - DNA, 20 bp, Artificial Sequence
  chemically synthesized
ctccgaagagctgaagagtg

SEQ ID NO: 14436 - DNA, 20 bp, Artificial Sequence
  chemically synthesized
cccttaccaccttcactctt

SEQ ID NO: 14437 - DNA, 20 bp, Artificial Sequence
  chemically synthesized
tccgaagagctgaagagtga

SEQ ID NO: 14438 - DNA, 20 bp, Artificial Sequence
  chemically synthesized
gaagagctgaagagtgaagg

SEQ ID NO: 14439 - DNA, 20 bp, Artificial Sequence
  chemically synthesized
agctgaagagtgaaggtggt

SEQ ID NO: 14440 - DNA, 20 bp, Artificial Sequence
  chemically synthesized
gctgaagagtgaaggtggta

SEQ ID NO: 14441 - DNA, 20 bp, Artificial Sequence
  chemically synthesized
ctgaagagtgaaggtggtaa

SEQ ID NO: 14442 - DNA, 20 bp, Artificial Sequence
  chemically synthesized
gtgaaggtggtaagggacac

SEQ ID NO: 14443 - DNA, 20 bp, Artificial Sequence
  chemically synthesized
gtaagggacaccagcctaat

SEQ ID NO: 14444 - DNA, 20 bp, Artificial Sequence
  chemically synthesized
gtggatctcacttattaggc

SEQ ID NO: 14445 - DNA, 20 bp, Artificial Sequence
  chemically synthesized
gggacaccagcctaataagt

SEQ ID NO: 14446 - DNA, 20 bp, Artificial Sequence
  chemically synthesized
tttggtggatctcacttatt

SEQ ID NO: 14447 - DNA, 20 bp, Artificial Sequence
  chemically synthesized
ttttggtggatctcacttat

SEQ ID NO: 14448 - DNA, 20 bp, Artificial Sequence
  chemically synthesized
tgatcgctaggttattttgg

SEQ ID NO: 14449 - DNA, 20 bp, Artificial Sequence
  chemically synthesized
tcctgatcgctaggttattt

SEQ ID NO: 14450 - DNA, 20 bp, Artificial Sequence
  chemically synthesized
tgagatccaccaaaataacc

SEQ ID NO: 14451 - DNA, 20 bp, Artificial Sequence
  chemically synthesized
caccaaaataacctagcgat

SEQ ID NO: 14452 - DNA, 20 bp, Artificial Sequence
  chemically synthesized
accaaaataacctagcgatc

SEQ ID NO: 14453 - DNA, 20 bp, Artificial Sequence
  chemically synthesized
ctgtcaccctcctgatcgct

SEQ ID NO: 14454 - DNA, 20 bp, Artificial Sequence
  chemically synthesized
cctgtcaccctcctgatcgc

SEQ ID NO: 14455 - DNA, 20 bp, Artificial Sequence
  chemically synthesized
caaaataacctagcgatcag

SEQ ID NO: 14456 - DNA, 20 bp, Artificial Sequence
  chemically synthesized
aaaataacctagcgatcagg

SEQ ID NO: 14457 - DNA, 20 bp, Artificial Sequence
  chemically synthesized
aaataacctagcgatcagga

SEQ ID NO: 14458 - DNA, 20 bp, Artificial Sequence
  chemically synthesized
cctagcgatcaggagggtga

SEQ ID NO: 14459 - DNA, 20 bp, Artificial Sequence
  chemically synthesized
ctagcgatcaggagggtgac

SEQ ID NO: 14460 - DNA, 20 bp, Artificial Sequence
  chemically synthesized
gacaggaatgatcgatgttc

SEQ ID NO: 14461 - DNA, 20 bp, Artificial Sequence
  chemically synthesized
gggagagaaggtgattgggc

SEQ ID NO: 14462 - DNA, 20 bp, Artificial Sequence
  chemically synthesized
aagtgggagagaaggtgatt

SEQ ID NO: 14463 - DNA, 20 bp, Artificial Sequence
  chemically synthesized
aaagtgggagagaaggtgat

SEQ ID NO: 14464 - DNA, 20 bp, Artificial Sequence
  chemically synthesized
cgtctccaaagtgggagaga

SEQ ID NO: 14465 - DNA, 20 bp, Artificial Sequence
  chemically synthesized
ccgtctccaaagtgggagag

SEQ ID NO: 14466 - DNA, 20 bp, Artificial Sequence
  chemically synthesized
gtaccgtctccaaagtggga

SEQ ID NO: 14467 - DNA, 20 bp, Artificial Sequence
  chemically synthesized
aatcaccttctctcccactt

SEQ ID NO: 14468 - DNA, 20 bp, Artificial Sequence
  chemically synthesized
tcgtaccgtctccaaagtgg

SEQ ID NO: 14469 - DNA, 20 bp, Artificial Sequence
  chemically synthesized
tcaccttctctcccactttg

SEQ ID NO: 14470 - DNA, 20 bp, Artificial Sequence
  chemically synthesized
gttcgtaccgtctccaaagt

SEQ ID NO: 14471 - DNA, 20 bp, Artificial Sequence
  chemically synthesized
agttcgtaccgtctccaaag

SEQ ID NO: 14472 - DNA, 20 bp, Artificial Sequence
  chemically synthesized
cttctctcccactttggaga

SEQ ID NO: 14473 - DNA, 20 bp, Artificial Sequence
  chemically synthesized
gttagttcgtaccgtctcca

SEQ ID NO: 14474 - DNA, 20 bp, Artificial Sequence
  chemically synthesized
ttggagacggtacgaactaa

SEQ ID NO: 14475 - DNA, 20 bp, Artificial Sequence
  chemically synthesized
tctcctgtgccagttgctgt

SEQ ID NO: 14476 - DNA, 20 bp, Artificial Sequence
  chemically synthesized
cggtacgaactaacagcaac

SEQ ID NO: 14477 - DNA, 20 bp, Artificial Sequence
  chemically synthesized
cgaactaacagcaactggca

SEQ ID NO: 14478 - DNA, 20 bp, Artificial Sequence
  chemically synthesized
gaactaacagcaactggcac

SEQ ID NO: 14479 - DNA, 20 bp, Artificial Sequence
  chemically synthesized
actaacagcaactggcacag

SEQ ID NO: 14480 - DNA, 20 bp, Artificial Sequence
  chemically synthesized
tgatcttttatctcctgtgc

SEQ ID NO: 14481 - DNA, 20 bp, Artificial Sequence
  chemically synthesized
gcaactggcacaggagataa

SEQ ID NO: 14482 - DNA, 20 bp, Artificial Sequence
  chemically synthesized
ggcacaggagataaaagatc

SEQ ID NO: 14483 - DNA, 20 bp, Artificial Sequence
  chemically synthesized
ataaaagatcaagtcataaa

SEQ ID NO: 14484 - DNA, 20 bp, Artificial Sequence
  chemically synthesized
taaaagatcaagtcataaaa

SEQ ID NO: 14485 - DNA, 20 bp, Artificial Sequence
  chemically synthesized
ataaaaaggtgaaaaatgat

SEQ ID NO: 14486 - DNA, 20 bp, Artificial Sequence
  chemically synthesized
aaaaaatgacattttttttt

SEQ ID NO: 14487 - DNA, 20 bp, Artificial Sequence
  chemically synthesized
aatcattggattcaggtatt

SEQ ID NO: 14488 - DNA, 20 bp, Artificial Sequence
  chemically synthesized
caatcattggattcaggtat

SEQ ID NO: 14489 - DNA, 20 bp, Artificial Sequence
  chemically synthesized
agtgtccaatcattggattc

SEQ ID NO: 14490 - DNA, 20 bp, Artificial Sequence
  chemically synthesized
gagtgtccaatcattggatt

SEQ ID NO: 14491 - DNA, 20 bp, Artificial Sequence
  chemically synthesized
taatacctgaatccaatgat

SEQ ID NO: 14492 - DNA, 20 bp, Artificial Sequence
  chemically synthesized
tgcaaagagtgtccaatcat

SEQ ID NO: 14493 - DNA, 20 bp, Artificial Sequence
  chemically synthesized
caatgattggacactctttg

SEQ ID NO: 14494 - DNA, 20 bp, Artificial Sequence
  chemically synthesized
ccaaatgtaacatctgcaaa

SEQ ID NO: 14495 - DNA, 20 bp, Artificial Sequence
  chemically synthesized
ggccaaatgtaacatctgca

SEQ ID NO: 14496 - DNA, 20 bp, Artificial Sequence
  chemically synthesized
ctctttgcagatgttacatt

SEQ ID NO: 14497 - DNA, 20 bp, Artificial Sequence
  chemically synthesized
gttacatttggcctgatgct

SEQ ID NO: 14498 - DNA, 20 bp, Artificial Sequence
  chemically synthesized
tgcagaaactgccaagcatc

SEQ ID NO: 14499 - DNA, 20 bp, Artificial Sequence
  chemically synthesized
ctgcagaaactgccaagcat

SEQ ID NO: 14500 - DNA, 20 bp, Artificial Sequence
  chemically synthesized
acatttggcctgatgcttgg

SEQ ID NO: 14501 - DNA, 20 bp, Artificial Sequence
  chemically synthesized
tggctgctgcagaaactgcc

SEQ ID NO: 14502 - DNA, 20 bp, Artificial Sequence
  chemically synthesized
ctgatgcttggcagtttctg

SEQ ID NO: 14503 - DNA, 20 bp, Artificial Sequence
  chemically synthesized
atgcttggcagtttctgcag

SEQ ID NO: 14504 - DNA, 20 bp, Artificial Sequence
  chemically synthesized
cctgcacagagtggctgctg

SEQ ID NO: 14505 - DNA, 20 bp, Artificial Sequence
  chemically synthesized
tctgcagcagccactctgtg

SEQ ID NO: 14506 - DNA, 20 bp, Artificial Sequence
  chemically synthesized
gctgcccgtcctgcacagag

SEQ ID NO: 14507 - DNA, 20 bp, Artificial Sequence
  chemically synthesized
ctgcagcagccactctgtgc

SEQ ID NO: 14508 - DNA, 20 bp, Artificial Sequence
  chemically synthesized
gtggctgcccgtcctgcaca

SEQ ID NO: 14509 - DNA, 20 bp, Artificial Sequence
  chemically synthesized
agcagccactctgtgcagga

SEQ ID NO: 14510 - DNA, 20 bp, Artificial Sequence
  chemically synthesized
gtgtggctgcccgtcctgca

SEQ ID NO: 14511 - DNA, 20 bp, Artificial Sequence
  chemically synthesized
gcagccactctgtgcaggac

SEQ ID NO: 14512 - DNA, 20 bp, Artificial Sequence
  chemically synthesized
gccactctgtgcaggacggg

SEQ ID NO: 14513 - DNA, 20 bp, Artificial Sequence
  chemically synthesized
caggacgggcagccacacca

SEQ ID NO: 14514 - DNA, 20 bp, Artificial Sequence
  chemically synthesized
tggaaccccagtccatggtg

SEQ ID NO: 14515 - DNA, 20 bp, Artificial Sequence
  chemically synthesized
cgggcagccacaccatggac

SEQ ID NO: 14516 - DNA, 20 bp, Artificial Sequence
  chemically synthesized
gggcagccacaccatggact

SEQ ID NO: 14517 - DNA, 20 bp, Artificial Sequence
  chemically synthesized
ggcagccacaccatggactg

SEQ ID NO: 14518 - DNA, 20 bp, Artificial Sequence
  chemically synthesized
gagactggaaccccagtcca

SEQ ID NO: 14519 - DNA, 20 bp, Artificial Sequence
  chemically synthesized
cacaccatggactggggttc

SEQ ID NO: 14520 - DNA, 20 bp, Artificial Sequence
  chemically synthesized
actggatgagactggaaccc

SEQ ID NO: 14521 - DNA, 20 bp, Artificial Sequence
  chemically synthesized
cttcctagactggatgagac

SEQ ID NO: 14522 - DNA, 20 bp, Artificial Sequence
  chemically synthesized
actggggttccagtctcatc

SEQ ID NO: 14523 - DNA, 20 bp, Artificial Sequence
  chemically synthesized
gccctcttcctagactggat

SEQ ID NO: 14524 - DNA, 20 bp, Artificial Sequence
  chemically synthesized
ggttccagtctcatccagtc

SEQ ID NO: 14525 - DNA, 20 bp, Artificial Sequence
  chemically synthesized
gttccagtctcatccagtct

SEQ ID NO: 14526 - DNA, 20 bp, Artificial Sequence
  chemically synthesized
ccagtctcatccagtctagg

SEQ ID NO: 14527 - DNA, 20 bp, Artificial Sequence
  chemically synthesized
aagcggccctcttcctagac

SEQ ID NO: 14528 - DNA, 20 bp, Artificial Sequence
  chemically synthesized
agtctcatccagtctaggaa

SEQ ID NO: 14529 - DNA, 20 bp, Artificial Sequence
  chemically synthesized
gtctcatccagtctaggaag

SEQ ID NO: 14530 - DNA, 20 bp, Artificial Sequence
  chemically synthesized
tctcatccagtctaggaaga

SEQ ID NO: 14531 - DNA, 20 bp, Artificial Sequence
  chemically synthesized
gatcgaagcggccctcttcc

SEQ ID NO: 14532 - DNA, 20 bp, Artificial Sequence
  chemically synthesized
taataagccagagatcgaag

SEQ ID NO: 14533 - DNA, 20 bp, Artificial Sequence
  chemically synthesized
aagagggccgcttcgatctc

SEQ ID NO: 14534 - DNA, 20 bp, Artificial Sequence
  chemically synthesized
taataataagccagagatcg

SEQ ID NO: 14535 - DNA, 20 bp, Artificial Sequence
  chemically synthesized
tgcaggctaataataagcca

SEQ ID NO: 14536 - DNA, 20 bp, Artificial Sequence
  chemically synthesized
tttgcaggctaataataagc

SEQ ID NO: 14537 - DNA, 20 bp, Artificial Sequence
  chemically synthesized
ttcgatctctggcttattat

SEQ ID NO: 14538 - DNA, 20 bp, Artificial Sequence
  chemically synthesized
tgtctttgcaggctaataat

SEQ ID NO: 14539 - DNA, 20 bp, Artificial Sequence
  chemically synthesized
tggcttattattagcctgca

SEQ ID NO: 14540 - DNA, 20 bp, Artificial Sequence
  chemically synthesized
ttattattagcctgcaaaga

SEQ ID NO: 14541 - DNA, 20 bp, Artificial Sequence
  chemically synthesized
tctctccctcctgtctttgc

SEQ ID NO: 14542 - DNA, 20 bp, Artificial Sequence
  chemically synthesized
tattattagcctgcaaagac

SEQ ID NO: 14543 - DNA, 20 bp, Artificial Sequence
  chemically synthesized
ctctctccctcctgtctttg

SEQ ID NO: 14544 - DNA, 20 bp, Artificial Sequence
  chemically synthesized
ttattagcctgcaaagacag

SEQ ID NO: 14545 - DNA, 20 bp, Artificial Sequence
  chemically synthesized
tattagcctgcaaagacagg

SEQ ID NO: 14546 - DNA, 20 bp, Artificial Sequence
  chemically synthesized
attagcctgcaaagacagga

SEQ ID NO: 14547 - DNA, 20 bp, Artificial Sequence
  chemically synthesized
tagcctgcaaagacaggagg

SEQ ID NO: 14548 - DNA, 20 bp, Artificial Sequence
  chemically synthesized
gcctgcaaagacaggaggga

SEQ ID NO: 14549 - DNA, 20 bp, Artificial Sequence
  chemically synthesized
ctgcaaagacaggagggaga

SEQ ID NO: 14550 - DNA, 20 bp, Artificial Sequence
  chemically synthesized
caaagacaggagggagagag

SEQ ID NO: 14551 - DNA, 20 bp, Artificial Sequence
  chemically synthesized
aaagacaggagggagagaga

SEQ ID NO: 14552 - DNA, 20 bp, Artificial Sequence
  chemically synthesized
agacaggagggagagagaag

SEQ ID NO: 14553 - DNA, 20 bp, Artificial Sequence
  chemically synthesized
gacaggagggagagagaagg

SEQ ID NO: 14554 - DNA, 20 bp, Artificial Sequence
  chemically synthesized
acaggagggagagagaagga

SEQ ID NO: 14555 - DNA, 20 bp, Artificial Sequence
  chemically synthesized
gggagagagaaggagggcaa

SEQ ID NO: 14556 - DNA, 20 bp, Artificial Sequence
  chemically synthesized
ggagagagaaggagggcaaa

SEQ ID NO: 14557 - DNA, 20 bp, Artificial Sequence
  chemically synthesized
gaaggagggcaaaaggatga

SEQ ID NO: 14558 - DNA, 20 bp, Artificial Sequence
  chemically synthesized
aaggagggcaaaaggatgaa

SEQ ID NO: 14559 - DNA, 20 bp, Artificial Sequence
  chemically synthesized
agggcaaaaggatgaaagga

SEQ ID NO: 14560 - DNA, 20 bp, Artificial Sequence
  chemically synthesized
gcaaaaggatgaaaggaaag

SEQ ID NO: 14561 - DNA, 20 bp, Artificial Sequence
  chemically synthesized
caaaaggatgaaaggaaaga

SEQ ID NO: 14562 - DNA, 20 bp, Artificial Sequence
  chemically synthesized
aggatgaaaggaaagaaggc

SEQ ID NO: 14563 - DNA, 20 bp, Artificial Sequence
  chemically synthesized
tgaaaggaaagaaggcaaga

SEQ ID NO: 14564 - DNA, 20 bp, Artificial Sequence
  chemically synthesized
ggaaagaaggcaagatggca

SEQ ID NO: 14565 - DNA, 20 bp, Artificial Sequence
  chemically synthesized
gaaagaaggcaagatggcaa

SEQ ID NO: 14566 - DNA, 20 bp, Artificial Sequence
  chemically synthesized
aagaaggcaagatggcaaag

SEQ ID NO: 14567 - DNA, 20 bp, Artificial Sequence
  chemically synthesized
agaaggcaagatggcaaagg

SEQ ID NO: 14568 - DNA, 20 bp, Artificial Sequence
  chemically synthesized
atggcaaaggaggtgtatat

SEQ ID NO: 14569 - DNA, 20 bp, Artificial Sequence
  chemically synthesized
tgtatatcagttcgattaat

SEQ ID NO: 14570 - DNA, 20 bp, Artificial Sequence
  chemically synthesized
agttcgattaataagttaaa

SEQ ID NO: 14571 - DNA, 20 bp, Artificial Sequence
  chemically synthesized
gattaataagttaaacagaa

SEQ ID NO: 14572 - DNA, 20 bp, Artificial Sequence
  chemically synthesized
aataagttaaacagaaaaga

SEQ ID NO: 14573 - DNA, 20 bp, Artificial Sequence
  chemically synthesized
agttaaacagaaaagataga

SEQ ID NO: 14574 - DNA, 20 bp, Artificial Sequence
  chemically synthesized
agaaaagatagaaagaacaa

SEQ ID NO: 14575 - DNA, 20 bp, Artificial Sequence
  chemically synthesized
tagaaagaacaatggttgca

SEQ ID NO: 14576 - DNA, 20 bp, Artificial Sequence
  chemically synthesized
aagaacaatggttgcaaagc

SEQ ID NO: 14577 - DNA, 20 bp, Artificial Sequence
  chemically synthesized
agaacaatggttgcaaagct

SEQ ID NO: 14578 - DNA, 20 bp, Artificial Sequence
  chemically synthesized
caatggttgcaaagctaggc

SEQ ID NO: 14579 - DNA, 20 bp, Artificial Sequence
  chemically synthesized
caagctgtgaaaagccagcc

SEQ ID NO: 14580 - DNA, 20 bp, Artificial Sequence
  chemically synthesized
agaaacaagctgtgaaaagc

SEQ ID NO: 14581 - DNA, 20 bp, Artificial Sequence
  chemically synthesized
aaagctaggctggcttttca

SEQ ID NO: 14582 - DNA, 20 bp, Artificial Sequence
  chemically synthesized
ttgcagaaacaagctgtgaa

SEQ ID NO: 14583 - DNA, 20 bp, Artificial Sequence
  chemically synthesized
cagggagcatttgcagaaac

SEQ ID NO: 14584 - DNA, 20 bp, Artificial Sequence
  chemically synthesized
tggatatcagggagcatttg

SEQ ID NO: 14585 - DNA, 20 bp, Artificial Sequence
  chemically synthesized
gtagctctttggatatcagg

SEQ ID NO: 14586 - DNA, 20 bp, Artificial Sequence
  chemically synthesized
gggtagctctttggatatca

SEQ ID NO: 14587 - DNA, 20 bp, Artificial Sequence
  chemically synthesized
tgggtagctctttggatatc

SEQ ID NO: 14588 - DNA, 20 bp, Artificial Sequence
  chemically synthesized
caaatgctccctgatatcca

SEQ ID NO: 14589 - DNA, 20 bp, Artificial Sequence
  chemically synthesized
gtgggtagctctttggatat

SEQ ID NO: 14590 - DNA, 20 bp, Artificial Sequence
  chemically synthesized
aatgctccctgatatccaaa

SEQ ID NO: 14591 - DNA, 20 bp, Artificial Sequence
  chemically synthesized
cttaggagtgggtagctctt

SEQ ID NO: 14592 - DNA, 20 bp, Artificial Sequence
  chemically synthesized
accaaagccttaggagtggg

SEQ ID NO: 14593 - DNA, 20 bp, Artificial Sequence
  chemically synthesized
ccaaagagctacccactcct

SEQ ID NO: 14594 - DNA, 20 bp, Artificial Sequence
  chemically synthesized
caaagagctacccactccta

SEQ ID NO: 14595 - DNA, 20 bp, Artificial Sequence
  chemically synthesized
tttaccaaagccttaggagt

SEQ ID NO: 14596 - DNA, 20 bp, Artificial Sequence
  chemically synthesized
gtttaccaaagccttaggag

SEQ ID NO: 14597 - DNA, 20 bp, Artificial Sequence
  chemically synthesized
gcagtttaccaaagccttag

SEQ ID NO: 14598 - DNA, 20 bp, Artificial Sequence
  chemically synthesized
gctacccactcctaaggctt

SEQ ID NO: 14599 - DNA, 20 bp, Artificial Sequence
  chemically synthesized
tggcagtttaccaaagcctt

SEQ ID NO: 14600 - DNA, 20 bp, Artificial Sequence
  chemically synthesized
atggcagtttaccaaagcct

SEQ ID NO: 14601 - DNA, 20 bp, Artificial Sequence
  chemically synthesized
agagtaatggcagtttacca

SEQ ID NO: 14602 - DNA, 20 bp, Artificial Sequence
  chemically synthesized
gtagccaaaaagagtaatgg

SEQ ID NO: 14603 - DNA, 20 bp, Artificial Sequence
  chemically synthesized
ctagtagccaaaaagagtaa

SEQ ID NO: 14604 - DNA, 20 bp, Artificial Sequence
  chemically synthesized
taaactgccattactctttt

SEQ ID NO: 14605 - DNA, 20 bp, Artificial Sequence
  chemically synthesized
tgtcatctagtagccaaaaa

SEQ ID NO: 14606 - DNA, 20 bp, Artificial Sequence
  chemically synthesized
cttgtcatctagtagccaaa

SEQ ID NO: 14607 - DNA, 20 bp, Artificial Sequence
  chemically synthesized
ccattactctttttggctac

SEQ ID NO: 14608 - DNA, 20 bp, Artificial Sequence
  chemically synthesized
tttcttttcttgtcatctag

SEQ ID NO: 14609 - DNA, 20 bp, Artificial Sequence
  chemically synthesized
ctttttggctactagatgac

SEQ ID NO: 14610 - DNA, 20 bp, Artificial Sequence
  chemically synthesized
tgttttcttttcttgtcatc

SEQ ID NO: 14611 - DNA, 20 bp, Artificial Sequence
  chemically synthesized
tggctactagatgacaagaa

SEQ ID NO: 14612 - DNA, 20 bp, Artificial Sequence
  chemically synthesized
agaaaacaaaaccaacaaac

SEQ ID NO: 14613 - DNA, 20 bp, Artificial Sequence
  chemically synthesized
tgcttacctttctcgtttgt

SEQ ID NO: 14614 - DNA, 20 bp, Artificial Sequence
  chemically synthesized
aacaaaaccaacaaacgaga

SEQ ID NO: 14615 - DNA, 20 bp, Artificial Sequence
  chemically synthesized
acaaaaccaacaaacgagaa

SEQ ID NO: 14616 - DNA, 20 bp, Artificial Sequence
  chemically synthesized
aaccaacaaacgagaaaggt

SEQ ID NO: 14617 - DNA, 20 bp, Artificial Sequence
  chemically synthesized
ggtaagcaaactacacacct

SEQ ID NO: 14618 - DNA, 20 bp, Artificial Sequence
  chemically synthesized
taaagtctcgctcaggtgtg

SEQ ID NO: 14619 - DNA, 20 bp, Artificial Sequence
  chemically synthesized
agcaaactacacacctgagc

SEQ ID NO: 14620 - DNA, 20 bp, Artificial Sequence
  chemically synthesized
agctaaataaagtctcgctc

SEQ ID NO: 14621 - DNA, 20 bp, Artificial Sequence
  chemically synthesized
aagctaaataaagtctcgct

SEQ ID NO: 14622 - DNA, 20 bp, Artificial Sequence
  chemically synthesized
cacctgagcgagactttatt

SEQ ID NO: 14623 - DNA, 20 bp, Artificial Sequence
  chemically synthesized
tcaaaaattaaagctaaata

SEQ ID NO: 14624 - DNA, 20 bp, Artificial Sequence
  chemically synthesized
atgtatcagttcaaaaatta

SEQ ID NO: 14625 - DNA, 20 bp, Artificial Sequence
  chemically synthesized
tctggctaacttttatgtat

SEQ ID NO: 14626 - DNA, 20 bp, Artificial Sequence
  chemically synthesized
atttttgaactgatacataa

SEQ ID NO: 14627 - DNA, 20 bp, Artificial Sequence
  chemically synthesized
ttgaactgatacataaaagt

SEQ ID NO: 14628 - DNA, 20 bp, Artificial Sequence
  chemically synthesized
actgatacataaaagttagc

SEQ ID NO: 14629 - DNA, 20 bp, Artificial Sequence
  chemically synthesized
gatacataaaagttagccag

SEQ ID NO: 14630 - DNA, 20 bp, Artificial Sequence
  chemically synthesized
aaacacctgcatttcacttc

SEQ ID NO: 14631 - DNA, 20 bp, Artificial Sequence
  chemically synthesized
agttagccagaagtgaaatg

SEQ ID NO: 14632 - DNA, 20 bp, Artificial Sequence
  chemically synthesized
gttagccagaagtgaaatgc

SEQ ID NO: 14633 - DNA, 20 bp, Artificial Sequence
  chemically synthesized
cccctcctttgaaattttat

SEQ ID NO: 14634 - DNA, 20 bp, Artificial Sequence
  chemically synthesized
tgtttactgataaaatttca

SEQ ID NO: 14635 - DNA, 20 bp, Artificial Sequence
  chemically synthesized
gtttactgataaaatttcaa

SEQ ID NO: 14636 - DNA, 20 bp, Artificial Sequence
  chemically synthesized
ttactgataaaatttcaaag

SEQ ID NO: 14637 - DNA, 20 bp, Artificial Sequence
  chemically synthesized
tactgataaaatttcaaagg

SEQ ID NO: 14638 - DNA, 20 bp, Artificial Sequence
  chemically synthesized
actgataaaatttcaaagga

SEQ ID NO: 14639 - DNA, 20 bp, Artificial Sequence
  chemically synthesized
ctgataaaatttcaaaggag

SEQ ID NO: 14640 - DNA, 20 bp, Artificial Sequence
  chemically synthesized
tgataaaatttcaaaggagg

SEQ ID NO: 14641 - DNA, 20 bp, Artificial Sequence
  chemically synthesized
gattctctagaaaaaaaaat

SEQ ID NO: 14642 - DNA, 20 bp, Artificial Sequence
  chemically synthesized
ggacaactgatttttttttc

SEQ ID NO: 14643 - DNA, 20 bp, Artificial Sequence
  chemically synthesized
acaactgatttttttttcta

SEQ ID NO: 14644 - DNA, 20 bp, Artificial Sequence
  chemically synthesized
tctatgagaaacagattctc

SEQ ID NO: 14645 - DNA, 20 bp, Artificial Sequence
  chemically synthesized
tctagagaatctgtttctca

SEQ ID NO: 14646 - DNA, 20 bp, Artificial Sequence
  chemically synthesized
cattatgattctatgagaaa

SEQ ID NO: 14647 - DNA, 20 bp, Artificial Sequence
  chemically synthesized
gcccctcattatgattctat

SEQ ID NO: 14648 - DNA, 20 bp, Artificial Sequence
  chemically synthesized
gtttctcatagaatcataat

SEQ ID NO: 14649 - DNA, 20 bp, Artificial Sequence
  chemically synthesized
tttctcatagaatcataatg

SEQ ID NO: 14650 - DNA, 20 bp, Artificial Sequence
  chemically synthesized
ttctcatagaatcataatga

SEQ ID NO: 14651 - DNA, 20 bp, Artificial Sequence
  chemically synthesized
tctcatagaatcataatgag

SEQ ID NO: 14652 - DNA, 20 bp, Artificial Sequence
  chemically synthesized
ttggaaccagatgaatttta

SEQ ID NO: 14653 - DNA, 20 bp, Artificial Sequence
  chemically synthesized
gaggggctttaaaattcatc

SEQ ID NO: 14654 - DNA, 20 bp, Artificial Sequence
  chemically synthesized
ttaaaattcatctggttcca

SEQ ID NO: 14655 - DNA, 20 bp, Artificial Sequence
  chemically synthesized
gttagatgaggctttggaac

SEQ ID NO: 14656 - DNA, 20 bp, Artificial Sequence
  chemically synthesized
ttgtctgttagatgaggctt

SEQ ID NO: 14657 - DNA, 20 bp, Artificial Sequence
  chemically synthesized
ggttccaaagcctcatctaa

SEQ ID NO: 14658 - DNA, 20 bp, Artificial Sequence
  chemically synthesized
gtttgcttgtctgttagatg

SEQ ID NO: 14659 - DNA, 20 bp, Artificial Sequence
  chemically synthesized
agtttgcttgtctgttagat

SEQ ID NO: 14660 - DNA, 20 bp, Artificial Sequence
  chemically synthesized
caaagcctcatctaacagac

SEQ ID NO: 14661 - DNA, 20 bp, Artificial Sequence
  chemically synthesized
aaatcagtttgcttgtctgt

SEQ ID NO: 14662 - DNA, 20 bp, Artificial Sequence
  chemically synthesized
agacaagcaaactgattttg

SEQ ID NO: 14663 - DNA, 20 bp, Artificial Sequence
  chemically synthesized
ccttttctggtctacaaaat

SEQ ID NO: 14664 - DNA, 20 bp, Artificial Sequence
  chemically synthesized
agcaaactgattttgtagac

SEQ ID NO: 14665 - DNA, 20 bp, Artificial Sequence
  chemically synthesized
actgattttgtagaccagaa

SEQ ID NO: 14666 - DNA, 20 bp, Artificial Sequence
  chemically synthesized
ctgattttgtagaccagaaa

SEQ ID NO: 14667 - DNA, 20 bp, Artificial Sequence
  chemically synthesized
gattttgtagaccagaaaag

SEQ ID NO: 14668 - DNA, 20 bp, Artificial Sequence
  chemically synthesized
cctttgaaaagctccttttc

SEQ ID NO: 14669 - DNA, 20 bp, Artificial Sequence
  chemically synthesized
accagaaaaggagcttttca

SEQ ID NO: 14670 - DNA, 20 bp, Artificial Sequence
  chemically synthesized
ccagaaaaggagcttttcaa

SEQ ID NO: 14671 - DNA, 20 bp, Artificial Sequence
  chemically synthesized
ctagctgtatggcctttgaa

SEQ ID NO: 14672 - DNA, 20 bp, Artificial Sequence
  chemically synthesized
ggagcttttcaaaggccata

SEQ ID NO: 14673 - DNA, 20 bp, Artificial Sequence
  chemically synthesized
cttttcaaaggccatacagc

SEQ ID NO: 14674 - DNA, 20 bp, Artificial Sequence
  chemically synthesized
cagctctgctgctagctgta

SEQ ID NO: 14675 - DNA, 20 bp, Artificial Sequence
  chemically synthesized
ttcaaaggccatacagctag

SEQ ID NO: 14676 - DNA, 20 bp, Artificial Sequence
  chemically synthesized
aaaggccatacagctagcag

SEQ ID NO: 14677 - DNA, 20 bp, Artificial Sequence
  chemically synthesized
aggccatacagctagcagca

SEQ ID NO: 14678 - DNA, 20 bp, Artificial Sequence
  chemically synthesized
tctattatcagctctgctgc

SEQ ID NO: 14679 - DNA, 20 bp, Artificial Sequence
  chemically synthesized
gctagcagcagagctgataa

SEQ ID NO: 14680 - DNA, 20 bp, Artificial Sequence
  chemically synthesized
ggaggtttggattctattat

SEQ ID NO: 14681 - DNA, 20 bp, Artificial Sequence
  chemically synthesized
ataatagaatccaaacctcc

SEQ ID NO: 14682 - DNA, 20 bp, Artificial Sequence
  chemically synthesized
cagcgctaagccaggaggtt

SEQ ID NO: 14683 - DNA, 20 bp, Artificial Sequence
  chemically synthesized
agaatccaaacctcctggct

SEQ ID NO: 14684 - DNA, 20 bp, Artificial Sequence
  chemically synthesized
gaaaacagcgctaagccagg

SEQ ID NO: 14685 - DNA, 20 bp, Artificial Sequence
  chemically synthesized
tgaaaacagcgctaagccag

SEQ ID NO: 14686 - DNA, 20 bp, Artificial Sequence
  chemically synthesized
catgaaaacagcgctaagcc

SEQ ID NO: 14687 - DNA, 20 bp, Artificial Sequence
  chemically synthesized
tcatgaaaacagcgctaagc

SEQ ID NO: 14688 - DNA, 20 bp, Artificial Sequence
  chemically synthesized
ggcatcatgaaaacagcgct

SEQ ID NO: 14689 - DNA, 20 bp, Artificial Sequence
  chemically synthesized
tcaacagggcatcatgaaaa

SEQ ID NO: 14690 - DNA, 20 bp, Artificial Sequence
  chemically synthesized
agaggcagacagaatcaaca

SEQ ID NO: 14691 - DNA, 20 bp, Artificial Sequence
  chemically synthesized
gagaggcagacagaatcaac

SEQ ID NO: 14692 - DNA, 20 bp, Artificial Sequence
  chemically synthesized
agagaggcagacagaatcaa

SEQ ID NO: 14693 - DNA, 20 bp, Artificial Sequence
  chemically synthesized
gagagaaatagagaggcaga

SEQ ID NO: 14694 - DNA, 20 bp, Artificial Sequence
  chemically synthesized
aagagagagaaatagagagg

SEQ ID NO: 14695 - DNA, 20 bp, Artificial Sequence
  chemically synthesized
tgaaagagagagaaatagag

SEQ ID NO: 14696 - DNA, 20 bp, Artificial Sequence
  chemically synthesized
ttgaaagagagagaaataga

SEQ ID NO: 14697 - DNA, 20 bp, Artificial Sequence
  chemically synthesized
ctttgaaagagagagaaata

SEQ ID NO: 14698 - DNA, 20 bp, Artificial Sequence
  chemically synthesized
gactttgaaagagagagaaa

SEQ ID NO: 14699 - DNA, 20 bp, Artificial Sequence
  chemically synthesized
catttagactttgaaagaga

SEQ ID NO: 14700 - DNA, 20 bp, Artificial Sequence
  chemically synthesized
ctctatttctctctctttca

SEQ ID NO: 14701 - DNA, 20 bp, Artificial Sequence
  chemically synthesized
tacatttagactttgaaaga

SEQ ID NO: 14702 - DNA, 20 bp, Artificial Sequence
  chemically synthesized
cttacatttagactttgaaa

SEQ ID NO: 14703 - DNA, 20 bp, Artificial Sequence
  chemically synthesized
ttcttacatttagactttga

SEQ ID NO: 14704 - DNA, 20 bp, Artificial Sequence
  chemically synthesized
ctctttcaaagtctaaatgt

SEQ ID NO: 14705 - DNA, 20 bp, Artificial Sequence
  chemically synthesized
tgaattgtatttcttacatt

SEQ ID NO: 14706 - DNA, 20 bp, Artificial Sequence
  chemically synthesized
gtaagaaatacaattcatcc

SEQ ID NO: 14707 - DNA, 20 bp, Artificial Sequence
  chemically synthesized
gaaatacaattcatcccaga

SEQ ID NO: 14708 - DNA, 20 bp, Artificial Sequence
  chemically synthesized
aaatacaattcatcccagac

SEQ ID NO: 14709 - DNA, 20 bp, Artificial Sequence
  chemically synthesized
ttgagatcattgtcctgtct

SEQ ID NO: 14710 - DNA, 20 bp, Artificial Sequence
  chemically synthesized
gttgagatcattgtcctgtc

SEQ ID NO: 14711 - DNA, 20 bp, Artificial Sequence
  chemically synthesized
ggtggtattttgagattgtt

SEQ ID NO: 14712 - DNA, 20 bp, Artificial Sequence
  chemically synthesized
aaatcaaatggtggtatttt

SEQ ID NO: 14713 - DNA, 20 bp, Artificial Sequence
  chemically synthesized
gtaacatataaatcaaatgg

SEQ ID NO: 14714 - DNA, 20 bp, Artificial Sequence
  chemically synthesized
atagtaacatataaatcaaa

SEQ ID NO: 14715 - DNA, 20 bp, Artificial Sequence
  chemically synthesized
ataattaaaattcatgaata

SEQ ID NO: 14716 - DNA, 20 bp, Artificial Sequence
  chemically synthesized
ctatagggttgaaaaaaaca

SEQ ID NO: 14717 - DNA, 20 bp, Artificial Sequence
  chemically synthesized
cctatagggttgaaaaaaac

SEQ ID NO: 14718 - DNA, 20 bp, Artificial Sequence
  chemically synthesized
ccttgtttttttcaacccta

SEQ ID NO: 14719 - DNA, 20 bp, Artificial Sequence
  chemically synthesized
cttgtttttttcaaccctat

SEQ ID NO: 14720 - DNA, 20 bp, Artificial Sequence
  chemically synthesized
aaaattaaaacaatcctata

SEQ ID NO: 14721 - DNA, 20 bp, Artificial Sequence
  chemically synthesized
aaaaattaaaacaatcctat

SEQ ID NO: 14722 - DNA, 20 bp, Artificial Sequence
  chemically synthesized
aaaaaattaaaacaatccta

SEQ ID NO: 14723 - DNA, 20 bp, Artificial Sequence
  chemically synthesized
gttttaattttttatattat

SEQ ID NO: 14724 - DNA, 20 bp, Artificial Sequence
  chemically synthesized
taattttttatattattaga

SEQ ID NO: 14725 - DNA, 20 bp, Artificial Sequence
  chemically synthesized
caaaaaagtagtcaatatat

SEQ ID NO: 14726 - DNA, 20 bp, Artificial Sequence
  chemically synthesized
gcaaaaaagtagtcaatata

SEQ ID NO: 14727 - DNA, 20 bp, Artificial Sequence
  chemically synthesized
agcaatgaagagcaaaaaag

SEQ ID NO: 14728 - DNA, 20 bp, Artificial Sequence
  chemically synthesized
gaaagcaatgaagagcaaaa

SEQ ID NO: 14729 - DNA, 20 bp, Artificial Sequence
  chemically synthesized
agatgaaagaaagcaatgaa

SEQ ID NO: 14730 - DNA, 20 bp, Artificial Sequence
  chemically synthesized
tgagatgaaagaaagcaatg

SEQ ID NO: 14731 - DNA, 20 bp, Artificial Sequence
  chemically synthesized
ggaagatttgagatgaaaga

SEQ ID NO: 14732 - DNA, 20 bp, Artificial Sequence
  chemically synthesized
agatggaagatttgagatga

SEQ ID NO: 14733 - DNA, 20 bp, Artificial Sequence
  chemically synthesized
taatcccagatggaagattt

SEQ ID NO: 14734 - DNA, 20 bp, Artificial Sequence
  chemically synthesized
ttcatctcaaatcttccatc

SEQ ID NO: 14735 - DNA, 20 bp, Artificial Sequence
  chemically synthesized
tcatctcaaatcttccatct

SEQ ID NO: 14736 - DNA, 20 bp, Artificial Sequence
  chemically synthesized
gcagaactaatcccagatgg

SEQ ID NO: 14737 - DNA, 20 bp, Artificial Sequence
  chemically synthesized
caggcagaactaatcccaga

SEQ ID NO: 14738 - DNA, 20 bp, Artificial Sequence
  chemically synthesized
tcaaatcttccatctgggat

SEQ ID NO: 14739 - DNA, 20 bp, Artificial Sequence
  chemically synthesized
atttcaggcagaactaatcc

SEQ ID NO: 14740 - DNA, 20 bp, Artificial Sequence
  chemically synthesized
tctaagggacatatttcagg

SEQ ID NO: 14741 - DNA, 20 bp, Artificial Sequence
  chemically synthesized
aattctaagggacatatttc

SEQ ID NO: 14742 - DNA, 20 bp, Artificial Sequence
  chemically synthesized
aaattctaagggacatattt

SEQ ID NO: 14743 - DNA, 20 bp, Artificial Sequence
  chemically synthesized
tctgcctgaaatatgtccct

SEQ ID NO: 14744 - DNA, 20 bp, Artificial Sequence
  chemically synthesized
acagctaaaggaaattctaa

SEQ ID NO: 14745 - DNA, 20 bp, Artificial Sequence
  chemically synthesized
aacagctaaaggaaattcta

SEQ ID NO: 14746 - DNA, 20 bp, Artificial Sequence
  chemically synthesized
caacagctaaaggaaattct

SEQ ID NO: 14747 - DNA, 20 bp, Artificial Sequence
  chemically synthesized
atgtcccttagaatttcctt

SEQ ID NO: 14748 - DNA, 20 bp, Artificial Sequence
  chemically synthesized
aatgcaccaccaacagctaa

SEQ ID NO: 14749 - DNA, 20 bp, Artificial Sequence
  chemically synthesized
ttagaatttcctttagctgt

SEQ ID NO: 14750 - DNA, 20 bp, Artificial Sequence
  chemically synthesized
aaatgcaccaccaacagcta

SEQ ID NO: 14751 - DNA, 20 bp, Artificial Sequence
  chemically synthesized
gaatttcctttagctgttgg

SEQ ID NO: 14752 - DNA, 20 bp, Artificial Sequence
  chemically synthesized
cttgagaaatgcaccaccaa

SEQ ID NO: 14753 - DNA, 20 bp, Artificial Sequence
  chemically synthesized
ctgttggtggtgcatttctc

SEQ ID NO: 14754 - DNA, 20 bp, Artificial Sequence
  chemically synthesized
ttttcagacaaacagagctt

SEQ ID NO: 14755 - DNA, 20 bp, Artificial Sequence
  chemically synthesized
gaggtattttcagacaaaca

SEQ ID NO: 14756 - DNA, 20 bp, Artificial Sequence
  chemically synthesized
aggaggtattttcagacaaa

SEQ ID NO: 14757 - DNA, 20 bp, Artificial Sequence
  chemically synthesized
ttaaaaaaaggaggtatttt

SEQ ID NO: 14758 - DNA, 20 bp, Artificial Sequence
  chemically synthesized
attttttttttaaaaaaagg

SEQ ID NO: 14759 - DNA, 20 bp, Artificial Sequence
  chemically synthesized
gattttttttttaaaaaaag

SEQ ID NO: 14760 - DNA, 20 bp, Artificial Sequence
  chemically synthesized
tggattttttttttaaaaaa

SEQ ID NO: 14761 - DNA, 20 bp, Artificial Sequence
  chemically synthesized
atggattttttttttaaaaa

SEQ ID NO: 14762 - DNA, 20 bp, Artificial Sequence
  chemically synthesized
gaagataactatcaggaata

SEQ ID NO: 14763 - DNA, 20 bp, Artificial Sequence
  chemically synthesized
aaaaaaatccatattcctga

SEQ ID NO: 14764 - DNA, 20 bp, Artificial Sequence
  chemically synthesized
atttaatgaagataactatc

SEQ ID NO: 14765 - DNA, 20 bp, Artificial Sequence
  chemically synthesized
tatttaatgaagataactat

SEQ ID NO: 14766 - DNA, 20 bp, Artificial Sequence
  chemically synthesized
aaaaaaaattgtatttaatg

SEQ ID NO: 14767 - DNA, 20 bp, Artificial Sequence
  chemically synthesized
atacaatttttttttttttt

SEQ ID NO: 14768 - DNA, 20 bp, Artificial Sequence
  chemically synthesized
ctgggcaatagagatagagt

SEQ ID NO: 14769 - DNA, 20 bp, Artificial Sequence
  chemically synthesized
cagcctgggcaatagagata

SEQ ID NO: 14770 - DNA, 20 bp, Artificial Sequence
  chemically synthesized
tccagcctgggcaatagaga

SEQ ID NO: 14771 - DNA, 20 bp, Artificial Sequence
  chemically synthesized
ctgactctatctctattgcc

SEQ ID NO: 14772 - DNA, 20 bp, Artificial Sequence
  chemically synthesized
gcactccagcctgggcaata

SEQ ID NO: 14773 - DNA, 20 bp, Artificial Sequence
  chemically synthesized
tgactctatctctattgccc

SEQ ID NO: 14774 - DNA, 20 bp, Artificial Sequence
  chemically synthesized
ctgcactccagcctgggcaa

SEQ ID NO: 14775 - DNA, 20 bp, Artificial Sequence
  chemically synthesized
tctatctctattgcccaggc

SEQ ID NO: 14776 - DNA, 20 bp, Artificial Sequence
  chemically synthesized
tatctctattgcccaggctg

SEQ ID NO: 14777 - DNA, 20 bp, Artificial Sequence
  chemically synthesized
acgccactgcactccagcct

SEQ ID NO: 14778 - DNA, 20 bp, Artificial Sequence
  chemically synthesized
cacgccactgcactccagcc

SEQ ID NO: 14779 - DNA, 20 bp, Artificial Sequence
  chemically synthesized
ctattgcccaggctggagtg

SEQ ID NO: 14780 - DNA, 20 bp, Artificial Sequence
  chemically synthesized
gagatcacgccactgcactc

SEQ ID NO: 14781 - DNA, 20 bp, Artificial Sequence
  chemically synthesized
ttgcccaggctggagtgcag

SEQ ID NO: 14782 - DNA, 20 bp, Artificial Sequence
  chemically synthesized
ggagtgcagtggcgtgatct

SEQ ID NO: 14783 - DNA, 20 bp, Artificial Sequence
  chemically synthesized
aggcggagattgcaggagcc

SEQ ID NO: 14784 - DNA, 20 bp, Artificial Sequence
  chemically synthesized
ccaggaggcggagattgcag

SEQ ID NO: 14785 - DNA, 20 bp, Artificial Sequence
  chemically synthesized
acccaggaggcggagattgc

SEQ ID NO: 14786 - DNA, 20 bp, Artificial Sequence
  chemically synthesized
aacccaggaggcggagattg

SEQ ID NO: 14787 - DNA, 20 bp, Artificial Sequence
  chemically synthesized
ctcctgcaatctccgcctcc

SEQ ID NO: 14788 - DNA, 20 bp, Artificial Sequence
  chemically synthesized
tcacttgaacccaggaggcg

SEQ ID NO: 14789 - DNA, 20 bp, Artificial Sequence
  chemically synthesized
tcctgcaatctccgcctcct

SEQ ID NO: 14790 - DNA, 20 bp, Artificial Sequence
  chemically synthesized
aatcacttgaacccaggagg

SEQ ID NO: 14791 - DNA, 20 bp, Artificial Sequence
  chemically synthesized
gagaatcacttgaacccagg

SEQ ID NO: 14792 - DNA, 20 bp, Artificial Sequence
  chemically synthesized
tgagaatcacttgaacccag

SEQ ID NO: 14793 - DNA, 20 bp, Artificial Sequence
  chemically synthesized
aatctccgcctcctgggttc

SEQ ID NO: 14794 - DNA, 20 bp, Artificial Sequence
  chemically synthesized
catgagaatcacttgaaccc

SEQ ID NO: 14795 - DNA, 20 bp, Artificial Sequence
  chemically synthesized
gcatgagaatcacttgaacc

SEQ ID NO: 14796 - DNA, 20 bp, Artificial Sequence
  chemically synthesized
ttcaagtgattctcatgcct

SEQ ID NO: 14797 - DNA, 20 bp, Artificial Sequence
  chemically synthesized
tacttgggaggctgaggcat

SEQ ID NO: 14798 - DNA, 20 bp, Artificial Sequence
  chemically synthesized
cccagctacttgggaggctg

SEQ ID NO: 14799 - DNA, 20 bp, Artificial Sequence
  chemically synthesized
tcccagctacttgggaggct

SEQ ID NO: 14800 - DNA, 20 bp, Artificial Sequence
  chemically synthesized
ttctcatgcctcagcctccc

SEQ ID NO: 14801 - DNA, 20 bp, Artificial Sequence
  chemically synthesized
tcatgcctcagcctcccaag

SEQ ID NO: 14802 - DNA, 20 bp, Artificial Sequence
  chemically synthesized
catggtcccagctacttggg

SEQ ID NO: 14803 - DNA, 20 bp, Artificial Sequence
  chemically synthesized
ccatggtcccagctacttgg

SEQ ID NO: 14804 - DNA, 20 bp, Artificial Sequence
  chemically synthesized
gcctcagcctcccaagtagc

SEQ ID NO: 14805 - DNA, 20 bp, Artificial Sequence
  chemically synthesized
gcccatggtcccagctactt

SEQ ID NO: 14806 - DNA, 20 bp, Artificial Sequence
  chemically synthesized
cctcagcctcccaagtagct

SEQ ID NO: 14807 - DNA, 20 bp, Artificial Sequence
  chemically synthesized
tgcccatggtcccagctact

SEQ ID NO: 14808 - DNA, 20 bp, Artificial Sequence
  chemically synthesized
ctcccaagtagctgggacca

SEQ ID NO: 14809 - DNA, 20 bp, Artificial Sequence
  chemically synthesized
tcccaagtagctgggaccat

SEQ ID NO: 14810 - DNA, 20 bp, Artificial Sequence
  chemically synthesized
gtggcgtgtgcccatggtcc

SEQ ID NO: 14811 - DNA, 20 bp, Artificial Sequence
  chemically synthesized
ggtggggtggcgtgtgccca

SEQ ID NO: 14812 - DNA, 20 bp, Artificial Sequence
  chemically synthesized
tgggcacacgccaccccacc

SEQ ID NO: 14813 - DNA, 20 bp, Artificial Sequence
  chemically synthesized
caaaaagtagccgggtgggg

SEQ ID NO: 14814 - DNA, 20 bp, Artificial Sequence
  chemically synthesized
atacaaaaagtagccgggtg

SEQ ID NO: 14815 - DNA, 20 bp, Artificial Sequence
  chemically synthesized
aatacaaaaagtagccgggt

SEQ ID NO: 14816 - DNA, 20 bp, Artificial Sequence
  chemically synthesized
aaatacaaaaagtagccggg

SEQ ID NO: 14817 - DNA, 20 bp, Artificial Sequence
  chemically synthesized
taaaaatacaaaaagtagcc

SEQ ID NO: 14818 - DNA, 20 bp, Artificial Sequence
  chemically synthesized
ctaaaaatacaaaaagtagc

SEQ ID NO: 14819 - DNA, 20 bp, Artificial Sequence
  chemically synthesized
tctactaaaaatacaaaaag

SEQ ID NO: 14820 - DNA, 20 bp, Artificial Sequence
  chemically synthesized
atctctactaaaaatacaaa

SEQ ID NO: 14821 - DNA, 20 bp, Artificial Sequence
  chemically synthesized
ccggctactttttgtatttt

SEQ ID NO: 14822 - DNA, 20 bp, Artificial Sequence
  chemically synthesized
gctactttttgtatttttag

SEQ ID NO: 14823 - DNA, 20 bp, Artificial Sequence
  chemically synthesized
tactttttgtatttttagta

SEQ ID NO: 14824 - DNA, 20 bp, Artificial Sequence
  chemically synthesized
ttttgtatttttagtagaga

SEQ ID NO: 14825 - DNA, 20 bp, Artificial Sequence
  chemically synthesized
tttgtatttttagtagagat

SEQ ID NO: 14826 - DNA, 20 bp, Artificial Sequence
  chemically synthesized
ttgtatttttagtagagatg

SEQ ID NO: 14827 - DNA, 20 bp, Artificial Sequence
  chemically synthesized
tggggtttcaccatgttgac

SEQ ID NO: 14828 - DNA, 20 bp, Artificial Sequence
  chemically synthesized
cgagacctgcctagtcaaca

SEQ ID NO: 14829 - DNA, 20 bp, Artificial Sequence
  chemically synthesized
ggggtttcaccatgttgact

SEQ ID NO: 14830 - DNA, 20 bp, Artificial Sequence
  chemically synthesized
gtttcaccatgttgactagg

SEQ ID NO: 14831 - DNA, 20 bp, Artificial Sequence
  chemically synthesized
tttcaccatgttgactaggc

SEQ ID NO: 14832 - DNA, 20 bp, Artificial Sequence
  chemically synthesized
tcaggagttcgagacctgcc

SEQ ID NO: 14833 - DNA, 20 bp, Artificial Sequence
  chemically synthesized
tcattttaagtcaggagttc

SEQ ID NO: 14834 - DNA, 20 bp, Artificial Sequence
  chemically synthesized
ggtggatcattttaagtcag

SEQ ID NO: 14835 - DNA, 20 bp, Artificial Sequence
  chemically synthesized
cgggtggatcattttaagtc

SEQ ID NO: 14836 - DNA, 20 bp, Artificial Sequence
  chemically synthesized
gcgggtggatcattttaagt

SEQ ID NO: 14837 - DNA, 20 bp, Artificial Sequence
  chemically synthesized
cgaggcgggtggatcatttt

SEQ ID NO: 14838 - DNA, 20 bp, Artificial Sequence
  chemically synthesized
ttaaaatgatccacccgcct

SEQ ID NO: 14839 - DNA, 20 bp, Artificial Sequence
  chemically synthesized
ctttgggaggccgaggcggg

SEQ ID NO: 14840 - DNA, 20 bp, Artificial Sequence
  chemically synthesized
gcactttgggaggccgaggc

SEQ ID NO: 14841 - DNA, 20 bp, Artificial Sequence
  chemically synthesized
agcactttgggaggccgagg

SEQ ID NO: 14842 - DNA, 20 bp, Artificial Sequence
  chemically synthesized
cccagcactttgggaggccg

SEQ ID NO: 14843 - DNA, 20 bp, Artificial Sequence
  chemically synthesized
tcccagcactttgggaggcc

SEQ ID NO: 14844 - DNA, 20 bp, Artificial Sequence
  chemically synthesized
ccacccgcctcggcctccca

SEQ ID NO: 14845 - DNA, 20 bp, Artificial Sequence
  chemically synthesized
tgttatcccagcactttggg

SEQ ID NO: 14846 - DNA, 20 bp, Artificial Sequence
  chemically synthesized
ctgttatcccagcactttgg

SEQ ID NO: 14847 - DNA, 20 bp, Artificial Sequence
  chemically synthesized
gcctcggcctcccaaagtgc

SEQ ID NO: 14848 - DNA, 20 bp, Artificial Sequence
  chemically synthesized
gcctgttatcccagcacttt

SEQ ID NO: 14849 - DNA, 20 bp, Artificial Sequence
  chemically synthesized
cctcggcctcccaaagtgct

SEQ ID NO: 14850 - DNA, 20 bp, Artificial Sequence
  chemically synthesized
cgcctgttatcccagcactt

SEQ ID NO: 14851 - DNA, 20 bp, Artificial Sequence
  chemically synthesized
ctcccaaagtgctgggataa

SEQ ID NO: 14852 - DNA, 20 bp, Artificial Sequence
  chemically synthesized
tcccaaagtgctgggataac

SEQ ID NO: 14853 - DNA, 20 bp, Artificial Sequence
  chemically synthesized
gtggctcacgcctgttatcc

SEQ ID NO: 14854 - DNA, 20 bp, Artificial Sequence
  chemically synthesized
agtgctgggataacaggcgt

SEQ ID NO: 14855 - DNA, 20 bp, Artificial Sequence
  chemically synthesized
caggcgtgagccactgcgcc

SEQ ID NO: 14856 - DNA, 20 bp, Artificial Sequence
  chemically synthesized
tatacttgggccaggcgcag

SEQ ID NO: 14857 - DNA, 20 bp, Artificial Sequence
  chemically synthesized
ttttatacttgggccaggcg

SEQ ID NO: 14858 - DNA, 20 bp, Artificial Sequence
  chemically synthesized
tgagccactgcgcctggccc

SEQ ID NO: 14859 - DNA, 20 bp, Artificial Sequence
  chemically synthesized
aaaaattttatacttgggcc

SEQ ID NO: 14860 - DNA, 20 bp, Artificial Sequence
  chemically synthesized
caaaaattttatacttgggc

SEQ ID NO: 14861 - DNA, 20 bp, Artificial Sequence
  chemically synthesized
caatcaaaaattttatactt

SEQ ID NO: 14862 - DNA, 20 bp, Artificial Sequence
  chemically synthesized
tcaatcaaaaattttatact

SEQ ID NO: 14863 - DNA, 20 bp, Artificial Sequence
  chemically synthesized
agtataaaatttttgattga

SEQ ID NO: 14864 - DNA, 20 bp, Artificial Sequence
  chemically synthesized
gtataaaatttttgattgaa

SEQ ID NO: 14865 - DNA, 20 bp, Artificial Sequence
  chemically synthesized
aatttttgattgaaaggttt

SEQ ID NO: 14866 - DNA, 20 bp, Artificial Sequence
  chemically synthesized
atttttgattgaaaggtttt

SEQ ID NO: 14867 - DNA, 20 bp, Artificial Sequence
  chemically synthesized
tttttgattgaaaggttttg

SEQ ID NO: 14868 - DNA, 20 bp, Artificial Sequence
  chemically synthesized
ttcaaaaacaaaataaaaac

SEQ ID NO: 14869 - DNA, 20 bp, Artificial Sequence
  chemically synthesized
acgaaagtggagtaatattt

SEQ ID NO: 14870 - DNA, 20 bp, Artificial Sequence
  chemically synthesized
aacagagatagacgaaagtg

SEQ ID NO: 14871 - DNA, 20 bp, Artificial Sequence
  chemically synthesized
gcaacagagatagacgaaag

SEQ ID NO: 14872 - DNA, 20 bp, Artificial Sequence
  chemically synthesized
gcagcaacagagatagacga

SEQ ID NO: 14873 - DNA, 20 bp, Artificial Sequence
  chemically synthesized
cttctcagcagcaacagaga

SEQ ID NO: 14874 - DNA, 20 bp, Artificial Sequence
  chemically synthesized
ttgacttctcagcagcaaca

SEQ ID NO: 14875 - DNA, 20 bp, Artificial Sequence
  chemically synthesized
tattgacttctcagcagcaa

SEQ ID NO: 14876 - DNA, 20 bp, Artificial Sequence
  chemically synthesized
cgtctatctctgttgctgct

SEQ ID NO: 14877 - DNA, 20 bp, Artificial Sequence
  chemically synthesized
ctatctctgttgctgctgag

SEQ ID NO: 14878 - DNA, 20 bp, Artificial Sequence
  chemically synthesized
ctttactattgacttctcag

SEQ ID NO: 14879 - DNA, 20 bp, Artificial Sequence
  chemically synthesized
catctttactattgacttct

SEQ ID NO: 14880 - DNA, 20 bp, Artificial Sequence
  chemically synthesized
tgttgctgctgagaagtcaa

SEQ ID NO: 14881 - DNA, 20 bp, Artificial Sequence
  chemically synthesized
ctgctgagaagtcaatagta

SEQ ID NO: 14882 - DNA, 20 bp, Artificial Sequence
  chemically synthesized
tgttttttgcaaaggagcaa

SEQ ID NO: 14883 - DNA, 20 bp, Artificial Sequence
  chemically synthesized
ttcatgtgttttttgcaaag

SEQ ID NO: 14884 - DNA, 20 bp, Artificial Sequence
  chemically synthesized
ttttcatgtgttttttgcaa

SEQ ID NO: 14885 - DNA, 20 bp, Artificial Sequence
  chemically synthesized
tttttcatgtgttttttgca

SEQ ID NO: 14886 - DNA, 20 bp, Artificial Sequence
  chemically synthesized
ctctgatggccagtgatggt

SEQ ID NO: 14887 - DNA, 20 bp, Artificial Sequence
  chemically synthesized
gaaaaaatgctcaccatcac

SEQ ID NO: 14888 - DNA, 20 bp, Artificial Sequence
  chemically synthesized
atttctctgatggccagtga

SEQ ID NO: 14889 - DNA, 20 bp, Artificial Sequence
  chemically synthesized
tgctcaccatcactggccat

SEQ ID NO: 14890 - DNA, 20 bp, Artificial Sequence
  chemically synthesized
ctcaccatcactggccatca

SEQ ID NO: 14891 - DNA, 20 bp, Artificial Sequence
  chemically synthesized
atttgcatttctctgatggc

SEQ ID NO: 14892 - DNA, 20 bp, Artificial Sequence
  chemically synthesized
tttgatttgcatttctctga

SEQ ID NO: 14893 - DNA, 20 bp, Artificial Sequence
  chemically synthesized
atgcaaatcaaaaccacaat

SEQ ID NO: 14894 - DNA, 20 bp, Artificial Sequence
  chemically synthesized
tgtgagatggtatctcattg

SEQ ID NO: 14895 - DNA, 20 bp, Artificial Sequence
  chemically synthesized
ccattctaactggtgtgaga

SEQ ID NO: 14896 - DNA, 20 bp, Artificial Sequence
  chemically synthesized
aatgagataccatctcacac

SEQ ID NO: 14897 - DNA, 20 bp, Artificial Sequence
  chemically synthesized
attgccattctaactggtgt

SEQ ID NO: 14898 - DNA, 20 bp, Artificial Sequence
  chemically synthesized
agataccatctcacaccagt

SEQ ID NO: 14899 - DNA, 20 bp, Artificial Sequence
  chemically synthesized
ccatctcacaccagttagaa

SEQ ID NO: 14900 - DNA, 20 bp, Artificial Sequence
  chemically synthesized
ttaatgattgccattctaac

SEQ ID NO: 14901 - DNA, 20 bp, Artificial Sequence
  chemically synthesized
ttagaatggcaatcattaaa

SEQ ID NO: 14902 - DNA, 20 bp, Artificial Sequence
  chemically synthesized
aatggcaatcattaaaaagt

SEQ ID NO: 14903 - DNA, 20 bp, Artificial Sequence
  chemically synthesized
atggcaatcattaaaaagtc

SEQ ID NO: 14904 - DNA, 20 bp, Artificial Sequence
  chemically synthesized
attaaaaagtcaggaaacaa

SEQ ID NO: 14905 - DNA, 20 bp, Artificial Sequence
  chemically synthesized
ttaaaaagtcaggaaacaac

SEQ ID NO: 14906 - DNA, 20 bp, Artificial Sequence
  chemically synthesized
agtcaggaaacaacaggtgc

SEQ ID NO: 14907 - DNA, 20 bp, Artificial Sequence
  chemically synthesized
tcaggaaacaacaggtgctg

SEQ ID NO: 14908 - DNA, 20 bp, Artificial Sequence
  chemically synthesized
aggaaacaacaggtgctgga

SEQ ID NO: 14909 - DNA, 20 bp, Artificial Sequence
  chemically synthesized
ggaaacaacaggtgctggag

SEQ ID NO: 14910 - DNA, 20 bp, Artificial Sequence
  chemically synthesized
ctatttctccacatcctctc

SEQ ID NO: 14911 - DNA, 20 bp, Artificial Sequence
  chemically synthesized
aacaggtgctggagaggatg

SEQ ID NO: 14912 - DNA, 20 bp, Artificial Sequence
  chemically synthesized
caggtgctggagaggatgtg

SEQ ID NO: 14913 - DNA, 20 bp, Artificial Sequence
  chemically synthesized
ctggagaggatgtggagaaa

SEQ ID NO: 14914 - DNA, 20 bp, Artificial Sequence
  chemically synthesized
tggagaggatgtggagaaat

SEQ ID NO: 14915 - DNA, 20 bp, Artificial Sequence
  chemically synthesized
cagtcccaccaacagtgtaa

SEQ ID NO: 14916 - DNA, 20 bp, Artificial Sequence
  chemically synthesized
taggaacacttttacactgt

SEQ ID NO: 14917 - DNA, 20 bp, Artificial Sequence
  chemically synthesized
gaacacttttacactgttgg

SEQ ID NO: 14918 - DNA, 20 bp, Artificial Sequence
  chemically synthesized
aacacttttacactgttggt

SEQ ID NO: 14919 - DNA, 20 bp, Artificial Sequence
  chemically synthesized
ctagtttacagtcccaccaa

SEQ ID NO: 14920 - DNA, 20 bp, Artificial Sequence
  chemically synthesized
ctgttggtgggactgtaaac

SEQ ID NO: 14921 - DNA, 20 bp, Artificial Sequence
  chemically synthesized
acaatggttgaactagttta

SEQ ID NO: 14922 - DNA, 20 bp, Artificial Sequence
  chemically synthesized
gacttccacaatggttgaac

SEQ ID NO: 14923 - DNA, 20 bp, Artificial Sequence
  chemically synthesized
gtaaactagttcaaccattg

SEQ ID NO: 14924 - DNA, 20 bp, Artificial Sequence
  chemically synthesized
aactagttcaaccattgtgg

SEQ ID NO: 14925 - DNA, 20 bp, Artificial Sequence
  chemically synthesized
cgccacactgacttccacaa

SEQ ID NO: 14926 - DNA, 20 bp, Artificial Sequence
  chemically synthesized
agttcaaccattgtggaagt

SEQ ID NO: 14927 - DNA, 20 bp, Artificial Sequence
  chemically synthesized
aaccattgtggaagtcagtg

SEQ ID NO: 14928 - DNA, 20 bp, Artificial Sequence
  chemically synthesized
aagtcagtgtggcgattcct

SEQ ID NO: 14929 - DNA, 20 bp, Artificial Sequence
  chemically synthesized
agtcagtgtggcgattcctc

SEQ ID NO: 14930 - DNA, 20 bp, Artificial Sequence
  chemically synthesized
gtcagtgtggcgattcctca

SEQ ID NO: 14931 - DNA, 20 bp, Artificial Sequence
  chemically synthesized
tttctagttctagatccctg

SEQ ID NO: 14932 - DNA, 20 bp, Artificial Sequence
  chemically synthesized
gtggcgattcctcagggatc

SEQ ID NO: 14933 - DNA, 20 bp, Artificial Sequence
  chemically synthesized
atttctagttctagatccct

SEQ ID NO: 14934 - DNA, 20 bp, Artificial Sequence
  chemically synthesized
attcctcagggatctagaac

SEQ ID NO: 14935 - DNA, 20 bp, Artificial Sequence
  chemically synthesized
tcaaatggtatttctagttc

SEQ ID NO: 14936 - DNA, 20 bp, Artificial Sequence
  chemically synthesized
gctgggtcaaatggtatttc

SEQ ID NO: 14937 - DNA, 20 bp, Artificial Sequence
  chemically synthesized
actagaaataccatttgacc

SEQ ID NO: 14938 - DNA, 20 bp, Artificial Sequence
  chemically synthesized
aatgggatggctgggtcaaa

SEQ ID NO: 14939 - DNA, 20 bp, Artificial Sequence
  chemically synthesized
tacccagtaatgggatggct

SEQ ID NO: 14940 - DNA, 20 bp, Artificial Sequence
  chemically synthesized
atacccagtaatgggatggc

SEQ ID NO: 14941 - DNA, 20 bp, Artificial Sequence
  chemically synthesized
gtatatacccagtaatggga

SEQ ID NO: 14942 - DNA, 20 bp, Artificial Sequence
  chemically synthesized
tgacccagccatcccattac

SEQ ID NO: 14943 - DNA, 20 bp, Artificial Sequence
  chemically synthesized
gacccagccatcccattact

SEQ ID NO: 14944 - DNA, 20 bp, Artificial Sequence
  chemically synthesized
ttgggtatatacccagtaat

SEQ ID NO: 14945 - DNA, 20 bp, Artificial Sequence
  chemically synthesized
tttgggtatatacccagtaa

SEQ ID NO: 14946 - DNA, 20 bp, Artificial Sequence
  chemically synthesized
tagtcctttgggtatatacc

SEQ ID NO: 14947 - DNA, 20 bp, Artificial Sequence
  chemically synthesized
cattactgggtatataccca

SEQ ID NO: 14948 - DNA, 20 bp, Artificial Sequence
  chemically synthesized
attactgggtatatacccaa

SEQ ID NO: 14949 - DNA, 20 bp, Artificial Sequence
  chemically synthesized
agcatgatttatagtccttt

SEQ ID NO: 14950 - DNA, 20 bp, Artificial Sequence
  chemically synthesized
cagcatgatttatagtcctt

SEQ ID NO: 14951 - DNA, 20 bp, Artificial Sequence
  chemically synthesized
ctttatagcagcatgattta

SEQ ID NO: 14952 - DNA, 20 bp, Artificial Sequence
  chemically synthesized
ctataaatcatgctgctata

SEQ ID NO: 14953 - DNA, 20 bp, Artificial Sequence
  chemically synthesized
gtgtgcatgtgtctttatag

SEQ ID NO: 14954 - DNA, 20 bp, Artificial Sequence
  chemically synthesized
tacgtgtgcatgtgtcttta

SEQ ID NO: 14955 - DNA, 20 bp, Artificial Sequence
  chemically synthesized
atgcacacgtatgtttattg

SEQ ID NO: 14956 - DNA, 20 bp, Artificial Sequence
  chemically synthesized
tattgcggcactattcacaa

SEQ ID NO: 14957 - DNA, 20 bp, Artificial Sequence
  chemically synthesized
caagtctttgctattgtgaa

SEQ ID NO: 14958 - DNA, 20 bp, Artificial Sequence
  chemically synthesized
cggcactattcacaatagca

SEQ ID NO: 14959 - DNA, 20 bp, Artificial Sequence
  chemically synthesized
tattcacaatagcaaagact

SEQ ID NO: 14960 - DNA, 20 bp, Artificial Sequence
  chemically synthesized
tgggcatttgggttggttcc

SEQ ID NO: 14961 - DNA, 20 bp, Artificial Sequence
  chemically synthesized
tcattgttgggcatttgggt

SEQ ID NO: 14962 - DNA, 20 bp, Artificial Sequence
  chemically synthesized
tctatcattgttgggcattt

SEQ ID NO: 14963 - DNA, 20 bp, Artificial Sequence
  chemically synthesized
gtctatcattgttgggcatt

SEQ ID NO: 14964 - DNA, 20 bp, Artificial Sequence
  chemically synthesized
taatccagtctatcattgtt

SEQ ID NO: 14965 - DNA, 20 bp, Artificial Sequence
  chemically synthesized
acccaaatgcccaacaatga

SEQ ID NO: 14966 - DNA, 20 bp, Artificial Sequence
  chemically synthesized
ttaatccagtctatcattgt

SEQ ID NO: 14967 - DNA, 20 bp, Artificial Sequence
  chemically synthesized
aatgcccaacaatgatagac

SEQ ID NO: 14968 - DNA, 20 bp, Artificial Sequence
  chemically synthesized
caacaatgatagactggatt

SEQ ID NO: 14969 - DNA, 20 bp, Artificial Sequence
  chemically synthesized
tgtgccacattttcttaatc

SEQ ID NO: 14970 - DNA, 20 bp, Artificial Sequence
  chemically synthesized
tagactggattaagaaaatg

SEQ ID NO: 14971 - DNA, 20 bp, Artificial Sequence
  chemically synthesized
aatgtggcacatatacacca

SEQ ID NO: 14972 - DNA, 20 bp, Artificial Sequence
  chemically synthesized
tatggctgcatagtattcca

SEQ ID NO: 14973 - DNA, 20 bp, Artificial Sequence
  chemically synthesized
atacaccatggaatactatg

SEQ ID NO: 14974 - DNA, 20 bp, Artificial Sequence
  chemically synthesized
catccttttttatggctgca

SEQ ID NO: 14975 - DNA, 20 bp, Artificial Sequence
  chemically synthesized
aatactatgcagccataaaa

SEQ ID NO: 14976 - DNA, 20 bp, Artificial Sequence
  chemically synthesized
atactatgcagccataaaaa

SEQ ID NO: 14977 - DNA, 20 bp, Artificial Sequence
  chemically synthesized
catgaactcatcctttttta

SEQ ID NO: 14978 - DNA, 20 bp, Artificial Sequence
  chemically synthesized
atgcagccataaaaaaggat

SEQ ID NO: 14979 - DNA, 20 bp, Artificial Sequence
  chemically synthesized
ggatgagttcatgtcctttg

SEQ ID NO: 14980 - DNA, 20 bp, Artificial Sequence
  chemically synthesized
gatgagttcatgtcctttgt

SEQ ID NO: 14981 - DNA, 20 bp, Artificial Sequence
  chemically synthesized
atgagttcatgtcctttgta

SEQ ID NO: 14982 - DNA, 20 bp, Artificial Sequence
  chemically synthesized
tttcatccatgtccctacaa

SEQ ID NO: 14983 - DNA, 20 bp, Artificial Sequence
  chemically synthesized
atttcatccatgtccctaca

SEQ ID NO: 14984 - DNA, 20 bp, Artificial Sequence
  chemically synthesized
tcatgtcctttgtagggaca

SEQ ID NO: 14985 - DNA, 20 bp, Artificial Sequence
  chemically synthesized
tgtagggacatggatgaaat

SEQ ID NO: 14986 - DNA, 20 bp, Artificial Sequence
  chemically synthesized
aaattggaaatcatcattct

SEQ ID NO: 14987 - DNA, 20 bp, Artificial Sequence
  chemically synthesized
tgtccttgcgatagtttact

SEQ ID NO: 14988 - DNA, 20 bp, Artificial Sequence
  chemically synthesized
cattctcagtaaactatcgc

SEQ ID NO: 14989 - DNA, 20 bp, Artificial Sequence
  chemically synthesized
attctcagtaaactatcgca

SEQ ID NO: 14990 - DNA, 20 bp, Artificial Sequence
  chemically synthesized
ttggttttttgtccttgcga

SEQ ID NO: 14991 - DNA, 20 bp, Artificial Sequence
  chemically synthesized
gagtgagaacatgcggtgtt

SEQ ID NO: 14992 - DNA, 20 bp, Artificial Sequence
  chemically synthesized
cacctatgagtgagaacatg

SEQ ID NO: 14993 - DNA, 20 bp, Artificial Sequence
  chemically synthesized
acaccgcatgttctcactca

SEQ ID NO: 14994 - DNA, 20 bp, Artificial Sequence
  chemically synthesized
caccgcatgttctcactcat

SEQ ID NO: 14995 - DNA, 20 bp, Artificial Sequence
  chemically synthesized
ttccattcccacctatgagt

SEQ ID NO: 14996 - DNA, 20 bp, Artificial Sequence
  chemically synthesized
cgcatgttctcactcatagg

SEQ ID NO: 14997 - DNA, 20 bp, Artificial Sequence
  chemically synthesized
gcatgttctcactcataggt

SEQ ID NO: 14998 - DNA, 20 bp, Artificial Sequence
  chemically synthesized
attgttccattcccacctat

SEQ ID NO: 14999 - DNA, 20 bp, Artificial Sequence
  chemically synthesized
ttctcactcataggtgggaa

SEQ ID NO: 15000 - DNA, 20 bp, Artificial Sequence
  chemically synthesized
ataggtgggaatggaacaat

SEQ ID NO: 15001 - DNA, 20 bp, Artificial Sequence
  chemically synthesized
aatggaacaatgagaacaca

SEQ ID NO: 15002 - DNA, 20 bp, Artificial Sequence
  chemically synthesized
acaatgagaacacatggaca

SEQ ID NO: 15003 - DNA, 20 bp, Artificial Sequence
  chemically synthesized
caatgagaacacatggacat

SEQ ID NO: 15004 - DNA, 20 bp, Artificial Sequence
  chemically synthesized
tgagaacacatggacatagg

SEQ ID NO: 15005 - DNA, 20 bp, Artificial Sequence
  chemically synthesized
gagaacacatggacatagga

SEQ ID NO: 15006 - DNA, 20 bp, Artificial Sequence
  chemically synthesized
agaacacatggacataggaa

SEQ ID NO: 15007 - DNA, 20 bp, Artificial Sequence
  chemically synthesized
gaacacatggacataggaag

SEQ ID NO: 15008 - DNA, 20 bp, Artificial Sequence
  chemically synthesized
ggaaggggaacatcacactc

SEQ ID NO: 15009 - DNA, 20 bp, Artificial Sequence
  chemically synthesized
gaaggggaacatcacactct

SEQ ID NO: 15010 - DNA, 20 bp, Artificial Sequence
  chemically synthesized
aaggggaacatcacactctg

SEQ ID NO: 15011 - DNA, 20 bp, Artificial Sequence
  chemically synthesized
ccaccccacaacagtcccca

SEQ ID NO: 15012 - DNA, 20 bp, Artificial Sequence
  chemically synthesized
ccccaccccacaacagtccc

SEQ ID NO: 15013 - DNA, 20 bp, Artificial Sequence
  chemically synthesized
tcacactctggggactgttg

SEQ ID NO: 15014 - DNA, 20 bp, Artificial Sequence
  chemically synthesized
cacactctggggactgttgt

SEQ ID NO: 15015 - DNA, 20 bp, Artificial Sequence
  chemically synthesized
acactctggggactgttgtg

SEQ ID NO: 15016 - DNA, 20 bp, Artificial Sequence
  chemically synthesized
cccctccccccaccccacaa

SEQ ID NO: 15017 - DNA, 20 bp, Artificial Sequence
  chemically synthesized
ctctggggactgttgtgggg

SEQ ID NO: 15018 - DNA, 20 bp, Artificial Sequence
  chemically synthesized
tctggggactgttgtggggt

SEQ ID NO: 15019 - DNA, 20 bp, Artificial Sequence
  chemically synthesized
ctggggactgttgtggggtg

SEQ ID NO: 15020 - DNA, 20 bp, Artificial Sequence
  chemically synthesized
tggggactgttgtggggtgg

SEQ ID NO: 15021 - DNA, 20 bp, Artificial Sequence
  chemically synthesized
ggggactgttgtggggtggg

SEQ ID NO: 15022 - DNA, 20 bp, Artificial Sequence
  chemically synthesized
ggactgttgtggggtggggg

SEQ ID NO: 15023 - DNA, 20 bp, Artificial Sequence
  chemically synthesized
gactgttgtggggtgggggg

SEQ ID NO: 15024 - DNA, 20 bp, Artificial Sequence
  chemically synthesized
actgttgtggggtgggggga

SEQ ID NO: 15025 - DNA, 20 bp, Artificial Sequence
  chemically synthesized
ctgttgtggggtggggggag

SEQ ID NO: 15026 - DNA, 20 bp, Artificial Sequence
  chemically synthesized
tgttgtggggtggggggagg

SEQ ID NO: 15027 - DNA, 20 bp, Artificial Sequence
  chemically synthesized
gttgtggggtggggggaggg

SEQ ID NO: 15028 - DNA, 20 bp, Artificial Sequence
  chemically synthesized
tgtggggtggggggaggggg

SEQ ID NO: 15029 - DNA, 20 bp, Artificial Sequence
  chemically synthesized
gtggggtggggggagggggg

SEQ ID NO: 15030 - DNA, 20 bp, Artificial Sequence
  chemically synthesized
tggggtggggggagggggga

SEQ ID NO: 15031 - DNA, 20 bp, Artificial Sequence
  chemically synthesized
gtggggggaggggggaggga

SEQ ID NO: 15032 - DNA, 20 bp, Artificial Sequence
  chemically synthesized
ggaggggggagggatagcat

SEQ ID NO: 15033 - DNA, 20 bp, Artificial Sequence
  chemically synthesized
gaggggggagggatagcatt

SEQ ID NO: 15034 - DNA, 20 bp, Artificial Sequence
  chemically synthesized
ggggggagggatagcattag

SEQ ID NO: 15035 - DNA, 20 bp, Artificial Sequence
  chemically synthesized
ttaggagatatacctaatgc

SEQ ID NO: 15036 - DNA, 20 bp, Artificial Sequence
  chemically synthesized
ctaactcgtcatctagcatt

SEQ ID NO: 15037 - DNA, 20 bp, Artificial Sequence
  chemically synthesized
actaactcgtcatctagcat

SEQ ID NO: 15038 - DNA, 20 bp, Artificial Sequence
  chemically synthesized
tatacctaatgctagatgac

SEQ ID NO: 15039 - DNA, 20 bp, Artificial Sequence
  chemically synthesized
gcacccactaactcgtcatc

SEQ ID NO: 15040 - DNA, 20 bp, Artificial Sequence
  chemically synthesized
cctaatgctagatgacgagt

SEQ ID NO: 15041 - DNA, 20 bp, Artificial Sequence
  chemically synthesized
aatgctagatgacgagttag

SEQ ID NO: 15042 - DNA, 20 bp, Artificial Sequence
  chemically synthesized
atgctagatgacgagttagt

SEQ ID NO: 15043 - DNA, 20 bp, Artificial Sequence
  chemically synthesized
agatgacgagttagtgggtg

SEQ ID NO: 15044 - DNA, 20 bp, Artificial Sequence
  chemically synthesized
agttagtgggtgcagcacac

SEQ ID NO: 15045 - DNA, 20 bp, Artificial Sequence
  chemically synthesized
gtgggtgcagcacaccagca

SEQ ID NO: 15046 - DNA, 20 bp, Artificial Sequence
  chemically synthesized
tatgtatacatgtgccatgc

SEQ ID NO: 15047 - DNA, 20 bp, Artificial Sequence
  chemically synthesized
catgtgcacaatgtgcaggt

SEQ ID NO: 15048 - DNA, 20 bp, Artificial Sequence
  chemically synthesized
ggtacatgtgcacaatgtgc

SEQ ID NO: 15049 - DNA, 20 bp, Artificial Sequence
  chemically synthesized
gggtacatgtgcacaatgtg

SEQ ID NO: 15050 - DNA, 20 bp, Artificial Sequence
  chemically synthesized
ttattatactttaagtttta

SEQ ID NO: 15051 - DNA, 20 bp, Artificial Sequence
  chemically synthesized
tttattatactttaagtttt

SEQ ID NO: 15052 - DNA, 20 bp, Artificial Sequence
  chemically synthesized
cacatgtaccctaaaactta

SEQ ID NO: 15053 - DNA, 20 bp, Artificial Sequence
  chemically synthesized
ttttattatactttaagttt

SEQ ID NO: 15054 - DNA, 20 bp, Artificial Sequence
  chemically synthesized
ttttatttttattatacttt

SEQ ID NO: 15055 - DNA, 20 bp, Artificial Sequence
  chemically synthesized
aaaataaaataaaaaaaata

SEQ ID NO: 15056 - DNA, 20 bp, Artificial Sequence
  chemically synthesized
agcacaagatagaaaacaga

SEQ ID NO: 15057 - DNA, 20 bp, Artificial Sequence
  chemically synthesized
aaacagcacaagatagaaaa

SEQ ID NO: 15058 - DNA, 20 bp, Artificial Sequence
  chemically synthesized
atcctagaaacagcacaaga

SEQ ID NO: 15059 - DNA, 20 bp, Artificial Sequence
  chemically synthesized
tcaaatcctagaaacagcac

SEQ ID NO: 15060 - DNA, 20 bp, Artificial Sequence
  chemically synthesized
tttctatcttgtgctgtttc

SEQ ID NO: 15061 - DNA, 20 bp, Artificial Sequence
  chemically synthesized
ttctatcttgtgctgtttct

SEQ ID NO: 15062 - DNA, 20 bp, Artificial Sequence
  chemically synthesized
tctaaatcaaatcctagaaa

SEQ ID NO: 15063 - DNA, 20 bp, Artificial Sequence
  chemically synthesized
aagcagtctaaatcaaatcc

SEQ ID NO: 15064 - DNA, 20 bp, Artificial Sequence
  chemically synthesized
gctgtttctaggatttgatt

SEQ ID NO: 15065 - DNA, 20 bp, Artificial Sequence
  chemically synthesized
aggatttgatttagactgct

SEQ ID NO: 15066 - DNA, 20 bp, Artificial Sequence
  chemically synthesized
ggatttgatttagactgctt

SEQ ID NO: 15067 - DNA, 20 bp, Artificial Sequence
  chemically synthesized
gaagtccagtgaatcctaag

SEQ ID NO: 15068 - DNA, 20 bp, Artificial Sequence
  chemically synthesized
taagaagtccagtgaatcct

SEQ ID NO: 15069 - DNA, 20 bp, Artificial Sequence
  chemically synthesized
ttagactgcttaggattcac

SEQ ID NO: 15070 - DNA, 20 bp, Artificial Sequence
  chemically synthesized
aatcacaggtttaagaagtc

SEQ ID NO: 15071 - DNA, 20 bp, Artificial Sequence
  chemically synthesized
ctctaaatcacaggtttaag

SEQ ID NO: 15072 - DNA, 20 bp, Artificial Sequence
  chemically synthesized
agactctaaatcacaggttt

SEQ ID NO: 15073 - DNA, 20 bp, Artificial Sequence
  chemically synthesized
gacttcttaaacctgtgatt

SEQ ID NO: 15074 - DNA, 20 bp, Artificial Sequence
  chemically synthesized
gattaaagactctaaatcac

SEQ ID NO: 15075 - DNA, 20 bp, Artificial Sequence
  chemically synthesized
cttcttaaacctgtgattta

SEQ ID NO: 15076 - DNA, 20 bp, Artificial Sequence
  chemically synthesized
tgattaaagactctaaatca

SEQ ID NO: 15077 - DNA, 20 bp, Artificial Sequence
  chemically synthesized
tgtgatttagagtctttaat

SEQ ID NO: 15078 - DNA, 20 bp, Artificial Sequence
  chemically synthesized
gaagattccacagctgatta

SEQ ID NO: 15079 - DNA, 20 bp, Artificial Sequence
  chemically synthesized
ttagagtctttaatcagctg

SEQ ID NO: 15080 - DNA, 20 bp, Artificial Sequence
  chemically synthesized
gaatgacggagaagattcca

SEQ ID NO: 15081 - DNA, 20 bp, Artificial Sequence
  chemically synthesized
ttgttgagagaatgacggag

SEQ ID NO: 15082 - DNA, 20 bp, Artificial Sequence
  chemically synthesized
tatttgttgagagaatgacg

SEQ ID NO: 15083 - DNA, 20 bp, Artificial Sequence
  chemically synthesized
actatttgttgagagaatga

SEQ ID NO: 15084 - DNA, 20 bp, Artificial Sequence
  chemically synthesized
gaagaggcactatttgttga

SEQ ID NO: 15085 - DNA, 20 bp, Artificial Sequence
  chemically synthesized
tccgtcattctctcaacaaa

SEQ ID NO: 15086 - DNA, 20 bp, Artificial Sequence
  chemically synthesized
gagaagaggcactatttgtt

SEQ ID NO: 15087 - DNA, 20 bp, Artificial Sequence
  chemically synthesized
atggagagggaatggagaag

SEQ ID NO: 15088 - DNA, 20 bp, Artificial Sequence
  chemically synthesized
aatggagagggaatggagaa

SEQ ID NO: 15089 - DNA, 20 bp, Artificial Sequence
  chemically synthesized
agaatggagagggaatggag

SEQ ID NO: 15090 - DNA, 20 bp, Artificial Sequence
  chemically synthesized
agtagaatggagagggaatg

SEQ ID NO: 15091 - DNA, 20 bp, Artificial Sequence
  chemically synthesized
aaagtagaatggagagggaa

SEQ ID NO: 15092 - DNA, 20 bp, Artificial Sequence
  chemically synthesized
ttctgaaagtagaatggaga

SEQ ID NO: 15093 - DNA, 20 bp, Artificial Sequence
  chemically synthesized
gttctgaaagtagaatggag

SEQ ID NO: 15094 - DNA, 20 bp, Artificial Sequence
  chemically synthesized
agttctgaaagtagaatgga

SEQ ID NO: 15095 - DNA, 20 bp, Artificial Sequence
  chemically synthesized
agagttctgaaagtagaatg

SEQ ID NO: 15096 - DNA, 20 bp, Artificial Sequence
  chemically synthesized
acagagttctgaaagtagaa

SEQ ID NO: 15097 - DNA, 20 bp, Artificial Sequence
  chemically synthesized
ttccctctccattctacttt

SEQ ID NO: 15098 - DNA, 20 bp, Artificial Sequence
  chemically synthesized
atgtaacagagttctgaaag

SEQ ID NO: 15099 - DNA, 20 bp, Artificial Sequence
  chemically synthesized
tttatgtaacagagttctga

SEQ ID NO: 15100 - DNA, 20 bp, Artificial Sequence
  chemically synthesized
agagtaacatttatgtaaca

SEQ ID NO: 15101 - DNA, 20 bp, Artificial Sequence
  chemically synthesized
gaagagtaacatttatgtaa

SEQ ID NO: 15102 - DNA, 20 bp, Artificial Sequence
  chemically synthesized
gagaaatatagattgaagaa

SEQ ID NO: 15103 - DNA, 20 bp, Artificial Sequence
  chemically synthesized
cagagaaatatagattgaag

SEQ ID NO: 15104 - DNA, 20 bp, Artificial Sequence
  chemically synthesized
gttcagagaaatatagattg

SEQ ID NO: 15105 - DNA, 20 bp, Artificial Sequence
  chemically synthesized
aagtcctgttcagagaaata

SEQ ID NO: 15106 - DNA, 20 bp, Artificial Sequence
  chemically synthesized
tcaatctatatttctctgaa

SEQ ID NO: 15107 - DNA, 20 bp, Artificial Sequence
  chemically synthesized
caatctatatttctctgaac

SEQ ID NO: 15108 - DNA, 20 bp, Artificial Sequence
  chemically synthesized
aactagggaagtcctgttca

SEQ ID NO: 15109 - DNA, 20 bp, Artificial Sequence
  chemically synthesized
ggaactagggaagtcctgtt

SEQ ID NO: 15110 - DNA, 20 bp, Artificial Sequence
  chemically synthesized
ttctctgaacaggacttccc

SEQ ID NO: 15111 - DNA, 20 bp, Artificial Sequence
  chemically synthesized
cagagaggggggaactaggg

SEQ ID NO: 15112 - DNA, 20 bp, Artificial Sequence
  chemically synthesized
gggcagagaggggggaacta

SEQ ID NO: 15113 - DNA, 20 bp, Artificial Sequence
  chemically synthesized
ggggcagagaggggggaact

SEQ ID NO: 15114 - DNA, 20 bp, Artificial Sequence
  chemically synthesized
tggggcagagaggggggaac

SEQ ID NO: 15115 - DNA, 20 bp, Artificial Sequence
  chemically synthesized
aagatgtggggcagagaggg

SEQ ID NO: 15116 - DNA, 20 bp, Artificial Sequence
  chemically synthesized
aaagatgtggggcagagagg

SEQ ID NO: 15117 - DNA, 20 bp, Artificial Sequence
  chemically synthesized
aaaagatgtggggcagagag

SEQ ID NO: 15118 - DNA, 20 bp, Artificial Sequence
  chemically synthesized
aaaaagatgtggggcagaga

SEQ ID NO: 15119 - DNA, 20 bp, Artificial Sequence
  chemically synthesized
taaaaagatgtggggcagag

SEQ ID NO: 15120 - DNA, 20 bp, Artificial Sequence
  chemically synthesized
ttaaaaagatgtggggcaga

SEQ ID NO: 15121 - DNA, 20 bp, Artificial Sequence
  chemically synthesized
ttttaaaaagatgtggggca

SEQ ID NO: 15122 - DNA, 20 bp, Artificial Sequence
  chemically synthesized
tgttttaaaaagatgtgggg

SEQ ID NO: 15123 - DNA, 20 bp, Artificial Sequence
  chemically synthesized
ggatgttttaaaaagatgtg

SEQ ID NO: 15124 - DNA, 20 bp, Artificial Sequence
  chemically synthesized
aggatgttttaaaaagatgt

SEQ ID NO: 15125 - DNA, 20 bp, Artificial Sequence
  chemically synthesized
aaggatgttttaaaaagatg

SEQ ID NO: 15126 - DNA, 20 bp, Artificial Sequence
  chemically synthesized
gcacagaaggatgttttaaa

SEQ ID NO: 15127 - DNA, 20 bp, Artificial Sequence
  chemically synthesized
taataagaatgaagcacaga

SEQ ID NO: 15128 - DNA, 20 bp, Artificial Sequence
  chemically synthesized
ttaataagaatgaagcacag

SEQ ID NO: 15129 - DNA, 20 bp, Artificial Sequence
  chemically synthesized
gaattaataagaatgaagca

SEQ ID NO: 15130 - DNA, 20 bp, Artificial Sequence
  chemically synthesized
agaaggaattaataagaatg

SEQ ID NO: 15131 - DNA, 20 bp, Artificial Sequence
  chemically synthesized
gtaaggcagaaggaattaat

SEQ ID NO: 15132 - DNA, 20 bp, Artificial Sequence
  chemically synthesized
tacccagacagtaaggcaga

SEQ ID NO: 15133 - DNA, 20 bp, Artificial Sequence
  chemically synthesized
atacccagacagtaaggcag

SEQ ID NO: 15134 - DNA, 20 bp, Artificial Sequence
  chemically synthesized
tggatacccagacagtaagg

SEQ ID NO: 15135 - DNA, 20 bp, Artificial Sequence
  chemically synthesized
attccttctgccttactgtc

SEQ ID NO: 15136 - DNA, 20 bp, Artificial Sequence
  chemically synthesized
aaatggatacccagacagta

SEQ ID NO: 15137 - DNA, 20 bp, Artificial Sequence
  chemically synthesized
ttccttctgccttactgtct

SEQ ID NO: 15138 - DNA, 20 bp, Artificial Sequence
  chemically synthesized
gaaatggatacccagacagt

SEQ ID NO: 15139 - DNA, 20 bp, Artificial Sequence
  chemically synthesized
aagagaaatggatacccaga

SEQ ID NO: 15140 - DNA, 20 bp, Artificial Sequence
  chemically synthesized
cggcaagagaaatggatacc

SEQ ID NO: 15141 - DNA, 20 bp, Artificial Sequence
  chemically synthesized
cagcagaccggcaagagaaa

SEQ ID NO: 15142 - DNA, 20 bp, Artificial Sequence
  chemically synthesized
tgggtatccatttctcttgc

SEQ ID NO: 15143 - DNA, 20 bp, Artificial Sequence
  chemically synthesized
ggtttacagcagaccggcaa

SEQ ID NO: 15144 - DNA, 20 bp, Artificial Sequence
  chemically synthesized
tgggtttacagcagaccggc

SEQ ID NO: 15145 - DNA, 20 bp, Artificial Sequence
  chemically synthesized
tgtatgggtttacagcagac

SEQ ID NO: 15146 - DNA, 20 bp, Artificial Sequence
  chemically synthesized
aaaactgtatgggtttacag

SEQ ID NO: 15147 - DNA, 20 bp, Artificial Sequence
  chemically synthesized
tttaaaactgtatgggttta

SEQ ID NO: 15148 - DNA, 20 bp, Artificial Sequence
  chemically synthesized
cggtctgctgtaaacccata

SEQ ID NO: 15149 - DNA, 20 bp, Artificial Sequence
  chemically synthesized
atcaaaatttaaaactgtat

SEQ ID NO: 15150 - DNA, 20 bp, Artificial Sequence
  chemically synthesized
aatcaaaatttaaaactgta

SEQ ID NO: 15151 - DNA, 20 bp, Artificial Sequence
  chemically synthesized
gtagtatttctagatgtcaa

SEQ ID NO: 15152 - DNA, 20 bp, Artificial Sequence
  chemically synthesized
attattgtacttttgacatc

SEQ ID NO: 15153 - DNA, 20 bp, Artificial Sequence
  chemically synthesized
aaatgaccaagtagtatttc

SEQ ID NO: 15154 - DNA, 20 bp, Artificial Sequence
  chemically synthesized
tgacatctagaaatactact

SEQ ID NO: 15155 - DNA, 20 bp, Artificial Sequence
  chemically synthesized
ttaccttaaaaatgaccaag

SEQ ID NO: 15156 - DNA, 20 bp, Artificial Sequence
  chemically synthesized
aagttaccttaaaaatgacc

SEQ ID NO: 15157 - DNA, 20 bp, Artificial Sequence
  chemically synthesized
aatactacttggtcattttt

SEQ ID NO: 15158 - DNA, 20 bp, Artificial Sequence
  chemically synthesized
atactacttggtcattttta

SEQ ID NO: 15159 - DNA, 20 bp, Artificial Sequence
  chemically synthesized
tcatttttaaggtaacttct

SEQ ID NO: 15160 - DNA, 20 bp, Artificial Sequence
  chemically synthesized
catttttaaggtaacttctc

SEQ ID NO: 15161 - DNA, 20 bp, Artificial Sequence
  chemically synthesized
cagggaaccacaaacctgag

SEQ ID NO: 15162 - DNA, 20 bp, Artificial Sequence
  chemically synthesized
aaggtaacttctcaggtttg

SEQ ID NO: 15163 - DNA, 20 bp, Artificial Sequence
  chemically synthesized
ctacagggaaccacaaacct

SEQ ID NO: 15164 - DNA, 20 bp, Artificial Sequence
  chemically synthesized
ctcaggtttgtggttccctg

SEQ ID NO: 15165 - DNA, 20 bp, Artificial Sequence
  chemically synthesized
aacattgaaaaatatctaca

SEQ ID NO: 15166 - DNA, 20 bp, Artificial Sequence
  chemically synthesized
caacattgaaaaatatctac

SEQ ID NO: 15167 - DNA, 20 bp, Artificial Sequence
  chemically synthesized
acaacattgaaaaatatcta

SEQ ID NO: 15168 - DNA, 20 bp, Artificial Sequence
  chemically synthesized
cttaattgtgtttatgcagt

SEQ ID NO: 15169 - DNA, 20 bp, Artificial Sequence
  chemically synthesized
ttttcttaattgtgtttatg

SEQ ID NO: 15170 - DNA, 20 bp, Artificial Sequence
  chemically synthesized
ctaactgcataaacacaatt

SEQ ID NO: 15171 - DNA, 20 bp, Artificial Sequence
  chemically synthesized
catattccagaattattaga

SEQ ID NO: 15172 - DNA, 20 bp, Artificial Sequence
  chemically synthesized
aataatctgtctaataattc

SEQ ID NO: 15173 - DNA, 20 bp, Artificial Sequence
  chemically synthesized
acatcatattccagaattat

SEQ ID NO: 15174 - DNA, 20 bp, Artificial Sequence
  chemically synthesized
cctacgataacatcatattc

SEQ ID NO: 15175 - DNA, 20 bp, Artificial Sequence
  chemically synthesized
tctggaatatgatgttatcg

SEQ ID NO: 15176 - DNA, 20 bp, Artificial Sequence
  chemically synthesized
ctggaatatgatgttatcgt

SEQ ID NO: 15177 - DNA, 20 bp, Artificial Sequence
  chemically synthesized
ttatcgtaggtctgcttcta

SEQ ID NO: 15178 - DNA, 20 bp, Artificial Sequence
  chemically synthesized
gaaatagcaaaccatagaag

SEQ ID NO: 15179 - DNA, 20 bp, Artificial Sequence
  chemically synthesized
gaagaaatagcaaaccatag

SEQ ID NO: 15180 - DNA, 20 bp, Artificial Sequence
  chemically synthesized
ccagaagaaatagcaaacca

SEQ ID NO: 15181 - DNA, 20 bp, Artificial Sequence
  chemically synthesized
ctatggtttgctatttcttc

SEQ ID NO: 15182 - DNA, 20 bp, Artificial Sequence
  chemically synthesized
tgaatgagaaccagaagaaa

SEQ ID NO: 15183 - DNA, 20 bp, Artificial Sequence
  chemically synthesized
tcaaggtgaatgagaaccag

SEQ ID NO: 15184 - DNA, 20 bp, Artificial Sequence
  chemically synthesized
aaatcaaggtgaatgagaac

SEQ ID NO: 15185 - DNA, 20 bp, Artificial Sequence
  chemically synthesized
agaaagaaatcaaggtgaat

SEQ ID NO: 15186 - DNA, 20 bp, Artificial Sequence
  chemically synthesized
gtggaaaaagaaagaaatca

SEQ ID NO: 15187 - DNA, 20 bp, Artificial Sequence
  chemically synthesized
ggtggaaaaagaaagaaatc

SEQ ID NO: 15188 - DNA, 20 bp, Artificial Sequence
  chemically synthesized
gaaatcaaggtggaaaaaga

SEQ ID NO: 15189 - DNA, 20 bp, Artificial Sequence
  chemically synthesized
acaagaaatcaaggtggaaa

SEQ ID NO: 15190 - DNA, 20 bp, Artificial Sequence
  chemically synthesized
aagcacacaagaaatcaagg

SEQ ID NO: 15191 - DNA, 20 bp, Artificial Sequence
  chemically synthesized
attaagcacacaagaaatca

SEQ ID NO: 15192 - DNA, 20 bp, Artificial Sequence
  chemically synthesized
tattaagcacacaagaaatc

SEQ ID NO: 15193 - DNA, 20 bp, Artificial Sequence
  chemically synthesized
aaaaaacatattaagcacac

SEQ ID NO: 15194 - DNA, 20 bp, Artificial Sequence
  chemically synthesized
aaaaaaacaaaaaacatatt

SEQ ID NO: 15195 - DNA, 20 bp, Artificial Sequence
  chemically synthesized
ggtaaggtcagtttagtacg

SEQ ID NO: 15196 - DNA, 20 bp, Artificial Sequence
  chemically synthesized
aaatattggtaaggtcagtt

SEQ ID NO: 15197 - DNA, 20 bp, Artificial Sequence
  chemically synthesized
ctagaaaatattggtaaggt

SEQ ID NO: 15198 - DNA, 20 bp, Artificial Sequence
  chemically synthesized
atctctagaaaatattggta

SEQ ID NO: 15199 - DNA, 20 bp, Artificial Sequence
  chemically synthesized
tatctctagaaaatattggt

SEQ ID NO: 15200 - DNA, 20 bp, Artificial Sequence
  chemically synthesized
tatttatctctagaaaatat

SEQ ID NO: 15201 - DNA, 20 bp, Artificial Sequence
  chemically synthesized
ctgaccttaccaatattttc

SEQ ID NO: 15202 - DNA, 20 bp, Artificial Sequence
  chemically synthesized
gaccttaccaatattttcta

SEQ ID NO: 15203 - DNA, 20 bp, Artificial Sequence
  chemically synthesized
ctcaagcttttatttatctc

SEQ ID NO: 15204 - DNA, 20 bp, Artificial Sequence
  chemically synthesized
tattttctagagataaataa

SEQ ID NO: 15205 - DNA, 20 bp, Artificial Sequence
  chemically synthesized
ctagagataaataaaagctt

SEQ ID NO: 15206 - DNA, 20 bp, Artificial Sequence
  chemically synthesized
gataaataaaagcttgagcc

SEQ ID NO: 15207 - DNA, 20 bp, Artificial Sequence
  chemically synthesized
agcacttttattctaggctc

SEQ ID NO: 15208 - DNA, 20 bp, Artificial Sequence
  chemically synthesized
aaagcttgagcctagaataa

SEQ ID NO: 15209 - DNA, 20 bp, Artificial Sequence
  chemically synthesized
ggagaaagcacttttattct

SEQ ID NO: 15210 - DNA, 20 bp, Artificial Sequence
  chemically synthesized
tggagaaagcacttttattc

SEQ ID NO: 15211 - DNA, 20 bp, Artificial Sequence
  chemically synthesized
tagaataaaagtgctttctc

SEQ ID NO: 15212 - DNA, 20 bp, Artificial Sequence
  chemically synthesized
gaataaaagtgctttctcca

SEQ ID NO: 15213 - DNA, 20 bp, Artificial Sequence
  chemically synthesized
aggagaatcatctctggaga

SEQ ID NO: 15214 - DNA, 20 bp, Artificial Sequence
  chemically synthesized
gcaaaggagaatcatctctg

SEQ ID NO: 15215 - DNA, 20 bp, Artificial Sequence
  chemically synthesized
aagcaaaggagaatcatctc

SEQ ID NO: 15216 - DNA, 20 bp, Artificial Sequence
  chemically synthesized
ggttcttggcaaaagcaaag

SEQ ID NO: 15217 - DNA, 20 bp, Artificial Sequence
  chemically synthesized
ttggttcttggcaaaagcaa

SEQ ID NO: 15218 - DNA, 20 bp, Artificial Sequence
  chemically synthesized
cttggttcttggcaaaagca

SEQ ID NO: 15219 - DNA, 20 bp, Artificial Sequence
  chemically synthesized
gattctcctttgcttttgcc

SEQ ID NO: 15220 - DNA, 20 bp, Artificial Sequence
  chemically synthesized
tgcttcttggttcttggcaa

SEQ ID NO: 15221 - DNA, 20 bp, Artificial Sequence
  chemically synthesized
ctttgcttttgccaagaacc

SEQ ID NO: 15222 - DNA, 20 bp, Artificial Sequence
  chemically synthesized
aagtaatgcttcttggttct

SEQ ID NO: 15223 - DNA, 20 bp, Artificial Sequence
  chemically synthesized
tgcttttgccaagaaccaag

SEQ ID NO: 15224 - DNA, 20 bp, Artificial Sequence
  chemically synthesized
gtggaataagtaatgcttct

SEQ ID NO: 15225 - DNA, 20 bp, Artificial Sequence
  chemically synthesized
aagaagcattacttattcca

SEQ ID NO: 15226 - DNA, 20 bp, Artificial Sequence
  chemically synthesized
actgaaattggctgtggaat

SEQ ID NO: 15227 - DNA, 20 bp, Artificial Sequence
  chemically synthesized
tattcaactgaaattggctg

SEQ ID NO: 15228 - DNA, 20 bp, Artificial Sequence
  chemically synthesized
acttattccacagccaattt

SEQ ID NO: 15229 - DNA, 20 bp, Artificial Sequence
  chemically synthesized
gtcatatattcaactgaaat

SEQ ID NO: 15230 - DNA, 20 bp, Artificial Sequence
  chemically synthesized
tttcagttgaatatatgaca

SEQ ID NO: 15231 - DNA, 20 bp, Artificial Sequence
  chemically synthesized
ttcagttgaatatatgacat

SEQ ID NO: 15232 - DNA, 20 bp, Artificial Sequence
  chemically synthesized
atatatgacatgggaatact

SEQ ID NO: 15233 - DNA, 20 bp, Artificial Sequence
  chemically synthesized
cccatgacttgtgtgatact

SEQ ID NO: 15234 - DNA, 20 bp, Artificial Sequence
  chemically synthesized
gggaatacttagtatcacac

SEQ ID NO: 15235 - DNA, 20 bp, Artificial Sequence
  chemically synthesized
acttagtatcacacaagtca

SEQ ID NO: 15236 - DNA, 20 bp, Artificial Sequence
  chemically synthesized
cttagtatcacacaagtcat

SEQ ID NO: 15237 - DNA, 20 bp, Artificial Sequence
  chemically synthesized
cacacaagtcatgggtattt

SEQ ID NO: 15238 - DNA, 20 bp, Artificial Sequence
  chemically synthesized
tcatgggtatttgagctgca

SEQ ID NO: 15239 - DNA, 20 bp, Artificial Sequence
  chemically synthesized
ggtatttgagctgcaaagcc

SEQ ID NO: 15240 - DNA, 20 bp, Artificial Sequence
  chemically synthesized
agagaagcaacttggctttg

SEQ ID NO: 15241 - DNA, 20 bp, Artificial Sequence
  chemically synthesized
acattacaagagaagcaact

SEQ ID NO: 15242 - DNA, 20 bp, Artificial Sequence
  chemically synthesized
aggaaaccacattacaagag

SEQ ID NO: 15243 - DNA, 20 bp, Artificial Sequence
  chemically synthesized
attaggaaaccacattacaa

SEQ ID NO: 15244 - DNA, 20 bp, Artificial Sequence
  chemically synthesized
aagttgcttctcttgtaatg

SEQ ID NO: 15245 - DNA, 20 bp, Artificial Sequence
  chemically synthesized
ttattaggaaaccacattac

SEQ ID NO: 15246 - DNA, 20 bp, Artificial Sequence
  chemically synthesized
tgtaatgtggtttcctaata

SEQ ID NO: 15247 - DNA, 20 bp, Artificial Sequence
  chemically synthesized
gtaatgtggtttcctaataa

SEQ ID NO: 15248 - DNA, 20 bp, Artificial Sequence
  chemically synthesized
atgtggatatgtcctttatt

SEQ ID NO: 15249 - DNA, 20 bp, Artificial Sequence
  chemically synthesized
aatgtggatatgtcctttat

SEQ ID NO: 15250 - DNA, 20 bp, Artificial Sequence
  chemically synthesized
taaaggacatatccacattt

SEQ ID NO: 15251 - DNA, 20 bp, Artificial Sequence
  chemically synthesized
ctgcctttctatctgaaatg

SEQ ID NO: 15252 - DNA, 20 bp, Artificial Sequence
  chemically synthesized
ggacatatccacatttcaga

SEQ ID NO: 15253 - DNA, 20 bp, Artificial Sequence
  chemically synthesized
atatccacatttcagataga

SEQ ID NO: 15254 - DNA, 20 bp, Artificial Sequence
  chemically synthesized
tatccacatttcagatagaa

SEQ ID NO: 15255 - DNA, 20 bp, Artificial Sequence
  chemically synthesized
ccacatttcagatagaaagg

SEQ ID NO: 15256 - DNA, 20 bp, Artificial Sequence
  chemically synthesized
cacatttcagatagaaaggc

SEQ ID NO: 15257 - DNA, 20 bp, Artificial Sequence
  chemically synthesized
catttcagatagaaaggcag

SEQ ID NO: 15258 - DNA, 20 bp, Artificial Sequence
  chemically synthesized
atttcagatagaaaggcagg

SEQ ID NO: 15259 - DNA, 20 bp, Artificial Sequence
  chemically synthesized
tttcagatagaaaggcagga

SEQ ID NO: 15260 - DNA, 20 bp, Artificial Sequence
  chemically synthesized
gatagaaaggcaggagggtt

SEQ ID NO: 15261 - DNA, 20 bp, Artificial Sequence
  chemically synthesized
ggcaggagggtttagactga

SEQ ID NO: 15262 - DNA, 20 bp, Artificial Sequence
  chemically synthesized
gcaggagggtttagactgac

SEQ ID NO: 15263 - DNA, 20 bp, Artificial Sequence
  chemically synthesized
ttataagccaaatgacctgt

SEQ ID NO: 15264 - DNA, 20 bp, Artificial Sequence
  chemically synthesized
gtttagactgacaggtcatt

SEQ ID NO: 15265 - DNA, 20 bp, Artificial Sequence
  chemically synthesized
gttgaggtgatcagtgttat

SEQ ID NO: 15266 - DNA, 20 bp, Artificial Sequence
  chemically synthesized
tggagtgctgttgaggtgat

SEQ ID NO: 15267 - DNA, 20 bp, Artificial Sequence
  chemically synthesized
tataacactgatcacctcaa

SEQ ID NO: 15268 - DNA, 20 bp, Artificial Sequence
  chemically synthesized
taatgactggagtgctgttg

SEQ ID NO: 15269 - DNA, 20 bp, Artificial Sequence
  chemically synthesized
gtaatgactggagtgctgtt

SEQ ID NO: 15270 - DNA, 20 bp, Artificial Sequence
  chemically synthesized
tgatcacctcaacagcactc

SEQ ID NO: 15271 - DNA, 20 bp, Artificial Sequence
  chemically synthesized
agaattaggggtaatgactg

SEQ ID NO: 15272 - DNA, 20 bp, Artificial Sequence
  chemically synthesized
ttagaattaggggtaatgac

SEQ ID NO: 15273 - DNA, 20 bp, Artificial Sequence
  chemically synthesized
gttgctaaatttagaattag

SEQ ID NO: 15274 - DNA, 20 bp, Artificial Sequence
  chemically synthesized
tgttgctaaatttagaatta

SEQ ID NO: 15275 - DNA, 20 bp, Artificial Sequence
  chemically synthesized
gtgttgctaaatttagaatt

SEQ ID NO: 15276 - DNA, 20 bp, Artificial Sequence
  chemically synthesized
agtgttgctaaatttagaat

SEQ ID NO: 15277 - DNA, 20 bp, Artificial Sequence
  chemically synthesized
attacccctaattctaaatt

SEQ ID NO: 15278 - DNA, 20 bp, Artificial Sequence
  chemically synthesized
tattatagtgttgctaaatt

SEQ ID NO: 15279 - DNA, 20 bp, Artificial Sequence
  chemically synthesized
caaagttaaacagtttatta

SEQ ID NO: 15280 - DNA, 20 bp, Artificial Sequence
  chemically synthesized
ctaggaaatccaaagttaaa

SEQ ID NO: 15281 - DNA, 20 bp, Artificial Sequence
  chemically synthesized
tataataaactgtttaactt

SEQ ID NO: 15282 - DNA, 20 bp, Artificial Sequence
  chemically synthesized
ttttgcagctaggaaatcca

SEQ ID NO: 15283 - DNA, 20 bp, Artificial Sequence
  chemically synthesized
ctgtttaactttggatttcc

SEQ ID NO: 15284 - DNA, 20 bp, Artificial Sequence
  chemically synthesized
actgataccattttgcagct

SEQ ID NO: 15285 - DNA, 20 bp, Artificial Sequence
  chemically synthesized
aactgataccattttgcagc

SEQ ID NO: 15286 - DNA, 20 bp, Artificial Sequence
  chemically synthesized
tggatttcctagctgcaaaa

SEQ ID NO: 15287 - DNA, 20 bp, Artificial Sequence
  chemically synthesized
tttgaactgataccattttg

SEQ ID NO: 15288 - DNA, 20 bp, Artificial Sequence
  chemically synthesized
tcctagctgcaaaatggtat

SEQ ID NO: 15289 - DNA, 20 bp, Artificial Sequence
  chemically synthesized
aaacagtagcatttgatcgg

SEQ ID NO: 15290 - DNA, 20 bp, Artificial Sequence
  chemically synthesized
ggtaaacagtagcatttgat

SEQ ID NO: 15291 - DNA, 20 bp, Artificial Sequence
  chemically synthesized
tctaggtctttggtaaacag

SEQ ID NO: 15292 - DNA, 20 bp, Artificial Sequence
  chemically synthesized
tcaaatgctactgtttacca

SEQ ID NO: 15293 - DNA, 20 bp, Artificial Sequence
  chemically synthesized
gattctaggtctttggtaaa

SEQ ID NO: 15294 - DNA, 20 bp, Artificial Sequence
  chemically synthesized
gctactgtttaccaaagacc

SEQ ID NO: 15295 - DNA, 20 bp, Artificial Sequence
  chemically synthesized
ttagattgattctaggtctt

SEQ ID NO: 15296 - DNA, 20 bp, Artificial Sequence
  chemically synthesized
tgggcatttagattgattct

SEQ ID NO: 15297 - DNA, 20 bp, Artificial Sequence
  chemically synthesized
gtgggcatttagattgattc

SEQ ID NO: 15298 - DNA, 20 bp, Artificial Sequence
  chemically synthesized
gtcttccattggtgggcatt

SEQ ID NO: 15299 - DNA, 20 bp, Artificial Sequence
  chemically synthesized
tcaatctaaatgcccaccaa

SEQ ID NO: 15300 - DNA, 20 bp, Artificial Sequence
  chemically synthesized
ttattcagtcttccattggt

SEQ ID NO: 15301 - DNA, 20 bp, Artificial Sequence
  chemically synthesized
atctaaatgcccaccaatgg

SEQ ID NO: 15302 - DNA, 20 bp, Artificial Sequence
  chemically synthesized
tttattcagtcttccattgg

SEQ ID NO: 15303 - DNA, 20 bp, Artificial Sequence
  chemically synthesized
ttctttattcagtcttccat

SEQ ID NO: 15304 - DNA, 20 bp, Artificial Sequence
  chemically synthesized
caccaatggaagactgaata

SEQ ID NO: 15305 - DNA, 20 bp, Artificial Sequence
  chemically synthesized
tgtaccacgttttctttatt

SEQ ID NO: 15306 - DNA, 20 bp, Artificial Sequence
  chemically synthesized
aagactgaataaagaaaacg

SEQ ID NO: 15307 - DNA, 20 bp, Artificial Sequence
  chemically synthesized
aacgtggtacatatacaccc

SEQ ID NO: 15308 - DNA, 20 bp, Artificial Sequence
  chemically synthesized
tctggctccggagtattcca

SEQ ID NO: 15309 - DNA, 20 bp, Artificial Sequence
  chemically synthesized
ttctggctccggagtattcc

SEQ ID NO: 15310 - DNA, 20 bp, Artificial Sequence
  chemically synthesized
tttctggctccggagtattc

SEQ ID NO: 15311 - DNA, 20 bp, Artificial Sequence
  chemically synthesized
atatacaccctggaatactc

SEQ ID NO: 15312 - DNA, 20 bp, Artificial Sequence
  chemically synthesized
atacaccctggaatactccg

SEQ ID NO: 15313 - DNA, 20 bp, Artificial Sequence
  chemically synthesized
accctggaatactccggagc

SEQ ID NO: 15314 - DNA, 20 bp, Artificial Sequence
  chemically synthesized
cattcttttttctggctccg

SEQ ID NO: 15315 - DNA, 20 bp, Artificial Sequence
  chemically synthesized
ctcattcttttttctggctc

SEQ ID NO: 15316 - DNA, 20 bp, Artificial Sequence
  chemically synthesized
aatactccggagccagaaaa

SEQ ID NO: 15317 - DNA, 20 bp, Artificial Sequence
  chemically synthesized
catgatctcattcttttttc

SEQ ID NO: 15318 - DNA, 20 bp, Artificial Sequence
  chemically synthesized
ccggagccagaaaaaagaat

SEQ ID NO: 15319 - DNA, 20 bp, Artificial Sequence
  chemically synthesized
gaatgagatcatgttctttg

SEQ ID NO: 15320 - DNA, 20 bp, Artificial Sequence
  chemically synthesized
aatgagatcatgttctttgc

SEQ ID NO: 15321 - DNA, 20 bp, Artificial Sequence
  chemically synthesized
gctccatccatgttcctgca

SEQ ID NO: 15322 - DNA, 20 bp, Artificial Sequence
  chemically synthesized
tcatgttctttgcaggaaca

SEQ ID NO: 15323 - DNA, 20 bp, Artificial Sequence
  chemically synthesized
gttctttgcaggaacatgga

SEQ ID NO: 15324 - DNA, 20 bp, Artificial Sequence
  chemically synthesized
tctttgcaggaacatggatg

SEQ ID NO: 15325 - DNA, 20 bp, Artificial Sequence
  chemically synthesized
tgcaggaacatggatggagc

SEQ ID NO: 15326 - DNA, 20 bp, Artificial Sequence
  chemically synthesized
caggaacatggatggagctg

SEQ ID NO: 15327 - DNA, 20 bp, Artificial Sequence
  chemically synthesized
aggaacatggatggagctgg

SEQ ID NO: 15328 - DNA, 20 bp, Artificial Sequence
  chemically synthesized
ttgctaaggataatggcctc

SEQ ID NO: 15329 - DNA, 20 bp, Artificial Sequence
  chemically synthesized
gagctggaggccattatcct

SEQ ID NO: 15330 - DNA, 20 bp, Artificial Sequence
  chemically synthesized
cattagtttgctaaggataa

SEQ ID NO: 15331 - DNA, 20 bp, Artificial Sequence
  chemically synthesized
gttcctgcattagtttgcta

SEQ ID NO: 15332 - DNA, 20 bp, Artificial Sequence
  chemically synthesized
tgttcctgcattagtttgct

SEQ ID NO: 15333 - DNA, 20 bp, Artificial Sequence
  chemically synthesized
ttatccttagcaaactaatg

SEQ ID NO: 15334 - DNA, 20 bp, Artificial Sequence
  chemically synthesized
tatccttagcaaactaatgc

SEQ ID NO: 15335 - DNA, 20 bp, Artificial Sequence
  chemically synthesized
ttggttttctgttcctgcat

SEQ ID NO: 15336 - DNA, 20 bp, Artificial Sequence
  chemically synthesized
ttagcaaactaatgcaggaa

SEQ ID NO: 15337 - DNA, 20 bp, Artificial Sequence
  chemically synthesized
taatgcaggaacagaaaacc

SEQ ID NO: 15338 - DNA, 20 bp, Artificial Sequence
  chemically synthesized
aagtgaaaacatgcaatact

SEQ ID NO: 15339 - DNA, 20 bp, Artificial Sequence
  chemically synthesized
tattgcatgttttcacttat

SEQ ID NO: 15340 - DNA, 20 bp, Artificial Sequence
  chemically synthesized
tgcatgttttcacttataag

SEQ ID NO: 15341 - DNA, 20 bp, Artificial Sequence
  chemically synthesized
gcatgttttcacttataagt

SEQ ID NO: 15342 - DNA, 20 bp, Artificial Sequence
  chemically synthesized
atcatttaactcccacttat

SEQ ID NO: 15343 - DNA, 20 bp, Artificial Sequence
  chemically synthesized
atgttttcacttataagtgg

SEQ ID NO: 15344 - DNA, 20 bp, Artificial Sequence
  chemically synthesized
ataagtgggagttaaatgat

SEQ ID NO: 15345 - DNA, 20 bp, Artificial Sequence
  chemically synthesized
agttaaatgatgagaacaca

SEQ ID NO: 15346 - DNA, 20 bp, Artificial Sequence
  chemically synthesized
gttaaatgatgagaacacat

SEQ ID NO: 15347 - DNA, 20 bp, Artificial Sequence
  chemically synthesized
aaatgatgagaacacatggg

SEQ ID NO: 15348 - DNA, 20 bp, Artificial Sequence
  chemically synthesized
gatgagaacacatgggcaga

SEQ ID NO: 15349 - DNA, 20 bp, Artificial Sequence
  chemically synthesized
tgagaacacatgggcagata

SEQ ID NO: 15350 - DNA, 20 bp, Artificial Sequence
  chemically synthesized
gagaacacatgggcagatag

SEQ ID NO: 15351 - DNA, 20 bp, Artificial Sequence
  chemically synthesized
agaacacatgggcagataga

SEQ ID NO: 15352 - DNA, 20 bp, Artificial Sequence
  chemically synthesized
gaacacatgggcagatagag

SEQ ID NO: 15353 - DNA, 20 bp, Artificial Sequence
  chemically synthesized
gaggggaaaaacacacactg

SEQ ID NO: 15354 - DNA, 20 bp, Artificial Sequence
  chemically synthesized
ctccatcctctgataagcca

SEQ ID NO: 15355 - DNA, 20 bp, Artificial Sequence
  chemically synthesized
aaacacacactgtggcttat

SEQ ID NO: 15356 - DNA, 20 bp, Artificial Sequence
  chemically synthesized
acacacactgtggcttatca

SEQ ID NO: 15357 - DNA, 20 bp, Artificial Sequence
  chemically synthesized
cacacactgtggcttatcag

SEQ ID NO: 15358 - DNA, 20 bp, Artificial Sequence
  chemically synthesized
cccaccctccatcctctgat

SEQ ID NO: 15359 - DNA, 20 bp, Artificial Sequence
  chemically synthesized
cactgtggcttatcagagga

SEQ ID NO: 15360 - DNA, 20 bp, Artificial Sequence
  chemically synthesized
ctgtggcttatcagaggatg

SEQ ID NO: 15361 - DNA, 20 bp, Artificial Sequence
  chemically synthesized
tgtggcttatcagaggatgg

SEQ ID NO: 15362 - DNA, 20 bp, Artificial Sequence
  chemically synthesized
gtggcttatcagaggatgga

SEQ ID NO: 15363 - DNA, 20 bp, Artificial Sequence
  chemically synthesized
gcttatcagaggatggaggg

SEQ ID NO: 15364 - DNA, 20 bp, Artificial Sequence
  chemically synthesized
cttatcagaggatggagggt

SEQ ID NO: 15365 - DNA, 20 bp, Artificial Sequence
  chemically synthesized
tatcagaggatggagggtgg

SEQ ID NO: 15366 - DNA, 20 bp, Artificial Sequence
  chemically synthesized
atcagaggatggagggtggg

SEQ ID NO: 15367 - DNA, 20 bp, Artificial Sequence
  chemically synthesized
cagaggatggagggtgggag

SEQ ID NO: 15368 - DNA, 20 bp, Artificial Sequence
  chemically synthesized
agaggatggagggtgggagg

SEQ ID NO: 15369 - DNA, 20 bp, Artificial Sequence
  chemically synthesized
gaggatggagggtgggagga

SEQ ID NO: 15370 - DNA, 20 bp, Artificial Sequence
  chemically synthesized
ggatggagggtgggaggagg

SEQ ID NO: 15371 - DNA, 20 bp, Artificial Sequence
  chemically synthesized
tggagggtgggaggagggag

SEQ ID NO: 15372 - DNA, 20 bp, Artificial Sequence
  chemically synthesized
ggtgggaggagggagaagat

SEQ ID NO: 15373 - DNA, 20 bp, Artificial Sequence
  chemically synthesized
gtgggaggagggagaagatc

SEQ ID NO: 15374 - DNA, 20 bp, Artificial Sequence
  chemically synthesized
aagatcaggaaaataactaa

SEQ ID NO: 15375 - DNA, 20 bp, Artificial Sequence
  chemically synthesized
agatcaggaaaataactaat

SEQ ID NO: 15376 - DNA, 20 bp, Artificial Sequence
  chemically synthesized
gtattaagcctaatacccat

SEQ ID NO: 15377 - DNA, 20 bp, Artificial Sequence
  chemically synthesized
ggaaaataactaatgggtat

SEQ ID NO: 15378 - DNA, 20 bp, Artificial Sequence
  chemically synthesized
gaaaataactaatgggtatt

SEQ ID NO: 15379 - DNA, 20 bp, Artificial Sequence
  chemically synthesized
tgggtattaggcttaatact

SEQ ID NO: 15380 - DNA, 20 bp, Artificial Sequence
  chemically synthesized
gggtattaggcttaatactt

SEQ ID NO: 15381 - DNA, 20 bp, Artificial Sequence
  chemically synthesized
tattttgtcacccaagtatt

SEQ ID NO: 15382 - DNA, 20 bp, Artificial Sequence
  chemically synthesized
tacagattattttgtcaccc

SEQ ID NO: 15383 - DNA, 20 bp, Artificial Sequence
  chemically synthesized
tgtcatgggggtttgttgta

SEQ ID NO: 15384 - DNA, 20 bp, Artificial Sequence
  chemically synthesized
gaggtaaacttgtgtcatgg

SEQ ID NO: 15385 - DNA, 20 bp, Artificial Sequence
  chemically synthesized
tgaggtaaacttgtgtcatg

SEQ ID NO: 15386 - DNA, 20 bp, Artificial Sequence
  chemically synthesized
acaacaaacccccatgacac

SEQ ID NO: 15387 - DNA, 20 bp, Artificial Sequence
  chemically synthesized
atgaggtaaacttgtgtcat

SEQ ID NO: 15388 - DNA, 20 bp, Artificial Sequence
  chemically synthesized
tatgaggtaaacttgtgtca

SEQ ID NO: 15389 - DNA, 20 bp, Artificial Sequence
  chemically synthesized
atgacacaagtttacctcat

SEQ ID NO: 15390 - DNA, 20 bp, Artificial Sequence
  chemically synthesized
acctgtctaggtttcttatg

SEQ ID NO: 15391 - DNA, 20 bp, Artificial Sequence
  chemically synthesized
tacctgtctaggtttcttat

SEQ ID NO: 15392 - DNA, 20 bp, Artificial Sequence
  chemically synthesized
agtttacctcataagaaacc

SEQ ID NO: 15393 - DNA, 20 bp, Artificial Sequence
  chemically synthesized
tacctcataagaaacctaga

SEQ ID NO: 15394 - DNA, 20 bp, Artificial Sequence
  chemically synthesized
acctcataagaaacctagac

SEQ ID NO: 15395 - DNA, 20 bp, Artificial Sequence
  chemically synthesized
aagttcaggggtacctgtct

SEQ ID NO: 15396 - DNA, 20 bp, Artificial Sequence
  chemically synthesized
taagttcaggggtacctgtc

SEQ ID NO: 15397 - DNA, 20 bp, Artificial Sequence
  chemically synthesized
aatttaacttgtaagttcag

SEQ ID NO: 15398 - DNA, 20 bp, Artificial Sequence
  chemically synthesized
aaatttaacttgtaagttca

SEQ ID NO: 15399 - DNA, 20 bp, Artificial Sequence
  chemically synthesized
aaaatttaacttgtaagttc

SEQ ID NO: 15400 - DNA, 20 bp, Artificial Sequence
  chemically synthesized
acaggtacccctgaacttac

SEQ ID NO: 15401 - DNA, 20 bp, Artificial Sequence
  chemically synthesized
taaaatttaacttgtaagtt

SEQ ID NO: 15402 - DNA, 20 bp, Artificial Sequence
  chemically synthesized
ctttttaaaatttaacttgt

SEQ ID NO: 15403 - DNA, 20 bp, Artificial Sequence
  chemically synthesized
cttacaagttaaattttaaa

SEQ ID NO: 15404 - DNA, 20 bp, Artificial Sequence
  chemically synthesized
aattttaaaaagctgttgct

SEQ ID NO: 15405 - DNA, 20 bp, Artificial Sequence
  chemically synthesized
cagagaaaagtgctcagcaa

SEQ ID NO: 15406 - DNA, 20 bp, Artificial Sequence
  chemically synthesized
tctacacagagaaaagtgct

SEQ ID NO: 15407 - DNA, 20 bp, Artificial Sequence
  chemically synthesized
atggaactctacacagagaa

SEQ ID NO: 15408 - DNA, 20 bp, Artificial Sequence
  chemically synthesized
gctgagcacttttctctgtg

SEQ ID NO: 15409 - DNA, 20 bp, Artificial Sequence
  chemically synthesized
tgagcacttttctctgtgta

SEQ ID NO: 15410 - DNA, 20 bp, Artificial Sequence
  chemically synthesized
ctgtgatggaactctacaca

SEQ ID NO: 15411 - DNA, 20 bp, Artificial Sequence
  chemically synthesized
ctctgtgatggaactctaca

SEQ ID NO: 15412 - DNA, 20 bp, Artificial Sequence
  chemically synthesized
ctctgtgtagagttccatca

SEQ ID NO: 15413 - DNA, 20 bp, Artificial Sequence
  chemically synthesized
ctgtgtagagttccatcaca

SEQ ID NO: 15414 - DNA, 20 bp, Artificial Sequence
  chemically synthesized
tgtgtagagttccatcacag

SEQ ID NO: 15415 - DNA, 20 bp, Artificial Sequence
  chemically synthesized
tccacaaagtacctctgtga

SEQ ID NO: 15416 - DNA, 20 bp, Artificial Sequence
  chemically synthesized
tccatcacagaggtactttg

SEQ ID NO: 15417 - DNA, 20 bp, Artificial Sequence
  chemically synthesized
tataaacttttttttccaca

SEQ ID NO: 15418 - DNA, 20 bp, Artificial Sequence
  chemically synthesized
gaggtactttgtggaaaaaa

SEQ ID NO: 15419 - DNA, 20 bp, Artificial Sequence
  chemically synthesized
tgtggaaaaaaaagtttata

SEQ ID NO: 15420 - DNA, 20 bp, Artificial Sequence
  chemically synthesized
tgcatgatctttttcatttt

SEQ ID NO: 15421 - DNA, 20 bp, Artificial Sequence
  chemically synthesized
tatgcaatctaaaaatgaaa

SEQ ID NO: 15422 - DNA, 20 bp, Artificial Sequence
  chemically synthesized
aaaaatgaaaaagatcatgc

SEQ ID NO: 15423 - DNA, 20 bp, Artificial Sequence
  chemically synthesized
tgccatgccaaaaggatgaa

SEQ ID NO: 15424 - DNA, 20 bp, Artificial Sequence
  chemically synthesized
tgcaagtccattcatccttt

SEQ ID NO: 15425 - DNA, 20 bp, Artificial Sequence
  chemically synthesized
gtccattcatccttttggca

SEQ ID NO: 15426 - DNA, 20 bp, Artificial Sequence
  chemically synthesized
ctctgtggtgccatgccaaa

SEQ ID NO: 15427 - DNA, 20 bp, Artificial Sequence
  chemically synthesized
gctctgtggtgccatgccaa

SEQ ID NO: 15428 - DNA, 20 bp, Artificial Sequence
  chemically synthesized
atccttttggcatggcacca

SEQ ID NO: 15429 - DNA, 20 bp, Artificial Sequence
  chemically synthesized
ccttttggcatggcaccaca

SEQ ID NO: 15430 - DNA, 20 bp, Artificial Sequence
  chemically synthesized
ctgaaagtcttacagctctg

SEQ ID NO: 15431 - DNA, 20 bp, Artificial Sequence
  chemically synthesized
gcatggcaccacagagctgt

SEQ ID NO: 15432 - DNA, 20 bp, Artificial Sequence
  chemically synthesized
agtgaatcctgaaagtctta

SEQ ID NO: 15433 - DNA, 20 bp, Artificial Sequence
  chemically synthesized
ccacagagctgtaagacttt

SEQ ID NO: 15434 - DNA, 20 bp, Artificial Sequence
  chemically synthesized
cacagagctgtaagactttc

SEQ ID NO: 15435 - DNA, 20 bp, Artificial Sequence
  chemically synthesized
ttggactcagtgaatcctga

SEQ ID NO: 15436 - DNA, 20 bp, Artificial Sequence
  chemically synthesized
taagactttcaggattcact

SEQ ID NO: 15437 - DNA, 20 bp, Artificial Sequence
  chemically synthesized
atgaatgctgagtttggact

SEQ ID NO: 15438 - DNA, 20 bp, Artificial Sequence
  chemically synthesized
ggattcactgagtccaaact

SEQ ID NO: 15439 - DNA, 20 bp, Artificial Sequence
  chemically synthesized
gactcgatgaatgctgagtt

SEQ ID NO: 15440 - DNA, 20 bp, Artificial Sequence
  chemically synthesized
gtttggactcgatgaatgct

SEQ ID NO: 15441 - DNA, 20 bp, Artificial Sequence
  chemically synthesized
gtccaaactcagcattcatc

SEQ ID NO: 15442 - DNA, 20 bp, Artificial Sequence
  chemically synthesized
cactggcatgggtaagagtt

SEQ ID NO: 15443 - DNA, 20 bp, Artificial Sequence
  chemically synthesized
gcacacactggcatgggtaa

SEQ ID NO: 15444 - DNA, 20 bp, Artificial Sequence
  chemically synthesized
aagcacacactggcatgggt

SEQ ID NO: 15445 - DNA, 20 bp, Artificial Sequence
  chemically synthesized
gtccaaactcttacccatgc

SEQ ID NO: 15446 - DNA, 20 bp, Artificial Sequence
  chemically synthesized
ctgtaagcacacactggcat

SEQ ID NO: 15447 - DNA, 20 bp, Artificial Sequence
  chemically synthesized
gctgtaagcacacactggca

SEQ ID NO: 15448 - DNA, 20 bp, Artificial Sequence
  chemically synthesized
tagtggctgtaagcacacac

SEQ ID NO: 15449 - DNA, 20 bp, Artificial Sequence
  chemically synthesized
cccatgccagtgtgtgctta

SEQ ID NO: 15450 - DNA, 20 bp, Artificial Sequence
  chemically synthesized
atgggtggtgtagtggctgt

SEQ ID NO: 15451 - DNA, 20 bp, Artificial Sequence
  chemically synthesized
ctctcacatgggtggtgtag

SEQ ID NO: 15452 - DNA, 20 bp, Artificial Sequence
  chemically synthesized
gctctctcacatgggtggtg

SEQ ID NO: 15453 - DNA, 20 bp, Artificial Sequence
  chemically synthesized
agccactacaccacccatgt

SEQ ID NO: 15454 - DNA, 20 bp, Artificial Sequence
  chemically synthesized
tcccagctctctcacatggg

SEQ ID NO: 15455 - DNA, 20 bp, Artificial Sequence
  chemically synthesized
ccactacaccacccatgtga

SEQ ID NO: 15456 - DNA, 20 bp, Artificial Sequence
  chemically synthesized
gtttcccagctctctcacat

SEQ ID NO: 15457 - DNA, 20 bp, Artificial Sequence
  chemically synthesized
actacaccacccatgtgaga

SEQ ID NO: 15458 - DNA, 20 bp, Artificial Sequence
  chemically synthesized
tgtttcccagctctctcaca

SEQ ID NO: 15459 - DNA, 20 bp, Artificial Sequence
  chemically synthesized
caccacccatgtgagagagc

SEQ ID NO: 15460 - DNA, 20 bp, Artificial Sequence
  chemically synthesized
accacccatgtgagagagct

SEQ ID NO: 15461 - DNA, 20 bp, Artificial Sequence
  chemically synthesized
caccttctaaggatgtttcc

SEQ ID NO: 15462 - DNA, 20 bp, Artificial Sequence
  chemically synthesized
agagagctgggaaacatcct

SEQ ID NO: 15463 - DNA, 20 bp, Artificial Sequence
  chemically synthesized
gagctgggaaacatccttag

SEQ ID NO: 15464 - DNA, 20 bp, Artificial Sequence
  chemically synthesized
agctgggaaacatccttaga

SEQ ID NO: 15465 - DNA, 20 bp, Artificial Sequence
  chemically synthesized
gtgttcaggatcaccttcta

SEQ ID NO: 15466 - DNA, 20 bp, Artificial Sequence
  chemically synthesized
ggtgttcaggatcaccttct

SEQ ID NO: 15467 - DNA, 20 bp, Artificial Sequence
  chemically synthesized
gtatctggacacaggtgttc

SEQ ID NO: 15468 - DNA, 20 bp, Artificial Sequence
  chemically synthesized
ggtatctggacacaggtgtt

SEQ ID NO: 15469 - DNA, 20 bp, Artificial Sequence
  chemically synthesized
tgatcctgaacacctgtgtc

SEQ ID NO: 15470 - DNA, 20 bp, Artificial Sequence
  chemically synthesized
tgacaggggtatctggacac

SEQ ID NO: 15471 - DNA, 20 bp, Artificial Sequence
  chemically synthesized
ttgacaggggtatctggaca

SEQ ID NO: 15472 - DNA, 20 bp, Artificial Sequence
  chemically synthesized
gcacttttgacaggggtatc

SEQ ID NO: 15473 - DNA, 20 bp, Artificial Sequence
  chemically synthesized
tgtccagatacccctgtcaa

SEQ ID NO: 15474 - DNA, 20 bp, Artificial Sequence
  chemically synthesized
tgatgcagcacttttgacag

SEQ ID NO: 15475 - DNA, 20 bp, Artificial Sequence
  chemically synthesized
gtgatgcagcacttttgaca

SEQ ID NO: 15476 - DNA, 20 bp, Artificial Sequence
  chemically synthesized
tgtgatgcagcacttttgac

SEQ ID NO: 15477 - DNA, 20 bp, Artificial Sequence
  chemically synthesized
atgtgatgcagcacttttga

SEQ ID NO: 15478 - DNA, 20 bp, Artificial Sequence
  chemically synthesized
gatttcagctcaatgtgatg

SEQ ID NO: 15479 - DNA, 20 bp, Artificial Sequence
  chemically synthesized
caaaagtgctgcatcacatt

SEQ ID NO: 15480 - DNA, 20 bp, Artificial Sequence
  chemically synthesized
tatgctgtgctgatggattt

SEQ ID NO: 15481 - DNA, 20 bp, Artificial Sequence
  chemically synthesized
cacattgagctgaaatccat

SEQ ID NO: 15482 - DNA, 20 bp, Artificial Sequence
  chemically synthesized
tgagctgaaatccatcagca

SEQ ID NO: 15483 - DNA, 20 bp, Artificial Sequence
  chemically synthesized
acttctatatgctgtgctga

SEQ ID NO: 15484 - DNA, 20 bp, Artificial Sequence
  chemically synthesized
aaatccatcagcacagcata

SEQ ID NO: 15485 - DNA, 20 bp, Artificial Sequence
  chemically synthesized
tccatcagcacagcatatag

SEQ ID NO: 15486 - DNA, 20 bp, Artificial Sequence
  chemically synthesized
agcacagcatatagaagttc

SEQ ID NO: 15487 - DNA, 20 bp, Artificial Sequence
  chemically synthesized
cacagcatatagaagttcca

SEQ ID NO: 15488 - DNA, 20 bp, Artificial Sequence
  chemically synthesized
gaactccagtggtttaactc

SEQ ID NO: 15489 - DNA, 20 bp, Artificial Sequence
  chemically synthesized
aagttccagagttaaaccac

SEQ ID NO: 15490 - DNA, 20 bp, Artificial Sequence
  chemically synthesized
gttccagagttaaaccactg

SEQ ID NO: 15491 - DNA, 20 bp, Artificial Sequence
  chemically synthesized
cagtgagtggtgaactccag

SEQ ID NO: 15492 - DNA, 20 bp, Artificial Sequence
  chemically synthesized
agccagtgagtggtgaactc

SEQ ID NO: 15493 - DNA, 20 bp, Artificial Sequence
  chemically synthesized
cactggagttcaccactcac

SEQ ID NO: 15494 - DNA, 20 bp, Artificial Sequence
  chemically synthesized
aaggtcacacagccagtgag

SEQ ID NO: 15495 - DNA, 20 bp, Artificial Sequence
  chemically synthesized
cctaaggtcacacagccagt

SEQ ID NO: 15496 - DNA, 20 bp, Artificial Sequence
  chemically synthesized
ttttcctaaggtcacacagc

SEQ ID NO: 15497 - DNA, 20 bp, Artificial Sequence
  chemically synthesized
gttattttcctaaggtcaca

SEQ ID NO: 15498 - DNA, 20 bp, Artificial Sequence
  chemically synthesized
actcactggctgtgtgacct

SEQ ID NO: 15499 - DNA, 20 bp, Artificial Sequence
  chemically synthesized
ctcactggctgtgtgacctt

SEQ ID NO: 15500 - DNA, 20 bp, Artificial Sequence
  chemically synthesized
gagataaagttattttccta

SEQ ID NO: 15501 - DNA, 20 bp, Artificial Sequence
  chemically synthesized
agagataaagttattttcct

SEQ ID NO: 15502 - DNA, 20 bp, Artificial Sequence
  chemically synthesized
aagtaagacacagagagata

SEQ ID NO: 15503 - DNA, 20 bp, Artificial Sequence
  chemically synthesized
gagaaaaagtaagacacaga

SEQ ID NO: 15504 - DNA, 20 bp, Artificial Sequence
  chemically synthesized
cagagaaaaagtaagacaca

SEQ ID NO: 15505 - DNA, 20 bp, Artificial Sequence
  chemically synthesized
agcagagaaaaagtaagaca

SEQ ID NO: 15506 - DNA, 20 bp, Artificial Sequence
  chemically synthesized
gtttgtagcagagaaaaagt

SEQ ID NO: 15507 - DNA, 20 bp, Artificial Sequence
  chemically synthesized
tccagtttgtagcagagaaa

SEQ ID NO: 15508 - DNA, 20 bp, Artificial Sequence
  chemically synthesized
aatatttccagtttgtagca

SEQ ID NO: 15509 - DNA, 20 bp, Artificial Sequence
  chemically synthesized
ttaatatttccagtttgtag

SEQ ID NO: 15510 - DNA, 20 bp, Artificial Sequence
  chemically synthesized
actttttctctgctacaaac

SEQ ID NO: 15511 - DNA, 20 bp, Artificial Sequence
  chemically synthesized
ctattaatatttccagtttg

SEQ ID NO: 15512 - DNA, 20 bp, Artificial Sequence
  chemically synthesized
gtaggcactattaatatttc

SEQ ID NO: 15513 - DNA, 20 bp, Artificial Sequence
  chemically synthesized
ctacaaactggaaatattaa

SEQ ID NO: 15514 - DNA, 20 bp, Artificial Sequence
  chemically synthesized
tattaatagtgcctacctca

SEQ ID NO: 15515 - DNA, 20 bp, Artificial Sequence
  chemically synthesized
ataaaataactctatgaggt

SEQ ID NO: 15516 - DNA, 20 bp, Artificial Sequence
  chemically synthesized
ttaatagtgcctacctcata

SEQ ID NO: 15517 - DNA, 20 bp, Artificial Sequence
  chemically synthesized
cataaaataactctatgagg

SEQ ID NO: 15518 - DNA, 20 bp, Artificial Sequence
  chemically synthesized
aatcataaaataactctatg

SEQ ID NO: 15519 - DNA, 20 bp, Artificial Sequence
  chemically synthesized
taatcataaaataactctat

SEQ ID NO: 15520 - DNA, 20 bp, Artificial Sequence
  chemically synthesized
gagttattttatgattacgt

SEQ ID NO: 15521 - DNA, 20 bp, Artificial Sequence
  chemically synthesized
tattttatgattacgtgagt

SEQ ID NO: 15522 - DNA, 20 bp, Artificial Sequence
  chemically synthesized
ttacgtgagtcagcaaatga

SEQ ID NO: 15523 - DNA, 20 bp, Artificial Sequence
  chemically synthesized
tacgtgagtcagcaaatgaa

SEQ ID NO: 15524 - DNA, 20 bp, Artificial Sequence
  chemically synthesized
gtcagcaaatgaaaggcaat

SEQ ID NO: 15525 - DNA, 20 bp, Artificial Sequence
  chemically synthesized
ttcttgctatgtgtcagaca

SEQ ID NO: 15526 - DNA, 20 bp, Artificial Sequence
  chemically synthesized
ttggaaccgtgtctgacaca

SEQ ID NO: 15527 - DNA, 20 bp, Artificial Sequence
  chemically synthesized
acatgattcttgctatgtgt

SEQ ID NO: 15528 - DNA, 20 bp, Artificial Sequence
  chemically synthesized
aaccgtgtctgacacatagc

SEQ ID NO: 15529 - DNA, 20 bp, Artificial Sequence
  chemically synthesized
aataataatgacaataacaa

SEQ ID NO: 15530 - DNA, 20 bp, Artificial Sequence
  chemically synthesized
attattattatccatctgac

SEQ ID NO: 15531 - DNA, 20 bp, Artificial Sequence
  chemically synthesized
cttctgggttgctggtcaga

SEQ ID NO: 15532 - DNA, 20 bp, Artificial Sequence
  chemically synthesized
agaacttctgggttgctggt

SEQ ID NO: 15533 - DNA, 20 bp, Artificial Sequence
  chemically synthesized
tatccatctgaccagcaacc

SEQ ID NO: 15534 - DNA, 20 bp, Artificial Sequence
  chemically synthesized
accaagaacttctgggttgc

SEQ ID NO: 15535 - DNA, 20 bp, Artificial Sequence
  chemically synthesized
ccatctgaccagcaacccag

SEQ ID NO: 15536 - DNA, 20 bp, Artificial Sequence
  chemically synthesized
ttcaaagaccaagaacttct

SEQ ID NO: 15537 - DNA, 20 bp, Artificial Sequence
  chemically synthesized
gttcaaagaccaagaacttc

SEQ ID NO: 15538 - DNA, 20 bp, Artificial Sequence
  chemically synthesized
accagcaacccagaagttct

SEQ ID NO: 15539 - DNA, 20 bp, Artificial Sequence
  chemically synthesized
taaagggctgttcaaagacc

SEQ ID NO: 15540 - DNA, 20 bp, Artificial Sequence
  chemically synthesized
agaagttcttggtctttgaa

SEQ ID NO: 15541 - DNA, 20 bp, Artificial Sequence
  chemically synthesized
aatatttaaagggctgttca

SEQ ID NO: 15542 - DNA, 20 bp, Artificial Sequence
  chemically synthesized
gctctggtaaaatatttaaa

SEQ ID NO: 15543 - DNA, 20 bp, Artificial Sequence
  chemically synthesized
agctctggtaaaatatttaa

SEQ ID NO: 15544 - DNA, 20 bp, Artificial Sequence
  chemically synthesized
cagctctggtaaaatattta

SEQ ID NO: 15545 - DNA, 20 bp, Artificial Sequence
  chemically synthesized
cagccctttaaatattttac

SEQ ID NO: 15546 - DNA, 20 bp, Artificial Sequence
  chemically synthesized
gccctttaaatattttacca

SEQ ID NO: 15547 - DNA, 20 bp, Artificial Sequence
  chemically synthesized
atggacagataagacagctc

SEQ ID NO: 15548 - DNA, 20 bp, Artificial Sequence
  chemically synthesized
agaggcatggacagataaga

SEQ ID NO: 15549 - DNA, 20 bp, Artificial Sequence
  chemically synthesized
atgaagaggcatggacagat

SEQ ID NO: 15550 - DNA, 20 bp, Artificial Sequence
  chemically synthesized
taggaatgaagaggcatgga

SEQ ID NO: 15551 - DNA, 20 bp, Artificial Sequence
  chemically synthesized
agaataggaatgaagaggca

SEQ ID NO: 15552 - DNA, 20 bp, Artificial Sequence
  chemically synthesized
taaaaagaataggaatgaag

SEQ ID NO: 15553 - DNA, 20 bp, Artificial Sequence
  chemically synthesized
gtaaaaagaataggaatgaa

SEQ ID NO: 15554 - DNA, 20 bp, Artificial Sequence
  chemically synthesized
aagtaaaaagaataggaatg

SEQ ID NO: 15555 - DNA, 20 bp, Artificial Sequence
  chemically synthesized
gaagaagaagtaaaaagaat

SEQ ID NO: 15556 - DNA, 20 bp, Artificial Sequence
  chemically synthesized
tgaagaagaagtaaaaagaa

SEQ ID NO: 15557 - DNA, 20 bp, Artificial Sequence
  chemically synthesized
tcatatgaagaagaagtaaa

SEQ ID NO: 15558 - DNA, 20 bp, Artificial Sequence
  chemically synthesized
agccgtgtcatatgaagaag

SEQ ID NO: 15559 - DNA, 20 bp, Artificial Sequence
  chemically synthesized
ctaagccgtgtcatatgaag

SEQ ID NO: 15560 - DNA, 20 bp, Artificial Sequence
  chemically synthesized
aaactaagccgtgtcatatg

SEQ ID NO: 15561 - DNA, 20 bp, Artificial Sequence
  chemically synthesized
tacttcttcttcatatgaca

SEQ ID NO: 15562 - DNA, 20 bp, Artificial Sequence
  chemically synthesized
cttcttcatatgacacggct

SEQ ID NO: 15563 - DNA, 20 bp, Artificial Sequence
  chemically synthesized
ctaaatgacaatggcaaact

SEQ ID NO: 15564 - DNA, 20 bp, Artificial Sequence
  chemically synthesized
aatagttttctaaatgacaa

SEQ ID NO: 15565 - DNA, 20 bp, Artificial Sequence
  chemically synthesized
cttagtttgccattgtcatt

SEQ ID NO: 15566 - DNA, 20 bp, Artificial Sequence
  chemically synthesized
ccgcaatcatatttgaagaa

SEQ ID NO: 15567 - DNA, 20 bp, Artificial Sequence
  chemically synthesized
attctccgcaatcatatttg

SEQ ID NO: 15568 - DNA, 20 bp, Artificial Sequence
  chemically synthesized
ctattcttcaaatatgattg

SEQ ID NO: 15569 - DNA, 20 bp, Artificial Sequence
  chemically synthesized
attcttcaaatatgattgcg

SEQ ID NO: 15570 - DNA, 20 bp, Artificial Sequence
  chemically synthesized
tacactgtctggagaaatag

SEQ ID NO: 15571 - DNA, 20 bp, Artificial Sequence
  chemically synthesized
ttacactgtctggagaaata

SEQ ID NO: 15572 - DNA, 20 bp, Artificial Sequence
  chemically synthesized
agaatgtacctctatttctc

SEQ ID NO: 15573 - DNA, 20 bp, Artificial Sequence
  chemically synthesized
agttacactgtctggagaaa

SEQ ID NO: 15574 - DNA, 20 bp, Artificial Sequence
  chemically synthesized
tgtacctctatttctccaga

SEQ ID NO: 15575 - DNA, 20 bp, Artificial Sequence
  chemically synthesized
taatccagttacactgtctg

SEQ ID NO: 15576 - DNA, 20 bp, Artificial Sequence
  chemically synthesized
agtaatccagttacactgtc

SEQ ID NO: 15577 - DNA, 20 bp, Artificial Sequence
  chemically synthesized
atttctccagacagtgtaac

SEQ ID NO: 15578 - DNA, 20 bp, Artificial Sequence
  chemically synthesized
cagaacaaaagaaagtaatc

SEQ ID NO: 15579 - DNA, 20 bp, Artificial Sequence
  chemically synthesized
ctacggtacagaacaaaaga

SEQ ID NO: 15580 - DNA, 20 bp, Artificial Sequence
  chemically synthesized
gagcctacggtacagaacaa

SEQ ID NO: 15581 - DNA, 20 bp, Artificial Sequence
  chemically synthesized
ctttcttttgttctgtaccg

SEQ ID NO: 15582 - DNA, 20 bp, Artificial Sequence
  chemically synthesized
tttcttttgttctgtaccgt

SEQ ID NO: 15583 - DNA, 20 bp, Artificial Sequence
  chemically synthesized
ccgtgtgtgagcctacggta

SEQ ID NO: 15584 - DNA, 20 bp, Artificial Sequence
  chemically synthesized
aggaaccgtgtgtgagccta

SEQ ID NO: 15585 - DNA, 20 bp, Artificial Sequence
  chemically synthesized
ctgtaccgtaggctcacaca

SEQ ID NO: 15586 - DNA, 20 bp, Artificial Sequence
  chemically synthesized
gttgagtaggaaccgtgtgt

SEQ ID NO: 15587 - DNA, 20 bp, Artificial Sequence
  chemically synthesized
ctcagagattttagttgagt

SEQ ID NO: 15588 - DNA, 20 bp, Artificial Sequence
  chemically synthesized
actcagagattttagttgag

SEQ ID NO: 15589 - DNA, 20 bp, Artificial Sequence
  chemically synthesized
ctgactcagagattttagtt

SEQ ID NO: 15590 - DNA, 20 bp, Artificial Sequence
  chemically synthesized
aaacactgactcagagattt

SEQ ID NO: 15591 - DNA, 20 bp, Artificial Sequence
  chemically synthesized
cctactcaactaaaatctct

SEQ ID NO: 15592 - DNA, 20 bp, Artificial Sequence
  chemically synthesized
ctcaactaaaatctctgagt

SEQ ID NO: 15593 - DNA, 20 bp, Artificial Sequence
  chemically synthesized
tactgggaaacactgactca

SEQ ID NO: 15594 - DNA, 20 bp, Artificial Sequence
  chemically synthesized
catactgggaaacactgact

SEQ ID NO: 15595 - DNA, 20 bp, Artificial Sequence
  chemically synthesized
atctctgagtcagtgtttcc

SEQ ID NO: 15596 - DNA, 20 bp, Artificial Sequence
  chemically synthesized
attgatctgctggacatact

SEQ ID NO: 15597 - DNA, 20 bp, Artificial Sequence
  chemically synthesized
tcagtgtttcccagtatgtc

SEQ ID NO: 15598 - DNA, 20 bp, Artificial Sequence
  chemically synthesized
gattgatctgctggacatac

SEQ ID NO: 15599 - DNA, 20 bp, Artificial Sequence
  chemically synthesized
gtgtttcccagtatgtccag

SEQ ID NO: 15600 - DNA, 20 bp, Artificial Sequence
  chemically synthesized
ttgctggacgattgatctgc

SEQ ID NO: 15601 - DNA, 20 bp, Artificial Sequence
  chemically synthesized
tgtccagcagatcaatcgtc

SEQ ID NO: 15602 - DNA, 20 bp, Artificial Sequence
  chemically synthesized
cttctcgtgaagcattttgc

SEQ ID NO: 15603 - DNA, 20 bp, Artificial Sequence
  chemically synthesized
cgtccagcaaaatgcttcac

SEQ ID NO: 15604 - DNA, 20 bp, Artificial Sequence
  chemically synthesized
ccagcaaaatgcttcacgag

SEQ ID NO: 15605 - DNA, 20 bp, Artificial Sequence
  chemically synthesized
cagcaaaatgcttcacgaga

SEQ ID NO: 15606 - DNA, 20 bp, Artificial Sequence
  chemically synthesized
attaatttgaccttctcgtg

SEQ ID NO: 15607 - DNA, 20 bp, Artificial Sequence
  chemically synthesized
cgagaaggtcaaattaatga

SEQ ID NO: 15608 - DNA, 20 bp, Artificial Sequence
  chemically synthesized
ggtcaaattaatgaaagaaa

SEQ ID NO: 15609 - DNA, 20 bp, Artificial Sequence
  chemically synthesized
gctctaagaattttaagagg

SEQ ID NO: 15610 - DNA, 20 bp, Artificial Sequence
  chemically synthesized
cgtgctctaagaattttaag

SEQ ID NO: 15611 - DNA, 20 bp, Artificial Sequence
  chemically synthesized
acgtgctctaagaattttaa

SEQ ID NO: 15612 - DNA, 20 bp, Artificial Sequence
  chemically synthesized
taacgtgctctaagaatttt

SEQ ID NO: 15613 - DNA, 20 bp, Artificial Sequence
  chemically synthesized
tatctgcctcttaaaattct

SEQ ID NO: 15614 - DNA, 20 bp, Artificial Sequence
  chemically synthesized
tctgcctcttaaaattctta

SEQ ID NO: 15615 - DNA, 20 bp, Artificial Sequence
  chemically synthesized
ttaatatgttaacgtgctct

SEQ ID NO: 15616 - DNA, 20 bp, Artificial Sequence
  chemically synthesized
agagcacgttaacatattaa

SEQ ID NO: 15617 - DNA, 20 bp, Artificial Sequence
  chemically synthesized
acgttaacatattaaaagct

SEQ ID NO: 15618 - DNA, 20 bp, Artificial Sequence
  chemically synthesized
ttaacatattaaaagctgag

SEQ ID NO: 15619 - DNA, 20 bp, Artificial Sequence
  chemically synthesized
taacatattaaaagctgaga

SEQ ID NO: 15620 - DNA, 20 bp, Artificial Sequence
  chemically synthesized
tgctttactgatgaccttct

SEQ ID NO: 15621 - DNA, 20 bp, Artificial Sequence
  chemically synthesized
ttaaaagctgagaaggtcat

SEQ ID NO: 15622 - DNA, 20 bp, Artificial Sequence
  chemically synthesized
agctgagaaggtcatcagta

SEQ ID NO: 15623 - DNA, 20 bp, Artificial Sequence
  chemically synthesized
cagtaaagcaacatgttaat

SEQ ID NO: 15624 - DNA, 20 bp, Artificial Sequence
  chemically synthesized
agcaacatgttaatcagctc

SEQ ID NO: 15625 - DNA, 20 bp, Artificial Sequence
  chemically synthesized
gagaatctgggaagattcca

SEQ ID NO: 15626 - DNA, 20 bp, Artificial Sequence
  chemically synthesized
ctgagaatctgggaagattc

SEQ ID NO: 15627 - DNA, 20 bp, Artificial Sequence
  chemically synthesized
aatcagctctggaatcttcc

SEQ ID NO: 15628 - DNA, 20 bp, Artificial Sequence
  chemically synthesized
tctctctctgagaatctggg

SEQ ID NO: 15629 - DNA, 20 bp, Artificial Sequence
  chemically synthesized
ctggaatcttcccagattct

SEQ ID NO: 15630 - DNA, 20 bp, Artificial Sequence
  chemically synthesized
ctctctctctctgagaatct

SEQ ID NO: 15631 - DNA, 20 bp, Artificial Sequence
  chemically synthesized
tctctctctctctgagaatc

SEQ ID NO: 15632 - DNA, 20 bp, Artificial Sequence
  chemically synthesized
ggaatcttcccagattctca

SEQ ID NO: 15633 - DNA, 20 bp, Artificial Sequence
  chemically synthesized
aatcttcccagattctcaga

SEQ ID NO: 15634 - DNA, 20 bp, Artificial Sequence
  chemically synthesized
tcttcccagattctcagaga

SEQ ID NO: 15635 - DNA, 20 bp, Artificial Sequence
  chemically synthesized
ttcccagattctcagagaga

SEQ ID NO: 15636 - DNA, 20 bp, Artificial Sequence
  chemically synthesized
ctctctctctctctctctct

SEQ ID NO: 15637 - DNA, 20 bp, Artificial Sequence
  chemically synthesized
cccagattctcagagagaga

SEQ ID NO: 15638 - DNA, 20 bp, Artificial Sequence
  chemically synthesized
cagattctcagagagagaga

SEQ ID NO: 15639 - DNA, 20 bp, Artificial Sequence
  chemically synthesized
gattctcagagagagagaga

SEQ ID NO: 15640 - DNA, 20 bp, Artificial Sequence
  chemically synthesized
ttctcagagagagagagaga

SEQ ID NO: 15641 - DNA, 20 bp, Artificial Sequence
  chemically synthesized
ctcagagagagagagagaga

SEQ ID NO: 15642 - DNA, 20 bp, Artificial Sequence
  chemically synthesized
cagagagagagagagagaga

SEQ ID NO: 15643 - DNA, 20 bp, Artificial Sequence
  chemically synthesized
gagagagagagagagagaga

SEQ ID NO: 15644 - DNA, 20 bp, Artificial Sequence
  chemically synthesized
gagagagagagagagagaga

SEQ ID NO: 15645 - DNA, 20 bp, Artificial Sequence
  chemically synthesized
gagagagagagagagagaga

SEQ ID NO: 15646 - DNA, 20 bp, Artificial Sequence
  chemically synthesized
gagagagagagagagagaga

SEQ ID NO: 15647 - DNA, 20 bp, Artificial Sequence
  chemically synthesized
gagagagagagagagagaga

SEQ ID NO: 15648 - DNA, 20 bp, Artificial Sequence
  chemically synthesized
gagagagagagagagagaga

SEQ ID NO: 15649 - DNA, 20 bp, Artificial Sequence
  chemically synthesized
gagagagagagagagagaga

SEQ ID NO: 15650 - DNA, 20 bp, Artificial Sequence
  chemically synthesized
gagagagagagagagagaga

SEQ ID NO: 15651 - DNA, 20 bp, Artificial Sequence
  chemically synthesized
gagagagagagagagagaga

SEQ ID NO: 15652 - DNA, 20 bp, Artificial Sequence
  chemically synthesized
gagagagagagagagagaga

SEQ ID NO: 15653 - DNA, 20 bp, Artificial Sequence
  chemically synthesized
gagagagagagagagagaga

SEQ ID NO: 15654 - DNA, 20 bp, Artificial Sequence
  chemically synthesized
gagagagagagagagagaga

SEQ ID NO: 15655 - DNA, 20 bp, Artificial Sequence
  chemically synthesized
gagagagagagagagagaga

SEQ ID NO: 15656 - DNA, 20 bp, Artificial Sequence
  chemically synthesized
gagagagagagagagagaga

SEQ ID NO: 15657 - DNA, 20 bp, Artificial Sequence
  chemically synthesized
gagagagagagagagagaga

SEQ ID NO: 15658 - DNA, 20 bp, Artificial Sequence
  chemically synthesized
gagagagagagagagagaga

SEQ ID NO: 15659 - DNA, 20 bp, Artificial Sequence
  chemically synthesized
gagagagagagagagagaga

SEQ ID NO: 15660 - DNA, 20 bp, Artificial Sequence
  chemically synthesized
gagagagagagagagagaga

SEQ ID NO: 15661 - DNA, 20 bp, Artificial Sequence
  chemically synthesized
gagagagagagagagagaga

SEQ ID NO: 15662 - DNA, 20 bp, Artificial Sequence
  chemically synthesized
gagagagagagagagagaga

SEQ ID NO: 15663 - DNA, 20 bp, Artificial Sequence
  chemically synthesized
gagagagagagagagagaga

SEQ ID NO: 15664 - DNA, 20 bp, Artificial Sequence
  chemically synthesized
gagagagagagagagagaga

SEQ ID NO: 15665 - DNA, 20 bp, Artificial Sequence
  chemically synthesized
gagagagagagagagagaga

SEQ ID NO: 15666 - DNA, 20 bp, Artificial Sequence
  chemically synthesized
gagagagagagagagagaga

SEQ ID NO: 15667 - DNA, 20 bp, Artificial Sequence
  chemically synthesized
gagagagagagagagagaac

SEQ ID NO: 15668 - DNA, 20 bp, Artificial Sequence
  chemically synthesized
gagagagagagagaacaagc

SEQ ID NO: 15669 - DNA, 20 bp, Artificial Sequence
  chemically synthesized
gagagagagagaacaagcaa

SEQ ID NO: 15670 - DNA, 20 bp, Artificial Sequence
  chemically synthesized
acaagcaagagtgacttctg

SEQ ID NO: 15671 - DNA, 20 bp, Artificial Sequence
  chemically synthesized
caagcaagagtgacttctga

SEQ ID NO: 15672 - DNA, 20 bp, Artificial Sequence
  chemically synthesized
aagcaagagtgacttctgaa

SEQ ID NO: 15673 - DNA, 20 bp, Artificial Sequence
  chemically synthesized
agcaagagtgacttctgaag

SEQ ID NO: 15674 - DNA, 20 bp, Artificial Sequence
  chemically synthesized
ttattaaatcgccccttcag

SEQ ID NO: 15675 - DNA, 20 bp, Artificial Sequence
  chemically synthesized
ctgttattaaatcgcccctt

SEQ ID NO: 15676 - DNA, 20 bp, Artificial Sequence
  chemically synthesized
ctgaaggggcgatttaataa

SEQ ID NO: 15677 - DNA, 20 bp, Artificial Sequence
  chemically synthesized
acagttttcaattatgtgaa

SEQ ID NO: 15678 - DNA, 20 bp, Artificial Sequence
  chemically synthesized
ttatgtgaatggctctcgca

SEQ ID NO: 15679 - DNA, 20 bp, Artificial Sequence
  chemically synthesized
tatgtgaatggctctcgcat

SEQ ID NO: 15680 - DNA, 20 bp, Artificial Sequence
  chemically synthesized
atgtgaatggctctcgcata

SEQ ID NO: 15681 - DNA, 20 bp, Artificial Sequence
  chemically synthesized
ggtcacaggcccctatgcga

SEQ ID NO: 15682 - DNA, 20 bp, Artificial Sequence
  chemically synthesized
tgtgaatggctctcgcatag

SEQ ID NO: 15683 - DNA, 20 bp, Artificial Sequence
  chemically synthesized
ctggtcacaggcccctatgc

SEQ ID NO: 15684 - DNA, 20 bp, Artificial Sequence
  chemically synthesized
ctcgcataggggcctgtgac

SEQ ID NO: 15685 - DNA, 20 bp, Artificial Sequence
  chemically synthesized
gagatcgaacagctggtcac

SEQ ID NO: 15686 - DNA, 20 bp, Artificial Sequence
  chemically synthesized
agagatcgaacagctggtca

SEQ ID NO: 15687 - DNA, 20 bp, Artificial Sequence
  chemically synthesized
cagtggagagatcgaacagc

SEQ ID NO: 15688 - DNA, 20 bp, Artificial Sequence
  chemically synthesized
tcctcagtggagagatcgaa

SEQ ID NO: 15689 - DNA, 20 bp, Artificial Sequence
  chemically synthesized
agctgttcgatctctccact

SEQ ID NO: 15690 - DNA, 20 bp, Artificial Sequence
  chemically synthesized
gctgttcgatctctccactg

SEQ ID NO: 15691 - DNA, 20 bp, Artificial Sequence
  chemically synthesized
cttgttctgtcctcagtgga

SEQ ID NO: 15692 - DNA, 20 bp, Artificial Sequence
  chemically synthesized
ttcttgttctgtcctcagtg

SEQ ID NO: 15693 - DNA, 20 bp, Artificial Sequence
  chemically synthesized
ttcgatctctccactgagga

SEQ ID NO: 15694 - DNA, 20 bp, Artificial Sequence
  chemically synthesized
tcttcttgttctgtcctcag

SEQ ID NO: 15695 - DNA, 20 bp, Artificial Sequence
  chemically synthesized
gtttcttcttgttctgtcct

SEQ ID NO: 15696 - DNA, 20 bp, Artificial Sequence
  chemically synthesized
ctctccactgaggacagaac

SEQ ID NO: 15697 - DNA, 20 bp, Artificial Sequence
  chemically synthesized
tccactgaggacagaacaag

SEQ ID NO: 15698 - DNA, 20 bp, Artificial Sequence
  chemically synthesized
gaggacagaacaagaagaaa

SEQ ID NO: 15699 - DNA, 20 bp, Artificial Sequence
  chemically synthesized
gaacaagaagaaacagactt

SEQ ID NO: 15700 - DNA, 20 bp, Artificial Sequence
  chemically synthesized
caagaagaaacagacttaag

SEQ ID NO: 15701 - DNA, 20 bp, Artificial Sequence
  chemically synthesized
ctaaattcttcatgctgctt

SEQ ID NO: 15702 - DNA, 20 bp, Artificial Sequence
  chemically synthesized
aaacagacttaagcagcatg

SEQ ID NO: 15703 - DNA, 20 bp, Artificial Sequence
  chemically synthesized
cttaagcagcatgaagaatt

SEQ ID NO: 15704 - DNA, 20 bp, Artificial Sequence
  chemically synthesized
ttaagcagcatgaagaattt

SEQ ID NO: 15705 - DNA, 20 bp, Artificial Sequence
  chemically synthesized
agcatgaagaatttaggctg

SEQ ID NO: 15706 - DNA, 20 bp, Artificial Sequence
  chemically synthesized
aaattcttccatatgagcta

SEQ ID NO: 15707 - DNA, 20 bp, Artificial Sequence
  chemically synthesized
aatttaggctgtagctcata

SEQ ID NO: 15708 - DNA, 20 bp, Artificial Sequence
  chemically synthesized
ttaggctgtagctcatatgg

SEQ ID NO: 15709 - DNA, 20 bp, Artificial Sequence
  chemically synthesized
atcaggaaattcttccatat

SEQ ID NO: 15710 - DNA, 20 bp, Artificial Sequence
  chemically synthesized
ctttaacaactttcagcatc

SEQ ID NO: 15711 - DNA, 20 bp, Artificial Sequence
  chemically synthesized
gaagaatttcctgatgctga

SEQ ID NO: 15712 - DNA, 20 bp, Artificial Sequence
  chemically synthesized
gctttaacaactttcagcat

SEQ ID NO: 15713 - DNA, 20 bp, Artificial Sequence
  chemically synthesized
actaatgctttaacaacttt

SEQ ID NO: 15714 - DNA, 20 bp, Artificial Sequence
  chemically synthesized
cctgatgctgaaagttgtta

SEQ ID NO: 15715 - DNA, 20 bp, Artificial Sequence
  chemically synthesized
gctgaaagttgttaaagcat

SEQ ID NO: 15716 - DNA, 20 bp, Artificial Sequence
  chemically synthesized
aagcattagtgtgaattacc

SEQ ID NO: 15717 - DNA, 20 bp, Artificial Sequence
  chemically synthesized
agcattagtgtgaattacca

SEQ ID NO: 15718 - DNA, 20 bp, Artificial Sequence
  chemically synthesized
gcattagtgtgaattaccaa

SEQ ID NO: 15719 - DNA, 20 bp, Artificial Sequence
  chemically synthesized
attagtgtgaattaccaagg

SEQ ID NO: 15720 - DNA, 20 bp, Artificial Sequence
  chemically synthesized
ttagtgtgaattaccaaggg

SEQ ID NO: 15721 - DNA, 20 bp, Artificial Sequence
  chemically synthesized
gaacattctacagcctccct

SEQ ID NO: 15722 - DNA, 20 bp, Artificial Sequence
  chemically synthesized
tgaattaccaagggaggctg

SEQ ID NO: 15723 - DNA, 20 bp, Artificial Sequence
  chemically synthesized
tgaaagagtagaacattcta

SEQ ID NO: 15724 - DNA, 20 bp, Artificial Sequence
  chemically synthesized
tctatagttttttgaaagag

SEQ ID NO: 15725 - DNA, 20 bp, Artificial Sequence
  chemically synthesized
gaatctatagttttttgaaa

SEQ ID NO: 15726 - DNA, 20 bp, Artificial Sequence
  chemically synthesized
aagaatctatagttttttga

SEQ ID NO: 15727 - DNA, 20 bp, Artificial Sequence
  chemically synthesized
tctactctttcaaaaaacta

SEQ ID NO: 15728 - DNA, 20 bp, Artificial Sequence
  chemically synthesized
tttaagcatagaagaatcta

SEQ ID NO: 15729 - DNA, 20 bp, Artificial Sequence
  chemically synthesized
tgttcaacctttaagcatag

SEQ ID NO: 15730 - DNA, 20 bp, Artificial Sequence
  chemically synthesized
tatagattcttctatgctta

SEQ ID NO: 15731 - DNA, 20 bp, Artificial Sequence
  chemically synthesized
atagattcttctatgcttaa

SEQ ID NO: 15732 - DNA, 20 bp, Artificial Sequence
  chemically synthesized
gaatgttcaacctttaagca

SEQ ID NO: 15733 - DNA, 20 bp, Artificial Sequence
  chemically synthesized
tttgagaatgttcaaccttt

SEQ ID NO: 15734 - DNA, 20 bp, Artificial Sequence
  chemically synthesized
gttgaacattctcaaatttc

SEQ ID NO: 15735 - DNA, 20 bp, Artificial Sequence
  chemically synthesized
atcttaggggctagaaattt

SEQ ID NO: 15736 - DNA, 20 bp, Artificial Sequence
  chemically synthesized
ttctcaaatttctagcccct

SEQ ID NO: 15737 - DNA, 20 bp, Artificial Sequence
  chemically synthesized
ggatcttgcatcttaggggc

SEQ ID NO: 15738 - DNA, 20 bp, Artificial Sequence
  chemically synthesized
tgatggatcttgcatcttag

SEQ ID NO: 15739 - DNA, 20 bp, Artificial Sequence
  chemically synthesized
atgatggatcttgcatctta

SEQ ID NO: 15740 - DNA, 20 bp, Artificial Sequence
  chemically synthesized
atttctagcccctaagatgc

SEQ ID NO: 15741 - DNA, 20 bp, Artificial Sequence
  chemically synthesized
catgatggatcttgcatctt

SEQ ID NO: 15742 - DNA, 20 bp, Artificial Sequence
  chemically synthesized
acatgatggatcttgcatct

SEQ ID NO: 15743 - DNA, 20 bp, Artificial Sequence
  chemically synthesized
agatgcaagatccatcatgt

SEQ ID NO: 15744 - DNA, 20 bp, Artificial Sequence
  chemically synthesized
ttttaaaagagccaacatga

SEQ ID NO: 15745 - DNA, 20 bp, Artificial Sequence
  chemically synthesized
gtaggtgagcagttttaaaa

SEQ ID NO: 15746 - DNA, 20 bp, Artificial Sequence
  chemically synthesized
gcgtaggtgagcagttttaa

SEQ ID NO: 15747 - DNA, 20 bp, Artificial Sequence
  chemically synthesized
tgtcagttggcgtaggtgag

SEQ ID NO: 15748 - DNA, 20 bp, Artificial Sequence
  chemically synthesized
gtctgtcagttggcgtaggt

SEQ ID NO: 15749 - DNA, 20 bp, Artificial Sequence
  chemically synthesized
ttcagtctgtcagttggcgt

SEQ ID NO: 15750 - DNA, 20 bp, Artificial Sequence
  chemically synthesized
cttcagtctgtcagttggcg

SEQ ID NO: 15751 - DNA, 20 bp, Artificial Sequence
  chemically synthesized
tgctcacctacgccaactga

SEQ ID NO: 15752 - DNA, 20 bp, Artificial Sequence
  chemically synthesized
cttgtcttcagtctgtcagt

SEQ ID NO: 15753 - DNA, 20 bp, Artificial Sequence
  chemically synthesized
gtaccttgtcttcagtctgt

SEQ ID NO: 15754 - DNA, 20 bp, Artificial Sequence
  chemically synthesized
ctacgccaactgacagactg

SEQ ID NO: 15755 - DNA, 20 bp, Artificial Sequence
  chemically synthesized
ccaactgacagactgaagac

SEQ ID NO: 15756 - DNA, 20 bp, Artificial Sequence
  chemically synthesized
caactgacagactgaagaca

SEQ ID NO: 15757 - DNA, 20 bp, Artificial Sequence
  chemically synthesized
gaatccccgtaccttgtctt

SEQ ID NO: 15758 - DNA, 20 bp, Artificial Sequence
  chemically synthesized
gacagactgaagacaaggta

SEQ ID NO: 15759 - DNA, 20 bp, Artificial Sequence
  chemically synthesized
acagactgaagacaaggtac

SEQ ID NO: 15760 - DNA, 20 bp, Artificial Sequence
  chemically synthesized
cagactgaagacaaggtacg

SEQ ID NO: 15761 - DNA, 20 bp, Artificial Sequence
  chemically synthesized
atgaaagattgaaacagaat

SEQ ID NO: 15762 - DNA, 20 bp, Artificial Sequence
  chemically synthesized
ataaaaatgaaagattgaaa

SEQ ID NO: 15763 - DNA, 20 bp, Artificial Sequence
  chemically synthesized
gtagtttgtcataaaaatga

SEQ ID NO: 15764 - DNA, 20 bp, Artificial Sequence
  chemically synthesized
tataccactaggatacagag

SEQ ID NO: 15765 - DNA, 20 bp, Artificial Sequence
  chemically synthesized
tgacaaactactctgtatcc

SEQ ID NO: 15766 - DNA, 20 bp, Artificial Sequence
  chemically synthesized
gaatataccactaggataca

SEQ ID NO: 15767 - DNA, 20 bp, Artificial Sequence
  chemically synthesized
gggaatataccactaggata

SEQ ID NO: 15768 - DNA, 20 bp, Artificial Sequence
  chemically synthesized
caaactactctgtatcctag

SEQ ID NO: 15769 - DNA, 20 bp, Artificial Sequence
  chemically synthesized
aggagagggaatataccact

SEQ ID NO: 15770 - DNA, 20 bp, Artificial Sequence
  chemically synthesized
aaggagagggaatataccac

SEQ ID NO: 15771 - DNA, 20 bp, Artificial Sequence
  chemically synthesized
cattgccagacaaaaggaga

SEQ ID NO: 15772 - DNA, 20 bp, Artificial Sequence
  chemically synthesized
tcattgccagacaaaaggag

SEQ ID NO: 15773 - DNA, 20 bp, Artificial Sequence
  chemically synthesized
ttcattgccagacaaaagga

SEQ ID NO: 15774 - DNA, 20 bp, Artificial Sequence
  chemically synthesized
tcttcattgccagacaaaag

SEQ ID NO: 15775 - DNA, 20 bp, Artificial Sequence
  chemically synthesized
atattccctctccttttgtc

SEQ ID NO: 15776 - DNA, 20 bp, Artificial Sequence
  chemically synthesized
cttcttcattgccagacaaa

SEQ ID NO: 15777 - DNA, 20 bp, Artificial Sequence
  chemically synthesized
ccttcttcattgccagacaa

SEQ ID NO: 15778 - DNA, 20 bp, Artificial Sequence
  chemically synthesized
tctccttttgtctggcaatg

SEQ ID NO: 15779 - DNA, 20 bp, Artificial Sequence
  chemically synthesized
attctttccttcttcattgc

SEQ ID NO: 15780 - DNA, 20 bp, Artificial Sequence
  chemically synthesized
ccttttgtctggcaatgaag

SEQ ID NO: 15781 - DNA, 20 bp, Artificial Sequence
  chemically synthesized
cttttgtctggcaatgaaga

SEQ ID NO: 15782 - DNA, 20 bp, Artificial Sequence
  chemically synthesized
tgtctggcaatgaagaagga

SEQ ID NO: 15783 - DNA, 20 bp, Artificial Sequence
  chemically synthesized
atgaagaaggaaagaattaa

SEQ ID NO: 15784 - DNA, 20 bp, Artificial Sequence
  chemically synthesized
agaaggaaagaattaaaagc

SEQ ID NO: 15785 - DNA, 20 bp, Artificial Sequence
  chemically synthesized
gaaggaaagaattaaaagcc

SEQ ID NO: 15786 - DNA, 20 bp, Artificial Sequence
  chemically synthesized
gaaagaattaaaagccaggc

SEQ ID NO: 15787 - DNA, 20 bp, Artificial Sequence
  chemically synthesized
ggtctttacagaagcttgcc

SEQ ID NO: 15788 - DNA, 20 bp, Artificial Sequence
  chemically synthesized
aagccaggcaagcttctgta

SEQ ID NO: 15789 - DNA, 20 bp, Artificial Sequence
  chemically synthesized
gttctgttaggtctttacag

SEQ ID NO: 15790 - DNA, 20 bp, Artificial Sequence
  chemically synthesized
ctagttctgttaggtcttta

SEQ ID NO: 15791 - DNA, 20 bp, Artificial Sequence
  chemically synthesized
aagcttctgtaaagacctaa

SEQ ID NO: 15792 - DNA, 20 bp, Artificial Sequence
  chemically synthesized
ggtttaattctagttctgtt

SEQ ID NO: 15793 - DNA, 20 bp, Artificial Sequence
  chemically synthesized
ctgtaaagacctaacagaac

SEQ ID NO: 15794 - DNA, 20 bp, Artificial Sequence
  chemically synthesized
gggtttaattctagttctgt

SEQ ID NO: 15795 - DNA, 20 bp, Artificial Sequence
  chemically synthesized
attttagctgggtttaattc

SEQ ID NO: 15796 - DNA, 20 bp, Artificial Sequence
  chemically synthesized
aacagaactagaattaaacc

SEQ ID NO: 15797 - DNA, 20 bp, Artificial Sequence
  chemically synthesized
atcgaaatgtaattttagct

SEQ ID NO: 15798 - DNA, 20 bp, Artificial Sequence
  chemically synthesized
gatcgaaatgtaattttagc

SEQ ID NO: 15799 - DNA, 20 bp, Artificial Sequence
  chemically synthesized
gaatgatcgaaatgtaattt

SEQ ID NO: 15800 - DNA, 20 bp, Artificial Sequence
  chemically synthesized
aaattacatttcgatcattc

SEQ ID NO: 15801 - DNA, 20 bp, Artificial Sequence
  chemically synthesized
tatccctatatatttttttc

SEQ ID NO: 15802 - DNA, 20 bp, Artificial Sequence
  chemically synthesized
tcattccagaaaaaaatata

SEQ ID NO: 15803 - DNA, 20 bp, Artificial Sequence
  chemically synthesized
cattccagaaaaaaatatat

SEQ ID NO: 15804 - DNA, 20 bp, Artificial Sequence
  chemically synthesized
attccagaaaaaaatatata

SEQ ID NO: 15805 - DNA, 20 bp, Artificial Sequence
  chemically synthesized
cagaaaaaaatatataggga

SEQ ID NO: 15806 - DNA, 20 bp, Artificial Sequence
  chemically synthesized
aaaaatatatagggatagat

SEQ ID NO: 15807 - DNA, 20 bp, Artificial Sequence
  chemically synthesized
tatatagggatagattggaa

SEQ ID NO: 15808 - DNA, 20 bp, Artificial Sequence
  chemically synthesized
atagggatagattggaatag

SEQ ID NO: 15809 - DNA, 20 bp, Artificial Sequence
  chemically synthesized
tagggatagattggaatagc

SEQ ID NO: 15810 - DNA, 20 bp, Artificial Sequence
  chemically synthesized
ggatagattggaatagcagg

SEQ ID NO: 15811 - DNA, 20 bp, Artificial Sequence
  chemically synthesized
tggaatagcaggaagttatt

SEQ ID NO: 15812 - DNA, 20 bp, Artificial Sequence
  chemically synthesized
ggaatagcaggaagttatta

SEQ ID NO: 15813 - DNA, 20 bp, Artificial Sequence
  chemically synthesized
caggaagttattaaggtcaa

SEQ ID NO: 15814 - DNA, 20 bp, Artificial Sequence
  chemically synthesized
agttattaaggtcaaaagat

SEQ ID NO: 15815 - DNA, 20 bp, Artificial Sequence
  chemically synthesized
aggtcaaaagataagtatga

SEQ ID NO: 15816 - DNA, 20 bp, Artificial Sequence
  chemically synthesized
ataagtatgatggcattcac

SEQ ID NO: 15817 - DNA, 20 bp, Artificial Sequence
  chemically synthesized
atgatggcattcactggact

SEQ ID NO: 15818 - DNA, 20 bp, Artificial Sequence
  chemically synthesized
ttacaaagattatctcagtc

SEQ ID NO: 15819 - DNA, 20 bp, Artificial Sequence
  chemically synthesized
ggtacttacaaagattatct

SEQ ID NO: 15820 - DNA, 20 bp, Artificial Sequence
  chemically synthesized
tggactgagataatctttgt

SEQ ID NO: 15821 - DNA, 20 bp, Artificial Sequence
  chemically synthesized
aacaaataatggtacttaca

SEQ ID NO: 15822 - DNA, 20 bp, Artificial Sequence
  chemically synthesized
atatgtatctcaacaaataa

SEQ ID NO: 15823 - DNA, 20 bp, Artificial Sequence
  chemically synthesized
tgtaagtaccattatttgtt

SEQ ID NO: 15824 - DNA, 20 bp, Artificial Sequence
  chemically synthesized
ttatttgttgagatacatat

SEQ ID NO: 15825 - DNA, 20 bp, Artificial Sequence
  chemically synthesized
gttgagatacatataagtct

SEQ ID NO: 15826 - DNA, 20 bp, Artificial Sequence
  chemically synthesized
actgagaggggattatatct

SEQ ID NO: 15827 - DNA, 20 bp, Artificial Sequence
  chemically synthesized
tctcagatataatcccctct

SEQ ID NO: 15828 - DNA, 20 bp, Artificial Sequence
  chemically synthesized
gtcacccttgatactgagag

SEQ ID NO: 15829 - DNA, 20 bp, Artificial Sequence
  chemically synthesized
ggtcacccttgatactgaga

SEQ ID NO: 15830 - DNA, 20 bp, Artificial Sequence
  chemically synthesized
aggtcacccttgatactgag

SEQ ID NO: 15831 - DNA, 20 bp, Artificial Sequence
  chemically synthesized
aaggtcacccttgatactga

SEQ ID NO: 15832 - DNA, 20 bp, Artificial Sequence
  chemically synthesized
tataatcccctctcagtatc

SEQ ID NO: 15833 - DNA, 20 bp, Artificial Sequence
  chemically synthesized
ataatcccctctcagtatca

SEQ ID NO: 15834 - DNA, 20 bp, Artificial Sequence
  chemically synthesized
acaaggtcacccttgatact

SEQ ID NO: 15835 - DNA, 20 bp, Artificial Sequence
  chemically synthesized
taatcccctctcagtatcaa

SEQ ID NO: 15836 - DNA, 20 bp, Artificial Sequence
  chemically synthesized
ggtgtttagagatgaggaca

SEQ ID NO: 15837 - DNA, 20 bp, Artificial Sequence
  chemically synthesized
tggtgtttagagatgaggac

SEQ ID NO: 15838 - DNA, 20 bp, Artificial Sequence
  chemically synthesized
gaaactggtgtttagagatg

SEQ ID NO: 15839 - DNA, 20 bp, Artificial Sequence
  chemically synthesized
tgaaactggtgtttagagat

SEQ ID NO: 15840 - DNA, 20 bp, Artificial Sequence
  chemically synthesized
ttgtcctcatctctaaacac

SEQ ID NO: 15841 - DNA, 20 bp, Artificial Sequence
  chemically synthesized
tggcttgaaactggtgttta

SEQ ID NO: 15842 - DNA, 20 bp, Artificial Sequence
  chemically synthesized
catggcttgaaactggtgtt

SEQ ID NO: 15843 - DNA, 20 bp, Artificial Sequence
  chemically synthesized
catctctaaacaccagtttc

SEQ ID NO: 15844 - DNA, 20 bp, Artificial Sequence
  chemically synthesized
ttgcttgcatggcttgaaac

SEQ ID NO: 15845 - DNA, 20 bp, Artificial Sequence
  chemically synthesized
acaccagtttcaagccatgc

SEQ ID NO: 15846 - DNA, 20 bp, Artificial Sequence
  chemically synthesized
tccaagagattttgcttgca

SEQ ID NO: 15847 - DNA, 20 bp, Artificial Sequence
  chemically synthesized
gccatgcaagcaaaatctct

SEQ ID NO: 15848 - DNA, 20 bp, Artificial Sequence
  chemically synthesized
tgcaagcaaaatctcttgga

SEQ ID NO: 15849 - DNA, 20 bp, Artificial Sequence
  chemically synthesized
gcaagcaaaatctcttggaa

SEQ ID NO: 15850 - DNA, 20 bp, Artificial Sequence
  chemically synthesized
gggctaaatgacctttccaa

SEQ ID NO: 15851 - DNA, 20 bp, Artificial Sequence
  chemically synthesized
cagggctaaatgacctttcc

SEQ ID NO: 15852 - DNA, 20 bp, Artificial Sequence
  chemically synthesized
aatctcttggaaaggtcatt

SEQ ID NO: 15853 - DNA, 20 bp, Artificial Sequence
  chemically synthesized
ttggaaaggtcatttagccc

SEQ ID NO: 15854 - DNA, 20 bp, Artificial Sequence
  chemically synthesized
tggaaaggtcatttagccct

SEQ ID NO: 15855 - DNA, 20 bp, Artificial Sequence
  chemically synthesized
aacaaacaaaacaaaaccca

SEQ ID NO: 15856 - DNA, 20 bp, Artificial Sequence
  chemically synthesized
caacaaacaaaacaaaaccc

SEQ ID NO: 15857 - DNA, 20 bp, Artificial Sequence
  chemically synthesized
ccaacaaacaaaacaaaacc

SEQ ID NO: 15858 - DNA, 20 bp, Artificial Sequence
  chemically synthesized
ctgggttttgttttgtttgt

SEQ ID NO: 15859 - DNA, 20 bp, Artificial Sequence
  chemically synthesized
acaacagcaaaagcaaaaca

SEQ ID NO: 15860 - DNA, 20 bp, Artificial Sequence
  chemically synthesized
tattgccaaaacaacagcaa

SEQ ID NO: 15861 - DNA, 20 bp, Artificial Sequence
  chemically synthesized
ttttgcttttgctgttgttt

SEQ ID NO: 15862 - DNA, 20 bp, Artificial Sequence
  chemically synthesized
tggagttattgccaaaacaa

SEQ ID NO: 15863 - DNA, 20 bp, Artificial Sequence
  chemically synthesized
tgacatagaaggggaaaatg

SEQ ID NO: 15864 - DNA, 20 bp, Artificial Sequence
  chemically synthesized
catgacatagaaggggaaaa

SEQ ID NO: 15865 - DNA, 20 bp, Artificial Sequence
  chemically synthesized
gtgtgtgcatgacatagaag

SEQ ID NO: 15866 - DNA, 20 bp, Artificial Sequence
  chemically synthesized
tgtgtgtgcatgacatagaa

SEQ ID NO: 15867 - DNA, 20 bp, Artificial Sequence
  chemically synthesized
ctgtgtgtgcatgacataga

SEQ ID NO: 15868 - DNA, 20 bp, Artificial Sequence
  chemically synthesized
tctgtgtgtgcatgacatag

SEQ ID NO: 15869 - DNA, 20 bp, Artificial Sequence
  chemically synthesized
ctttctgtgtgtgcatgaca

SEQ ID NO: 15870 - DNA, 20 bp, Artificial Sequence
  chemically synthesized
ccttctatgtcatgcacaca

SEQ ID NO: 15871 - DNA, 20 bp, Artificial Sequence
  chemically synthesized
ctatgtcatgcacacacaga

SEQ ID NO: 15872 - DNA, 20 bp, Artificial Sequence
  chemically synthesized
tcatgcacacacagaaagca

SEQ ID NO: 15873 - DNA, 20 bp, Artificial Sequence
  chemically synthesized
cacagaaagcaaagctatca

SEQ ID NO: 15874 - DNA, 20 bp, Artificial Sequence
  chemically synthesized
cataatggaaggagctgtga

SEQ ID NO: 15875 - DNA, 20 bp, Artificial Sequence
  chemically synthesized
tgtgaccatcataatggaag

SEQ ID NO: 15876 - DNA, 20 bp, Artificial Sequence
  chemically synthesized
actgtgaccatcataatgga

SEQ ID NO: 15877 - DNA, 20 bp, Artificial Sequence
  chemically synthesized
aactgtgaccatcataatgg

SEQ ID NO: 15878 - DNA, 20 bp, Artificial Sequence
  chemically synthesized
cacagctccttccattatga

SEQ ID NO: 15879 - DNA, 20 bp, Artificial Sequence
  chemically synthesized
ccaaactgtgaccatcataa

SEQ ID NO: 15880 - DNA, 20 bp, Artificial Sequence
  chemically synthesized
tccttccattatgatggtca

SEQ ID NO: 15881 - DNA, 20 bp, Artificial Sequence
  chemically synthesized
ccattatgatggtcacagtt

SEQ ID NO: 15882 - DNA, 20 bp, Artificial Sequence
  chemically synthesized
gtcacagtttggaattatgt

SEQ ID NO: 15883 - DNA, 20 bp, Artificial Sequence
  chemically synthesized
tcacagtttggaattatgtt

SEQ ID NO: 15884 - DNA, 20 bp, Artificial Sequence
  chemically synthesized
gaggaccaacagaaaaagag

SEQ ID NO: 15885 - DNA, 20 bp, Artificial Sequence
  chemically synthesized
gtgaggaccaacagaaaaag

SEQ ID NO: 15886 - DNA, 20 bp, Artificial Sequence
  chemically synthesized
ggtgaggaccaacagaaaaa

SEQ ID NO: 15887 - DNA, 20 bp, Artificial Sequence
  chemically synthesized
ggtttctcctctttttctgt

SEQ ID NO: 15888 - DNA, 20 bp, Artificial Sequence
  chemically synthesized
caggtgaggaccaacagaaa

SEQ ID NO: 15889 - DNA, 20 bp, Artificial Sequence
  chemically synthesized
tgctggcaggtgaggaccaa

SEQ ID NO: 15890 - DNA, 20 bp, Artificial Sequence
  chemically synthesized
ttctgttggtcctcacctgc

SEQ ID NO: 15891 - DNA, 20 bp, Artificial Sequence
  chemically synthesized
tggatagttgctggcaggtg

SEQ ID NO: 15892 - DNA, 20 bp, Artificial Sequence
  chemically synthesized
atggatagttgctggcaggt

SEQ ID NO: 15893 - DNA, 20 bp, Artificial Sequence
  chemically synthesized
tgttatggatagttgctggc

SEQ ID NO: 15894 - DNA, 20 bp, Artificial Sequence
  chemically synthesized
ctgttatggatagttgctgg

SEQ ID NO: 15895 - DNA, 20 bp, Artificial Sequence
  chemically synthesized
tttctgttatggatagttgc

SEQ ID NO: 15896 - DNA, 20 bp, Artificial Sequence
  chemically synthesized
ctgccagcaactatccataa

SEQ ID NO: 15897 - DNA, 20 bp, Artificial Sequence
  chemically synthesized
cctagcttttctgttatgga

SEQ ID NO: 15898 - DNA, 20 bp, Artificial Sequence
  chemically synthesized
ttcccctagcttttctgtta

SEQ ID NO: 15899 - DNA, 20 bp, Artificial Sequence
  chemically synthesized
agcaactatccataacagaa

SEQ ID NO: 15900 - DNA, 20 bp, Artificial Sequence
  chemically synthesized
actatccataacagaaaagc

SEQ ID NO: 15901 - DNA, 20 bp, Artificial Sequence
  chemically synthesized
ctatccataacagaaaagct

SEQ ID NO: 15902 - DNA, 20 bp, Artificial Sequence
  chemically synthesized
tatccataacagaaaagcta

SEQ ID NO: 15903 - DNA, 20 bp, Artificial Sequence
  chemically synthesized
atccataacagaaaagctag

SEQ ID NO: 15904 - DNA, 20 bp, Artificial Sequence
  chemically synthesized
cataacagaaaagctagggg

SEQ ID NO: 15905 - DNA, 20 bp, Artificial Sequence
  chemically synthesized
ataacagaaaagctagggga

SEQ ID NO: 15906 - DNA, 20 bp, Artificial Sequence
  chemically synthesized
tgacaactgattccttcccc

SEQ ID NO: 15907 - DNA, 20 bp, Artificial Sequence
  chemically synthesized
gaaaagctaggggaaggaat

SEQ ID NO: 15908 - DNA, 20 bp, Artificial Sequence
  chemically synthesized
agtgtgctgtaacagagcaa

SEQ ID NO: 15909 - DNA, 20 bp, Artificial Sequence
  chemically synthesized
tcattactattgctctgtta

SEQ ID NO: 15910 - DNA, 20 bp, Artificial Sequence
  chemically synthesized
ccctccagtgtgctgtaaca

SEQ ID NO: 15911 - DNA, 20 bp, Artificial Sequence
  chemically synthesized
caccctccagtgtgctgtaa

SEQ ID NO: 15912 - DNA, 20 bp, Artificial Sequence
  chemically synthesized
attgctctgttacagcacac

SEQ ID NO: 15913 - DNA, 20 bp, Artificial Sequence
  chemically synthesized
tgctctgttacagcacactg

SEQ ID NO: 15914 - DNA, 20 bp, Artificial Sequence
  chemically synthesized
gctctgttacagcacactgg

SEQ ID NO: 15915 - DNA, 20 bp, Artificial Sequence
  chemically synthesized
ctctgttacagcacactgga

SEQ ID NO: 15916 - DNA, 20 bp, Artificial Sequence
  chemically synthesized
tgttacagcacactggaggg

SEQ ID NO: 15917 - DNA, 20 bp, Artificial Sequence
  chemically synthesized
atttgtatgaagccaccctc

SEQ ID NO: 15918 - DNA, 20 bp, Artificial Sequence
  chemically synthesized
ataaaggtgatatttgtatg

SEQ ID NO: 15919 - DNA, 20 bp, Artificial Sequence
  chemically synthesized
accttgttatatttgtataa

SEQ ID NO: 15920 - DNA, 20 bp, Artificial Sequence
  chemically synthesized
taccttgttatatttgtata

SEQ ID NO: 15921 - DNA, 20 bp, Artificial Sequence
  chemically synthesized
cacctttatacaaatataac

SEQ ID NO: 15922 - DNA, 20 bp, Artificial Sequence
  chemically synthesized
acctttatacaaatataaca

SEQ ID NO: 15923 - DNA, 20 bp, Artificial Sequence
  chemically synthesized
tacaaatataacaaggtaca

SEQ ID NO: 15924 - DNA, 20 bp, Artificial Sequence
  chemically synthesized
tataacaaggtacacagaca

SEQ ID NO: 15925 - DNA, 20 bp, Artificial Sequence
  chemically synthesized
gacaaagaattctcaatatc

SEQ ID NO: 15926 - DNA, 20 bp, Artificial Sequence
  chemically synthesized
tgctagaaattccagatatt

SEQ ID NO: 15927 - DNA, 20 bp, Artificial Sequence
  chemically synthesized
ttctcaatatctggaatttc

SEQ ID NO: 15928 - DNA, 20 bp, Artificial Sequence
  chemically synthesized
aatcggtttgctagaaattc

SEQ ID NO: 15929 - DNA, 20 bp, Artificial Sequence
  chemically synthesized
tgataggtaaatcggtttgc

SEQ ID NO: 15930 - DNA, 20 bp, Artificial Sequence
  chemically synthesized
tattatattgataggtaaat

SEQ ID NO: 15931 - DNA, 20 bp, Artificial Sequence
  chemically synthesized
tttaaacttattatattgat

SEQ ID NO: 15932 - DNA, 20 bp, Artificial Sequence
  chemically synthesized
ttttaaacttattatattga

SEQ ID NO: 15933 - DNA, 20 bp, Artificial Sequence
  chemically synthesized
gatttacctatcaatataat

SEQ ID NO: 15934 - DNA, 20 bp, Artificial Sequence
  chemically synthesized
tatcaatataataagtttaa

SEQ ID NO: 15935 - DNA, 20 bp, Artificial Sequence
  chemically synthesized
atcaatataataagtttaaa

SEQ ID NO: 15936 - DNA, 20 bp, Artificial Sequence
  chemically synthesized
tcaatataataagtttaaaa

SEQ ID NO: 15937 - DNA, 20 bp, Artificial Sequence
  chemically synthesized
aagtttaaaagggcattaca

SEQ ID NO: 15938 - DNA, 20 bp, Artificial Sequence
  chemically synthesized
ttaaaagggcattacatggc

SEQ ID NO: 15939 - DNA, 20 bp, Artificial Sequence
  chemically synthesized
agggcattacatggcaagtt

SEQ ID NO: 15940 - DNA, 20 bp, Artificial Sequence
  chemically synthesized
ggcattacatggcaagtttg

SEQ ID NO: 15941 - DNA, 20 bp, Artificial Sequence
  chemically synthesized
gcattacatggcaagtttgg

SEQ ID NO: 15942 - DNA, 20 bp, Artificial Sequence
  chemically synthesized
ttacatggcaagtttggagg

SEQ ID NO: 15943 - DNA, 20 bp, Artificial Sequence
  chemically synthesized
tacatggcaagtttggaggt

SEQ ID NO: 15944 - DNA, 20 bp, Artificial Sequence
  chemically synthesized
catggcaagtttggaggtag

SEQ ID NO: 15945 - DNA, 20 bp, Artificial Sequence
  chemically synthesized
tggcaagtttggaggtagga

SEQ ID NO: 15946 - DNA, 20 bp, Artificial Sequence
  chemically synthesized
tttggaggtaggagagttgc

SEQ ID NO: 15947 - DNA, 20 bp, Artificial Sequence
  chemically synthesized
ttggaggtaggagagttgct

SEQ ID NO: 15948 - DNA, 20 bp, Artificial Sequence
  chemically synthesized
tggaggtaggagagttgctg

SEQ ID NO: 15949 - DNA, 20 bp, Artificial Sequence
  chemically synthesized
ccaaaagttcttcggaaccc

SEQ ID NO: 15950 - DNA, 20 bp, Artificial Sequence
  chemically synthesized
ggagagttgctggggttccg

SEQ ID NO: 15951 - DNA, 20 bp, Artificial Sequence
  chemically synthesized
aaagaaatccaaaagttctt

SEQ ID NO: 15952 - DNA, 20 bp, Artificial Sequence
  chemically synthesized
ctggggttccgaagaacttt

SEQ ID NO: 15953 - DNA, 20 bp, Artificial Sequence
  chemically synthesized
acaacatcaaagaaatccaa

SEQ ID NO: 15954 - DNA, 20 bp, Artificial Sequence
  chemically synthesized
ttatagaaagcacaacatca

SEQ ID NO: 15955 - DNA, 20 bp, Artificial Sequence
  chemically synthesized
agtgtccaaggatttataga

SEQ ID NO: 15956 - DNA, 20 bp, Artificial Sequence
  chemically synthesized
cttcagtgtccaaggattta

SEQ ID NO: 15957 - DNA, 20 bp, Artificial Sequence
  chemically synthesized
ttgtgctttctataaatcct

SEQ ID NO: 15958 - DNA, 20 bp, Artificial Sequence
  chemically synthesized
ggttggcccttcagtgtcca

SEQ ID NO: 15959 - DNA, 20 bp, Artificial Sequence
  chemically synthesized
cggttggcccttcagtgtcc

SEQ ID NO: 15960 - DNA, 20 bp, Artificial Sequence
  chemically synthesized
ctataaatccttggacactg

SEQ ID NO: 15961 - DNA, 20 bp, Artificial Sequence
  chemically synthesized
tataaatccttggacactga

SEQ ID NO: 15962 - DNA, 20 bp, Artificial Sequence
  chemically synthesized
ataaatccttggacactgaa

SEQ ID NO: 15963 - DNA, 20 bp, Artificial Sequence
  chemically synthesized
ctggcaggcggttggccctt

SEQ ID NO: 15964 - DNA, 20 bp, Artificial Sequence
  chemically synthesized
tggacctcctggcaggcggt

SEQ ID NO: 15965 - DNA, 20 bp, Artificial Sequence
  chemically synthesized
ctgaagggccaaccgcctgc

SEQ ID NO: 15966 - DNA, 20 bp, Artificial Sequence
  chemically synthesized
tgaagggccaaccgcctgcc

SEQ ID NO: 15967 - DNA, 20 bp, Artificial Sequence
  chemically synthesized
caggtggacctcctggcagg

SEQ ID NO: 15968 - DNA, 20 bp, Artificial Sequence
  chemically synthesized
aagggccaaccgcctgccag

SEQ ID NO: 15969 - DNA, 20 bp, Artificial Sequence
  chemically synthesized
agggccaaccgcctgccagg

SEQ ID NO: 15970 - DNA, 20 bp, Artificial Sequence
  chemically synthesized
attcaggtggacctcctggc

SEQ ID NO: 15971 - DNA, 20 bp, Artificial Sequence
  chemically synthesized
tattcaggtggacctcctgg

SEQ ID NO: 15972 - DNA, 20 bp, Artificial Sequence
  chemically synthesized
gagtattcaggtggacctcc

SEQ ID NO: 15973 - DNA, 20 bp, Artificial Sequence
  chemically synthesized
gagaaaaatgagtattcagg

SEQ ID NO: 15974 - DNA, 20 bp, Artificial Sequence
  chemically synthesized
tgagagaaaaatgagtattc

SEQ ID NO: 15975 - DNA, 20 bp, Artificial Sequence
  chemically synthesized
ttgagagaaaaatgagtatt

SEQ ID NO: 15976 - DNA, 20 bp, Artificial Sequence
  chemically synthesized
tattaccttgagagaaaaat

SEQ ID NO: 15977 - DNA, 20 bp, Artificial Sequence
  chemically synthesized
tgaatactcatttttctctc

SEQ ID NO: 15978 - DNA, 20 bp, Artificial Sequence
  chemically synthesized
gaatactcatttttctctca

SEQ ID NO: 15979 - DNA, 20 bp, Artificial Sequence
  chemically synthesized
aattgattttattaccttga

SEQ ID NO: 15980 - DNA, 20 bp, Artificial Sequence
  chemically synthesized
tgaattgattttattacctt

SEQ ID NO: 15981 - DNA, 20 bp, Artificial Sequence
  chemically synthesized
aaggtaataaaatcaattca

SEQ ID NO: 15982 - DNA, 20 bp, Artificial Sequence
  chemically synthesized
ataaaatcaattcatggcta

SEQ ID NO: 15983 - DNA, 20 bp, Artificial Sequence
  chemically synthesized
aaatcaattcatggctacag

SEQ ID NO: 15984 - DNA, 20 bp, Artificial Sequence
  chemically synthesized
acttaattgcatttcttctg

SEQ ID NO: 15985 - DNA, 20 bp, Artificial Sequence
  chemically synthesized
gctacagaagaaatgcaatt

SEQ ID NO: 15986 - DNA, 20 bp, Artificial Sequence
  chemically synthesized
aaatgcaattaagtatttct

SEQ ID NO: 15987 - DNA, 20 bp, Artificial Sequence
  chemically synthesized
gcaattaagtatttctcagc

SEQ ID NO: 15988 - DNA, 20 bp, Artificial Sequence
  chemically synthesized
gctgggatgcagggcttgct

SEQ ID NO: 15989 - DNA, 20 bp, Artificial Sequence
  chemically synthesized
tctcagcaagccctgcatcc

SEQ ID NO: 15990 - DNA, 20 bp, Artificial Sequence
  chemically synthesized
ttcatggtagctgggatgca

SEQ ID NO: 15991 - DNA, 20 bp, Artificial Sequence
  chemically synthesized
gttcatggtagctgggatgc

SEQ ID NO: 15992 - DNA, 20 bp, Artificial Sequence
  chemically synthesized
tgttcatggtagctgggatg

SEQ ID NO: 15993 - DNA, 20 bp, Artificial Sequence
  chemically synthesized
tgtacgtgttcatggtagct

SEQ ID NO: 15994 - DNA, 20 bp, Artificial Sequence
  chemically synthesized
atgtacgtgttcatggtagc

SEQ ID NO: 15995 - DNA, 20 bp, Artificial Sequence
  chemically synthesized
tacaatgtacgtgttcatgg

SEQ ID NO: 15996 - DNA, 20 bp, Artificial Sequence
  chemically synthesized
aaatacaatgtacgtgttca

SEQ ID NO: 15997 - DNA, 20 bp, Artificial Sequence
  chemically synthesized
aacacgtacattgtattttt

SEQ ID NO: 15998 - DNA, 20 bp, Artificial Sequence
  chemically synthesized
acacgtacattgtatttttt

SEQ ID NO: 15999 - DNA, 20 bp, Artificial Sequence
  chemically synthesized
acgtacattgtattttttag

SEQ ID NO: 16000 - DNA, 20 bp, Artificial Sequence
  chemically synthesized
tacattgtattttttaggag

SEQ ID NO: 16001 - DNA, 20 bp, Artificial Sequence
  chemically synthesized
acattgtattttttaggaga

SEQ ID NO: 16002 - DNA, 20 bp, Artificial Sequence
  chemically synthesized
attttttaggagaaggcaat

SEQ ID NO: 16003 - DNA, 20 bp, Artificial Sequence
  chemically synthesized
gcaattggcatttcaattgt

SEQ ID NO: 16004 - DNA, 20 bp, Artificial Sequence
  chemically synthesized
caattggcatttcaattgtg

SEQ ID NO: 16005 - DNA, 20 bp, Artificial Sequence
  chemically synthesized
tagtttattaagtgttcaca

SEQ ID NO: 16006 - DNA, 20 bp, Artificial Sequence
  chemically synthesized
actaattattgtagtttatt

SEQ ID NO: 16007 - DNA, 20 bp, Artificial Sequence
  chemically synthesized
acttaataaactacaataat

SEQ ID NO: 16008 - DNA, 20 bp, Artificial Sequence
  chemically synthesized
gatgactgtactaattattg

SEQ ID NO: 16009 - DNA, 20 bp, Artificial Sequence
  chemically synthesized
ataaactacaataattagta

SEQ ID NO: 16010 - DNA, 20 bp, Artificial Sequence
  chemically synthesized
taattagtacagtcatccct

SEQ ID NO: 16011 - DNA, 20 bp, Artificial Sequence
  chemically synthesized
caacccctagcatatactga

SEQ ID NO: 16012 - DNA, 20 bp, Artificial Sequence
  chemically synthesized
gcaacccctagcatatactg

SEQ ID NO: 16013 - DNA, 20 bp, Artificial Sequence
  chemically synthesized
agcaacccctagcatatact

SEQ ID NO: 16014 - DNA, 20 bp, Artificial Sequence
  chemically synthesized
agtcatccctcagtatatgc

SEQ ID NO: 16015 - DNA, 20 bp, Artificial Sequence
  chemically synthesized
gtcatccctcagtatatgct

SEQ ID NO: 16016 - DNA, 20 bp, Artificial Sequence
  chemically synthesized
tcatccctcagtatatgcta

SEQ ID NO: 16017 - DNA, 20 bp, Artificial Sequence
  chemically synthesized
catccctcagtatatgctag

SEQ ID NO: 16018 - DNA, 20 bp, Artificial Sequence
  chemically synthesized
gcgggccaggaagcaacccc

SEQ ID NO: 16019 - DNA, 20 bp, Artificial Sequence
  chemically synthesized
atatgctaggggttgcttcc

SEQ ID NO: 16020 - DNA, 20 bp, Artificial Sequence
  chemically synthesized
tggggctgcggcgggccagg

SEQ ID NO: 16021 - DNA, 20 bp, Artificial Sequence
  chemically synthesized
gagtggggctgcggcgggcc

SEQ ID NO: 16022 - DNA, 20 bp, Artificial Sequence
  chemically synthesized
ggagtggggctgcggcgggc

SEQ ID NO: 16023 - DNA, 20 bp, Artificial Sequence
  chemically synthesized
ggttgcttcctggcccgccg

SEQ ID NO: 16024 - DNA, 20 bp, Artificial Sequence
  chemically synthesized
cgtgggagtggggctgcggc

SEQ ID NO: 16025 - DNA, 20 bp, Artificial Sequence
  chemically synthesized
ccgtgggagtggggctgcgg

SEQ ID NO: 16026 - DNA, 20 bp, Artificial Sequence
  chemically synthesized
tccccgtgggagtggggctg

SEQ ID NO: 16027 - DNA, 20 bp, Artificial Sequence
  chemically synthesized
gcaaaatccccgtgggagtg

SEQ ID NO: 16028 - DNA, 20 bp, Artificial Sequence
  chemically synthesized
ccgccgcagccccactccca

SEQ ID NO: 16029 - DNA, 20 bp, Artificial Sequence
  chemically synthesized
agcaaaatccccgtgggagt

SEQ ID NO: 16030 - DNA, 20 bp, Artificial Sequence
  chemically synthesized
cgccgcagccccactcccac

SEQ ID NO: 16031 - DNA, 20 bp, Artificial Sequence
  chemically synthesized
cagcaaaatccccgtgggag

SEQ ID NO: 16032 - DNA, 20 bp, Artificial Sequence
  chemically synthesized
gccgcagccccactcccacg

SEQ ID NO: 16033 - DNA, 20 bp, Artificial Sequence
  chemically synthesized
caacagcaaaatccccgtgg

SEQ ID NO: 16034 - DNA, 20 bp, Artificial Sequence
  chemically synthesized
ctcaacagcaaaatccccgt

SEQ ID NO: 16035 - DNA, 20 bp, Artificial Sequence
  chemically synthesized
tctcaacagcaaaatccccg

SEQ ID NO: 16036 - DNA, 20 bp, Artificial Sequence
  chemically synthesized
cccacggggattttgctgtt

SEQ ID NO: 16037 - DNA, 20 bp, Artificial Sequence
  chemically synthesized
tggattttgctgtatctcaa

SEQ ID NO: 16038 - DNA, 20 bp, Artificial Sequence
  chemically synthesized
gggattttgctgttgagata

SEQ ID NO: 16039 - DNA, 20 bp, Artificial Sequence
  chemically synthesized
ctgtgggacttgcgtatgcg

SEQ ID NO: 16040 - DNA, 20 bp, Artificial Sequence
  chemically synthesized
agcaaaatccacgcatacgc

SEQ ID NO: 16041 - DNA, 20 bp, Artificial Sequence
  chemically synthesized
ccacgcatacgcaagtccca

SEQ ID NO: 16042 - DNA, 20 bp, Artificial Sequence
  chemically synthesized
cgcatacgcaagtcccacag

SEQ ID NO: 16043 - DNA, 20 bp, Artificial Sequence
  chemically synthesized
gcatacgcaagtcccacagt

SEQ ID NO: 16044 - DNA, 20 bp, Artificial Sequence
  chemically synthesized
cgttcagctgggcctactgt

SEQ ID NO: 16045 - DNA, 20 bp, Artificial Sequence
  chemically synthesized
gcgttcagctgggcctactg

SEQ ID NO: 16046 - DNA, 20 bp, Artificial Sequence
  chemically synthesized
cgcaagtcccacagtaggcc

SEQ ID NO: 16047 - DNA, 20 bp, Artificial Sequence
  chemically synthesized
ctgcggatatgcgttcagct

SEQ ID NO: 16048 - DNA, 20 bp, Artificial Sequence
  chemically synthesized
cctgcggatatgcgttcagc

SEQ ID NO: 16049 - DNA, 20 bp, Artificial Sequence
  chemically synthesized
gaaacctgcggatatgcgtt

SEQ ID NO: 16050 - DNA, 20 bp, Artificial Sequence
  chemically synthesized
cccagctgaacgcatatccg

SEQ ID NO: 16051 - DNA, 20 bp, Artificial Sequence
  chemically synthesized
ccagctgaacgcatatccgc

SEQ ID NO: 16052 - DNA, 20 bp, Artificial Sequence
  chemically synthesized
ctcaagagatgtgaaacctg

SEQ ID NO: 16053 - DNA, 20 bp, Artificial Sequence
  chemically synthesized
ccgcaggtttcacatctctt

SEQ ID NO: 16054 - DNA, 20 bp, Artificial Sequence
  chemically synthesized
atcgaaaatgcagtactcaa

SEQ ID NO: 16055 - DNA, 20 bp, Artificial Sequence
  chemically synthesized
gtatcgaaaatgcagtactc

SEQ ID NO: 16056 - DNA, 20 bp, Artificial Sequence
  chemically synthesized
ccaaatgcgtatcgaaaatg

SEQ ID NO: 16057 - DNA, 20 bp, Artificial Sequence
  chemically synthesized
ctgcattttcgatacgcatt

SEQ ID NO: 16058 - DNA, 20 bp, Artificial Sequence
  chemically synthesized
gttgaaaacgatccacttat

SEQ ID NO: 16059 - DNA, 20 bp, Artificial Sequence
  chemically synthesized
tgtgtgggtccacttataag

SEQ ID NO: 16060 - DNA, 20 bp, Artificial Sequence
  chemically synthesized
gaaaacgatccacttataag

SEQ ID NO: 16061 - DNA, 20 bp, Artificial Sequence
  chemically synthesized
aactgtgtgggtccacttat

SEQ ID NO: 16062 - DNA, 20 bp, Artificial Sequence
  chemically synthesized
cacttataagtggacccaca

SEQ ID NO: 16063 - DNA, 20 bp, Artificial Sequence
  chemically synthesized
aacatagatttgaactgtgt

SEQ ID NO: 16064 - DNA, 20 bp, Artificial Sequence
  chemically synthesized
aaacatagatttgaactgtg

SEQ ID NO: 16065 - DNA, 20 bp, Artificial Sequence
  chemically synthesized
gagttgacccttgaaaaaca

SEQ ID NO: 16066 - DNA, 20 bp, Artificial Sequence
  chemically synthesized
agttcaaatctatgtttttc

SEQ ID NO: 16067 - DNA, 20 bp, Artificial Sequence
  chemically synthesized
gttcaaatctatgtttttca

SEQ ID NO: 16068 - DNA, 20 bp, Artificial Sequence
  chemically synthesized
ttcaaatctatgtttttcaa

SEQ ID NO: 16069 - DNA, 20 bp, Artificial Sequence
  chemically synthesized
tttcaagggtcaactctata

SEQ ID NO: 16070 - DNA, 20 bp, Artificial Sequence
  chemically synthesized
tcaagggtcaactctatata

SEQ ID NO: 16071 - DNA, 20 bp, Artificial Sequence
  chemically synthesized
aatgtttacttctctatata

SEQ ID NO: 16072 - DNA, 20 bp, Artificial Sequence
  chemically synthesized
agggtcaactctatatagag

SEQ ID NO: 16073 - DNA, 20 bp, Artificial Sequence
  chemically synthesized
ccaatgtttacttctctata

SEQ ID NO: 16074 - DNA, 20 bp, Artificial Sequence
  chemically synthesized
ctatatagagaagtaaacat

SEQ ID NO: 16075 - DNA, 20 bp, Artificial Sequence
  chemically synthesized
tatatagagaagtaaacatt

SEQ ID NO: 16076 - DNA, 20 bp, Artificial Sequence
  chemically synthesized
tagagaagtaaacattgggc

SEQ ID NO: 16077 - DNA, 20 bp, Artificial Sequence
  chemically synthesized
gagaagtaaacattgggcaa

SEQ ID NO: 16078 - DNA, 20 bp, Artificial Sequence
  chemically synthesized
attgggcaagagactgtgcc

SEQ ID NO: 16079 - DNA, 20 bp, Artificial Sequence
  chemically synthesized
tatctgagaattactgggca

SEQ ID NO: 16080 - DNA, 20 bp, Artificial Sequence
  chemically synthesized
cttgttatctgagaattact

SEQ ID NO: 16081 - DNA, 20 bp, Artificial Sequence
  chemically synthesized
tcttgttatctgagaattac

SEQ ID NO: 16082 - DNA, 20 bp, Artificial Sequence
  chemically synthesized
agactgtgcccagtaattct

SEQ ID NO: 16083 - DNA, 20 bp, Artificial Sequence
  chemically synthesized
cccagtaattctcagataac

SEQ ID NO: 16084 - DNA, 20 bp, Artificial Sequence
  chemically synthesized
atggtggtttcttgttatct

SEQ ID NO: 16085 - DNA, 20 bp, Artificial Sequence
  chemically synthesized
ataacaagaaaccaccatcc

SEQ ID NO: 16086 - DNA, 20 bp, Artificial Sequence
  chemically synthesized
ctgtattgtttccaggatgg

SEQ ID NO: 16087 - DNA, 20 bp, Artificial Sequence
  chemically synthesized
gttctgtattgtttccagga

SEQ ID NO: 16088 - DNA, 20 bp, Artificial Sequence
  chemically synthesized
tatcgttctgtattgtttcc

SEQ ID NO: 16089 - DNA, 20 bp, Artificial Sequence
  chemically synthesized
gtatcgttctgtattgtttc

SEQ ID NO: 16090 - DNA, 20 bp, Artificial Sequence
  chemically synthesized
ccaccatcctggaaacaata

SEQ ID NO: 16091 - DNA, 20 bp, Artificial Sequence
  chemically synthesized
atttaggaaagaaattaagg

SEQ ID NO: 16092 - DNA, 20 bp, Artificial Sequence
  chemically synthesized
aatttaggaaagaaattaag

SEQ ID NO: 16093 - DNA, 20 bp, Artificial Sequence
  chemically synthesized
gcaatttaggaaagaaatta

SEQ ID NO: 16094 - DNA, 20 bp, Artificial Sequence
  chemically synthesized
tgcaatttaggaaagaaatt

SEQ ID NO: 16095 - DNA, 20 bp, Artificial Sequence
  chemically synthesized
aattaatctgcaatttagga

SEQ ID NO: 16096 - DNA, 20 bp, Artificial Sequence
  chemically synthesized
ttaatttctttcctaaattg

SEQ ID NO: 16097 - DNA, 20 bp, Artificial Sequence
  chemically synthesized
ctttaattaatctgcaattt

SEQ ID NO: 16098 - DNA, 20 bp, Artificial Sequence
  chemically synthesized
tctttaattaatctgcaatt

SEQ ID NO: 16099 - DNA, 20 bp, Artificial Sequence
  chemically synthesized
cctaaattgcagattaatta

SEQ ID NO: 16100 - DNA, 20 bp, Artificial Sequence
  chemically synthesized
aattgcagattaattaaaga

SEQ ID NO: 16101 - DNA, 20 bp, Artificial Sequence
  chemically synthesized
attgcagattaattaaagac

SEQ ID NO: 16102 - DNA, 20 bp, Artificial Sequence
  chemically synthesized
aaagacaggaactatacttc

SEQ ID NO: 16103 - DNA, 20 bp, Artificial Sequence
  chemically synthesized
taacagagactccagaagta

SEQ ID NO: 16104 - DNA, 20 bp, Artificial Sequence
  chemically synthesized
agacaggaactatacttctg

SEQ ID NO: 16105 - DNA, 20 bp, Artificial Sequence
  chemically synthesized
gattttaacagagactccag

SEQ ID NO: 16106 - DNA, 20 bp, Artificial Sequence
  chemically synthesized
gcagattttaacagagactc

SEQ ID NO: 16107 - DNA, 20 bp, Artificial Sequence
  chemically synthesized
caattcagcagattttaaca

SEQ ID NO: 16108 - DNA, 20 bp, Artificial Sequence
  chemically synthesized
ttcaattcagcagattttaa

SEQ ID NO: 16109 - DNA, 20 bp, Artificial Sequence
  chemically synthesized
ccacccactgttcaattcag

SEQ ID NO: 16110 - DNA, 20 bp, Artificial Sequence
  chemically synthesized
ttaaaatctgctgaattgaa

SEQ ID NO: 16111 - DNA, 20 bp, Artificial Sequence
  chemically synthesized
ttcccacccactgttcaatt

SEQ ID NO: 16112 - DNA, 20 bp, Artificial Sequence
  chemically synthesized
aaatctgctgaattgaacag

SEQ ID NO: 16113 - DNA, 20 bp, Artificial Sequence
  chemically synthesized
aatctgctgaattgaacagt

SEQ ID NO: 16114 - DNA, 20 bp, Artificial Sequence
  chemically synthesized
ctgctgaattgaacagtggg

SEQ ID NO: 16115 - DNA, 20 bp, Artificial Sequence
  chemically synthesized
tgctgaattgaacagtgggt

SEQ ID NO: 16116 - DNA, 20 bp, Artificial Sequence
  chemically synthesized
tatttcttgcgatcatattg

SEQ ID NO: 16117 - DNA, 20 bp, Artificial Sequence
  chemically synthesized
ttcaactgcaatatgatcgc

SEQ ID NO: 16118 - DNA, 20 bp, Artificial Sequence
  chemically synthesized
aatatgatcgcaagaaataa

SEQ ID NO: 16119 - DNA, 20 bp, Artificial Sequence
  chemically synthesized
atatgatcgcaagaaataaa

SEQ ID NO: 16120 - DNA, 20 bp, Artificial Sequence
  chemically synthesized
tgatcgcaagaaataaaagg

SEQ ID NO: 16121 - DNA, 20 bp, Artificial Sequence
  chemically synthesized
aagattataaaatctgtatg

SEQ ID NO: 16122 - DNA, 20 bp, Artificial Sequence
  chemically synthesized
tttaaaattctgacttcata

SEQ ID NO: 16123 - DNA, 20 bp, Artificial Sequence
  chemically synthesized
ttataaaatctgtatgaagt

SEQ ID NO: 16124 - DNA, 20 bp, Artificial Sequence
  chemically synthesized
tatgaagtcagaattttaaa

SEQ ID NO: 16125 - DNA, 20 bp, Artificial Sequence
  chemically synthesized
cagaattttaaaaagctgcc

SEQ ID NO: 16126 - DNA, 20 bp, Artificial Sequence
  chemically synthesized
tgctcttcaggatgactagg

SEQ ID NO: 16127 - DNA, 20 bp, Artificial Sequence
  chemically synthesized
ttttgctcttcaggatgact

SEQ ID NO: 16128 - DNA, 20 bp, Artificial Sequence
  chemically synthesized
tttttgctcttcaggatgac

SEQ ID NO: 16129 - DNA, 20 bp, Artificial Sequence
  chemically synthesized
aaagctgcctagtcatcctg

SEQ ID NO: 16130 - DNA, 20 bp, Artificial Sequence
  chemically synthesized
agctgcctagtcatcctgaa

SEQ ID NO: 16131 - DNA, 20 bp, Artificial Sequence
  chemically synthesized
agtgtatgtttttgctcttc

SEQ ID NO: 16132 - DNA, 20 bp, Artificial Sequence
  chemically synthesized
aagtgtatgtttttgctctt

SEQ ID NO: 16133 - DNA, 20 bp, Artificial Sequence
  chemically synthesized
agcaaaaacatacacttgta

SEQ ID NO: 16134 - DNA, 20 bp, Artificial Sequence
  chemically synthesized
gctctttataaaatctttac

SEQ ID NO: 16135 - DNA, 20 bp, Artificial Sequence
  chemically synthesized
acacttgtaaagattttata

SEQ ID NO: 16136 - DNA, 20 bp, Artificial Sequence
  chemically synthesized
acttgtaaagattttataaa

SEQ ID NO: 16137 - DNA, 20 bp, Artificial Sequence
  chemically synthesized
tgtaaagattttataaagag

SEQ ID NO: 16138 - DNA, 20 bp, Artificial Sequence
  chemically synthesized
aaagattttataaagagcag

SEQ ID NO: 16139 - DNA, 20 bp, Artificial Sequence
  chemically synthesized
taaagagcagaagacaaaat

SEQ ID NO: 16140 - DNA, 20 bp, Artificial Sequence
  chemically synthesized
aaattttggacagtttgaga

SEQ ID NO: 16141 - DNA, 20 bp, Artificial Sequence
  chemically synthesized
aaggaaattttggacagttt

SEQ ID NO: 16142 - DNA, 20 bp, Artificial Sequence
  chemically synthesized
tcgataaaggaaattttgga

SEQ ID NO: 16143 - DNA, 20 bp, Artificial Sequence
  chemically synthesized
gtaatcgataaaggaaattt

SEQ ID NO: 16144 - DNA, 20 bp, Artificial Sequence
  chemically synthesized
acatttactgtaatcgataa

SEQ ID NO: 16145 - DNA, 20 bp, Artificial Sequence
  chemically synthesized
gacatttactgtaatcgata

SEQ ID NO: 16146 - DNA, 20 bp, Artificial Sequence
  chemically synthesized
aaaatttcctttatcgatta

SEQ ID NO: 16147 - DNA, 20 bp, Artificial Sequence
  chemically synthesized
tacagtaaatgtccttgtgt

SEQ ID NO: 16148 - DNA, 20 bp, Artificial Sequence
  chemically synthesized
atcacatagaaaccaacaca

SEQ ID NO: 16149 - DNA, 20 bp, Artificial Sequence
  chemically synthesized
catcacatagaaaccaacac

SEQ ID NO: 16150 - DNA, 20 bp, Artificial Sequence
  chemically synthesized
ttgtgttggtttctatgtga

SEQ ID NO: 16151 - DNA, 20 bp, Artificial Sequence
  chemically synthesized
ttatgtgtgataccatcaca

SEQ ID NO: 16152 - DNA, 20 bp, Artificial Sequence
  chemically synthesized
tgtgatggtatcacacataa

SEQ ID NO: 16153 - DNA, 20 bp, Artificial Sequence
  chemically synthesized
gtgatggtatcacacataaa

SEQ ID NO: 16154 - DNA, 20 bp, Artificial Sequence
  chemically synthesized
tatcacacataaaaggctaa

SEQ ID NO: 16155 - DNA, 20 bp, Artificial Sequence
  chemically synthesized
taagtccagatgaagtctgt

SEQ ID NO: 16156 - DNA, 20 bp, Artificial Sequence
  chemically synthesized
aaaggctaacagacttcatc

SEQ ID NO: 16157 - DNA, 20 bp, Artificial Sequence
  chemically synthesized
ataccttctaagtccagatg

SEQ ID NO: 16158 - DNA, 20 bp, Artificial Sequence
  chemically synthesized
taacagacttcatctggact

SEQ ID NO: 16159 - DNA, 20 bp, Artificial Sequence
  chemically synthesized
cagacttcatctggacttag

SEQ ID NO: 16160 - DNA, 20 bp, Artificial Sequence
  chemically synthesized
ctgtacataccttctaagtc

SEQ ID NO: 16161 - DNA, 20 bp, Artificial Sequence
  chemically synthesized
agacttcatctggacttaga

SEQ ID NO: 16162 - DNA, 20 bp, Artificial Sequence
  chemically synthesized
tcattctgtacataccttct

SEQ ID NO: 16163 - DNA, 20 bp, Artificial Sequence
  chemically synthesized
ctggacttagaaggtatgta

SEQ ID NO: 16164 - DNA, 20 bp, Artificial Sequence
  chemically synthesized
aaggtatgtacagaatgatc

SEQ ID NO: 16165 - DNA, 20 bp, Artificial Sequence
  chemically synthesized
tgtatacctatattttaagc

SEQ ID NO: 16166 - DNA, 20 bp, Artificial Sequence
  chemically synthesized
gaatgatctggcttaaaata

SEQ ID NO: 16167 - DNA, 20 bp, Artificial Sequence
  chemically synthesized
aatgatctggcttaaaatat

SEQ ID NO: 16168 - DNA, 20 bp, Artificial Sequence
  chemically synthesized
tttgtgtatacctatatttt

SEQ ID NO: 16169 - DNA, 20 bp, Artificial Sequence
  chemically synthesized
gtatacacaaaattcacact

SEQ ID NO: 16170 - DNA, 20 bp, Artificial Sequence
  chemically synthesized
tatacacaaaattcacactt

SEQ ID NO: 16171 - DNA, 20 bp, Artificial Sequence
  chemically synthesized
atacacaaaattcacacttg

SEQ ID NO: 16172 - DNA, 20 bp, Artificial Sequence
  chemically synthesized
cagttcctttcaagggcccc

SEQ ID NO: 16173 - DNA, 20 bp, Artificial Sequence
  chemically synthesized
ttcacacttggggcccttga

SEQ ID NO: 16174 - DNA, 20 bp, Artificial Sequence
  chemically synthesized
tcacacttggggcccttgaa

SEQ ID NO: 16175 - DNA, 20 bp, Artificial Sequence
  chemically synthesized
gcctgtgcagttcctttcaa

SEQ ID NO: 16176 - DNA, 20 bp, Artificial Sequence
  chemically synthesized
tgcctgtgcagttcctttca

SEQ ID NO: 16177 - DNA, 20 bp, Artificial Sequence
  chemically synthesized
ctgcctgtgcagttcctttc

SEQ ID NO: 16178 - DNA, 20 bp, Artificial Sequence
  chemically synthesized
ggcccttgaaaggaactgca

SEQ ID NO: 16179 - DNA, 20 bp, Artificial Sequence
  chemically synthesized
gcccttgaaaggaactgcac

SEQ ID NO: 16180 - DNA, 20 bp, Artificial Sequence
  chemically synthesized
cttgaaaggaactgcacagg

SEQ ID NO: 16181 - DNA, 20 bp, Artificial Sequence
  chemically synthesized
agaaaagctatctgcctgtg

SEQ ID NO: 16182 - DNA, 20 bp, Artificial Sequence
  chemically synthesized
aaaggaactgcacaggcaga

SEQ ID NO: 16183 - DNA, 20 bp, Artificial Sequence
  chemically synthesized
acaggcagatagcttttctc

SEQ ID NO: 16184 - DNA, 20 bp, Artificial Sequence
  chemically synthesized
caggcagatagcttttctct

SEQ ID NO: 16185 - DNA, 20 bp, Artificial Sequence
  chemically synthesized
agaaccaccgacctagagaa

SEQ ID NO: 16186 - DNA, 20 bp, Artificial Sequence
  chemically synthesized
cagatagcttttctctaggt

SEQ ID NO: 16187 - DNA, 20 bp, Artificial Sequence
  chemically synthesized
ggttgagaaccaccgaccta

SEQ ID NO: 16188 - DNA, 20 bp, Artificial Sequence
  chemically synthesized
atagcttttctctaggtcgg

SEQ ID NO: 16189 - DNA, 20 bp, Artificial Sequence
  chemically synthesized
ccggttgagaaccaccgacc

SEQ ID NO: 16190 - DNA, 20 bp, Artificial Sequence
  chemically synthesized
ctaggtcggtggttctcaac

SEQ ID NO: 16191 - DNA, 20 bp, Artificial Sequence
  chemically synthesized
gtacggcatcatttccggtt

SEQ ID NO: 16192 - DNA, 20 bp, Artificial Sequence
  chemically synthesized
ctggggtacggcatcatttc

SEQ ID NO: 16193 - DNA, 20 bp, Artificial Sequence
  chemically synthesized
ccggaaatgatgccgtaccc

SEQ ID NO: 16194 - DNA, 20 bp, Artificial Sequence
  chemically synthesized
ggaaatgatgccgtacccca

SEQ ID NO: 16195 - DNA, 20 bp, Artificial Sequence
  chemically synthesized
gttatatttcctctggggta

SEQ ID NO: 16196 - DNA, 20 bp, Artificial Sequence
  chemically synthesized
gaaatgatgccgtaccccag

SEQ ID NO: 16197 - DNA, 20 bp, Artificial Sequence
  chemically synthesized
acattgttatatttcctctg

SEQ ID NO: 16198 - DNA, 20 bp, Artificial Sequence
  chemically synthesized
aacattgttatatttcctct

SEQ ID NO: 16199 - DNA, 20 bp, Artificial Sequence
  chemically synthesized
aaacattgttatatttcctc

SEQ ID NO: 16200 - DNA, 20 bp, Artificial Sequence
  chemically synthesized
agaggaaatataacaatgtt

SEQ ID NO: 16201 - DNA, 20 bp, Artificial Sequence
  chemically synthesized
aggaaatataacaatgtttg

SEQ ID NO: 16202 - DNA, 20 bp, Artificial Sequence
  chemically synthesized
tgtttttctctgatgttttt

SEQ ID NO: 16203 - DNA, 20 bp, Artificial Sequence
  chemically synthesized
gagtgtcgaccaaaaaacat

SEQ ID NO: 16204 - DNA, 20 bp, Artificial Sequence
  chemically synthesized
gtgtcgaccaaaaaacatca

SEQ ID NO: 16205 - DNA, 20 bp, Artificial Sequence
  chemically synthesized
caaaataaatttaacatatt

SEQ ID NO: 16206 - DNA, 20 bp, Artificial Sequence
  chemically synthesized
caaatatgttaaatttattt

SEQ ID NO: 16207 - DNA, 20 bp, Artificial Sequence
  chemically synthesized
tgttaaatttattttggaat

SEQ ID NO: 16208 - DNA, 20 bp, Artificial Sequence
  chemically synthesized
tttattttggaattagaaat

SEQ ID NO: 16209 - DNA, 20 bp, Artificial Sequence
  chemically synthesized
ttattttggaattagaaatg

SEQ ID NO: 16210 - DNA, 20 bp, Artificial Sequence
  chemically synthesized
agaaatgaggattacaaccc

SEQ ID NO: 16211 - DNA, 20 bp, Artificial Sequence
  chemically synthesized
ctcctcttcagatgcatctt

SEQ ID NO: 16212 - DNA, 20 bp, Artificial Sequence
  chemically synthesized
tctcctcttcagatgcatct

SEQ ID NO: 16213 - DNA, 20 bp, Artificial Sequence
  chemically synthesized
tacaacccaagatgcatctg

SEQ ID NO: 16214 - DNA, 20 bp, Artificial Sequence
  chemically synthesized
caacccaagatgcatctgaa

SEQ ID NO: 16215 - DNA, 20 bp, Artificial Sequence
  chemically synthesized
aacccaagatgcatctgaag

SEQ ID NO: 16216 - DNA, 20 bp, Artificial Sequence
  chemically synthesized
cccaagatgcatctgaagag

SEQ ID NO: 16217 - DNA, 20 bp, Artificial Sequence
  chemically synthesized
tccctctacagtctcctctt

SEQ ID NO: 16218 - DNA, 20 bp, Artificial Sequence
  chemically synthesized
tgcatctgaagaggagactg

SEQ ID NO: 16219 - DNA, 20 bp, Artificial Sequence
  chemically synthesized
catctgaagaggagactgta

SEQ ID NO: 16220 - DNA, 20 bp, Artificial Sequence
  chemically synthesized
atctgaagaggagactgtag

SEQ ID NO: 16221 - DNA, 20 bp, Artificial Sequence
  chemically synthesized
tctgaagaggagactgtaga

SEQ ID NO: 16222 - DNA, 20 bp, Artificial Sequence
  chemically synthesized
ccaataaaagtttccctcta

SEQ ID NO: 16223 - DNA, 20 bp, Artificial Sequence
  chemically synthesized
ctgtagagggaaacttttat

SEQ ID NO: 16224 - DNA, 20 bp, Artificial Sequence
  chemically synthesized
acttctgtttttaccaataa

SEQ ID NO: 16225 - DNA, 20 bp, Artificial Sequence
  chemically synthesized
gaaacttttattggtaaaaa

SEQ ID NO: 16226 - DNA, 20 bp, Artificial Sequence
  chemically synthesized
acttttattggtaaaaacag

SEQ ID NO: 16227 - DNA, 20 bp, Artificial Sequence
  chemically synthesized
gtaaaaacagaagtttacat

SEQ ID NO: 16228 - DNA, 20 bp, Artificial Sequence
  chemically synthesized
agaagtttacataagctgct

SEQ ID NO: 16229 - DNA, 20 bp, Artificial Sequence
  chemically synthesized
aaacgaactatgtttccaag

SEQ ID NO: 16230 - DNA, 20 bp, Artificial Sequence
  chemically synthesized
acataagctgcttggaaaca

SEQ ID NO: 16231 - DNA, 20 bp, Artificial Sequence
  chemically synthesized
ctgaaacgaactatgtttcc

SEQ ID NO: 16232 - DNA, 20 bp, Artificial Sequence
  chemically synthesized
cttggaaacatagttcgttt

SEQ ID NO: 16233 - DNA, 20 bp, Artificial Sequence
  chemically synthesized
tcgtttcagatgctcaacgc

SEQ ID NO: 16234 - DNA, 20 bp, Artificial Sequence
  chemically synthesized
ctgacaccagttctggcgtt

SEQ ID NO: 16235 - DNA, 20 bp, Artificial Sequence
  chemically synthesized
cagatgctcaacgccagaac

SEQ ID NO: 16236 - DNA, 20 bp, Artificial Sequence
  chemically synthesized
taataaactgacaccagttc

SEQ ID NO: 16237 - DNA, 20 bp, Artificial Sequence
  chemically synthesized
ctcaacgccagaactggtgt

SEQ ID NO: 16238 - DNA, 20 bp, Artificial Sequence
  chemically synthesized
ccccactaataaactgacac

SEQ ID NO: 16239 - DNA, 20 bp, Artificial Sequence
  chemically synthesized
cagaactggtgtcagtttat

SEQ ID NO: 16240 - DNA, 20 bp, Artificial Sequence
  chemically synthesized
aactggtgtcagtttattag

SEQ ID NO: 16241 - DNA, 20 bp, Artificial Sequence
  chemically synthesized
actggtgtcagtttattagt

SEQ ID NO: 16242 - DNA, 20 bp, Artificial Sequence
  chemically synthesized
ctggtgtcagtttattagtg

SEQ ID NO: 16243 - DNA, 20 bp, Artificial Sequence
  chemically synthesized
attagtggggatgccattac

SEQ ID NO: 16244 - DNA, 20 bp, Artificial Sequence
  chemically synthesized
ttagtggggatgccattact

SEQ ID NO: 16245 - DNA, 20 bp, Artificial Sequence
  chemically synthesized
aaagaacatctgcccagtaa

SEQ ID NO: 16246 - DNA, 20 bp, Artificial Sequence
  chemically synthesized
gtggggatgccattactggg

SEQ ID NO: 16247 - DNA, 20 bp, Artificial Sequence
  chemically synthesized
ctctcaaaagaacatctgcc

SEQ ID NO: 16248 - DNA, 20 bp, Artificial Sequence
  chemically synthesized
tactgggcagatgttctttt

SEQ ID NO: 16249 - DNA, 20 bp, Artificial Sequence
  chemically synthesized
ctgggcagatgttcttttga

SEQ ID NO: 16250 - DNA, 20 bp, Artificial Sequence
  chemically synthesized
tgcacgtaatatgctctcaa

SEQ ID NO: 16251 - DNA, 20 bp, Artificial Sequence
  chemically synthesized
gcatattacgtgcactgctg

SEQ ID NO: 16252 - DNA, 20 bp, Artificial Sequence
  chemically synthesized
ttcctctgttaggactgcag

SEQ ID NO: 16253 - DNA, 20 bp, Artificial Sequence
  chemically synthesized
aaattcctctgttaggactg

SEQ ID NO: 16254 - DNA, 20 bp, Artificial Sequence
  chemically synthesized
gtgcactgctgcagtcctaa

SEQ ID NO: 16255 - DNA, 20 bp, Artificial Sequence
  chemically synthesized
gcactgctgcagtcctaaca

SEQ ID NO: 16256 - DNA, 20 bp, Artificial Sequence
  chemically synthesized
cactgctgcagtcctaacag

SEQ ID NO: 16257 - DNA, 20 bp, Artificial Sequence
  chemically synthesized
ccacaagaaattcctctgtt

SEQ ID NO: 16258 - DNA, 20 bp, Artificial Sequence
  chemically synthesized
cccacaagaaattcctctgt

SEQ ID NO: 16259 - DNA, 20 bp, Artificial Sequence
  chemically synthesized
cctaacagaggaatttcttg

SEQ ID NO: 16260 - DNA, 20 bp, Artificial Sequence
  chemically synthesized
ctaacagaggaatttcttgt

SEQ ID NO: 16261 - DNA, 20 bp, Artificial Sequence
  chemically synthesized
taacagaggaatttcttgtg

SEQ ID NO: 16262 - DNA, 20 bp, Artificial Sequence
  chemically synthesized
actttctaaaatcgccccac

SEQ ID NO: 16263 - DNA, 20 bp, Artificial Sequence
  chemically synthesized
aatttcttgtggggcgattt

SEQ ID NO: 16264 - DNA, 20 bp, Artificial Sequence
  chemically synthesized
tcttgtggggcgattttaga

SEQ ID NO: 16265 - DNA, 20 bp, Artificial Sequence
  chemically synthesized
ggcgattttagaaagtcctt

SEQ ID NO: 16266 - DNA, 20 bp, Artificial Sequence
  chemically synthesized
attttagaaagtccttgaga

SEQ ID NO: 16267 - DNA, 20 bp, Artificial Sequence
  chemically synthesized
ctgagataaagactgtctca

SEQ ID NO: 16268 - DNA, 20 bp, Artificial Sequence
  chemically synthesized
cctgagataaagactgtctc

SEQ ID NO: 16269 - DNA, 20 bp, Artificial Sequence
  chemically synthesized
ccttgagacagtctttatct

SEQ ID NO: 16270 - DNA, 20 bp, Artificial Sequence
  chemically synthesized
cttgagacagtctttatctc

SEQ ID NO: 16271 - DNA, 20 bp, Artificial Sequence
  chemically synthesized
atggttacatgcctgagata

SEQ ID NO: 16272 - DNA, 20 bp, Artificial Sequence
  chemically synthesized
gggttcatggttacatgcct

SEQ ID NO: 16273 - DNA, 20 bp, Artificial Sequence
  chemically synthesized
catgaaaggaggagggttca

SEQ ID NO: 16274 - DNA, 20 bp, Artificial Sequence
  chemically synthesized
agggcagcatgaaaggagga

SEQ ID NO: 16275 - DNA, 20 bp, Artificial Sequence
  chemically synthesized
cagggcagcatgaaaggagg

SEQ ID NO: 16276 - DNA, 20 bp, Artificial Sequence
  chemically synthesized
ccagggcagcatgaaaggag

SEQ ID NO: 16277 - DNA, 20 bp, Artificial Sequence
  chemically synthesized
agccagggcagcatgaaagg

SEQ ID NO: 16278 - DNA, 20 bp, Artificial Sequence
  chemically synthesized
gagccagggcagcatgaaag

SEQ ID NO: 16279 - DNA, 20 bp, Artificial Sequence
  chemically synthesized
tagagccagggcagcatgaa

SEQ ID NO: 16280 - DNA, 20 bp, Artificial Sequence
  chemically synthesized
ctagagccagggcagcatga

SEQ ID NO: 16281 - DNA, 20 bp, Artificial Sequence
  chemically synthesized
ctcctcctttcatgctgccc

SEQ ID NO: 16282 - DNA, 20 bp, Artificial Sequence
  chemically synthesized
caaactaactagagccaggg

SEQ ID NO: 16283 - DNA, 20 bp, Artificial Sequence
  chemically synthesized
ctttcatgctgccctggctc

SEQ ID NO: 16284 - DNA, 20 bp, Artificial Sequence
  chemically synthesized
tcccaaactaactagagcca

SEQ ID NO: 16285 - DNA, 20 bp, Artificial Sequence
  chemically synthesized
gtcccaaactaactagagcc

SEQ ID NO: 16286 - DNA, 20 bp, Artificial Sequence
  chemically synthesized
agtcccaaactaactagagc

SEQ ID NO: 16287 - DNA, 20 bp, Artificial Sequence
  chemically synthesized
catgctgccctggctctagt

SEQ ID NO: 16288 - DNA, 20 bp, Artificial Sequence
  chemically synthesized
tgtcagtcccaaactaacta

SEQ ID NO: 16289 - DNA, 20 bp, Artificial Sequence
  chemically synthesized
tgccctggctctagttagtt

SEQ ID NO: 16290 - DNA, 20 bp, Artificial Sequence
  chemically synthesized
tttgtcagtcccaaactaac

SEQ ID NO: 16291 - DNA, 20 bp, Artificial Sequence
  chemically synthesized
gccctggctctagttagttt

SEQ ID NO: 16292 - DNA, 20 bp, Artificial Sequence
  chemically synthesized
gttagtttgggactgacaaa

SEQ ID NO: 16293 - DNA, 20 bp, Artificial Sequence
  chemically synthesized
aggatgaaatcactttttgt

SEQ ID NO: 16294 - DNA, 20 bp, Artificial Sequence
  chemically synthesized
gacaaaaagtgatttcatcc

SEQ ID NO: 16295 - DNA, 20 bp, Artificial Sequence
  chemically synthesized
tgtctcccgtaaaagatacc

SEQ ID NO: 16296 - DNA, 20 bp, Artificial Sequence
  chemically synthesized
atgtctcccgtaaaagatac

SEQ ID NO: 16297 - DNA, 20 bp, Artificial Sequence
  chemically synthesized
tttcatcctggtatctttta

SEQ ID NO: 16298 - DNA, 20 bp, Artificial Sequence
  chemically synthesized
ttcatcctggtatcttttac

SEQ ID NO: 16299 - DNA, 20 bp, Artificial Sequence
  chemically synthesized
catcctggtatcttttacgg

SEQ ID NO: 16300 - DNA, 20 bp, Artificial Sequence
  chemically synthesized
accaaaaatgtctcccgtaa

SEQ ID NO: 16301 - DNA, 20 bp, Artificial Sequence
  chemically synthesized
tcttttacgggagacatttt

SEQ ID NO: 16302 - DNA, 20 bp, Artificial Sequence
  chemically synthesized
acatttttggttgtcacaac

SEQ ID NO: 16303 - DNA, 20 bp, Artificial Sequence
  chemically synthesized
catttttggttgtcacaact

SEQ ID NO: 16304 - DNA, 20 bp, Artificial Sequence
  chemically synthesized
ttttggttgtcacaactggg

SEQ ID NO: 16305 - DNA, 20 bp, Artificial Sequence
  chemically synthesized
tttggttgtcacaactgggc

SEQ ID NO: 16306 - DNA, 20 bp, Artificial Sequence
  chemically synthesized
ttggttgtcacaactgggcg

SEQ ID NO: 16307 - DNA, 20 bp, Artificial Sequence
  chemically synthesized
tggttgtcacaactgggcgg

SEQ ID NO: 16308 - DNA, 20 bp, Artificial Sequence
  chemically synthesized
ggttgtcacaactgggcggg

SEQ ID NO: 16309 - DNA, 20 bp, Artificial Sequence
  chemically synthesized
gttgtcacaactgggcgggg

SEQ ID NO: 16310 - DNA, 20 bp, Artificial Sequence
  chemically synthesized
cccccccccccccccccgcc

SEQ ID NO: 16311 - DNA, 20 bp, Artificial Sequence
  chemically synthesized
ttgtcacaactgggcggggg

SEQ ID NO: 16312 - DNA, 20 bp, Artificial Sequence
  chemically synthesized
tgtcacaactgggcgggggg

SEQ ID NO: 16313 - DNA, 20 bp, Artificial Sequence
  chemically synthesized
gtcacaactgggcggggggg

SEQ ID NO: 16314 - DNA, 20 bp, Artificial Sequence
  chemically synthesized
tcacaactgggcgggggggg

SEQ ID NO: 16315 - DNA, 20 bp, Artificial Sequence
  chemically synthesized
cacaactgggcggggggggg

SEQ ID NO: 16316 - DNA, 20 bp, Artificial Sequence
  chemically synthesized
acaactgggcgggggggggg

SEQ ID NO: 16317 - DNA, 20 bp, Artificial Sequence
  chemically synthesized
caactgggcggggggggggg

SEQ ID NO: 16318 - DNA, 20 bp, Artificial Sequence
  chemically synthesized
aactgggcgggggggggggg

SEQ ID NO: 16319 - DNA, 20 bp, Artificial Sequence
  chemically synthesized
actgggcggggggggggggg

SEQ ID NO: 16320 - DNA, 20 bp, Artificial Sequence
  chemically synthesized
ctgggcgggggggggggggg

SEQ ID NO: 16321 - DNA, 20 bp, Artificial Sequence
  chemically synthesized
tgggcggggggggggggggg

SEQ ID NO: 16322 - DNA, 20 bp, Artificial Sequence
  chemically synthesized
gggcgggggggggggggggg

SEQ ID NO: 16323 - DNA, 20 bp, Artificial Sequence
  chemically synthesized
ggcggggggggggggggggg

SEQ ID NO: 16324 - DNA, 20 bp, Artificial Sequence
  chemically synthesized
gcgggggggggggggggggg

SEQ ID NO: 16325 - DNA, 20 bp, Artificial Sequence
  chemically synthesized
gggggggggggggggggggg

SEQ ID NO: 16326 - DNA, 20 bp, Artificial Sequence
  chemically synthesized
gggggggggggggggggggg

SEQ ID NO: 16327 - DNA, 20 bp, Artificial Sequence
  chemically synthesized
ggggggggggggggggggga

SEQ ID NO: 16328 - DNA, 20 bp, Artificial Sequence
  chemically synthesized
ggggggggggggggggggag

SEQ ID NO: 16329 - DNA, 20 bp, Artificial Sequence
  chemically synthesized
gggggggggggggggggagg

SEQ ID NO: 16330 - DNA, 20 bp, Artificial Sequence
  chemically synthesized
gggggggggggggggagggg

SEQ ID NO: 16331 - DNA, 20 bp, Artificial Sequence
  chemically synthesized
ggggggggggggggaggggg

SEQ ID NO: 16332 - DNA, 20 bp, Artificial Sequence
  chemically synthesized
gggggggggggggaggggga

SEQ ID NO: 16333 - DNA, 20 bp, Artificial Sequence
  chemically synthesized
ggggggggggagggggaggg

SEQ ID NO: 16334 - DNA, 20 bp, Artificial Sequence
  chemically synthesized
gggggggggagggggagggc

SEQ ID NO: 16335 - DNA, 20 bp, Artificial Sequence
  chemically synthesized
ggggggggagggggagggcg

SEQ ID NO: 16336 - DNA, 20 bp, Artificial Sequence
  chemically synthesized
ggggggagggggagggcggg

SEQ ID NO: 16337 - DNA, 20 bp, Artificial Sequence
  chemically synthesized
gggggagggggagggcgggg

SEQ ID NO: 16338 - DNA, 20 bp, Artificial Sequence
  chemically synthesized
ggggagggggagggcgggga

SEQ ID NO: 16339 - DNA, 20 bp, Artificial Sequence
  chemically synthesized
gggagggggagggcggggag

SEQ ID NO: 16340 - DNA, 20 bp, Artificial Sequence
  chemically synthesized
ggagggggagggcggggagg

SEQ ID NO: 16341 - DNA, 20 bp, Artificial Sequence
  chemically synthesized
gggcggggagggggtgctac

SEQ ID NO: 16342 - DNA, 20 bp, Artificial Sequence
  chemically synthesized
ctctatctactaaatgctag

SEQ ID NO: 16343 - DNA, 20 bp, Artificial Sequence
  chemically synthesized
gagggggtgctactagcatt

SEQ ID NO: 16344 - DNA, 20 bp, Artificial Sequence
  chemically synthesized
ggcctctatctactaaatgc

SEQ ID NO: 16345 - DNA, 20 bp, Artificial Sequence
  chemically synthesized
ggggtgctactagcatttag

SEQ ID NO: 16346 - DNA, 20 bp, Artificial Sequence
  chemically synthesized
tgctactagcatttagtaga

SEQ ID NO: 16347 - DNA, 20 bp, Artificial Sequence
  chemically synthesized
ctactagcatttagtagata

SEQ ID NO: 16348 - DNA, 20 bp, Artificial Sequence
  chemically synthesized
tactagcatttagtagatag

SEQ ID NO: 16349 - DNA, 20 bp, Artificial Sequence
  chemically synthesized
agcatttagtagatagaggc

SEQ ID NO: 16350 - DNA, 20 bp, Artificial Sequence
  chemically synthesized
gcatttagtagatagaggcc

SEQ ID NO: 16351 - DNA, 20 bp, Artificial Sequence
  chemically synthesized
ctggatgttttgcagaatcc

SEQ ID NO: 16352 - DNA, 20 bp, Artificial Sequence
  chemically synthesized
gtgtgctgctggatgttttg

SEQ ID NO: 16353 - DNA, 20 bp, Artificial Sequence
  chemically synthesized
ccaggattctgcaaaacatc

SEQ ID NO: 16354 - DNA, 20 bp, Artificial Sequence
  chemically synthesized
ggattctgcaaaacatccag

SEQ ID NO: 16355 - DNA, 20 bp, Artificial Sequence
  chemically synthesized
gaagctgccctgtgtgctgc

SEQ ID NO: 16356 - DNA, 20 bp, Artificial Sequence
  chemically synthesized
gcaaaacatccagcagcaca

SEQ ID NO: 16357 - DNA, 20 bp, Artificial Sequence
  chemically synthesized
caaaacatccagcagcacac

SEQ ID NO: 16358 - DNA, 20 bp, Artificial Sequence
  chemically synthesized
aaaacatccagcagcacaca

SEQ ID NO: 16359 - DNA, 20 bp, Artificial Sequence
  chemically synthesized
acatccagcagcacacaggg

SEQ ID NO: 16360 - DNA, 20 bp, Artificial Sequence
  chemically synthesized
ttctagttctttgttgtggg

SEQ ID NO: 16361 - DNA, 20 bp, Artificial Sequence
  chemically synthesized
cagggcagcttcccacaaca

SEQ ID NO: 16362 - DNA, 20 bp, Artificial Sequence
  chemically synthesized
tcattctagttctttgttgt

SEQ ID NO: 16363 - DNA, 20 bp, Artificial Sequence
  chemically synthesized
atcattctagttctttgttg

SEQ ID NO: 16364 - DNA, 20 bp, Artificial Sequence
  chemically synthesized
agcttcccacaacaaagaac

SEQ ID NO: 16365 - DNA, 20 bp, Artificial Sequence
  chemically synthesized
tgctttggcccgaatcattc

SEQ ID NO: 16366 - DNA, 20 bp, Artificial Sequence
  chemically synthesized
aacaaagaactagaatgatt

SEQ ID NO: 16367 - DNA, 20 bp, Artificial Sequence
  chemically synthesized
acaaagaactagaatgattc

SEQ ID NO: 16368 - DNA, 20 bp, Artificial Sequence
  chemically synthesized
aactagaatgattcgggcca

SEQ ID NO: 16369 - DNA, 20 bp, Artificial Sequence
  chemically synthesized
aatgattcgggccaaagcat

SEQ ID NO: 16370 - DNA, 20 bp, Artificial Sequence
  chemically synthesized
ccttggtgctactgatgctt

SEQ ID NO: 16371 - DNA, 20 bp, Artificial Sequence
  chemically synthesized
gattcgggccaaagcatcag

SEQ ID NO: 16372 - DNA, 20 bp, Artificial Sequence
  chemically synthesized
gccaaagcatcagtagcacc

SEQ ID NO: 16373 - DNA, 20 bp, Artificial Sequence
  chemically synthesized
ccaaagcatcagtagcacca

SEQ ID NO: 16374 - DNA, 20 bp, Artificial Sequence
  chemically synthesized
gcatcagtagcaccaaggtt

SEQ ID NO: 16375 - DNA, 20 bp, Artificial Sequence
  chemically synthesized
ggggcagggtttctcaacct

SEQ ID NO: 16376 - DNA, 20 bp, Artificial Sequence
  chemically synthesized
aagatgttaacattggggca

SEQ ID NO: 16377 - DNA, 20 bp, Artificial Sequence
  chemically synthesized
taagatgttaacattggggc

SEQ ID NO: 16378 - DNA, 20 bp, Artificial Sequence
  chemically synthesized
gtaagatgttaacattgggg

SEQ ID NO: 16379 - DNA, 20 bp, Artificial Sequence
  chemically synthesized
tatgtaagatgttaacattg

SEQ ID NO: 16380 - DNA, 20 bp, Artificial Sequence
  chemically synthesized
ttatgtaagatgttaacatt

SEQ ID NO: 16381 - DNA, 20 bp, Artificial Sequence
  chemically synthesized
gttatgtaagatgttaacat

SEQ ID NO: 16382 - DNA, 20 bp, Artificial Sequence
  chemically synthesized
agtgaaccatatggttatgt

SEQ ID NO: 16383 - DNA, 20 bp, Artificial Sequence
  chemically synthesized
taacatcttacataaccata

SEQ ID NO: 16384 - DNA, 20 bp, Artificial Sequence
  chemically synthesized
gttttgacaagtgaaccata

SEQ ID NO: 16385 - DNA, 20 bp, Artificial Sequence
  chemically synthesized
gtggatttcttagttttgac

SEQ ID NO: 16386 - DNA, 20 bp, Artificial Sequence
  chemically synthesized
atggttcacttgtcaaaact

SEQ ID NO: 16387 - DNA, 20 bp, Artificial Sequence
  chemically synthesized
atgaatcaatgtggatttct

SEQ ID NO: 16388 - DNA, 20 bp, Artificial Sequence
  chemically synthesized
tgaatagtgatgaatcaatg

SEQ ID NO: 16389 - DNA, 20 bp, Artificial Sequence
  chemically synthesized
gaagtctgttgtttagtgaa

SEQ ID NO: 16390 - DNA, 20 bp, Artificial Sequence
  chemically synthesized
catcactattcactaaacaa

SEQ ID NO: 16391 - DNA, 20 bp, Artificial Sequence
  chemically synthesized
tctcagggaagtctgttgtt

SEQ ID NO: 16392 - DNA, 20 bp, Artificial Sequence
  chemically synthesized
actaaacaacagacttccct

SEQ ID NO: 16393 - DNA, 20 bp, Artificial Sequence
  chemically synthesized
taaacaacagacttccctga

SEQ ID NO: 16394 - DNA, 20 bp, Artificial Sequence
  chemically synthesized
cccttgcaggactctcaggg

SEQ ID NO: 16395 - DNA, 20 bp, Artificial Sequence
  chemically synthesized
atgcccttgcaggactctca

SEQ ID NO: 16396 - DNA, 20 bp, Artificial Sequence
  chemically synthesized
aatgcccttgcaggactctc

SEQ ID NO: 16397 - DNA, 20 bp, Artificial Sequence
  chemically synthesized
aaatgcccttgcaggactct

SEQ ID NO: 16398 - DNA, 20 bp, Artificial Sequence
  chemically synthesized
gacttccctgagagtcctgc

SEQ ID NO: 16399 - DNA, 20 bp, Artificial Sequence
  chemically synthesized
acttccctgagagtcctgca

SEQ ID NO: 16400 - DNA, 20 bp, Artificial Sequence
  chemically synthesized
cttccctgagagtcctgcaa

SEQ ID NO: 16401 - DNA, 20 bp, Artificial Sequence
  chemically synthesized
ggcttattaaatgcccttgc

SEQ ID NO: 16402 - DNA, 20 bp, Artificial Sequence
  chemically synthesized
cggcttattaaatgcccttg

SEQ ID NO: 16403 - DNA, 20 bp, Artificial Sequence
  chemically synthesized
gtcctgcaagggcatttaat

SEQ ID NO: 16404 - DNA, 20 bp, Artificial Sequence
  chemically synthesized
tgcaagggcatttaataagc

SEQ ID NO: 16405 - DNA, 20 bp, Artificial Sequence
  chemically synthesized
gtgttgtagaggatagttgc

SEQ ID NO: 16406 - DNA, 20 bp, Artificial Sequence
  chemically synthesized
agtttctgtgttgtagagga

SEQ ID NO: 16407 - DNA, 20 bp, Artificial Sequence
  chemically synthesized
tcccagtttctgtgttgtag

SEQ ID NO: 16408 - DNA, 20 bp, Artificial Sequence
  chemically synthesized
ggcaactatcctctacaaca

SEQ ID NO: 16409 - DNA, 20 bp, Artificial Sequence
  chemically synthesized
ctcccagtttctgtgttgta

SEQ ID NO: 16410 - DNA, 20 bp, Artificial Sequence
  chemically synthesized
gcctcccagtttctgtgttg

SEQ ID NO: 16411 - DNA, 20 bp, Artificial Sequence
  chemically synthesized
atcctctacaacacagaaac

SEQ ID NO: 16412 - DNA, 20 bp, Artificial Sequence
  chemically synthesized
tcctctacaacacagaaact

SEQ ID NO: 16413 - DNA, 20 bp, Artificial Sequence
  chemically synthesized
ctctacaacacagaaactgg

SEQ ID NO: 16414 - DNA, 20 bp, Artificial Sequence
  chemically synthesized
tctacaacacagaaactggg

SEQ ID NO: 16415 - DNA, 20 bp, Artificial Sequence
  chemically synthesized
ataggcctatggtagcctcc

SEQ ID NO: 16416 - DNA, 20 bp, Artificial Sequence
  chemically synthesized
cagaaactgggaggctacca

SEQ ID NO: 16417 - DNA, 20 bp, Artificial Sequence
  chemically synthesized
agaaactgggaggctaccat

SEQ ID NO: 16418 - DNA, 20 bp, Artificial Sequence
  chemically synthesized
gcagttgaataggcctatgg

SEQ ID NO: 16419 - DNA, 20 bp, Artificial Sequence
  chemically synthesized
tcggcagttgaataggccta

SEQ ID NO: 16420 - DNA, 20 bp, Artificial Sequence
  chemically synthesized
tggcatttcggcagttgaat

SEQ ID NO: 16421 - DNA, 20 bp, Artificial Sequence
  chemically synthesized
gtggcatttcggcagttgaa

SEQ ID NO: 16422 - DNA, 20 bp, Artificial Sequence
  chemically synthesized
gaacgagtgtggcatttcgg

SEQ ID NO: 16423 - DNA, 20 bp, Artificial Sequence
  chemically synthesized
tatgaacgagtgtggcattt

SEQ ID NO: 16424 - DNA, 20 bp, Artificial Sequence
  chemically synthesized
cctcagtttatgaacgagtg

SEQ ID NO: 16425 - DNA, 20 bp, Artificial Sequence
  chemically synthesized
tctaccctcagtttatgaac

SEQ ID NO: 16426 - DNA, 20 bp, Artificial Sequence
  chemically synthesized
gccacactcgttcataaact

SEQ ID NO: 16427 - DNA, 20 bp, Artificial Sequence
  chemically synthesized
ccacactcgttcataaactg

SEQ ID NO: 16428 - DNA, 20 bp, Artificial Sequence
  chemically synthesized
cacactcgttcataaactga

SEQ ID NO: 16429 - DNA, 20 bp, Artificial Sequence
  chemically synthesized
actcgttcataaactgaggg

SEQ ID NO: 16430 - DNA, 20 bp, Artificial Sequence
  chemically synthesized
tcgttcataaactgagggta

SEQ ID NO: 16431 - DNA, 20 bp, Artificial Sequence
  chemically synthesized
ccttttgctctctctaccct

SEQ ID NO: 16432 - DNA, 20 bp, Artificial Sequence
  chemically synthesized
gttcataaactgagggtaga

SEQ ID NO: 16433 - DNA, 20 bp, Artificial Sequence
  chemically synthesized
tcataaactgagggtagaga

SEQ ID NO: 16434 - DNA, 20 bp, Artificial Sequence
  chemically synthesized
actgagggtagagagagcaa

SEQ ID NO: 16435 - DNA, 20 bp, Artificial Sequence
  chemically synthesized
ctgagggtagagagagcaaa

SEQ ID NO: 16436 - DNA, 20 bp, Artificial Sequence
  chemically synthesized
tgagggtagagagagcaaaa

SEQ ID NO: 16437 - DNA, 20 bp, Artificial Sequence
  chemically synthesized
gagagcaaaagggaaattaa

SEQ ID NO: 16438 - DNA, 20 bp, Artificial Sequence
  chemically synthesized
ggaaattaaaagccccaaac

SEQ ID NO: 16439 - DNA, 20 bp, Artificial Sequence
  chemically synthesized
tccttgtgacttctagtttg

SEQ ID NO: 16440 - DNA, 20 bp, Artificial Sequence
  chemically synthesized
aattaaaagccccaaactag

SEQ ID NO: 16441 - DNA, 20 bp, Artificial Sequence
  chemically synthesized
ttccttgtgacttctagttt

SEQ ID NO: 16442 - DNA, 20 bp, Artificial Sequence
  chemically synthesized
tttccttgtgacttctagtt

SEQ ID NO: 16443 - DNA, 20 bp, Artificial Sequence
  chemically synthesized
gcgtgtttccttgtgacttc

SEQ ID NO: 16444 - DNA, 20 bp, Artificial Sequence
  chemically synthesized
agccccaaactagaagtcac

SEQ ID NO: 16445 - DNA, 20 bp, Artificial Sequence
  chemically synthesized
gccccaaactagaagtcaca

SEQ ID NO: 16446 - DNA, 20 bp, Artificial Sequence
  chemically synthesized
aaggaaacacgctaaaattg

SEQ ID NO: 16447 - DNA, 20 bp, Artificial Sequence
  chemically synthesized
caaatctgagtctacaattt

SEQ ID NO: 16448 - DNA, 20 bp, Artificial Sequence
  chemically synthesized
acacgctaaaattgtagact

SEQ ID NO: 16449 - DNA, 20 bp, Artificial Sequence
  chemically synthesized
agcaacttgatttcaaatct

SEQ ID NO: 16450 - DNA, 20 bp, Artificial Sequence
  chemically synthesized
gtagactcagatttgaaatc

SEQ ID NO: 16451 - DNA, 20 bp, Artificial Sequence
  chemically synthesized
catagagttgtcagtttgag

SEQ ID NO: 16452 - DNA, 20 bp, Artificial Sequence
  chemically synthesized
ctgcatagagttgtcagttt

SEQ ID NO: 16453 - DNA, 20 bp, Artificial Sequence
  chemically synthesized
aatacactgcatagagttgt

SEQ ID NO: 16454 - DNA, 20 bp, Artificial Sequence
  chemically synthesized
ctcaaactgacaactctatg

SEQ ID NO: 16455 - DNA, 20 bp, Artificial Sequence
  chemically synthesized
atcctggaatacactgcata

SEQ ID NO: 16456 - DNA, 20 bp, Artificial Sequence
  chemically synthesized
ttatcctggaatacactgca

SEQ ID NO: 16457 - DNA, 20 bp, Artificial Sequence
  chemically synthesized
caactctatgcagtgtattc

SEQ ID NO: 16458 - DNA, 20 bp, Artificial Sequence
  chemically synthesized
aactctatgcagtgtattcc

SEQ ID NO: 16459 - DNA, 20 bp, Artificial Sequence
  chemically synthesized
gcagtgtattccaggataaa

SEQ ID NO: 16460 - DNA, 20 bp, Artificial Sequence
  chemically synthesized
atttctgcaactgtttatcc

SEQ ID NO: 16461 - DNA, 20 bp, Artificial Sequence
  chemically synthesized
tattccaggataaacagttg

SEQ ID NO: 16462 - DNA, 20 bp, Artificial Sequence
  chemically synthesized
gaaatttatttatttaatca

SEQ ID NO: 16463 - DNA, 20 bp, Artificial Sequence
  chemically synthesized
atttatttatttaatcatgg

SEQ ID NO: 16464 - DNA, 20 bp, Artificial Sequence
  chemically synthesized
tcatggcagataattatccc

SEQ ID NO: 16465 - DNA, 20 bp, Artificial Sequence
  chemically synthesized
ggcagataattatcccaagc

SEQ ID NO: 16466 - DNA, 20 bp, Artificial Sequence
  chemically synthesized
gcagataattatcccaagca

SEQ ID NO: 16467 - DNA, 20 bp, Artificial Sequence
  chemically synthesized
agacctgctttaccttgctt

SEQ ID NO: 16468 - DNA, 20 bp, Artificial Sequence
  chemically synthesized
cagacctgctttaccttgct

SEQ ID NO: 16469 - DNA, 20 bp, Artificial Sequence
  chemically synthesized
taattatcccaagcaaggta

SEQ ID NO: 16470 - DNA, 20 bp, Artificial Sequence
  chemically synthesized
ttatcccaagcaaggtaaag

SEQ ID NO: 16471 - DNA, 20 bp, Artificial Sequence
  chemically synthesized
tatcccaagcaaggtaaagc

SEQ ID NO: 16472 - DNA, 20 bp, Artificial Sequence
  chemically synthesized
gcaaggtaaagcaggtctgc

SEQ ID NO: 16473 - DNA, 20 bp, Artificial Sequence
  chemically synthesized
acacatacacattgtactag

SEQ ID NO: 16474 - DNA, 20 bp, Artificial Sequence
  chemically synthesized
cacacacatacacattgtac

SEQ ID NO: 16475 - DNA, 20 bp, Artificial Sequence
  chemically synthesized
gtgtgtgttttgattttact

SEQ ID NO: 16476 - DNA, 20 bp, Artificial Sequence
  chemically synthesized
tgttttgattttacttagta

SEQ ID NO: 16477 - DNA, 20 bp, Artificial Sequence
  chemically synthesized
gttttgattttacttagtac

SEQ ID NO: 16478 - DNA, 20 bp, Artificial Sequence
  chemically synthesized
aaatggttatgacctgtact

SEQ ID NO: 16479 - DNA, 20 bp, Artificial Sequence
  chemically synthesized
tagtacaggtcataaccatt

SEQ ID NO: 16480 - DNA, 20 bp, Artificial Sequence
  chemically synthesized
gtacaggtcataaccattta

SEQ ID NO: 16481 - DNA, 20 bp, Artificial Sequence
  chemically synthesized
gttcttattttttctctaaa

SEQ ID NO: 16482 - DNA, 20 bp, Artificial Sequence
  chemically synthesized
taaccatttagagaaaaaat

SEQ ID NO: 16483 - DNA, 20 bp, Artificial Sequence
  chemically synthesized
gtatttaatatttgcatatt

SEQ ID NO: 16484 - DNA, 20 bp, Artificial Sequence
  chemically synthesized
aatacatacatatccataaa

SEQ ID NO: 16485 - DNA, 20 bp, Artificial Sequence
  chemically synthesized
atgtttaggaattctattta

SEQ ID NO: 16486 - DNA, 20 bp, Artificial Sequence
  chemically synthesized
ttctgtcaataaaaatgttt

SEQ ID NO: 16487 - DNA, 20 bp, Artificial Sequence
  chemically synthesized
tttctgtcaataaaaatgtt

SEQ ID NO: 16488 - DNA, 20 bp, Artificial Sequence
  chemically synthesized
ttcctaaacatttttattga

SEQ ID NO: 16489 - DNA, 20 bp, Artificial Sequence
  chemically synthesized
aacatttttattgacagaaa

SEQ ID NO: 16490 - DNA, 20 bp, Artificial Sequence
  chemically synthesized
acatttttattgacagaaaa

SEQ ID NO: 16491 - DNA, 20 bp, Artificial Sequence
  chemically synthesized
gacagaaaaaggtaaattta

SEQ ID NO: 16492 - DNA, 20 bp, Artificial Sequence
  chemically synthesized
taaatttatggaaaacattg

SEQ ID NO: 16493 - DNA, 20 bp, Artificial Sequence
  chemically synthesized
aaatttatggaaaacattgt

SEQ ID NO: 16494 - DNA, 20 bp, Artificial Sequence
  chemically synthesized
aaaacattgtgggcaaacca

SEQ ID NO: 16495 - DNA, 20 bp, Artificial Sequence
  chemically synthesized
ttaccctttttaaaaatctg

SEQ ID NO: 16496 - DNA, 20 bp, Artificial Sequence
  chemically synthesized
gcaaaccacagatttttaaa

SEQ ID NO: 16497 - DNA, 20 bp, Artificial Sequence
  chemically synthesized
caaaccacagatttttaaaa

SEQ ID NO: 16498 - DNA, 20 bp, Artificial Sequence
  chemically synthesized
aaaccacagatttttaaaaa

SEQ ID NO: 16499 - DNA, 20 bp, Artificial Sequence
  chemically synthesized
aaagggtaatctctcctttg

SEQ ID NO: 16500 - DNA, 20 bp, Artificial Sequence
  chemically synthesized
accatatcagccacaaagga

SEQ ID NO: 16501 - DNA, 20 bp, Artificial Sequence
  chemically synthesized
aaaccatatcagccacaaag

SEQ ID NO: 16502 - DNA, 20 bp, Artificial Sequence
  chemically synthesized
ccaaaccatatcagccacaa

SEQ ID NO: 16503 - DNA, 20 bp, Artificial Sequence
  chemically synthesized
gccaaaccatatcagccaca

SEQ ID NO: 16504 - DNA, 20 bp, Artificial Sequence
  chemically synthesized
tctctcctttgtggctgata

SEQ ID NO: 16505 - DNA, 20 bp, Artificial Sequence
  chemically synthesized
gggacacagccaaaccatat

SEQ ID NO: 16506 - DNA, 20 bp, Artificial Sequence
  chemically synthesized
cctttgtggctgatatggtt

SEQ ID NO: 16507 - DNA, 20 bp, Artificial Sequence
  chemically synthesized
atgagatttgggtggggaca

SEQ ID NO: 16508 - DNA, 20 bp, Artificial Sequence
  chemically synthesized
ttcaagatgagatttgggtg

SEQ ID NO: 16509 - DNA, 20 bp, Artificial Sequence
  chemically synthesized
attcaagatgagatttgggt

SEQ ID NO: 16510 - DNA, 20 bp, Artificial Sequence
  chemically synthesized
aattcaagatgagatttggg

SEQ ID NO: 16511 - DNA, 20 bp, Artificial Sequence
  chemically synthesized
tataattcaagatgagattt

SEQ ID NO: 16512 - DNA, 20 bp, Artificial Sequence
  chemically synthesized
ttataattcaagatgagatt

SEQ ID NO: 16513 - DNA, 20 bp, Artificial Sequence
  chemically synthesized
tgggagttataattcaagat

SEQ ID NO: 16514 - DNA, 20 bp, Artificial Sequence
  chemically synthesized
aattgtgggagttataattc

SEQ ID NO: 16515 - DNA, 20 bp, Artificial Sequence
  chemically synthesized
acgacatgtgggaattgtgg

SEQ ID NO: 16516 - DNA, 20 bp, Artificial Sequence
  chemically synthesized
ccacgacatgtgggaattgt

SEQ ID NO: 16517 - DNA, 20 bp, Artificial Sequence
  chemically synthesized
cccacgacatgtgggaattg

SEQ ID NO: 16518 - DNA, 20 bp, Artificial Sequence
  chemically synthesized
aggctcctcccacgacatgt

SEQ ID NO: 16519 - DNA, 20 bp, Artificial Sequence
  chemically synthesized
cccacaattcccacatgtcg

SEQ ID NO: 16520 - DNA, 20 bp, Artificial Sequence
  chemically synthesized
caggctcctcccacgacatg

SEQ ID NO: 16521 - DNA, 20 bp, Artificial Sequence
  chemically synthesized
ccacaattcccacatgtcgt

SEQ ID NO: 16522 - DNA, 20 bp, Artificial Sequence
  chemically synthesized
acaattcccacatgtcgtgg

SEQ ID NO: 16523 - DNA, 20 bp, Artificial Sequence
  chemically synthesized
caattcccacatgtcgtggg

SEQ ID NO: 16524 - DNA, 20 bp, Artificial Sequence
  chemically synthesized
attcccacatgtcgtgggag

SEQ ID NO: 16525 - DNA, 20 bp, Artificial Sequence
  chemically synthesized
cacatgtcgtgggaggagcc

SEQ ID NO: 16526 - DNA, 20 bp, Artificial Sequence
  chemically synthesized
atgtcgtgggaggagcctgg

SEQ ID NO: 16527 - DNA, 20 bp, Artificial Sequence
  chemically synthesized
tgtcgtgggaggagcctggt

SEQ ID NO: 16528 - DNA, 20 bp, Artificial Sequence
  chemically synthesized
tcgtgggaggagcctggtgg

SEQ ID NO: 16529 - DNA, 20 bp, Artificial Sequence
  chemically synthesized
cgtgggaggagcctggtggg

SEQ ID NO: 16530 - DNA, 20 bp, Artificial Sequence
  chemically synthesized
taagtcaatcacctcccacc

SEQ ID NO: 16531 - DNA, 20 bp, Artificial Sequence
  chemically synthesized
ataagtcaatcacctcccac

SEQ ID NO: 16532 - DNA, 20 bp, Artificial Sequence
  chemically synthesized
ggtgggaggtgattgactta

SEQ ID NO: 16533 - DNA, 20 bp, Artificial Sequence
  chemically synthesized
gtgggaggtgattgacttat

SEQ ID NO: 16534 - DNA, 20 bp, Artificial Sequence
  chemically synthesized
tgggaggtgattgacttatg

SEQ ID NO: 16535 - DNA, 20 bp, Artificial Sequence
  chemically synthesized
gggaggtgattgacttatgg

SEQ ID NO: 16536 - DNA, 20 bp, Artificial Sequence
  chemically synthesized
caggaaagaccaacccccat

SEQ ID NO: 16537 - DNA, 20 bp, Artificial Sequence
  chemically synthesized
ggtgattgacttatgggggt

SEQ ID NO: 16538 - DNA, 20 bp, Artificial Sequence
  chemically synthesized
atcacgagaacggcgcagga

SEQ ID NO: 16539 - DNA, 20 bp, Artificial Sequence
  chemically synthesized
cactatcacgagaacggcgc

SEQ ID NO: 16540 - DNA, 20 bp, Artificial Sequence
  chemically synthesized
tcactatcacgagaacggcg

SEQ ID NO: 16541 - DNA, 20 bp, Artificial Sequence
  chemically synthesized
ctcattcactatcacgagaa

SEQ ID NO: 16542 - DNA, 20 bp, Artificial Sequence
  chemically synthesized
ttcctgcgccgttctcgtga

SEQ ID NO: 16543 - DNA, 20 bp, Artificial Sequence
  chemically synthesized
tgagactcattcactatcac

SEQ ID NO: 16544 - DNA, 20 bp, Artificial Sequence
  chemically synthesized
ccgttctcgtgatagtgaat

SEQ ID NO: 16545 - DNA, 20 bp, Artificial Sequence
  chemically synthesized
ttaaaaccatcagatagtgt

SEQ ID NO: 16546 - DNA, 20 bp, Artificial Sequence
  chemically synthesized
atgagtctcacactatctga

SEQ ID NO: 16547 - DNA, 20 bp, Artificial Sequence
  chemically synthesized
ccgtttttaaaaccatcaga

SEQ ID NO: 16548 - DNA, 20 bp, Artificial Sequence
  chemically synthesized
actcccgtttttaaaaccat

SEQ ID NO: 16549 - DNA, 20 bp, Artificial Sequence
  chemically synthesized
ctatctgatggttttaaaaa

SEQ ID NO: 16550 - DNA, 20 bp, Artificial Sequence
  chemically synthesized
tatctgatggttttaaaaac

SEQ ID NO: 16551 - DNA, 20 bp, Artificial Sequence
  chemically synthesized
tctgatggttttaaaaacgg

SEQ ID NO: 16552 - DNA, 20 bp, Artificial Sequence
  chemically synthesized
aaacgggagtttctctgcac

SEQ ID NO: 16553 - DNA, 20 bp, Artificial Sequence
  chemically synthesized
gcaaaaaaagagcttgtgca

SEQ ID NO: 16554 - DNA, 20 bp, Artificial Sequence
  chemically synthesized
aggcaaaaaaagagcttgtg

SEQ ID NO: 16555 - DNA, 20 bp, Artificial Sequence
  chemically synthesized
gatggcagcaggcaaaaaaa

SEQ ID NO: 16556 - DNA, 20 bp, Artificial Sequence
  chemically synthesized
tggatggcagcaggcaaaaa

SEQ ID NO: 16557 - DNA, 20 bp, Artificial Sequence
  chemically synthesized
caacttacctggatggcagc

SEQ ID NO: 16558 - DNA, 20 bp, Artificial Sequence
  chemically synthesized
acaacttacctggatggcag

SEQ ID NO: 16559 - DNA, 20 bp, Artificial Sequence
  chemically synthesized
tttttttgcctgctgccatc

SEQ ID NO: 16560 - DNA, 20 bp, Artificial Sequence
  chemically synthesized
ttttttgcctgctgccatcc

SEQ ID NO: 16561 - DNA, 20 bp, Artificial Sequence
  chemically synthesized
gtcacaacttacctggatgg

SEQ ID NO: 16562 - DNA, 20 bp, Artificial Sequence
  chemically synthesized
ttgcctgctgccatccaggt

SEQ ID NO: 16563 - DNA, 20 bp, Artificial Sequence
  chemically synthesized
caagtcacaacttacctgga

SEQ ID NO: 16564 - DNA, 20 bp, Artificial Sequence
  chemically synthesized
ggagcaagtcacaacttacc

SEQ ID NO: 16565 - DNA, 20 bp, Artificial Sequence
  chemically synthesized
ggcagaaggcaaggaggagc

SEQ ID NO: 16566 - DNA, 20 bp, Artificial Sequence
  chemically synthesized
tcatggcagaaggcaaggag

SEQ ID NO: 16567 - DNA, 20 bp, Artificial Sequence
  chemically synthesized
aatcatggcagaaggcaagg

SEQ ID NO: 16568 - DNA, 20 bp, Artificial Sequence
  chemically synthesized
caatcatggcagaaggcaag

SEQ ID NO: 16569 - DNA, 20 bp, Artificial Sequence
  chemically synthesized
cacaatcatggcagaaggca

SEQ ID NO: 16570 - DNA, 20 bp, Artificial Sequence
  chemically synthesized
tcacaatcatggcagaaggc

SEQ ID NO: 16571 - DNA, 20 bp, Artificial Sequence
  chemically synthesized
ggcctcacaatcatggcaga

SEQ ID NO: 16572 - DNA, 20 bp, Artificial Sequence
  chemically synthesized
aggcctcacaatcatggcag

SEQ ID NO: 16573 - DNA, 20 bp, Artificial Sequence
  chemically synthesized
gggaggcctcacaatcatgg

SEQ ID NO: 16574 - DNA, 20 bp, Artificial Sequence
  chemically synthesized
ttgccttctgccatgattgt

SEQ ID NO: 16575 - DNA, 20 bp, Artificial Sequence
  chemically synthesized
ctggggaggcctcacaatca

SEQ ID NO: 16576 - DNA, 20 bp, Artificial Sequence
  chemically synthesized
tgccttctgccatgattgtg

SEQ ID NO: 16577 - DNA, 20 bp, Artificial Sequence
  chemically synthesized
ccatgattgtgaggcctccc

SEQ ID NO: 16578 - DNA, 20 bp, Artificial Sequence
  chemically synthesized
acagttccacgtggctgggg

SEQ ID NO: 16579 - DNA, 20 bp, Artificial Sequence
  chemically synthesized
aacagttccacgtggctggg

SEQ ID NO: 16580 - DNA, 20 bp, Artificial Sequence
  chemically synthesized
ttaacagttccacgtggctg

SEQ ID NO: 16581 - DNA, 20 bp, Artificial Sequence
  chemically synthesized
gtgaggcctccccagccacg

SEQ ID NO: 16582 - DNA, 20 bp, Artificial Sequence
  chemically synthesized
cttaacagttccacgtggct

SEQ ID NO: 16583 - DNA, 20 bp, Artificial Sequence
  chemically synthesized
acttaacagttccacgtggc

SEQ ID NO: 16584 - DNA, 20 bp, Artificial Sequence
  chemically synthesized
ttggacttaacagttccacg

SEQ ID NO: 16585 - DNA, 20 bp, Artificial Sequence
  chemically synthesized
cccagccacgtggaactgtt

SEQ ID NO: 16586 - DNA, 20 bp, Artificial Sequence
  chemically synthesized
gagagggtcattggacttaa

SEQ ID NO: 16587 - DNA, 20 bp, Artificial Sequence
  chemically synthesized
tacaaaagagagagggtcat

SEQ ID NO: 16588 - DNA, 20 bp, Artificial Sequence
  chemically synthesized
ggcaatttacaaaagagaga

SEQ ID NO: 16589 - DNA, 20 bp, Artificial Sequence
  chemically synthesized
gggcaatttacaaaagagag

SEQ ID NO: 16590 - DNA, 20 bp, Artificial Sequence
  chemically synthesized
ggggcaatttacaaaagaga

SEQ ID NO: 16591 - DNA, 20 bp, Artificial Sequence
  chemically synthesized
atggggcaatttacaaaaga

SEQ ID NO: 16592 - DNA, 20 bp, Artificial Sequence
  chemically synthesized
agatggggcaatttacaaaa

SEQ ID NO: 16593 - DNA, 20 bp, Artificial Sequence
  chemically synthesized
tgagatggggcaatttacaa

SEQ ID NO: 16594 - DNA, 20 bp, Artificial Sequence
  chemically synthesized
ttttgtaaattgccccatct

SEQ ID NO: 16595 - DNA, 20 bp, Artificial Sequence
  chemically synthesized
tttgtaaattgccccatctc

SEQ ID NO: 16596 - DNA, 20 bp, Artificial Sequence
  chemically synthesized
ataaagacatacctgagatg

SEQ ID NO: 16597 - DNA, 20 bp, Artificial Sequence
  chemically synthesized
gataaagacatacctgagat

SEQ ID NO: 16598 - DNA, 20 bp, Artificial Sequence
  chemically synthesized
tgataaagacatacctgaga

SEQ ID NO: 16599 - DNA, 20 bp, Artificial Sequence
  chemically synthesized
ctgctgataaagacatacct

SEQ ID NO: 16600 - DNA, 20 bp, Artificial Sequence
  chemically synthesized
catctcaggtatgtctttat

SEQ ID NO: 16601 - DNA, 20 bp, Artificial Sequence
  chemically synthesized
ctcaggtatgtctttatcag

SEQ ID NO: 16602 - DNA, 20 bp, Artificial Sequence
  chemically synthesized
ccgttttcacgctgctgata

SEQ ID NO: 16603 - DNA, 20 bp, Artificial Sequence
  chemically synthesized
ctttatcagcagcgtgaaaa

SEQ ID NO: 16604 - DNA, 20 bp, Artificial Sequence
  chemically synthesized
agcgtgaaaacggactaata

SEQ ID NO: 16605 - DNA, 20 bp, Artificial Sequence
  chemically synthesized
gtgaaaacggactaatacag

SEQ ID NO: 16606 - DNA, 20 bp, Artificial Sequence
  chemically synthesized
aatgaaaatggccactgtat

SEQ ID NO: 16607 - DNA, 20 bp, Artificial Sequence
  chemically synthesized
atgaaaatagcaaatgaaaa

SEQ ID NO: 16608 - DNA, 20 bp, Artificial Sequence
  chemically synthesized
ttttcatttgctattttcat

SEQ ID NO: 16609 - DNA, 20 bp, Artificial Sequence
  chemically synthesized
gaacatgttactaatgaaaa

SEQ ID NO: 16610 - DNA, 20 bp, Artificial Sequence
  chemically synthesized
tgattttttggatttatgaa

SEQ ID NO: 16611 - DNA, 20 bp, Artificial Sequence
  chemically synthesized
atgattttttggatttatga

SEQ ID NO: 16612 - DNA, 20 bp, Artificial Sequence
  chemically synthesized
aatgattttttggatttatg

SEQ ID NO: 16613 - DNA, 20 bp, Artificial Sequence
  chemically synthesized
atgacattgaaatgattttt

SEQ ID NO: 16614 - DNA, 20 bp, Artificial Sequence
  chemically synthesized
aatgtcattgccattgttaa

SEQ ID NO: 16615 - DNA, 20 bp, Artificial Sequence
  chemically synthesized
atgccaatacctattaacaa

SEQ ID NO: 16616 - DNA, 20 bp, Artificial Sequence
  chemically synthesized
atgtcattgccattgttaat

SEQ ID NO: 16617 - DNA, 20 bp, Artificial Sequence
  chemically synthesized
ttgccattgttaataggtat

SEQ ID NO: 16618 - DNA, 20 bp, Artificial Sequence
  chemically synthesized
ttaataggtattggcattaa

SEQ ID NO: 16619 - DNA, 20 bp, Artificial Sequence
  chemically synthesized
ggctagaaaagttgagttgt

SEQ ID NO: 16620 - DNA, 20 bp, Artificial Sequence
  chemically synthesized
taacgagggctagaaaagtt

SEQ ID NO: 16621 - DNA, 20 bp, Artificial Sequence
  chemically synthesized
agctgacaactcaacttttc

SEQ ID NO: 16622 - DNA, 20 bp, Artificial Sequence
  chemically synthesized
ttttataacgagggctagaa

SEQ ID NO: 16623 - DNA, 20 bp, Artificial Sequence
  chemically synthesized
aggctttttataacgagggc

SEQ ID NO: 16624 - DNA, 20 bp, Artificial Sequence
  chemically synthesized
gctaaggctttttataacga

SEQ ID NO: 16625 - DNA, 20 bp, Artificial Sequence
  chemically synthesized
tgctaaggctttttataacg

SEQ ID NO: 16626 - DNA, 20 bp, Artificial Sequence
  chemically synthesized
atgctaaggctttttataac

SEQ ID NO: 16627 - DNA, 20 bp, Artificial Sequence
  chemically synthesized
tttctagccctcgttataaa

SEQ ID NO: 16628 - DNA, 20 bp, Artificial Sequence
  chemically synthesized
gccctcgttataaaaagcct

SEQ ID NO: 16629 - DNA, 20 bp, Artificial Sequence
  chemically synthesized
ttataaaaagccttagcatt

SEQ ID NO: 16630 - DNA, 20 bp, Artificial Sequence
  chemically synthesized
gcaaatctttccaaatgcta

SEQ ID NO: 16631 - DNA, 20 bp, Artificial Sequence
  chemically synthesized
agcaaatctttccaaatgct

SEQ ID NO: 16632 - DNA, 20 bp, Artificial Sequence
  chemically synthesized
aaaaagccttagcatttgga

SEQ ID NO: 16633 - DNA, 20 bp, Artificial Sequence
  chemically synthesized
agtttttataaatttaaatt

SEQ ID NO: 16634 - DNA, 20 bp, Artificial Sequence
  chemically synthesized
acagactgtaattcaaaaaa

SEQ ID NO: 16635 - DNA, 20 bp, Artificial Sequence
  chemically synthesized
aaaaactgttttttgaatta

SEQ ID NO: 16636 - DNA, 20 bp, Artificial Sequence
  chemically synthesized
tgaattacagtctgtacaca

SEQ ID NO: 16637 - DNA, 20 bp, Artificial Sequence
  chemically synthesized
tagttttaaatctttgtgta

SEQ ID NO: 16638 - DNA, 20 bp, Artificial Sequence
  chemically synthesized
acacaaagatttaaaactac

SEQ ID NO: 16639 - DNA, 20 bp, Artificial Sequence
  chemically synthesized
cacaaagatttaaaactaca

SEQ ID NO: 16640 - DNA, 20 bp, Artificial Sequence
  chemically synthesized
caaagatttaaaactacaag

SEQ ID NO: 16641 - DNA, 20 bp, Artificial Sequence
  chemically synthesized
ctgactaaccgttctccttg

SEQ ID NO: 16642 - DNA, 20 bp, Artificial Sequence
  chemically synthesized
atttaaaactacaaggagaa

SEQ ID NO: 16643 - DNA, 20 bp, Artificial Sequence
  chemically synthesized
aaaactacaaggagaacggt

SEQ ID NO: 16644 - DNA, 20 bp, Artificial Sequence
  chemically synthesized
ctacaaggagaacggttagt

SEQ ID NO: 16645 - DNA, 20 bp, Artificial Sequence
  chemically synthesized
tacaaggagaacggttagtc

SEQ ID NO: 16646 - DNA, 20 bp, Artificial Sequence
  chemically synthesized
acaaggagaacggttagtca

SEQ ID NO: 16647 - DNA, 20 bp, Artificial Sequence
  chemically synthesized
ggagaacggttagtcagggt

SEQ ID NO: 16648 - DNA, 20 bp, Artificial Sequence
  chemically synthesized
aacggttagtcagggtcaga

SEQ ID NO: 16649 - DNA, 20 bp, Artificial Sequence
  chemically synthesized
ttagtcagggtcagacagta

SEQ ID NO: 16650 - DNA, 20 bp, Artificial Sequence
  chemically synthesized
tagtcagggtcagacagtat

SEQ ID NO: 16651 - DNA, 20 bp, Artificial Sequence
  chemically synthesized
cagggtcagacagtatagga

SEQ ID NO: 16652 - DNA, 20 bp, Artificial Sequence
  chemically synthesized
agggtcagacagtataggac

SEQ ID NO: 16653 - DNA, 20 bp, Artificial Sequence
  chemically synthesized
gtcagacagtataggacagg

SEQ ID NO: 16654 - DNA, 20 bp, Artificial Sequence
  chemically synthesized
aacagatcagggaacagtca

SEQ ID NO: 16655 - DNA, 20 bp, Artificial Sequence
  chemically synthesized
taacagatcagggaacagtc

SEQ ID NO: 16656 - DNA, 20 bp, Artificial Sequence
  chemically synthesized
ataacagatcagggaacagt

SEQ ID NO: 16657 - DNA, 20 bp, Artificial Sequence
  chemically synthesized
tgtaataacagatcagggaa

SEQ ID NO: 16658 - DNA, 20 bp, Artificial Sequence
  chemically synthesized
gaaattgtaataacagatca

SEQ ID NO: 16659 - DNA, 20 bp, Artificial Sequence
  chemically synthesized
agaaattgtaataacagatc

SEQ ID NO: 16660 - DNA, 20 bp, Artificial Sequence
  chemically synthesized
aagaaattgtaataacagat

SEQ ID NO: 16661 - DNA, 20 bp, Artificial Sequence
  chemically synthesized
tgttaaagaaattgtaataa

SEQ ID NO: 16662 - DNA, 20 bp, Artificial Sequence
  chemically synthesized
ggtagatttagaggttgtta

SEQ ID NO: 16663 - DNA, 20 bp, Artificial Sequence
  chemically synthesized
gatgcccttggtagatttag

SEQ ID NO: 16664 - DNA, 20 bp, Artificial Sequence
  chemically synthesized
tgatgcccttggtagattta

SEQ ID NO: 16665 - DNA, 20 bp, Artificial Sequence
  chemically synthesized
actgatgcccttggtagatt

SEQ ID NO: 16666 - DNA, 20 bp, Artificial Sequence
  chemically synthesized
taacaacctctaaatctacc

SEQ ID NO: 16667 - DNA, 20 bp, Artificial Sequence
  chemically synthesized
aacaacctctaaatctacca

SEQ ID NO: 16668 - DNA, 20 bp, Artificial Sequence
  chemically synthesized
acaacctctaaatctaccaa

SEQ ID NO: 16669 - DNA, 20 bp, Artificial Sequence
  chemically synthesized
tattccactgatgcccttgg

SEQ ID NO: 16670 - DNA, 20 bp, Artificial Sequence
  chemically synthesized
tctaaatctaccaagggcat

SEQ ID NO: 16671 - DNA, 20 bp, Artificial Sequence
  chemically synthesized
aaatattccactgatgccct

SEQ ID NO: 16672 - DNA, 20 bp, Artificial Sequence
  chemically synthesized
aaatctaccaagggcatcag

SEQ ID NO: 16673 - DNA, 20 bp, Artificial Sequence
  chemically synthesized
atcagtggaatattttacat

SEQ ID NO: 16674 - DNA, 20 bp, Artificial Sequence
  chemically synthesized
cagtggaatattttacataa

SEQ ID NO: 16675 - DNA, 20 bp, Artificial Sequence
  chemically synthesized
gtggaatattttacataaga

SEQ ID NO: 16676 - DNA, 20 bp, Artificial Sequence
  chemically synthesized
gaatattttacataagagag

SEQ ID NO: 16677 - DNA, 20 bp, Artificial Sequence
  chemically synthesized
cataagagagaagtctgcac

SEQ ID NO: 16678 - DNA, 20 bp, Artificial Sequence
  chemically synthesized
aagagagaagtctgcaccag

SEQ ID NO: 16679 - DNA, 20 bp, Artificial Sequence
  chemically synthesized
ttttatgttctctgctggtg

SEQ ID NO: 16680 - DNA, 20 bp, Artificial Sequence
  chemically synthesized
gagagaagtctgcaccagca

SEQ ID NO: 16681 - DNA, 20 bp, Artificial Sequence
  chemically synthesized
cctccttttatgttctctgc

SEQ ID NO: 16682 - DNA, 20 bp, Artificial Sequence
  chemically synthesized
tgcaccagcagagaacataa

SEQ ID NO: 16683 - DNA, 20 bp, Artificial Sequence
  chemically synthesized
gcaccagcagagaacataaa

SEQ ID NO: 16684 - DNA, 20 bp, Artificial Sequence
  chemically synthesized
accagcagagaacataaaag

SEQ ID NO: 16685 - DNA, 20 bp, Artificial Sequence
  chemically synthesized
ccagcagagaacataaaagg

SEQ ID NO: 16686 - DNA, 20 bp, Artificial Sequence
  chemically synthesized
gagaacataaaaggaggaac

SEQ ID NO: 16687 - DNA, 20 bp, Artificial Sequence
  chemically synthesized
ataaaaggaggaacaagaac

SEQ ID NO: 16688 - DNA, 20 bp, Artificial Sequence
  chemically synthesized
aggaacaagaacaagctgta

SEQ ID NO: 16689 - DNA, 20 bp, Artificial Sequence
  chemically synthesized
agagtcattaatattcttta

SEQ ID NO: 16690 - DNA, 20 bp, Artificial Sequence
  chemically synthesized
attgggattgtttggaagaa

SEQ ID NO: 16691 - DNA, 20 bp, Artificial Sequence
  chemically synthesized
aaattgggattgtttggaag

SEQ ID NO: 16692 - DNA, 20 bp, Artificial Sequence
  chemically synthesized
taaaaattgggattgtttgg

SEQ ID NO: 16693 - DNA, 20 bp, Artificial Sequence
  chemically synthesized
tcataaaaattgggattgtt

SEQ ID NO: 16694 - DNA, 20 bp, Artificial Sequence
  chemically synthesized
atttgattttcataaaaatt

SEQ ID NO: 16695 - DNA, 20 bp, Artificial Sequence
  chemically synthesized
catttgattttcataaaaat

SEQ ID NO: 16696 - DNA, 20 bp, Artificial Sequence
  chemically synthesized
aatttttatgaaaatcaaat

SEQ ID NO: 16697 - DNA, 20 bp, Artificial Sequence
  chemically synthesized
aaaatcaaatgagtgataaa

SEQ ID NO: 16698 - DNA, 20 bp, Artificial Sequence
  chemically synthesized
aggttttgtatagttttata

SEQ ID NO: 16699 - DNA, 20 bp, Artificial Sequence
  chemically synthesized
gcaggttttgtatagtttta

SEQ ID NO: 16700 - DNA, 20 bp, Artificial Sequence
  chemically synthesized
tgttacatgcaggttttgta

SEQ ID NO: 16701 - DNA, 20 bp, Artificial Sequence
  chemically synthesized
ctgttttatttgttacatgc

SEQ ID NO: 16702 - DNA, 20 bp, Artificial Sequence
  chemically synthesized
tctgttttatttgttacatg

SEQ ID NO: 16703 - DNA, 20 bp, Artificial Sequence
  chemically synthesized
cctgcatgtaacaaataaaa

SEQ ID NO: 16704 - DNA, 20 bp, Artificial Sequence
  chemically synthesized
gcatgtaacaaataaaacag

SEQ ID NO: 16705 - DNA, 20 bp, Artificial Sequence
  chemically synthesized
catgtaacaaataaaacaga

SEQ ID NO: 16706 - DNA, 20 bp, Artificial Sequence
  chemically synthesized
gtaacaaataaaacagaagg

SEQ ID NO: 16707 - DNA, 20 bp, Artificial Sequence
  chemically synthesized
taacaaataaaacagaagga

SEQ ID NO: 16708 - DNA, 20 bp, Artificial Sequence
  chemically synthesized
aggtgacattttgatcctct

SEQ ID NO: 16709 - DNA, 20 bp, Artificial Sequence
  chemically synthesized
ccaagtatcttgtgtctaag

SEQ ID NO: 16710 - DNA, 20 bp, Artificial Sequence
  chemically synthesized
cccaagtatcttgtgtctaa

SEQ ID NO: 16711 - DNA, 20 bp, Artificial Sequence
  chemically synthesized
attttgatcctcttagacac

SEQ ID NO: 16712 - DNA, 20 bp, Artificial Sequence
  chemically synthesized
aacccaagtatcttgtgtct

SEQ ID NO: 16713 - DNA, 20 bp, Artificial Sequence
  chemically synthesized
cctcttagacacaagatact

SEQ ID NO: 16714 - DNA, 20 bp, Artificial Sequence
  chemically synthesized
ctcttagacacaagatactt

SEQ ID NO: 16715 - DNA, 20 bp, Artificial Sequence
  chemically synthesized
gtaactcaaaggtaaaaccc

SEQ ID NO: 16716 - DNA, 20 bp, Artificial Sequence
  chemically synthesized
gatacttgggttttaccttt

SEQ ID NO: 16717 - DNA, 20 bp, Artificial Sequence
  chemically synthesized
tagtttcctcagtaactcaa

SEQ ID NO: 16718 - DNA, 20 bp, Artificial Sequence
  chemically synthesized
atagtttcctcagtaactca

SEQ ID NO: 16719 - DNA, 20 bp, Artificial Sequence
  chemically synthesized
ggttttacctttgagttact

SEQ ID NO: 16720 - DNA, 20 bp, Artificial Sequence
  chemically synthesized
gttttacctttgagttactg

SEQ ID NO: 16721 - DNA, 20 bp, Artificial Sequence
  chemically synthesized
tccgtacactatagtttcct

SEQ ID NO: 16722 - DNA, 20 bp, Artificial Sequence
  chemically synthesized
ttgagttactgaggaaacta

SEQ ID NO: 16723 - DNA, 20 bp, Artificial Sequence
  chemically synthesized
actgaggaaactatagtgta

SEQ ID NO: 16724 - DNA, 20 bp, Artificial Sequence
  chemically synthesized
tcccttgcgtccgtacacta

SEQ ID NO: 16725 - DNA, 20 bp, Artificial Sequence
  chemically synthesized
aaactatagtgtacggacgc

SEQ ID NO: 16726 - DNA, 20 bp, Artificial Sequence
  chemically synthesized
aactatagtgtacggacgca

SEQ ID NO: 16727 - DNA, 20 bp, Artificial Sequence
  chemically synthesized
actatagtgtacggacgcaa

SEQ ID NO: 16728 - DNA, 20 bp, Artificial Sequence
  chemically synthesized
acgcaagggatcatttacat

SEQ ID NO: 16729 - DNA, 20 bp, Artificial Sequence
  chemically synthesized
cgcaagggatcatttacatg

SEQ ID NO: 16730 - DNA, 20 bp, Artificial Sequence
  chemically synthesized
ttacatgaggttgtacacaa

SEQ ID NO: 16731 - DNA, 20 bp, Artificial Sequence
  chemically synthesized
ggtttttcacatcttgctct

SEQ ID NO: 16732 - DNA, 20 bp, Artificial Sequence
  chemically synthesized
tggaaacacacactaagagc

SEQ ID NO: 16733 - DNA, 20 bp, Artificial Sequence
  chemically synthesized
tgaatggaaacacacactaa

SEQ ID NO: 16734 - DNA, 20 bp, Artificial Sequence
  chemically synthesized
tctgaatggaaacacacact

SEQ ID NO: 16735 - DNA, 20 bp, Artificial Sequence
  chemically synthesized
tcttagtgtgtgtttccatt

SEQ ID NO: 16736 - DNA, 20 bp, Artificial Sequence
  chemically synthesized
ttagtgtgtgtttccattca

SEQ ID NO: 16737 - DNA, 20 bp, Artificial Sequence
  chemically synthesized
gagaccaagtgttctctgaa

SEQ ID NO: 16738 - DNA, 20 bp, Artificial Sequence
  chemically synthesized
gtttccattcagagaacact

SEQ ID NO: 16739 - DNA, 20 bp, Artificial Sequence
  chemically synthesized
gtggcatttcacatgagacc

SEQ ID NO: 16740 - DNA, 20 bp, Artificial Sequence
  chemically synthesized
tagagtgtggcatttcacat

SEQ ID NO: 16741 - DNA, 20 bp, Artificial Sequence
  chemically synthesized
acagtcttgtacatagagtg

SEQ ID NO: 16742 - DNA, 20 bp, Artificial Sequence
  chemically synthesized
aaatgccacactctatgtac

SEQ ID NO: 16743 - DNA, 20 bp, Artificial Sequence
  chemically synthesized
agaaaacagtcttgtacata

SEQ ID NO: 16744 - DNA, 20 bp, Artificial Sequence
  chemically synthesized
atagaaaacagtcttgtaca

SEQ ID NO: 16745 - DNA, 20 bp, Artificial Sequence
  chemically synthesized
gagctataagatatagaaaa

SEQ ID NO: 16746 - DNA, 20 bp, Artificial Sequence
  chemically synthesized
agactgttttctatatctta

SEQ ID NO: 16747 - DNA, 20 bp, Artificial Sequence
  chemically synthesized
tgtatcagagctataagata

SEQ ID NO: 16748 - DNA, 20 bp, Artificial Sequence
  chemically synthesized
aactcttgtatcagagctat

SEQ ID NO: 16749 - DNA, 20 bp, Artificial Sequence
  chemically synthesized
atatcttatagctctgatac

SEQ ID NO: 16750 - DNA, 20 bp, Artificial Sequence
  chemically synthesized
gggtaacaactcttgtatca

SEQ ID NO: 16751 - DNA, 20 bp, Artificial Sequence
  chemically synthesized
atcttatagctctgatacaa

SEQ ID NO: 16752 - DNA, 20 bp, Artificial Sequence
  chemically synthesized
ccgggtaacaactcttgtat

SEQ ID NO: 16753 - DNA, 20 bp, Artificial Sequence
  chemically synthesized
ctgatacaagagttgttacc

SEQ ID NO: 16754 - DNA, 20 bp, Artificial Sequence
  chemically synthesized
atacaagagttgttacccgg

SEQ ID NO: 16755 - DNA, 20 bp, Artificial Sequence
  chemically synthesized
agagttgttacccggaagat

SEQ ID NO: 16756 - DNA, 20 bp, Artificial Sequence
  chemically synthesized
aaagtcttacctgatcttcc

SEQ ID NO: 16757 - DNA, 20 bp, Artificial Sequence
  chemically synthesized
gagttgttacccggaagatc

SEQ ID NO: 16758 - DNA, 20 bp, Artificial Sequence
  chemically synthesized
caaagtcttacctgatcttc

SEQ ID NO: 16759 - DNA, 20 bp, Artificial Sequence
  chemically synthesized
tgttacccggaagatcaggt

SEQ ID NO: 16760 - DNA, 20 bp, Artificial Sequence
  chemically synthesized
aagcttggccatgatcagca

SEQ ID NO: 16761 - DNA, 20 bp, Artificial Sequence
  chemically synthesized
aggtaagactttgctgatca

SEQ ID NO: 16762 - DNA, 20 bp, Artificial Sequence
  chemically synthesized
tttcaaagcttggccatgat

SEQ ID NO: 16763 - DNA, 20 bp, Artificial Sequence
  chemically synthesized
agactttgctgatcatggcc

SEQ ID NO: 16764 - DNA, 20 bp, Artificial Sequence
  chemically synthesized
attgtacttatttcaaagct

SEQ ID NO: 16765 - DNA, 20 bp, Artificial Sequence
  chemically synthesized
tcatggccaagctttgaaat

SEQ ID NO: 16766 - DNA, 20 bp, Artificial Sequence
  chemically synthesized
ggattattgtacttatttca

SEQ ID NO: 16767 - DNA, 20 bp, Artificial Sequence
  chemically synthesized
tataaaggccgaaagggaaa

SEQ ID NO: 16768 - DNA, 20 bp, Artificial Sequence
  chemically synthesized
acaataatccatttcccttt

SEQ ID NO: 16769 - DNA, 20 bp, Artificial Sequence
  chemically synthesized
aaatgttataaaggccgaaa

SEQ ID NO: 16770 - DNA, 20 bp, Artificial Sequence
  chemically synthesized
taaatgttataaaggccgaa

SEQ ID NO: 16771 - DNA, 20 bp, Artificial Sequence
  chemically synthesized
ctaaatgttataaaggccga

SEQ ID NO: 16772 - DNA, 20 bp, Artificial Sequence
  chemically synthesized
ttctatgctaaatgttataa

SEQ ID NO: 16773 - DNA, 20 bp, Artificial Sequence
  chemically synthesized
attctatgctaaatgttata

SEQ ID NO: 16774 - DNA, 20 bp, Artificial Sequence
  chemically synthesized
ctttcggcctttataacatt

SEQ ID NO: 16775 - DNA, 20 bp, Artificial Sequence
  chemically synthesized
ggcctttataacatttagca

SEQ ID NO: 16776 - DNA, 20 bp, Artificial Sequence
  chemically synthesized
taacatttagcatagaatca

SEQ ID NO: 16777 - DNA, 20 bp, Artificial Sequence
  chemically synthesized
agcatagaatcaaagacact

SEQ ID NO: 16778 - DNA, 20 bp, Artificial Sequence
  chemically synthesized
gcatagaatcaaagacactt

SEQ ID NO: 16779 - DNA, 20 bp, Artificial Sequence
  chemically synthesized
catagaatcaaagacactta

SEQ ID NO: 16780 - DNA, 20 bp, Artificial Sequence
  chemically synthesized
aatcaaagacacttagggat

SEQ ID NO: 16781 - DNA, 20 bp, Artificial Sequence
  chemically synthesized
ctcaaaagttacttatccct

SEQ ID NO: 16782 - DNA, 20 bp, Artificial Sequence
  chemically synthesized
cttagggataagtaactttt

SEQ ID NO: 16783 - DNA, 20 bp, Artificial Sequence
  chemically synthesized
gttaaaacaggttatctcaa

SEQ ID NO: 16784 - DNA, 20 bp, Artificial Sequence
  chemically synthesized
ctgtaacataaagttaaaac

SEQ ID NO: 16785 - DNA, 20 bp, Artificial Sequence
  chemically synthesized
tctgtaacataaagttaaaa

SEQ ID NO: 16786 - DNA, 20 bp, Artificial Sequence
  chemically synthesized
cctgttttaactttatgtta

SEQ ID NO: 16787 - DNA, 20 bp, Artificial Sequence
  chemically synthesized
cttttcttatctgtaacata

SEQ ID NO: 16788 - DNA, 20 bp, Artificial Sequence
  chemically synthesized
tttaactttatgttacagat

SEQ ID NO: 16789 - DNA, 20 bp, Artificial Sequence
  chemically synthesized
ctttatgttacagataagaa

SEQ ID NO: 16790 - DNA, 20 bp, Artificial Sequence
  chemically synthesized
tttatgttacagataagaaa

SEQ ID NO: 16791 - DNA, 20 bp, Artificial Sequence
  chemically synthesized
tacagataagaaaaggccca

SEQ ID NO: 16792 - DNA, 20 bp, Artificial Sequence
  chemically synthesized
cagataagaaaaggcccaaa

SEQ ID NO: 16793 - DNA, 20 bp, Artificial Sequence
  chemically synthesized
agataagaaaaggcccaaag

SEQ ID NO: 16794 - DNA, 20 bp, Artificial Sequence
  chemically synthesized
gctgtttccttaacctcttt

SEQ ID NO: 16795 - DNA, 20 bp, Artificial Sequence
  chemically synthesized
agctgtttccttaacctctt

SEQ ID NO: 16796 - DNA, 20 bp, Artificial Sequence
  chemically synthesized
agaaaaggcccaaagaggtt

SEQ ID NO: 16797 - DNA, 20 bp, Artificial Sequence
  chemically synthesized
gaaaaggcccaaagaggtta

SEQ ID NO: 16798 - DNA, 20 bp, Artificial Sequence
  chemically synthesized
gcccaaagaggttaaggaaa

SEQ ID NO: 16799 - DNA, 20 bp, Artificial Sequence
  chemically synthesized
agaggttaaggaaacagctt

SEQ ID NO: 16800 - DNA, 20 bp, Artificial Sequence
  chemically synthesized
ttaaaatcgtagataatctt

SEQ ID NO: 16801 - DNA, 20 bp, Artificial Sequence
  chemically synthesized
atatttcagtattaaaatcg

SEQ ID NO: 16802 - DNA, 20 bp, Artificial Sequence
  chemically synthesized
actattttaagcatatattt

SEQ ID NO: 16803 - DNA, 20 bp, Artificial Sequence
  chemically synthesized
actgaaatatatgcttaaaa

SEQ ID NO: 16804 - DNA, 20 bp, Artificial Sequence
  chemically synthesized
tgtctttttaagactatttt

SEQ ID NO: 16805 - DNA, 20 bp, Artificial Sequence
  chemically synthesized
atgcttaaaatagtcttaaa

SEQ ID NO: 16806 - DNA, 20 bp, Artificial Sequence
  chemically synthesized
ttaaaatagtcttaaaaaga

SEQ ID NO: 16807 - DNA, 20 bp, Artificial Sequence
  chemically synthesized
cacttttgtcctgtcttttt

SEQ ID NO: 16808 - DNA, 20 bp, Artificial Sequence
  chemically synthesized
taaaatagtcttaaaaagac

SEQ ID NO: 16809 - DNA, 20 bp, Artificial Sequence
  chemically synthesized
gtcttaaaaagacaggacaa

SEQ ID NO: 16810 - DNA, 20 bp, Artificial Sequence
  chemically synthesized
aggacaaaagtgatttccta

SEQ ID NO: 16811 - DNA, 20 bp, Artificial Sequence
  chemically synthesized
ggacaaaagtgatttcctat

SEQ ID NO: 16812 - DNA, 20 bp, Artificial Sequence
  chemically synthesized
atcgccttgctttttcccat

SEQ ID NO: 16813 - DNA, 20 bp, Artificial Sequence
  chemically synthesized
aagtgatttcctatgggaaa

SEQ ID NO: 16814 - DNA, 20 bp, Artificial Sequence
  chemically synthesized
gatcgccttgctttttccca

SEQ ID NO: 16815 - DNA, 20 bp, Artificial Sequence
  chemically synthesized
gatttcctatgggaaaaagc

SEQ ID NO: 16816 - DNA, 20 bp, Artificial Sequence
  chemically synthesized
atttcctatgggaaaaagca

SEQ ID NO: 16817 - DNA, 20 bp, Artificial Sequence
  chemically synthesized
taaagattcaaaagattttg

SEQ ID NO: 16818 - DNA, 20 bp, Artificial Sequence
  chemically synthesized
ttaaagattcaaaagatttt

SEQ ID NO: 16819 - DNA, 20 bp, Artificial Sequence
  chemically synthesized
attaaagattcaaaagattt

SEQ ID NO: 16820 - DNA, 20 bp, Artificial Sequence
  chemically synthesized
caaacaaattaaagattcaa

SEQ ID NO: 16821 - DNA, 20 bp, Artificial Sequence
  chemically synthesized
tagtactttcaaacaaatta

SEQ ID NO: 16822 - DNA, 20 bp, Artificial Sequence
  chemically synthesized
tgaatctttaatttgtttga

SEQ ID NO: 16823 - DNA, 20 bp, Artificial Sequence
  chemically synthesized
tttaatttgtttgaaagtac

SEQ ID NO: 16824 - DNA, 20 bp, Artificial Sequence
  chemically synthesized
taatttgtttgaaagtacta

SEQ ID NO: 16825 - DNA, 20 bp, Artificial Sequence
  chemically synthesized
cttacttagctatcagactc

SEQ ID NO: 16826 - DNA, 20 bp, Artificial Sequence
  chemically synthesized
ttgaaagtactagagtctga

SEQ ID NO: 16827 - DNA, 20 bp, Artificial Sequence
  chemically synthesized
agtactagagtctgatagct

SEQ ID NO: 16828 - DNA, 20 bp, Artificial Sequence
  chemically synthesized
ggccttgcttacttagctat

SEQ ID NO: 16829 - DNA, 20 bp, Artificial Sequence
  chemically synthesized
ctagagtctgatagctaagt

SEQ ID NO: 16830 - DNA, 20 bp, Artificial Sequence
  chemically synthesized
agtctgatagctaagtaagc

SEQ ID NO: 16831 - DNA, 20 bp, Artificial Sequence
  chemically synthesized
ctaagtgggccttgcttact

SEQ ID NO: 16832 - DNA, 20 bp, Artificial Sequence
  chemically synthesized
gtctgatagctaagtaagca

SEQ ID NO: 16833 - DNA, 20 bp, Artificial Sequence
  chemically synthesized
ctaagtaagcaaggcccact

SEQ ID NO: 16834 - DNA, 20 bp, Artificial Sequence
  chemically synthesized
taagtaagcaaggcccactt

SEQ ID NO: 16835 - DNA, 20 bp, Artificial Sequence
  chemically synthesized
acctggaaattgtcctaagt

SEQ ID NO: 16836 - DNA, 20 bp, Artificial Sequence
  chemically synthesized
cacctggaaattgtcctaag

SEQ ID NO: 16837 - DNA, 20 bp, Artificial Sequence
  chemically synthesized
attcacctggaaattgtcct

SEQ ID NO: 16838 - DNA, 20 bp, Artificial Sequence
  chemically synthesized
ggcccacttaggacaatttc

SEQ ID NO: 16839 - DNA, 20 bp, Artificial Sequence
  chemically synthesized
gcccacttaggacaatttcc

SEQ ID NO: 16840 - DNA, 20 bp, Artificial Sequence
  chemically synthesized
gttgaagatttatattcacc

SEQ ID NO: 16841 - DNA, 20 bp, Artificial Sequence
  chemically synthesized
atcggcatataattcagttg

SEQ ID NO: 16842 - DNA, 20 bp, Artificial Sequence
  chemically synthesized
catgttatcggcatataatt

SEQ ID NO: 16843 - DNA, 20 bp, Artificial Sequence
  chemically synthesized
tgaattatatgccgataaca

SEQ ID NO: 16844 - DNA, 20 bp, Artificial Sequence
  chemically synthesized
ggctctcgcagccatgttat

SEQ ID NO: 16845 - DNA, 20 bp, Artificial Sequence
  chemically synthesized
tatgccgataacatggctgc

SEQ ID NO: 16846 - DNA, 20 bp, Artificial Sequence
  chemically synthesized
tgccgataacatggctgcga

SEQ ID NO: 16847 - DNA, 20 bp, Artificial Sequence
  chemically synthesized
gcaccttccattggctctcg

SEQ ID NO: 16848 - DNA, 20 bp, Artificial Sequence
  chemically synthesized
aacatggctgcgagagccaa

SEQ ID NO: 16849 - DNA, 20 bp, Artificial Sequence
  chemically synthesized
atggctgcgagagccaatgg

SEQ ID NO: 16850 - DNA, 20 bp, Artificial Sequence
  chemically synthesized
tggctgcgagagccaatgga

SEQ ID NO: 16851 - DNA, 20 bp, Artificial Sequence
  chemically synthesized
tattcacttgcaccttccat

SEQ ID NO: 16852 - DNA, 20 bp, Artificial Sequence
  chemically synthesized
cgagagccaatggaaggtgc

SEQ ID NO: 16853 - DNA, 20 bp, Artificial Sequence
  chemically synthesized
atgcatttatcagtgttgtg

SEQ ID NO: 16854 - DNA, 20 bp, Artificial Sequence
  chemically synthesized
tatgcatttatcagtgttgt

SEQ ID NO: 16855 - DNA, 20 bp, Artificial Sequence
  chemically synthesized
gtatgcatttatcagtgttg

SEQ ID NO: 16856 - DNA, 20 bp, Artificial Sequence
  chemically synthesized
agatataagtatgcatttat

SEQ ID NO: 16857 - DNA, 20 bp, Artificial Sequence
  chemically synthesized
gagttgatcagatgagatat

SEQ ID NO: 16858 - DNA, 20 bp, Artificial Sequence
  chemically synthesized
gggaaaggagttgatcagat

SEQ ID NO: 16859 - DNA, 20 bp, Artificial Sequence
  chemically synthesized
gaagggggaaaggagttgat

SEQ ID NO: 16860 - DNA, 20 bp, Artificial Sequence
  chemically synthesized
gctgaaaagaagggggaaag

SEQ ID NO: 16861 - DNA, 20 bp, Artificial Sequence
  chemically synthesized
atgctgaaaagaagggggaa

SEQ ID NO: 16862 - DNA, 20 bp, Artificial Sequence
  chemically synthesized
aatgctgaaaagaaggggga

SEQ ID NO: 16863 - DNA, 20 bp, Artificial Sequence
  chemically synthesized
atgtaatgctgaaaagaagg

SEQ ID NO: 16864 - DNA, 20 bp, Artificial Sequence
  chemically synthesized
catgtaatgctgaaaagaag

SEQ ID NO: 16865 - DNA, 20 bp, Artificial Sequence
  chemically synthesized
actcctttcccccttctttt

SEQ ID NO: 16866 - DNA, 20 bp, Artificial Sequence
  chemically synthesized
acatgtaatgctgaaaagaa

SEQ ID NO: 16867 - DNA, 20 bp, Artificial Sequence
  chemically synthesized
gacatgtaatgctgaaaaga

SEQ ID NO: 16868 - DNA, 20 bp, Artificial Sequence
  chemically synthesized
ggacatgtaatgctgaaaag

SEQ ID NO: 16869 - DNA, 20 bp, Artificial Sequence
  chemically synthesized
gagggacatgtaatgctgaa

SEQ ID NO: 16870 - DNA, 20 bp, Artificial Sequence
  chemically synthesized
cgtagcatctaatggtacga

SEQ ID NO: 16871 - DNA, 20 bp, Artificial Sequence
  chemically synthesized
ccgtagcatctaatggtacg

SEQ ID NO: 16872 - DNA, 20 bp, Artificial Sequence
  chemically synthesized
ttacatgtccctcgtaccat

SEQ ID NO: 16873 - DNA, 20 bp, Artificial Sequence
  chemically synthesized
gccgtagcatctaatggtac

SEQ ID NO: 16874 - DNA, 20 bp, Artificial Sequence
  chemically synthesized
atacatgccgtagcatctaa

SEQ ID NO: 16875 - DNA, 20 bp, Artificial Sequence
  chemically synthesized
cctcgtaccattagatgcta

SEQ ID NO: 16876 - DNA, 20 bp, Artificial Sequence
  chemically synthesized
caggtagctcatacatgccg

SEQ ID NO: 16877 - DNA, 20 bp, Artificial Sequence
  chemically synthesized
ttagatgctacggcatgtat

SEQ ID NO: 16878 - DNA, 20 bp, Artificial Sequence
  chemically synthesized
tacggcatgtatgagctacc

SEQ ID NO: 16879 - DNA, 20 bp, Artificial Sequence
  chemically synthesized
cccgcacctgtcagtccagg

SEQ ID NO: 16880 - DNA, 20 bp, Artificial Sequence
  chemically synthesized
gtatgagctacctggactga

SEQ ID NO: 16881 - DNA, 20 bp, Artificial Sequence
  chemically synthesized
ggacccgcacctgtcagtcc

SEQ ID NO: 16882 - DNA, 20 bp, Artificial Sequence
  chemically synthesized
tatgagctacctggactgac

SEQ ID NO: 16883 - DNA, 20 bp, Artificial Sequence
  chemically synthesized
tggacccgcacctgtcagtc

SEQ ID NO: 16884 - DNA, 20 bp, Artificial Sequence
  chemically synthesized
gctacctggactgacaggtg

SEQ ID NO: 16885 - DNA, 20 bp, Artificial Sequence
  chemically synthesized
atatatggacccgcacctgt

SEQ ID NO: 16886 - DNA, 20 bp, Artificial Sequence
  chemically synthesized
ctacctggactgacaggtgc

SEQ ID NO: 16887 - DNA, 20 bp, Artificial Sequence
  chemically synthesized
ttttgccacttcaatatata

SEQ ID NO: 16888 - DNA, 20 bp, Artificial Sequence
  chemically synthesized
gtgcgggtccatatatattg

SEQ ID NO: 16889 - DNA, 20 bp, Artificial Sequence
  chemically synthesized
cgggtccatatatattgaag

SEQ ID NO: 16890 - DNA, 20 bp, Artificial Sequence
  chemically synthesized
atatatattgaagtggcaaa

SEQ ID NO: 16891 - DNA, 20 bp, Artificial Sequence
  chemically synthesized
tatatattgaagtggcaaaa

SEQ ID NO: 16892 - DNA, 20 bp, Artificial Sequence
  chemically synthesized
aagtggcaaaaaggaaaaaa

SEQ ID NO: 16893 - DNA, 20 bp, Artificial Sequence
  chemically synthesized
aaaaagaaacaaaactctat

SEQ ID NO: 16894 - DNA, 20 bp, Artificial Sequence
  chemically synthesized
gctgaattgagaagctcata

SEQ ID NO: 16895 - DNA, 20 bp, Artificial Sequence
  chemically synthesized
gtgctgaattgagaagctca

SEQ ID NO: 16896 - DNA, 20 bp, Artificial Sequence
  chemically synthesized
actctatgagcttctcaatt

SEQ ID NO: 16897 - DNA, 20 bp, Artificial Sequence
  chemically synthesized
gaaaactgtgctgaattgag

SEQ ID NO: 16898 - DNA, 20 bp, Artificial Sequence
  chemically synthesized
catgaaaactgtgctgaatt

SEQ ID NO: 16899 - DNA, 20 bp, Artificial Sequence
  chemically synthesized
atgagcttctcaattcagca

SEQ ID NO: 16900 - DNA, 20 bp, Artificial Sequence
  chemically synthesized
tcaatgtgttgttcccataa

SEQ ID NO: 16901 - DNA, 20 bp, Artificial Sequence
  chemically synthesized
caatgtgttgttcccataaa

SEQ ID NO: 16902 - DNA, 20 bp, Artificial Sequence
  chemically synthesized
atattaaccaatccttttat

SEQ ID NO: 16903 - DNA, 20 bp, Artificial Sequence
  chemically synthesized
catattaaccaatcctttta

SEQ ID NO: 16904 - DNA, 20 bp, Artificial Sequence
  chemically synthesized
tgttgttcccataaaaggat

SEQ ID NO: 16905 - DNA, 20 bp, Artificial Sequence
  chemically synthesized
cataaaaggattggttaata

SEQ ID NO: 16906 - DNA, 20 bp, Artificial Sequence
  chemically synthesized
taatatggaaatgtatttat

SEQ ID NO: 16907 - DNA, 20 bp, Artificial Sequence
  chemically synthesized
ttattagacatctgtttatg

SEQ ID NO: 16908 - DNA, 20 bp, Artificial Sequence
  chemically synthesized
tctccagagagccacataaa

SEQ ID NO: 16909 - DNA, 20 bp, Artificial Sequence
  chemically synthesized
catctgtttatgtggctctc

SEQ ID NO: 16910 - DNA, 20 bp, Artificial Sequence
  chemically synthesized
tctgtttatgtggctctctg

SEQ ID NO: 16911 - DNA, 20 bp, Artificial Sequence
  chemically synthesized
ttgaaagtcctttctccaga

SEQ ID NO: 16912 - DNA, 20 bp, Artificial Sequence
  chemically synthesized
tttatgtggctctctggaga

SEQ ID NO: 16913 - DNA, 20 bp, Artificial Sequence
  chemically synthesized
ttatgtggctctctggagaa

SEQ ID NO: 16914 - DNA, 20 bp, Artificial Sequence
  chemically synthesized
aattgaaagtcctttctcca

SEQ ID NO: 16915 - DNA, 20 bp, Artificial Sequence
  chemically synthesized
ggaattgaaagtcctttctc

SEQ ID NO: 16916 - DNA, 20 bp, Artificial Sequence
  chemically synthesized
atggcagtgtatggaattga

SEQ ID NO: 16917 - DNA, 20 bp, Artificial Sequence
  chemically synthesized
ttgtttaaaatggcagtgta

SEQ ID NO: 16918 - DNA, 20 bp, Artificial Sequence
  chemically synthesized
cttggaattgtttaaaatgg

SEQ ID NO: 16919 - DNA, 20 bp, Artificial Sequence
  chemically synthesized
tgtcttggaattgtttaaaa

SEQ ID NO: 16920 - DNA, 20 bp, Artificial Sequence
  chemically synthesized
ctgccattttaaacaattcc

SEQ ID NO: 16921 - DNA, 20 bp, Artificial Sequence
  chemically synthesized
attggatactatttttgtct

SEQ ID NO: 16922 - DNA, 20 bp, Artificial Sequence
  chemically synthesized
aaacaattccaagacaaaaa

SEQ ID NO: 16923 - DNA, 20 bp, Artificial Sequence
  chemically synthesized
aagacaaaaatagtatccaa

SEQ ID NO: 16924 - DNA, 20 bp, Artificial Sequence
  chemically synthesized
acaaaaatagtatccaatgg

SEQ ID NO: 16925 - DNA, 20 bp, Artificial Sequence
  chemically synthesized
tctctttactgaactgccat

SEQ ID NO: 16926 - DNA, 20 bp, Artificial Sequence
  chemically synthesized
aatagtatccaatggcagtt

SEQ ID NO: 16927 - DNA, 20 bp, Artificial Sequence
  chemically synthesized
tatccaatggcagttcagta

SEQ ID NO: 16928 - DNA, 20 bp, Artificial Sequence
  chemically synthesized
tccaatggcagttcagtaaa

SEQ ID NO: 16929 - DNA, 20 bp, Artificial Sequence
  chemically synthesized
caatggcagttcagtaaaga

SEQ ID NO: 16930 - DNA, 20 bp, Artificial Sequence
  chemically synthesized
aaggtggttctgagtgtaca

SEQ ID NO: 16931 - DNA, 20 bp, Artificial Sequence
  chemically synthesized
gatatcattctttgtacact

SEQ ID NO: 16932 - DNA, 20 bp, Artificial Sequence
  chemically synthesized
tggacatccaaggtggttct

SEQ ID NO: 16933 - DNA, 20 bp, Artificial Sequence
  chemically synthesized
ttgtacactcagaaccacct

SEQ ID NO: 16934 - DNA, 20 bp, Artificial Sequence
  chemically synthesized
atcactgtggacatccaagg

SEQ ID NO: 16935 - DNA, 20 bp, Artificial Sequence
  chemically synthesized
aatatcactgtggacatcca

SEQ ID NO: 16936 - DNA, 20 bp, Artificial Sequence
  chemically synthesized
gaatatcactgtggacatcc

SEQ ID NO: 16937 - DNA, 20 bp, Artificial Sequence
  chemically synthesized
agaaccaccttggatgtcca

SEQ ID NO: 16938 - DNA, 20 bp, Artificial Sequence
  chemically synthesized
tctattcatgaatatcactg

SEQ ID NO: 16939 - DNA, 20 bp, Artificial Sequence
  chemically synthesized
tccacagtgatattcatgaa

SEQ ID NO: 16940 - DNA, 20 bp, Artificial Sequence
  chemically synthesized
cagtgatattcatgaataga

SEQ ID NO: 16941 - DNA, 20 bp, Artificial Sequence
  chemically synthesized
agtgatattcatgaatagac

SEQ ID NO: 16942 - DNA, 20 bp, Artificial Sequence
  chemically synthesized
gtgatattcatgaatagacg

SEQ ID NO: 16943 - DNA, 20 bp, Artificial Sequence
  chemically synthesized
tgatattcatgaatagacgg

SEQ ID NO: 16944 - DNA, 20 bp, Artificial Sequence
  chemically synthesized
atattcatgaatagacgggg

SEQ ID NO: 16945 - DNA, 20 bp, Artificial Sequence
  chemically synthesized
attcatgaatagacggggga

SEQ ID NO: 16946 - DNA, 20 bp, Artificial Sequence
  chemically synthesized
ttcatgaatagacgggggag

SEQ ID NO: 16947 - DNA, 20 bp, Artificial Sequence
  chemically synthesized
atgaatagacgggggagagg

SEQ ID NO: 16948 - DNA, 20 bp, Artificial Sequence
  chemically synthesized
aatagacgggggagaggtag

SEQ ID NO: 16949 - DNA, 20 bp, Artificial Sequence
  chemically synthesized
ccattttcttatgtaaagaa

SEQ ID NO: 16950 - DNA, 20 bp, Artificial Sequence
  chemically synthesized
gaccattttcttatgtaaag

SEQ ID NO: 16951 - DNA, 20 bp, Artificial Sequence
  chemically synthesized
gtagaagctcttctttacat

SEQ ID NO: 16952 - DNA, 20 bp, Artificial Sequence
  chemically synthesized
ttagaccattttcttatgta

SEQ ID NO: 16953 - DNA, 20 bp, Artificial Sequence
  chemically synthesized
ctcttctttacataagaaaa

SEQ ID NO: 16954 - DNA, 20 bp, Artificial Sequence
  chemically synthesized
agaaaatggtctaatacatg

SEQ ID NO: 16955 - DNA, 20 bp, Artificial Sequence
  chemically synthesized
accatactttctgcatgtat

SEQ ID NO: 16956 - DNA, 20 bp, Artificial Sequence
  chemically synthesized
aatggtctaatacatgcaga

SEQ ID NO: 16957 - DNA, 20 bp, Artificial Sequence
  chemically synthesized
tctaatacatgcagaaagta

SEQ ID NO: 16958 - DNA, 20 bp, Artificial Sequence
  chemically synthesized
aatacatgcagaaagtatgg

SEQ ID NO: 16959 - DNA, 20 bp, Artificial Sequence
  chemically synthesized
tgcagaaagtatggtagaat

SEQ ID NO: 16960 - DNA, 20 bp, Artificial Sequence
  chemically synthesized
gaaagtatggtagaattaga

SEQ ID NO: 16961 - DNA, 20 bp, Artificial Sequence
  chemically synthesized
tattggtggttgcataatgg

SEQ ID NO: 16962 - DNA, 20 bp, Artificial Sequence
  chemically synthesized
taatattggtggttgcataa

SEQ ID NO: 16963 - DNA, 20 bp, Artificial Sequence
  chemically synthesized
taattcagttataatattgg

SEQ ID NO: 16964 - DNA, 20 bp, Artificial Sequence
  chemically synthesized
gtctaattcagttataatat

SEQ ID NO: 16965 - DNA, 20 bp, Artificial Sequence
  chemically synthesized
caccaatattataactgaat

SEQ ID NO: 16966 - DNA, 20 bp, Artificial Sequence
  chemically synthesized
tggatgatccttgtctaatt

SEQ ID NO: 16967 - DNA, 20 bp, Artificial Sequence
  chemically synthesized
atattataactgaattagac

SEQ ID NO: 16968 - DNA, 20 bp, Artificial Sequence
  chemically synthesized
tattataactgaattagaca

SEQ ID NO: 16969 - DNA, 20 bp, Artificial Sequence
  chemically synthesized
ccctatggttttagcattta

SEQ ID NO: 16970 - DNA, 20 bp, Artificial Sequence
  chemically synthesized
atccataaatgctaaaacca

SEQ ID NO: 16971 - DNA, 20 bp, Artificial Sequence
  chemically synthesized
tccataaatgctaaaaccat

SEQ ID NO: 16972 - DNA, 20 bp, Artificial Sequence
  chemically synthesized
aaccttttaccctatggttt

SEQ ID NO: 16973 - DNA, 20 bp, Artificial Sequence
  chemically synthesized
ccataaatgctaaaaccata

SEQ ID NO: 16974 - DNA, 20 bp, Artificial Sequence
  chemically synthesized
ttccttaaccttttacccta

SEQ ID NO: 16975 - DNA, 20 bp, Artificial Sequence
  chemically synthesized
atgctaaaaccatagggtaa

SEQ ID NO: 16976 - DNA, 20 bp, Artificial Sequence
  chemically synthesized
tgctaaaaccatagggtaaa

SEQ ID NO: 16977 - DNA, 20 bp, Artificial Sequence
  chemically synthesized
aaaccatagggtaaaaggtt

SEQ ID NO: 16978 - DNA, 20 bp, Artificial Sequence
  chemically synthesized
aaccatagggtaaaaggtta

SEQ ID NO: 16979 - DNA, 20 bp, Artificial Sequence
  chemically synthesized
tagggtaaaaggttaaggaa

SEQ ID NO: 16980 - DNA, 20 bp, Artificial Sequence
  chemically synthesized
cttttccctttgtaatgaga

SEQ ID NO: 16981 - DNA, 20 bp, Artificial Sequence
  chemically synthesized
aaaattactttctcattaca

SEQ ID NO: 16982 - DNA, 20 bp, Artificial Sequence
  chemically synthesized
aaattactttctcattacaa

SEQ ID NO: 16983 - DNA, 20 bp, Artificial Sequence
  chemically synthesized
tatccttttccctttgtaat

SEQ ID NO: 16984 - DNA, 20 bp, Artificial Sequence
  chemically synthesized
aattactttctcattacaaa

SEQ ID NO: 16985 - DNA, 20 bp, Artificial Sequence
  chemically synthesized
ctttctcattacaaagggaa

SEQ ID NO: 16986 - DNA, 20 bp, Artificial Sequence
  chemically synthesized
tttctcattacaaagggaaa

SEQ ID NO: 16987 - DNA, 20 bp, Artificial Sequence
  chemically synthesized
aagggaaaaggatattttac

SEQ ID NO: 16988 - DNA, 20 bp, Artificial Sequence
  chemically synthesized
agggaaaaggatattttaca

SEQ ID NO: 16989 - DNA, 20 bp, Artificial Sequence
  chemically synthesized
aaaaggatattttacaagga

SEQ ID NO: 16990 - DNA, 20 bp, Artificial Sequence
  chemically synthesized
tttacaaggaaagtatcttg

SEQ ID NO: 16991 - DNA, 20 bp, Artificial Sequence
  chemically synthesized
aatgttaaggtggtgtctac

SEQ ID NO: 16992 - DNA, 20 bp, Artificial Sequence
  chemically synthesized
tatcactaagaatgttaagg

SEQ ID NO: 16993 - DNA, 20 bp, Artificial Sequence
  chemically synthesized
tggtatcactaagaatgtta

SEQ ID NO: 16994 - DNA, 20 bp, Artificial Sequence
  chemically synthesized
ttggtatcactaagaatgtt

SEQ ID NO: 16995 - DNA, 20 bp, Artificial Sequence
  chemically synthesized
agacaccaccttaacattct

SEQ ID NO: 16996 - DNA, 20 bp, Artificial Sequence
  chemically synthesized
ttgttcctattggtatcact

SEQ ID NO: 16997 - DNA, 20 bp, Artificial Sequence
  chemically synthesized
aacattcttagtgataccaa

SEQ ID NO: 16998 - DNA, 20 bp, Artificial Sequence
  chemically synthesized
acattcttagtgataccaat

SEQ ID NO: 16999 - DNA, 20 bp, Artificial Sequence
  chemically synthesized
aaataacattttgttcctat

SEQ ID NO: 17000 - DNA, 20 bp, Artificial Sequence
  chemically synthesized
aaaatgttattttgttcctc

SEQ ID NO: 17001 - DNA, 20 bp, Artificial Sequence
  chemically synthesized
accactgtatcacaatctgg

SEQ ID NO: 17002 - DNA, 20 bp, Artificial Sequence
  chemically synthesized
taccactgtatcacaatctg

SEQ ID NO: 17003 - DNA, 20 bp, Artificial Sequence
  chemically synthesized
cctaccactgtatcacaatc

SEQ ID NO: 17004 - DNA, 20 bp, Artificial Sequence
  chemically synthesized
tgttcctccagattgtgata

SEQ ID NO: 17005 - DNA, 20 bp, Artificial Sequence
  chemically synthesized
tcctccagattgtgatacag

SEQ ID NO: 17006 - DNA, 20 bp, Artificial Sequence
  chemically synthesized
tccagattgtgatacagtgg

SEQ ID NO: 17007 - DNA, 20 bp, Artificial Sequence
  chemically synthesized
ccagattgtgatacagtggt

SEQ ID NO: 17008 - DNA, 20 bp, Artificial Sequence
  chemically synthesized
ttgtgatacagtggtaggta

SEQ ID NO: 17009 - DNA, 20 bp, Artificial Sequence
  chemically synthesized
gtgatacagtggtaggtaca

SEQ ID NO: 17010 - DNA, 20 bp, Artificial Sequence
  chemically synthesized
ttttttggccaaaagacgat

SEQ ID NO: 17011 - DNA, 20 bp, Artificial Sequence
  chemically synthesized
agcatcatcttatcgtcttt

SEQ ID NO: 17012 - DNA, 20 bp, Artificial Sequence
  chemically synthesized
tgttaacattttttggccaa

SEQ ID NO: 17013 - DNA, 20 bp, Artificial Sequence
  chemically synthesized
agattaatgttaacattttt

SEQ ID NO: 17014 - DNA, 20 bp, Artificial Sequence
  chemically synthesized
gttaacattaatctaatcac

SEQ ID NO: 17015 - DNA, 20 bp, Artificial Sequence
  chemically synthesized
ttaacattaatctaatcaca

SEQ ID NO: 17016 - DNA, 20 bp, Artificial Sequence
  chemically synthesized
tctgatggtttccttgtgat

SEQ ID NO: 17017 - DNA, 20 bp, Artificial Sequence
  chemically synthesized
tctaatcacaaggaaaccat

SEQ ID NO: 17018 - DNA, 20 bp, Artificial Sequence
  chemically synthesized
tcacaaggaaaccatcagaa

SEQ ID NO: 17019 - DNA, 20 bp, Artificial Sequence
  chemically synthesized
catactctgggcttttctga

SEQ ID NO: 17020 - DNA, 20 bp, Artificial Sequence
  chemically synthesized
aggaaaccatcagaaaagcc

SEQ ID NO: 17021 - DNA, 20 bp, Artificial Sequence
  chemically synthesized
gaaaccatcagaaaagccca

SEQ ID NO: 17022 - DNA, 20 bp, Artificial Sequence
  chemically synthesized
catcagaaaagcccagagta

SEQ ID NO: 17023 - DNA, 20 bp, Artificial Sequence
  chemically synthesized
atcagaaaagcccagagtat

SEQ ID NO: 17024 - DNA, 20 bp, Artificial Sequence
  chemically synthesized
tgaagaatgtcccatactct

SEQ ID NO: 17025 - DNA, 20 bp, Artificial Sequence
  chemically synthesized
ttgaagaatgtcccatactc

SEQ ID NO: 17026 - DNA, 20 bp, Artificial Sequence
  chemically synthesized
cagagtatgggacattcttc

SEQ ID NO: 17027 - DNA, 20 bp, Artificial Sequence
  chemically synthesized
gagtatgggacattcttcaa

SEQ ID NO: 17028 - DNA, 20 bp, Artificial Sequence
  chemically synthesized
agttcagaccagttctcttg

SEQ ID NO: 17029 - DNA, 20 bp, Artificial Sequence
  chemically synthesized
gggacattcttcaagagaac

SEQ ID NO: 17030 - DNA, 20 bp, Artificial Sequence
  chemically synthesized
catttttgaagagttcagac

SEQ ID NO: 17031 - DNA, 20 bp, Artificial Sequence
  chemically synthesized
gttgacatttttgaagagtt

SEQ ID NO: 17032 - DNA, 20 bp, Artificial Sequence
  chemically synthesized
ctgacgttgacatttttgaa

SEQ ID NO: 17033 - DNA, 20 bp, Artificial Sequence
  chemically synthesized
ggctgacgttgacatttttg

SEQ ID NO: 17034 - DNA, 20 bp, Artificial Sequence
  chemically synthesized
ctcttcaaaaatgtcaacgt

SEQ ID NO: 17035 - DNA, 20 bp, Artificial Sequence
  chemically synthesized
caaaaatgtcaacgtcagcc

SEQ ID NO: 17036 - DNA, 20 bp, Artificial Sequence
  chemically synthesized
atgtcaacgtcagcccggcg

SEQ ID NO: 17037 - DNA, 20 bp, Artificial Sequence
  chemically synthesized
tcaacgtcagcccggcgtgg

SEQ ID NO: 17038 - DNA, 20 bp, Artificial Sequence
  chemically synthesized
caggtatcagccaccacgcc

SEQ ID NO: 17039 - DNA, 20 bp, Artificial Sequence
  chemically synthesized
acaggtatcagccaccacgc

SEQ ID NO: 17040 - DNA, 20 bp, Artificial Sequence
  chemically synthesized
agtactggaattacaggtat

SEQ ID NO: 17041 - DNA, 20 bp, Artificial Sequence
  chemically synthesized
gtggctgatacctgtaattc

SEQ ID NO: 17042 - DNA, 20 bp, Artificial Sequence
  chemically synthesized
tcccaaagtactggaattac

SEQ ID NO: 17043 - DNA, 20 bp, Artificial Sequence
  chemically synthesized
ctcccaaagtactggaatta

SEQ ID NO: 17044 - DNA, 20 bp, Artificial Sequence
  chemically synthesized
tacctgtaattccagtactt

SEQ ID NO: 17045 - DNA, 20 bp, Artificial Sequence
  chemically synthesized
acctgtaattccagtacttt

SEQ ID NO: 17046 - DNA, 20 bp, Artificial Sequence
  chemically synthesized
gcctcggcctcccaaagtac

SEQ ID NO: 17047 - DNA, 20 bp, Artificial Sequence
  chemically synthesized
ctgtaattccagtactttgg

SEQ ID NO: 17048 - DNA, 20 bp, Artificial Sequence
  chemically synthesized
tgtaattccagtactttggg

SEQ ID NO: 17049 - DNA, 20 bp, Artificial Sequence
  chemically synthesized
ccacctgcctcggcctccca

SEQ ID NO: 17050 - DNA, 20 bp, Artificial Sequence
  chemically synthesized
ttccagtactttgggaggcc

SEQ ID NO: 17051 - DNA, 20 bp, Artificial Sequence
  chemically synthesized
tccagtactttgggaggccg

SEQ ID NO: 17052 - DNA, 20 bp, Artificial Sequence
  chemically synthesized
agtactttgggaggccgagg

SEQ ID NO: 17053 - DNA, 20 bp, Artificial Sequence
  chemically synthesized
gtactttgggaggccgaggc

SEQ ID NO: 17054 - DNA, 20 bp, Artificial Sequence
  chemically synthesized
ctttgggaggccgaggcagg

SEQ ID NO: 17055 - DNA, 20 bp, Artificial Sequence
  chemically synthesized
ctcaggtgatccacctgcct

SEQ ID NO: 17056 - DNA, 20 bp, Artificial Sequence
  chemically synthesized
ccgaggcaggtggatcacct

SEQ ID NO: 17057 - DNA, 20 bp, Artificial Sequence
  chemically synthesized
cgaggcaggtggatcacctg

SEQ ID NO: 17058 - DNA, 20 bp, Artificial Sequence
  chemically synthesized
gcaggtggatcacctgaggt

SEQ ID NO: 17059 - DNA, 20 bp, Artificial Sequence
  chemically synthesized
caggtggatcacctgaggtc

SEQ ID NO: 17060 - DNA, 20 bp, Artificial Sequence
  chemically synthesized
ggtcttgaactcctgacctc

SEQ ID NO: 17061 - DNA, 20 bp, Artificial Sequence
  chemically synthesized
ggtggatcacctgaggtcag

SEQ ID NO: 17062 - DNA, 20 bp, Artificial Sequence
  chemically synthesized
tggtcttgaactcctgacct

SEQ ID NO: 17063 - DNA, 20 bp, Artificial Sequence
  chemically synthesized
tcacctgaggtcaggagttc

SEQ ID NO: 17064 - DNA, 20 bp, Artificial Sequence
  chemically synthesized
tgaggtcaggagttcaagac

SEQ ID NO: 17065 - DNA, 20 bp, Artificial Sequence
  chemically synthesized
tcaggagttcaagaccagcc

SEQ ID NO: 17066 - DNA, 20 bp, Artificial Sequence
  chemically synthesized
tttcaccacgttggccaggc

SEQ ID NO: 17067 - DNA, 20 bp, Artificial Sequence
  chemically synthesized
agggtttcaccacgttggcc

SEQ ID NO: 17068 - DNA, 20 bp, Artificial Sequence
  chemically synthesized
caagaccagcctggccaacg

SEQ ID NO: 17069 - DNA, 20 bp, Artificial Sequence
  chemically synthesized
cagggtttcaccacgttggc

SEQ ID NO: 17070 - DNA, 20 bp, Artificial Sequence
  chemically synthesized
gagacagggtttcaccacgt

SEQ ID NO: 17071 - DNA, 20 bp, Artificial Sequence
  chemically synthesized
ttgtatttttagtagagaca

SEQ ID NO: 17072 - DNA, 20 bp, Artificial Sequence
  chemically synthesized
tttgtatttttagtagagac

SEQ ID NO: 17073 - DNA, 20 bp, Artificial Sequence
  chemically synthesized
ttttgtatttttagtagaga

SEQ ID NO: 17074 - DNA, 20 bp, Artificial Sequence
  chemically synthesized
tgatttttgtatttttagta

SEQ ID NO: 17075 - DNA, 20 bp, Artificial Sequence
  chemically synthesized
gctgatttttgtatttttag

SEQ ID NO: 17076 - DNA, 20 bp, Artificial Sequence
  chemically synthesized
ccggctgatttttgtatttt

SEQ ID NO: 17077 - DNA, 20 bp, Artificial Sequence
  chemically synthesized
tctactaaaaatacaaaaat

SEQ ID NO: 17078 - DNA, 20 bp, Artificial Sequence
  chemically synthesized
ctaaaaatacaaaaatcagc

SEQ ID NO: 17079 - DNA, 20 bp, Artificial Sequence
  chemically synthesized
taaaaatacaaaaatcagcc

SEQ ID NO: 17080 - DNA, 20 bp, Artificial Sequence
  chemically synthesized
atacaaaaatcagccgggtg

SEQ ID NO: 17081 - DNA, 20 bp, Artificial Sequence
  chemically synthesized
caaaaatcagccgggtgtgg

SEQ ID NO: 17082 - DNA, 20 bp, Artificial Sequence
  chemically synthesized
caggcatgcaccaccacacc

SEQ ID NO: 17083 - DNA, 20 bp, Artificial Sequence
  chemically synthesized
gtggtgcatgcctgtaatcc

SEQ ID NO: 17084 - DNA, 20 bp, Artificial Sequence
  chemically synthesized
tcaggagtagctgggattac

SEQ ID NO: 17085 - DNA, 20 bp, Artificial Sequence
  chemically synthesized
ctcaggagtagctgggatta

SEQ ID NO: 17086 - DNA, 20 bp, Artificial Sequence
  chemically synthesized
cctcagcctcaggagtagct

SEQ ID NO: 17087 - DNA, 20 bp, Artificial Sequence
  chemically synthesized
acctcagcctcaggagtagc

SEQ ID NO: 17088 - DNA, 20 bp, Artificial Sequence
  chemically synthesized
ctgtaatcccagctactcct

SEQ ID NO: 17089 - DNA, 20 bp, Artificial Sequence
  chemically synthesized
tgtaatcccagctactcctg

SEQ ID NO: 17090 - DNA, 20 bp, Artificial Sequence
  chemically synthesized
ctccacctcagcctcaggag

SEQ ID NO: 17091 - DNA, 20 bp, Artificial Sequence
  chemically synthesized
actctccacctcagcctcag

SEQ ID NO: 17092 - DNA, 20 bp, Artificial Sequence
  chemically synthesized
tcccagctactcctgaggct

SEQ ID NO: 17093 - DNA, 20 bp, Artificial Sequence
  chemically synthesized
cccagctactcctgaggctg

SEQ ID NO: 17094 - DNA, 20 bp, Artificial Sequence
  chemically synthesized
tgactctccacctcagcctc

SEQ ID NO: 17095 - DNA, 20 bp, Artificial Sequence
  chemically synthesized
gtgactctccacctcagcct

SEQ ID NO: 17096 - DNA, 20 bp, Artificial Sequence
  chemically synthesized
agctactcctgaggctgagg

SEQ ID NO: 17097 - DNA, 20 bp, Artificial Sequence
  chemically synthesized
ctactcctgaggctgaggtg

SEQ ID NO: 17098 - DNA, 20 bp, Artificial Sequence
  chemically synthesized
actcctgaggctgaggtgga

SEQ ID NO: 17099 - DNA, 20 bp, Artificial Sequence
  chemically synthesized
gttcatgtgactctccacct

SEQ ID NO: 17100 - DNA, 20 bp, Artificial Sequence
  chemically synthesized
ggtggagagtcacatgaact

SEQ ID NO: 17101 - DNA, 20 bp, Artificial Sequence
  chemically synthesized
gtggagagtcacatgaactc

SEQ ID NO: 17102 - DNA, 20 bp, Artificial Sequence
  chemically synthesized
gagagtcacatgaactcggg

SEQ ID NO: 17103 - DNA, 20 bp, Artificial Sequence
  chemically synthesized
agtcacatgaactcgggaag

SEQ ID NO: 17104 - DNA, 20 bp, Artificial Sequence
  chemically synthesized
cactgcaacctctgcttccc

SEQ ID NO: 17105 - DNA, 20 bp, Artificial Sequence
  chemically synthesized
tcacatgaactcgggaagca

SEQ ID NO: 17106 - DNA, 20 bp, Artificial Sequence
  chemically synthesized
cacatgaactcgggaagcag

SEQ ID NO: 17107 - DNA, 20 bp, Artificial Sequence
  chemically synthesized
aactcgggaagcagaggttg

SEQ ID NO: 17108 - DNA, 20 bp, Artificial Sequence
  chemically synthesized
cgggaagcagaggttgcagt

SEQ ID NO: 17109 - DNA, 20 bp, Artificial Sequence
  chemically synthesized
agcagaggttgcagtgagcc

SEQ ID NO: 17110 - DNA, 20 bp, Artificial Sequence
  chemically synthesized
ggagtgcagtggcgcaatct

SEQ ID NO: 17111 - DNA, 20 bp, Artificial Sequence
  chemically synthesized
tcacccaggctggagtgcag

SEQ ID NO: 17112 - DNA, 20 bp, Artificial Sequence
  chemically synthesized
gagattgcgccactgcactc

SEQ ID NO: 17113 - DNA, 20 bp, Artificial Sequence
  chemically synthesized
ctgtcacccaggctggagtg

SEQ ID NO: 17114 - DNA, 20 bp, Artificial Sequence
  chemically synthesized
tgcgccactgcactccagcc

SEQ ID NO: 17115 - DNA, 20 bp, Artificial Sequence
  chemically synthesized
gcgccactgcactccagcct

SEQ ID NO: 17116 - DNA, 20 bp, Artificial Sequence
  chemically synthesized
tcgctctgtcacccaggctg

SEQ ID NO: 17117 - DNA, 20 bp, Artificial Sequence
  chemically synthesized
tctcgctctgtcacccaggc

SEQ ID NO: 17118 - DNA, 20 bp, Artificial Sequence
  chemically synthesized
ctgcactccagcctgggtga

SEQ ID NO: 17119 - DNA, 20 bp, Artificial Sequence
  chemically synthesized
agagtctcgctctgtcaccc

SEQ ID NO: 17120 - DNA, 20 bp, Artificial Sequence
  chemically synthesized
gcactccagcctgggtgaca

SEQ ID NO: 17121 - DNA, 20 bp, Artificial Sequence
  chemically synthesized
cagagtctcgctctgtcacc

SEQ ID NO: 17122 - DNA, 20 bp, Artificial Sequence
  chemically synthesized
tccagcctgggtgacagagc

SEQ ID NO: 17123 - DNA, 20 bp, Artificial Sequence
  chemically synthesized
acttttttggtagggggaca

SEQ ID NO: 17124 - DNA, 20 bp, Artificial Sequence
  chemically synthesized
tgacttttttggtaggggga

SEQ ID NO: 17125 - DNA, 20 bp, Artificial Sequence
  chemically synthesized
acattgacttttttggtagg

SEQ ID NO: 17126 - DNA, 20 bp, Artificial Sequence
  chemically synthesized
gacattgacttttttggtag

SEQ ID NO: 17127 - DNA, 20 bp, Artificial Sequence
  chemically synthesized
tgacattgacttttttggta

SEQ ID NO: 17128 - DNA, 20 bp, Artificial Sequence
  chemically synthesized
actctgtccccctaccaaaa

SEQ ID NO: 17129 - DNA, 20 bp, Artificial Sequence
  chemically synthesized
atgacattgacttttttggt

SEQ ID NO: 17130 - DNA, 20 bp, Artificial Sequence
  chemically synthesized
catgacattgacttttttgg

SEQ ID NO: 17131 - DNA, 20 bp, Artificial Sequence
  chemically synthesized
tttcatgacattgacttttt

SEQ ID NO: 17132 - DNA, 20 bp, Artificial Sequence
  chemically synthesized
caaaaaagtcaatgtcatga

SEQ ID NO: 17133 - DNA, 20 bp, Artificial Sequence
  chemically synthesized
aaaaaagtcaatgtcatgaa

SEQ ID NO: 17134 - DNA, 20 bp, Artificial Sequence
  chemically synthesized
atgaaaggaaaacaaaatgc

SEQ ID NO: 17135 - DNA, 20 bp, Artificial Sequence
  chemically synthesized
tgaaaggaaaacaaaatgct

SEQ ID NO: 17136 - DNA, 20 bp, Artificial Sequence
  chemically synthesized
aaaggaaaacaaaatgctgg

SEQ ID NO: 17137 - DNA, 20 bp, Artificial Sequence
  chemically synthesized
tttagttttgaacagtctcc

SEQ ID NO: 17138 - DNA, 20 bp, Artificial Sequence
  chemically synthesized
taccttcatttagttttgaa

SEQ ID NO: 17139 - DNA, 20 bp, Artificial Sequence
  chemically synthesized
agactgttcaaaactaaatg

SEQ ID NO: 17140 - DNA, 20 bp, Artificial Sequence
  chemically synthesized
gactgttcaaaactaaatga

SEQ ID NO: 17141 - DNA, 20 bp, Artificial Sequence
  chemically synthesized
catgtctctgtaccttcatt

SEQ ID NO: 17142 - DNA, 20 bp, Artificial Sequence
  chemically synthesized
ttcaaaactaaatgaaggta

SEQ ID NO: 17143 - DNA, 20 bp, Artificial Sequence
  chemically synthesized
caaaactaaatgaaggtaca

SEQ ID NO: 17144 - DNA, 20 bp, Artificial Sequence
  chemically synthesized
atgaaggtacagagacatga

SEQ ID NO: 17145 - DNA, 20 bp, Artificial Sequence
  chemically synthesized
tgacagacaaaaaccttgac

SEQ ID NO: 17146 - DNA, 20 bp, Artificial Sequence
  chemically synthesized
tttcttccagcatctagtca

SEQ ID NO: 17147 - DNA, 20 bp, Artificial Sequence
  chemically synthesized
ttttcttccagcatctagtc

SEQ ID NO: 17148 - DNA, 20 bp, Artificial Sequence
  chemically synthesized
caaaaaccttgactagatgc

SEQ ID NO: 17149 - DNA, 20 bp, Artificial Sequence
  chemically synthesized
cactgttttcttccagcatc

SEQ ID NO: 17150 - DNA, 20 bp, Artificial Sequence
  chemically synthesized
aaaccttgactagatgctgg

SEQ ID NO: 17151 - DNA, 20 bp, Artificial Sequence
  chemically synthesized
ttatagccactgttttcttc

SEQ ID NO: 17152 - DNA, 20 bp, Artificial Sequence
  chemically synthesized
gactagatgctggaagaaaa

SEQ ID NO: 17153 - DNA, 20 bp, Artificial Sequence
  chemically synthesized
tagatgctggaagaaaacag

SEQ ID NO: 17154 - DNA, 20 bp, Artificial Sequence
  chemically synthesized
tggaagaaaacagtggctat

SEQ ID NO: 17155 - DNA, 20 bp, Artificial Sequence
  chemically synthesized
ggaagaaaacagtggctata

SEQ ID NO: 17156 - DNA, 20 bp, Artificial Sequence
  chemically synthesized
tgccccagaattgttcctta

SEQ ID NO: 17157 - DNA, 20 bp, Artificial Sequence
  chemically synthesized
gtggctataaggaacaattc

SEQ ID NO: 17158 - DNA, 20 bp, Artificial Sequence
  chemically synthesized
tggctataaggaacaattct

SEQ ID NO: 17159 - DNA, 20 bp, Artificial Sequence
  chemically synthesized
ggctataaggaacaattctg

SEQ ID NO: 17160 - DNA, 20 bp, Artificial Sequence
  chemically synthesized
aaggaacaattctggggcac

SEQ ID NO: 17161 - DNA, 20 bp, Artificial Sequence
  chemically synthesized
aggaacaattctggggcact

SEQ ID NO: 17162 - DNA, 20 bp, Artificial Sequence
  chemically synthesized
ctgaactttccccagtgccc

SEQ ID NO: 17163 - DNA, 20 bp, Artificial Sequence
  chemically synthesized
ggaacaattctggggcactg

SEQ ID NO: 17164 - DNA, 20 bp, Artificial Sequence
  chemically synthesized
caattctggggcactgggga

SEQ ID NO: 17165 - DNA, 20 bp, Artificial Sequence
  chemically synthesized
agtccacactgaactttccc

SEQ ID NO: 17166 - DNA, 20 bp, Artificial Sequence
  chemically synthesized
ctggggcactggggaaagtt

SEQ ID NO: 17167 - DNA, 20 bp, Artificial Sequence
  chemically synthesized
gcactggggaaagttcagtg

SEQ ID NO: 17168 - DNA, 20 bp, Artificial Sequence
  chemically synthesized
gttcagtgtggactgcatat

SEQ ID NO: 17169 - DNA, 20 bp, Artificial Sequence
  chemically synthesized
tcagtgtggactgcatatca

SEQ ID NO: 17170 - DNA, 20 bp, Artificial Sequence
  chemically synthesized
cagcaataccctctgatatg

SEQ ID NO: 17171 - DNA, 20 bp, Artificial Sequence
  chemically synthesized
cagtgtggactgcatatcag

SEQ ID NO: 17172 - DNA, 20 bp, Artificial Sequence
  chemically synthesized
agtgtggactgcatatcaga

SEQ ID NO: 17173 - DNA, 20 bp, Artificial Sequence
  chemically synthesized
tgcatatcagagggtattgc

SEQ ID NO: 17174 - DNA, 20 bp, Artificial Sequence
  chemically synthesized
acacaaatttaacagcaatc

SEQ ID NO: 17175 - DNA, 20 bp, Artificial Sequence
  chemically synthesized
atcgttacacacaaatttaa

SEQ ID NO: 17176 - DNA, 20 bp, Artificial Sequence
  chemically synthesized
gttaaatttgtgtgtaacga

SEQ ID NO: 17177 - DNA, 20 bp, Artificial Sequence
  chemically synthesized
tgtgtgtaacgatagcattg

SEQ ID NO: 17178 - DNA, 20 bp, Artificial Sequence
  chemically synthesized
cgatagcattgcagttatgt

SEQ ID NO: 17179 - DNA, 20 bp, Artificial Sequence
  chemically synthesized
atagcattgcagttatgtta

SEQ ID NO: 17180 - DNA, 20 bp, Artificial Sequence
  chemically synthesized
gttagagaatgtcatccttt

SEQ ID NO: 17181 - DNA, 20 bp, Artificial Sequence
  chemically synthesized
accatacaccattttcttaa

SEQ ID NO: 17182 - DNA, 20 bp, Artificial Sequence
  chemically synthesized
caccatacaccattttctta

SEQ ID NO: 17183 - DNA, 20 bp, Artificial Sequence
  chemically synthesized
aatgtcatcctttaagaaaa

SEQ ID NO: 17184 - DNA, 20 bp, Artificial Sequence
  chemically synthesized
tcctttaagaaaatggtgta

SEQ ID NO: 17185 - DNA, 20 bp, Artificial Sequence
  chemically synthesized
taagaaaatggtgtatggtg

SEQ ID NO: 17186 - DNA, 20 bp, Artificial Sequence
  chemically synthesized
atggtgtatggtgaagtgtt

SEQ ID NO: 17187 - DNA, 20 bp, Artificial Sequence
  chemically synthesized
tggtgtatggtgaagtgttt

SEQ ID NO: 17188 - DNA, 20 bp, Artificial Sequence
  chemically synthesized
ggtgtatggtgaagtgttta

SEQ ID NO: 17189 - DNA, 20 bp, Artificial Sequence
  chemically synthesized
gtgtatggtgaagtgtttag

SEQ ID NO: 17190 - DNA, 20 bp, Artificial Sequence
  chemically synthesized
tatgccatttaaaagtaaag

SEQ ID NO: 17191 - DNA, 20 bp, Artificial Sequence
  chemically synthesized
cctatgccatttaaaagtaa

SEQ ID NO: 17192 - DNA, 20 bp, Artificial Sequence
  chemically synthesized
ccctatgccatttaaaagta

SEQ ID NO: 17193 - DNA, 20 bp, Artificial Sequence
  chemically synthesized
gatgctcctttacttttaaa

SEQ ID NO: 17194 - DNA, 20 bp, Artificial Sequence
  chemically synthesized
ttttcccctatgccatttaa

SEQ ID NO: 17195 - DNA, 20 bp, Artificial Sequence
  chemically synthesized
tcctttacttttaaatggca

SEQ ID NO: 17196 - DNA, 20 bp, Artificial Sequence
  chemically synthesized
cctttacttttaaatggcat

SEQ ID NO: 17197 - DNA, 20 bp, Artificial Sequence
  chemically synthesized
ctttacttttaaatggcata

SEQ ID NO: 17198 - DNA, 20 bp, Artificial Sequence
  chemically synthesized
tttacttttaaatggcatag

SEQ ID NO: 17199 - DNA, 20 bp, Artificial Sequence
  chemically synthesized
tgtttgtgtgtgtatgtaca

SEQ ID NO: 17200 - DNA, 20 bp, Artificial Sequence
  chemically synthesized
tgtgtgtgtatgtacacaga

SEQ ID NO: 17201 - DNA, 20 bp, Artificial Sequence
  chemically synthesized
cagacagacacatacataaa

SEQ ID NO: 17202 - DNA, 20 bp, Artificial Sequence
  chemically synthesized
gacagacacatacataaaca

SEQ ID NO: 17203 - DNA, 20 bp, Artificial Sequence
  chemically synthesized
acacatacataaacagagct

SEQ ID NO: 17204 - DNA, 20 bp, Artificial Sequence
  chemically synthesized
acatacataaacagagctga

SEQ ID NO: 17205 - DNA, 20 bp, Artificial Sequence
  chemically synthesized
catacataaacagagctgag

SEQ ID NO: 17206 - DNA, 20 bp, Artificial Sequence
  chemically synthesized
atacataaacagagctgaga

SEQ ID NO: 17207 - DNA, 20 bp, Artificial Sequence
  chemically synthesized
cataaacagagctgagaggg

SEQ ID NO: 17208 - DNA, 20 bp, Artificial Sequence
  chemically synthesized
acttacctcctccaccctct

SEQ ID NO: 17209 - DNA, 20 bp, Artificial Sequence
  chemically synthesized
taaacagagctgagagggtg

SEQ ID NO: 17210 - DNA, 20 bp, Artificial Sequence
  chemically synthesized
aaacagagctgagagggtgg

SEQ ID NO: 17211 - DNA, 20 bp, Artificial Sequence
  chemically synthesized
acagagctgagagggtggag

SEQ ID NO: 17212 - DNA, 20 bp, Artificial Sequence
  chemically synthesized
cagagctgagagggtggagg

SEQ ID NO: 17213 - DNA, 20 bp, Artificial Sequence
  chemically synthesized
gctgagagggtggaggaggt

SEQ ID NO: 17214 - DNA, 20 bp, Artificial Sequence
  chemically synthesized
gagagggtggaggaggtaag

SEQ ID NO: 17215 - DNA, 20 bp, Artificial Sequence
  chemically synthesized
gagggtggaggaggtaagta

SEQ ID NO: 17216 - DNA, 20 bp, Artificial Sequence
  chemically synthesized
gaggaggtaagtagagcgaa

SEQ ID NO: 17217 - DNA, 20 bp, Artificial Sequence
  chemically synthesized
agtagagcgaaaagcaacca

SEQ ID NO: 17218 - DNA, 20 bp, Artificial Sequence
  chemically synthesized
tcatacatctgttcaatcca

SEQ ID NO: 17219 - DNA, 20 bp, Artificial Sequence
  chemically synthesized
aaaagcaaccatggattgaa

SEQ ID NO: 17220 - DNA, 20 bp, Artificial Sequence
  chemically synthesized
gattgaacagatgtatgaca

SEQ ID NO: 17221 - DNA, 20 bp, Artificial Sequence
  chemically synthesized
aacagatgtatgacacagat

SEQ ID NO: 17222 - DNA, 20 bp, Artificial Sequence
  chemically synthesized
tgacacagatgagtgttctt

SEQ ID NO: 17223 - DNA, 20 bp, Artificial Sequence
  chemically synthesized
gtagttgaaaggatagtcta

SEQ ID NO: 17224 - DNA, 20 bp, Artificial Sequence
  chemically synthesized
acaaagagtagttgaaagga

SEQ ID NO: 17225 - DNA, 20 bp, Artificial Sequence
  chemically synthesized
aagcacaaagagtagttgaa

SEQ ID NO: 17226 - DNA, 20 bp, Artificial Sequence
  chemically synthesized
caagcacaaagagtagttga

SEQ ID NO: 17227 - DNA, 20 bp, Artificial Sequence
  chemically synthesized
aacatttcaagcacaaagag

SEQ ID NO: 17228 - DNA, 20 bp, Artificial Sequence
  chemically synthesized
ggaaacatttcaagcacaaa

SEQ ID NO: 17229 - DNA, 20 bp, Artificial Sequence
  chemically synthesized
ttggaaacatttcaagcaca

SEQ ID NO: 17230 - DNA, 20 bp, Artificial Sequence
  chemically synthesized
ttttattttggaaacatttc

SEQ ID NO: 17231 - DNA, 20 bp, Artificial Sequence
  chemically synthesized
ttccaaccaacgttttattt

SEQ ID NO: 17232 - DNA, 20 bp, Artificial Sequence
  chemically synthesized
atgtttccaaaataaaacgt

SEQ ID NO: 17233 - DNA, 20 bp, Artificial Sequence
  chemically synthesized
ttccaaaataaaacgttggt

SEQ ID NO: 17234 - DNA, 20 bp, Artificial Sequence
  chemically synthesized
gggtgacttgggagaaataa

SEQ ID NO: 17235 - DNA, 20 bp, Artificial Sequence
  chemically synthesized
tggaaaccgttatttctccc

SEQ ID NO: 17236 - DNA, 20 bp, Artificial Sequence
  chemically synthesized
cccatgaaggggtgacttgg

SEQ ID NO: 17237 - DNA, 20 bp, Artificial Sequence
  chemically synthesized
ttcccatgaaggggtgactt

SEQ ID NO: 17238 - DNA, 20 bp, Artificial Sequence
  chemically synthesized
attcccatgaaggggtgact

SEQ ID NO: 17239 - DNA, 20 bp, Artificial Sequence
  chemically synthesized
tctcccaagtcaccccttca

SEQ ID NO: 17240 - DNA, 20 bp, Artificial Sequence
  chemically synthesized
ctcccaagtcaccccttcat

SEQ ID NO: 17241 - DNA, 20 bp, Artificial Sequence
  chemically synthesized
cacaacctattcccatgaag

SEQ ID NO: 17242 - DNA, 20 bp, Artificial Sequence
  chemically synthesized
ccacaacctattcccatgaa

SEQ ID NO: 17243 - DNA, 20 bp, Artificial Sequence
  chemically synthesized
cccacaacctattcccatga

SEQ ID NO: 17244 - DNA, 20 bp, Artificial Sequence
  chemically synthesized
gcccacaacctattcccatg

SEQ ID NO: 17245 - DNA, 20 bp, Artificial Sequence
  chemically synthesized
aagtcaccccttcatgggaa

SEQ ID NO: 17246 - DNA, 20 bp, Artificial Sequence
  chemically synthesized
agtcaccccttcatgggaat

SEQ ID NO: 17247 - DNA, 20 bp, Artificial Sequence
  chemically synthesized
cccttcatgggaataggttg

SEQ ID NO: 17248 - DNA, 20 bp, Artificial Sequence
  chemically synthesized
ccttcatgggaataggttgt

SEQ ID NO: 17249 - DNA, 20 bp, Artificial Sequence
  chemically synthesized
catgggaataggttgtgggc

SEQ ID NO: 17250 - DNA, 20 bp, Artificial Sequence
  chemically synthesized
atgggaataggttgtgggca

SEQ ID NO: 17251 - DNA, 20 bp, Artificial Sequence
  chemically synthesized
ggaataggttgtgggcaagg

SEQ ID NO: 17252 - DNA, 20 bp, Artificial Sequence
  chemically synthesized
gaataggttgtgggcaaggc

SEQ ID NO: 17253 - DNA, 20 bp, Artificial Sequence
  chemically synthesized
ataggttgtgggcaaggcag

SEQ ID NO: 17254 - DNA, 20 bp, Artificial Sequence
  chemically synthesized
taggttgtgggcaaggcagg

SEQ ID NO: 17255 - DNA, 20 bp, Artificial Sequence
  chemically synthesized
aggttgtgggcaaggcagga

SEQ ID NO: 17256 - DNA, 20 bp, Artificial Sequence
  chemically synthesized
ttgtgggcaaggcaggaggg

SEQ ID NO: 17257 - DNA, 20 bp, Artificial Sequence
  chemically synthesized
tgtgggcaaggcaggagggt

SEQ ID NO: 17258 - DNA, 20 bp, Artificial Sequence
  chemically synthesized
ggcaaggcaggagggtgggc

SEQ ID NO: 17259 - DNA, 20 bp, Artificial Sequence
  chemically synthesized
caaggcaggagggtgggcaa

SEQ ID NO: 17260 - DNA, 20 bp, Artificial Sequence
  chemically synthesized
agggtgggcaagagtgattt

SEQ ID NO: 17261 - DNA, 20 bp, Artificial Sequence
  chemically synthesized
agtgattttagtaactgtga

SEQ ID NO: 17262 - DNA, 20 bp, Artificial Sequence
  chemically synthesized
gtgattttagtaactgtgaa

SEQ ID NO: 17263 - DNA, 20 bp, Artificial Sequence
  chemically synthesized
tgattttagtaactgtgaaa

SEQ ID NO: 17264 - DNA, 20 bp, Artificial Sequence
  chemically synthesized
ccattgtcctgtccctttca

SEQ ID NO: 17265 - DNA, 20 bp, Artificial Sequence
  chemically synthesized
tttagtaactgtgaaaggga

SEQ ID NO: 17266 - DNA, 20 bp, Artificial Sequence
  chemically synthesized
ttagtaactgtgaaagggac

SEQ ID NO: 17267 - DNA, 20 bp, Artificial Sequence
  chemically synthesized
ctgtgaaagggacaggacaa

SEQ ID NO: 17268 - DNA, 20 bp, Artificial Sequence
  chemically synthesized
gacaatggtattaatgtcaa

SEQ ID NO: 17269 - DNA, 20 bp, Artificial Sequence
  chemically synthesized
gtattaatgtcaatagtaat

SEQ ID NO: 17270 - DNA, 20 bp, Artificial Sequence
  chemically synthesized
tcaatagtaatgagtgtgaa

SEQ ID NO: 17271 - DNA, 20 bp, Artificial Sequence
  chemically synthesized
aatgagtgtgaaaagttccc

SEQ ID NO: 17272 - DNA, 20 bp, Artificial Sequence
  chemically synthesized
atgagtgtgaaaagttcccc

SEQ ID NO: 17273 - DNA, 20 bp, Artificial Sequence
  chemically synthesized
tttagagaaaacgaatcctg

SEQ ID NO: 17274 - DNA, 20 bp, Artificial Sequence
  chemically synthesized
ttttagagaaaacgaatcct

SEQ ID NO: 17275 - DNA, 20 bp, Artificial Sequence
  chemically synthesized
tttttagagaaaacgaatcc

SEQ ID NO: 17276 - DNA, 20 bp, Artificial Sequence
  chemically synthesized
gcgttaggtttgtattttta

SEQ ID NO: 17277 - DNA, 20 bp, Artificial Sequence
  chemically synthesized
ttgcgttaggtttgtatttt

SEQ ID NO: 17278 - DNA, 20 bp, Artificial Sequence
  chemically synthesized
aaggaaatcaattttgcgtt

SEQ ID NO: 17279 - DNA, 20 bp, Artificial Sequence
  chemically synthesized
gaaggaaatcaattttgcgt

SEQ ID NO: 17280 - DNA, 20 bp, Artificial Sequence
  chemically synthesized
gaaccgtgacaaggacagga

SEQ ID NO: 17281 - DNA, 20 bp, Artificial Sequence
  chemically synthesized
agaaccgtgacaaggacagg

SEQ ID NO: 17282 - DNA, 20 bp, Artificial Sequence
  chemically synthesized
ttaagaaccgtgacaaggac

SEQ ID NO: 17283 - DNA, 20 bp, Artificial Sequence
  chemically synthesized
tttaagaaccgtgacaagga

SEQ ID NO: 17284 - DNA, 20 bp, Artificial Sequence
  chemically synthesized
tttccttcctgtccttgtca

SEQ ID NO: 17285 - DNA, 20 bp, Artificial Sequence
  chemically synthesized
atgctttaagaaccgtgaca

SEQ ID NO: 17286 - DNA, 20 bp, Artificial Sequence
  chemically synthesized
gatgctttaagaaccgtgac

SEQ ID NO: 17287 - DNA, 20 bp, Artificial Sequence
  chemically synthesized
tgtccttgtcacggttctta

SEQ ID NO: 17288 - DNA, 20 bp, Artificial Sequence
  chemically synthesized
agtcgatgaggagatgcttt

SEQ ID NO: 17289 - DNA, 20 bp, Artificial Sequence
  chemically synthesized
atctaggcagagtcgatgag

SEQ ID NO: 17290 - DNA, 20 bp, Artificial Sequence
  chemically synthesized
acatctaggcagagtcgatg

SEQ ID NO: 17291 - DNA, 20 bp, Artificial Sequence
  chemically synthesized
cacatctaggcagagtcgat

SEQ ID NO: 17292 - DNA, 20 bp, Artificial Sequence
  chemically synthesized
atctcctcatcgactctgcc

SEQ ID NO: 17293 - DNA, 20 bp, Artificial Sequence
  chemically synthesized
aggaaaagcacatctaggca

SEQ ID NO: 17294 - DNA, 20 bp, Artificial Sequence
  chemically synthesized
ctaggaaaagcacatctagg

SEQ ID NO: 17295 - DNA, 20 bp, Artificial Sequence
  chemically synthesized
gatctaggaaaagcacatct

SEQ ID NO: 17296 - DNA, 20 bp, Artificial Sequence
  chemically synthesized
ggatctaggaaaagcacatc

SEQ ID NO: 17297 - DNA, 20 bp, Artificial Sequence
  chemically synthesized
ctgcctagatgtgcttttcc

SEQ ID NO: 17298 - DNA, 20 bp, Artificial Sequence
  chemically synthesized
cacatttagggatctaggaa

SEQ ID NO: 17299 - DNA, 20 bp, Artificial Sequence
  chemically synthesized
agattcacatttagggatct

SEQ ID NO: 17300 - DNA, 20 bp, Artificial Sequence
  chemically synthesized
gagattcacatttagggatc

SEQ ID NO: 17301 - DNA, 20 bp, Artificial Sequence
  chemically synthesized
tgcctggagattcacattta

SEQ ID NO: 17302 - DNA, 20 bp, Artificial Sequence
  chemically synthesized
atgcctggagattcacattt

SEQ ID NO: 17303 - DNA, 20 bp, Artificial Sequence
  chemically synthesized
catgcctggagattcacatt

SEQ ID NO: 17304 - DNA, 20 bp, Artificial Sequence
  chemically synthesized
gatccctaaatgtgaatctc

SEQ ID NO: 17305 - DNA, 20 bp, Artificial Sequence
  chemically synthesized
atccctaaatgtgaatctcc

SEQ ID NO: 17306 - DNA, 20 bp, Artificial Sequence
  chemically synthesized
taaactcattttcatgcctg

SEQ ID NO: 17307 - DNA, 20 bp, Artificial Sequence
  chemically synthesized
cttaaactcattttcatgcc

SEQ ID NO: 17308 - DNA, 20 bp, Artificial Sequence
  chemically synthesized
gaatctccaggcatgaaaat

SEQ ID NO: 17309 - DNA, 20 bp, Artificial Sequence
  chemically synthesized
ccaggcatgaaaatgagttt

SEQ ID NO: 17310 - DNA, 20 bp, Artificial Sequence
  chemically synthesized
aggcatgaaaatgagtttaa

SEQ ID NO: 17311 - DNA, 20 bp, Artificial Sequence
  chemically synthesized
gttctgcttctgcgcatgtg

SEQ ID NO: 17312 - DNA, 20 bp, Artificial Sequence
  chemically synthesized
tttaagagtccccacatgcg

SEQ ID NO: 17313 - DNA, 20 bp, Artificial Sequence
  chemically synthesized
agttctgcttctgcgcatgt

SEQ ID NO: 17314 - DNA, 20 bp, Artificial Sequence
  chemically synthesized
aagttctgcttctgcgcatg

SEQ ID NO: 17315 - DNA, 20 bp, Artificial Sequence
  chemically synthesized
aagagtccccacatgcgcag

SEQ ID NO: 17316 - DNA, 20 bp, Artificial Sequence
  chemically synthesized
agtccccacatgcgcagaag

SEQ ID NO: 17317 - DNA, 20 bp, Artificial Sequence
  chemically synthesized
agaagcagaactttttgttt

SEQ ID NO: 17318 - DNA, 20 bp, Artificial Sequence
  chemically synthesized
cctctcaatccttaaacaaa

SEQ ID NO: 17319 - DNA, 20 bp, Artificial Sequence
  chemically synthesized
gaagcagaactttttgttta

SEQ ID NO: 17320 - DNA, 20 bp, Artificial Sequence
  chemically synthesized
gaactttttgtttaaggatt

SEQ ID NO: 17321 - DNA, 20 bp, Artificial Sequence
  chemically synthesized
actttttgtttaaggattga

SEQ ID NO: 17322 - DNA, 20 bp, Artificial Sequence
  chemically synthesized
ctttttgtttaaggattgag

SEQ ID NO: 17323 - DNA, 20 bp, Artificial Sequence
  chemically synthesized
tgtttaaggattgagaggtc

SEQ ID NO: 17324 - DNA, 20 bp, Artificial Sequence
  chemically synthesized
tttaaggattgagaggtcaa

SEQ ID NO: 17325 - DNA, 20 bp, Artificial Sequence
  chemically synthesized
aggtcaagagttgtctttgt

SEQ ID NO: 17326 - DNA, 20 bp, Artificial Sequence
  chemically synthesized
ttacttcttcttgtctcaca

SEQ ID NO: 17327 - DNA, 20 bp, Artificial Sequence
  chemically synthesized
aagagttgtctttgtgagac

SEQ ID NO: 17328 - DNA, 20 bp, Artificial Sequence
  chemically synthesized
agttgtctttgtgagacaag

SEQ ID NO: 17329 - DNA, 20 bp, Artificial Sequence
  chemically synthesized
tgtctttgtgagacaagaag

SEQ ID NO: 17330 - DNA, 20 bp, Artificial Sequence
  chemically synthesized
tgtgagacaagaagaagtaa

SEQ ID NO: 17331 - DNA, 20 bp, Artificial Sequence
  chemically synthesized
gtgagacaagaagaagtaaa

SEQ ID NO: 17332 - DNA, 20 bp, Artificial Sequence
  chemically synthesized
cccaagatggtagttatggg

SEQ ID NO: 17333 - DNA, 20 bp, Artificial Sequence
  chemically synthesized
ctacccaagatggtagttat

SEQ ID NO: 17334 - DNA, 20 bp, Artificial Sequence
  chemically synthesized
tctacccaagatggtagtta

SEQ ID NO: 17335 - DNA, 20 bp, Artificial Sequence
  chemically synthesized
gcttcccataactaccatct

SEQ ID NO: 17336 - DNA, 20 bp, Artificial Sequence
  chemically synthesized
cttcccataactaccatctt

SEQ ID NO: 17337 - DNA, 20 bp, Artificial Sequence
  chemically synthesized
ttgatttctacccaagatgg

SEQ ID NO: 17338 - DNA, 20 bp, Artificial Sequence
  chemically synthesized
cccataactaccatcttggg

SEQ ID NO: 17339 - DNA, 20 bp, Artificial Sequence
  chemically synthesized
tacttgatttctacccaaga

SEQ ID NO: 17340 - DNA, 20 bp, Artificial Sequence
  chemically synthesized
aaaatacttgatttctaccc

SEQ ID NO: 17341 - DNA, 20 bp, Artificial Sequence
  chemically synthesized
taccatcttgggtagaaatc

SEQ ID NO: 17342 - DNA, 20 bp, Artificial Sequence
  chemically synthesized
gaaatcaagtattttattta

SEQ ID NO: 17343 - DNA, 20 bp, Artificial Sequence
  chemically synthesized
gtattttatttaaagttctg

SEQ ID NO: 17344 - DNA, 20 bp, Artificial Sequence
  chemically synthesized
tcctacctgctcattatctt

SEQ ID NO: 17345 - DNA, 20 bp, Artificial Sequence
  chemically synthesized
tttaaagttctgaagataat

SEQ ID NO: 17346 - DNA, 20 bp, Artificial Sequence
  chemically synthesized
aaagttctgaagataatgag

SEQ ID NO: 17347 - DNA, 20 bp, Artificial Sequence
  chemically synthesized
aagttctgaagataatgagc

SEQ ID NO: 17348 - DNA, 20 bp, Artificial Sequence
  chemically synthesized
ttctgaagataatgagcagg

SEQ ID NO: 17349 - DNA, 20 bp, Artificial Sequence
  chemically synthesized
tctgaagataatgagcaggt

SEQ ID NO: 17350 - DNA, 20 bp, Artificial Sequence
  chemically synthesized
tgaagataatgagcaggtag

SEQ ID NO: 17351 - DNA, 20 bp, Artificial Sequence
  chemically synthesized
gaagataatgagcaggtagg

SEQ ID NO: 17352 - DNA, 20 bp, Artificial Sequence
  chemically synthesized
ataatgagcaggtaggaggc

SEQ ID NO: 17353 - DNA, 20 bp, Artificial Sequence
  chemically synthesized
atgagcaggtaggaggccag

SEQ ID NO: 17354 - DNA, 20 bp, Artificial Sequence
  chemically synthesized
atatttagagcagtgactgc

SEQ ID NO: 17355 - DNA, 20 bp, Artificial Sequence
  chemically synthesized
gtcctgattaatatttagag

SEQ ID NO: 17356 - DNA, 20 bp, Artificial Sequence
  chemically synthesized
agagtcctgattaatattta

SEQ ID NO: 17357 - DNA, 20 bp, Artificial Sequence
  chemically synthesized
tcagagtcctgattaatatt

SEQ ID NO: 17358 - DNA, 20 bp, Artificial Sequence
  chemically synthesized
tcactgctctaaatattaat

SEQ ID NO: 17359 - DNA, 20 bp, Artificial Sequence
  chemically synthesized
cactgctctaaatattaatc

SEQ ID NO: 17360 - DNA, 20 bp, Artificial Sequence
  chemically synthesized
tatctttaatgggtgattca

SEQ ID NO: 17361 - DNA, 20 bp, Artificial Sequence
  chemically synthesized
tttatctttaatgggtgatt

SEQ ID NO: 17362 - DNA, 20 bp, Artificial Sequence
  chemically synthesized
ggactctgaatcacccatta

SEQ ID NO: 17363 - DNA, 20 bp, Artificial Sequence
  chemically synthesized
gggctgattttatctttaat

SEQ ID NO: 17364 - DNA, 20 bp, Artificial Sequence
  chemically synthesized
tgggctgattttatctttaa

SEQ ID NO: 17365 - DNA, 20 bp, Artificial Sequence
  chemically synthesized
tcacccattaaagataaaat

SEQ ID NO: 17366 - DNA, 20 bp, Artificial Sequence
  chemically synthesized
atcaccatgtgttattgttt

SEQ ID NO: 17367 - DNA, 20 bp, Artificial Sequence
  chemically synthesized
aatcaccatgtgttattgtt

SEQ ID NO: 17368 - DNA, 20 bp, Artificial Sequence
  chemically synthesized
tcagcccaaacaataacaca

SEQ ID NO: 17369 - DNA, 20 bp, Artificial Sequence
  chemically synthesized
ttgaacatggaaatgaagag

SEQ ID NO: 17370 - DNA, 20 bp, Artificial Sequence
  chemically synthesized
tccttgaacatggaaatgaa

SEQ ID NO: 17371 - DNA, 20 bp, Artificial Sequence
  chemically synthesized
tgtccttgaacatggaaatg

SEQ ID NO: 17372 - DNA, 20 bp, Artificial Sequence
  chemically synthesized
cactcttcatttccatgttc

SEQ ID NO: 17373 - DNA, 20 bp, Artificial Sequence
  chemically synthesized
actcttcatttccatgttca

SEQ ID NO: 17374 - DNA, 20 bp, Artificial Sequence
  chemically synthesized
aggacagttgtccttgaaca

SEQ ID NO: 17375 - DNA, 20 bp, Artificial Sequence
  chemically synthesized
tgcagagcctgaggtcagga

SEQ ID NO: 17376 - DNA, 20 bp, Artificial Sequence
  chemically synthesized
aaggacaactgtcctgacct

SEQ ID NO: 17377 - DNA, 20 bp, Artificial Sequence
  chemically synthesized
aggacaactgtcctgacctc

SEQ ID NO: 17378 - DNA, 20 bp, Artificial Sequence
  chemically synthesized
ggagtgcagagcctgaggtc

SEQ ID NO: 17379 - DNA, 20 bp, Artificial Sequence
  chemically synthesized
tggagtgcagagcctgaggt

SEQ ID NO: 17380 - DNA, 20 bp, Artificial Sequence
  chemically synthesized
caggtggagtgcagagcctg

SEQ ID NO: 17381 - DNA, 20 bp, Artificial Sequence
  chemically synthesized
tcaggtggagtgcagagcct

SEQ ID NO: 17382 - DNA, 20 bp, Artificial Sequence
  chemically synthesized
tattagtcaggtggagtgca

SEQ ID NO: 17383 - DNA, 20 bp, Artificial Sequence
  chemically synthesized
tttattagtcaggtggagtg

SEQ ID NO: 17384 - DNA, 20 bp, Artificial Sequence
  chemically synthesized
attggtttattagtcaggtg

SEQ ID NO: 17385 - DNA, 20 bp, Artificial Sequence
  chemically synthesized
taattggtttattagtcagg

SEQ ID NO: 17386 - DNA, 20 bp, Artificial Sequence
  chemically synthesized
cgttaattggtttattagtc

SEQ ID NO: 17387 - DNA, 20 bp, Artificial Sequence
  chemically synthesized
gcgttaattggtttattagt

SEQ ID NO: 17388 - DNA, 20 bp, Artificial Sequence
  chemically synthesized
catggcgttaattggtttat

SEQ ID NO: 17389 - DNA, 20 bp, Artificial Sequence
  chemically synthesized
cctagggccatggcgttaat

SEQ ID NO: 17390 - DNA, 20 bp, Artificial Sequence
  chemically synthesized
taataaaccaattaacgcca

SEQ ID NO: 17391 - DNA, 20 bp, Artificial Sequence
  chemically synthesized
accaattaacgccatggccc

SEQ ID NO: 17392 - DNA, 20 bp, Artificial Sequence
  chemically synthesized
ccaattaacgccatggccct

SEQ ID NO: 17393 - DNA, 20 bp, Artificial Sequence
  chemically synthesized
gcatatgttccctagggcca

SEQ ID NO: 17394 - DNA, 20 bp, Artificial Sequence
  chemically synthesized
caattaacgccatggcccta

SEQ ID NO: 17395 - DNA, 20 bp, Artificial Sequence
  chemically synthesized
aattgtgcatatgttcccta

SEQ ID NO: 17396 - DNA, 20 bp, Artificial Sequence
  chemically synthesized
aaattgtgcatatgttccct

SEQ ID NO: 17397 - DNA, 20 bp, Artificial Sequence
  chemically synthesized
aaaattgtgcatatgttccc

SEQ ID NO: 17398 - DNA, 20 bp, Artificial Sequence
  chemically synthesized
agtatacttagggatttgca

SEQ ID NO: 17399 - DNA, 20 bp, Artificial Sequence
  chemically synthesized
ttaaatctatgcaaatccct

SEQ ID NO: 17400 - DNA, 20 bp, Artificial Sequence
  chemically synthesized
aatactgttgagtatactta

SEQ ID NO: 17401 - DNA, 20 bp, Artificial Sequence
  chemically synthesized
taatactgttgagtatactt

SEQ ID NO: 17402 - DNA, 20 bp, Artificial Sequence
  chemically synthesized
ttaatactgttgagtatact

SEQ ID NO: 17403 - DNA, 20 bp, Artificial Sequence
  chemically synthesized
aaatccctaagtatactcaa

SEQ ID NO: 17404 - DNA, 20 bp, Artificial Sequence
  chemically synthesized
tagcataaattaatactgtt

SEQ ID NO: 17405 - DNA, 20 bp, Artificial Sequence
  chemically synthesized
cagtattaatttatgctacc

SEQ ID NO: 17406 - DNA, 20 bp, Artificial Sequence
  chemically synthesized
cctgttaaattagaactcgg

SEQ ID NO: 17407 - DNA, 20 bp, Artificial Sequence
  chemically synthesized
tttcctgttaaattagaact

SEQ ID NO: 17408 - DNA, 20 bp, Artificial Sequence
  chemically synthesized
gctaccgagttctaatttaa

SEQ ID NO: 17409 - DNA, 20 bp, Artificial Sequence
  chemically synthesized
ctaccgagttctaatttaac

SEQ ID NO: 17410 - DNA, 20 bp, Artificial Sequence
  chemically synthesized
atttaactttcctgttaaat

SEQ ID NO: 17411 - DNA, 20 bp, Artificial Sequence
  chemically synthesized
cgagttctaatttaacagga

SEQ ID NO: 17412 - DNA, 20 bp, Artificial Sequence
  chemically synthesized
atttaacaggaaagttaaat

SEQ ID NO: 17413 - DNA, 20 bp, Artificial Sequence
  chemically synthesized
acaggaaagttaaattagaa

SEQ ID NO: 17414 - DNA, 20 bp, Artificial Sequence
  chemically synthesized
agaaaagtttcacatataca

SEQ ID NO: 17415 - DNA, 20 bp, Artificial Sequence
  chemically synthesized
agtttcacatatacatggta

SEQ ID NO: 17416 - DNA, 20 bp, Artificial Sequence
  chemically synthesized
aaagcacatatatctgtcta

SEQ ID NO: 17417 - DNA, 20 bp, Artificial Sequence
  chemically synthesized
aagcacatatatctgtctat

SEQ ID NO: 17418 - DNA, 20 bp, Artificial Sequence
  chemically synthesized
tattccatggtacctataga

SEQ ID NO: 17419 - DNA, 20 bp, Artificial Sequence
  chemically synthesized
agtatattccatggtaccta

SEQ ID NO: 17420 - DNA, 20 bp, Artificial Sequence
  chemically synthesized
atatctgtctataggtacca

SEQ ID NO: 17421 - DNA, 20 bp, Artificial Sequence
  chemically synthesized
acttgggaaagtatattcca

SEQ ID NO: 17422 - DNA, 20 bp, Artificial Sequence
  chemically synthesized
accatggaatatactttccc

SEQ ID NO: 17423 - DNA, 20 bp, Artificial Sequence
  chemically synthesized
gccctgatccacacttggga

SEQ ID NO: 17424 - DNA, 20 bp, Artificial Sequence
  chemically synthesized
ggaatatactttcccaagtg

SEQ ID NO: 17425 - DNA, 20 bp, Artificial Sequence
  chemically synthesized
atgcgccctgatccacactt

SEQ ID NO: 17426 - DNA, 20 bp, Artificial Sequence
  chemically synthesized
aatgcgccctgatccacact

SEQ ID NO: 17427 - DNA, 20 bp, Artificial Sequence
  chemically synthesized
atactttcccaagtgtggat

SEQ ID NO: 17428 - DNA, 20 bp, Artificial Sequence
  chemically synthesized
tactttcccaagtgtggatc

SEQ ID NO: 17429 - DNA, 20 bp, Artificial Sequence
  chemically synthesized
actttcccaagtgtggatca

SEQ ID NO: 17430 - DNA, 20 bp, Artificial Sequence
  chemically synthesized
gatcagggcgcattatgtaa

SEQ ID NO: 17431 - DNA, 20 bp, Artificial Sequence
  chemically synthesized
ggcgcattatgtaaaagaac

SEQ ID NO: 17432 - DNA, 20 bp, Artificial Sequence
  chemically synthesized
atgtaaaagaacaagatata

SEQ ID NO: 17433 - DNA, 20 bp, Artificial Sequence
  chemically synthesized
aaaagaacaagatataaagt

SEQ ID NO: 17434 - DNA, 20 bp, Artificial Sequence
  chemically synthesized
tgtaggaggcagtagtggaa

SEQ ID NO: 17435 - DNA, 20 bp, Artificial Sequence
  chemically synthesized
attgtaggaggcagtagtgg

SEQ ID NO: 17436 - DNA, 20 bp, Artificial Sequence
  chemically synthesized
aggattgtaggaggcagtag

SEQ ID NO: 17437 - DNA, 20 bp, Artificial Sequence
  chemically synthesized
taaaggattgtaggaggcag

SEQ ID NO: 17438 - DNA, 20 bp, Artificial Sequence
  chemically synthesized
ttttaaaggattgtaggagg

SEQ ID NO: 17439 - DNA, 20 bp, Artificial Sequence
  chemically synthesized
ggattttaaaggattgtagg

SEQ ID NO: 17440 - DNA, 20 bp, Artificial Sequence
  chemically synthesized
tggattttaaaggattgtag

SEQ ID NO: 17441 - DNA, 20 bp, Artificial Sequence
  chemically synthesized
actggattttaaaggattgt

SEQ ID NO: 17442 - DNA, 20 bp, Artificial Sequence
  chemically synthesized
aactggattttaaaggattg

SEQ ID NO: 17443 - DNA, 20 bp, Artificial Sequence
  chemically synthesized
tttcctgaactggattttaa

SEQ ID NO: 17444 - DNA, 20 bp, Artificial Sequence
  chemically synthesized
tcctacaatcctttaaaatc

SEQ ID NO: 17445 - DNA, 20 bp, Artificial Sequence
  chemically synthesized
ttttcctgaactggatttta

SEQ ID NO: 17446 - DNA, 20 bp, Artificial Sequence
  chemically synthesized
caatcctttaaaatccagtt

SEQ ID NO: 17447 - DNA, 20 bp, Artificial Sequence
  chemically synthesized
aatcctttaaaatccagttc

SEQ ID NO: 17448 - DNA, 20 bp, Artificial Sequence
  chemically synthesized
aattttgccttttcctgaac

SEQ ID NO: 17449 - DNA, 20 bp, Artificial Sequence
  chemically synthesized
tttaaaatccagttcaggaa

SEQ ID NO: 17450 - DNA, 20 bp, Artificial Sequence
  chemically synthesized
ttaaaatccagttcaggaaa

SEQ ID NO: 17451 - DNA, 20 bp, Artificial Sequence
  chemically synthesized
ttcaggaaaaggcaaaatta

SEQ ID NO: 17452 - DNA, 20 bp, Artificial Sequence
  chemically synthesized
tcaggaaaaggcaaaattac

SEQ ID NO: 17453 - DNA, 20 bp, Artificial Sequence
  chemically synthesized
aaaaggcaaaattacaggaa

SEQ ID NO: 17454 - DNA, 20 bp, Artificial Sequence
  chemically synthesized
aaaattacaggaacagaaaa

SEQ ID NO: 17455 - DNA, 20 bp, Artificial Sequence
  chemically synthesized
aattacaggaacagaaaaca

SEQ ID NO: 17456 - DNA, 20 bp, Artificial Sequence
  chemically synthesized
aggaacagaaaacagagctg

SEQ ID NO: 17457 - DNA, 20 bp, Artificial Sequence
  chemically synthesized
gaaaacagagctgtggtttc

SEQ ID NO: 17458 - DNA, 20 bp, Artificial Sequence
  chemically synthesized
gtcccaatctctggaaacca

SEQ ID NO: 17459 - DNA, 20 bp, Artificial Sequence
  chemically synthesized
aaacagagctgtggtttcca

SEQ ID NO: 17460 - DNA, 20 bp, Artificial Sequence
  chemically synthesized
gagctgtggtttccagagat

SEQ ID NO: 17461 - DNA, 20 bp, Artificial Sequence
  chemically synthesized
agctgtggtttccagagatt

SEQ ID NO: 17462 - DNA, 20 bp, Artificial Sequence
  chemically synthesized
tctcactaagtcccaatctc

SEQ ID NO: 17463 - DNA, 20 bp, Artificial Sequence
  chemically synthesized
ggtttccagagattgggact

SEQ ID NO: 17464 - DNA, 20 bp, Artificial Sequence
  chemically synthesized
tccagagattgggacttagt

SEQ ID NO: 17465 - DNA, 20 bp, Artificial Sequence
  chemically synthesized
tcatgctgtatcatctcact

SEQ ID NO: 17466 - DNA, 20 bp, Artificial Sequence
  chemically synthesized
tgggacttagtgagatgata

SEQ ID NO: 17467 - DNA, 20 bp, Artificial Sequence
  chemically synthesized
agtgagatgatacagcatga

SEQ ID NO: 17468 - DNA, 20 bp, Artificial Sequence
  chemically synthesized
gatacagcatgatggaattt

SEQ ID NO: 17469 - DNA, 20 bp, Artificial Sequence
  chemically synthesized
atacagcatgatggaatttt

SEQ ID NO: 17470 - DNA, 20 bp, Artificial Sequence
  chemically synthesized
tacagcatgatggaatttta

SEQ ID NO: 17471 - DNA, 20 bp, Artificial Sequence
  chemically synthesized
acagcatgatggaattttag

SEQ ID NO: 17472 - DNA, 20 bp, Artificial Sequence
  chemically synthesized
tgatggaattttaggggtga

SEQ ID NO: 17473 - DNA, 20 bp, Artificial Sequence
  chemically synthesized
aattttaggggtgatagaaa

SEQ ID NO: 17474 - DNA, 20 bp, Artificial Sequence
  chemically synthesized
tttaggggtgatagaaatgg

SEQ ID NO: 17475 - DNA, 20 bp, Artificial Sequence
  chemically synthesized
ttaggggtgatagaaatgga

SEQ ID NO: 17476 - DNA, 20 bp, Artificial Sequence
  chemically synthesized
ggggtgatagaaatggaagg

SEQ ID NO: 17477 - DNA, 20 bp, Artificial Sequence
  chemically synthesized
tgatagaaatggaaggaaga

SEQ ID NO: 17478 - DNA, 20 bp, Artificial Sequence
  chemically synthesized
gatagaaatggaaggaagaa

SEQ ID NO: 17479 - DNA, 20 bp, Artificial Sequence
  chemically synthesized
agaaatggaaggaagaaagg

SEQ ID NO: 17480 - DNA, 20 bp, Artificial Sequence
  chemically synthesized
gaaatggaaggaagaaagga

SEQ ID NO: 17481 - DNA, 20 bp, Artificial Sequence
  chemically synthesized
atggaaggaagaaaggaagg

SEQ ID NO: 17482 - DNA, 20 bp, Artificial Sequence
  chemically synthesized
tggaaggaagaaaggaagga

SEQ ID NO: 17483 - DNA, 20 bp, Artificial Sequence
  chemically synthesized
gaaggaagaaaggaaggaag

SEQ ID NO: 17484 - DNA, 20 bp, Artificial Sequence
  chemically synthesized
aaggaagaaaggaaggaagg

SEQ ID NO: 17485 - DNA, 20 bp, Artificial Sequence
  chemically synthesized
aggaagaaaggaaggaagga

SEQ ID NO: 17486 - DNA, 20 bp, Artificial Sequence
  chemically synthesized
aagaaaggaaggaaggaggg

SEQ ID NO: 17487 - DNA, 20 bp, Artificial Sequence
  chemically synthesized
agaaaggaaggaaggaggga

SEQ ID NO: 17488 - DNA, 20 bp, Artificial Sequence
  chemically synthesized
aaaggaaggaaggagggaag

SEQ ID NO: 17489 - DNA, 20 bp, Artificial Sequence
  chemically synthesized
ggaaggaaggagggaaggag

SEQ ID NO: 17490 - DNA, 20 bp, Artificial Sequence
  chemically synthesized
gaaggaaggagggaaggaga

SEQ ID NO: 17491 - DNA, 20 bp, Artificial Sequence
  chemically synthesized
aaggaaggagggaaggagaa

SEQ ID NO: 17492 - DNA, 20 bp, Artificial Sequence
  chemically synthesized
aggaaggagggaaggagaag

SEQ ID NO: 17493 - DNA, 20 bp, Artificial Sequence
  chemically synthesized
aggagggaaggagaagggga

SEQ ID NO: 17494 - DNA, 20 bp, Artificial Sequence
  chemically synthesized
gagggaaggagaaggggaca

SEQ ID NO: 17495 - DNA, 20 bp, Artificial Sequence
  chemically synthesized
gggaaggagaaggggacaga

SEQ ID NO: 17496 - DNA, 20 bp, Artificial Sequence
  chemically synthesized
gaaggagaaggggacagaga

SEQ ID NO: 17497 - DNA, 20 bp, Artificial Sequence
  chemically synthesized
aaggagaaggggacagagag

SEQ ID NO: 17498 - DNA, 20 bp, Artificial Sequence
  chemically synthesized
aggagaaggggacagagaga

SEQ ID NO: 17499 - DNA, 20 bp, Artificial Sequence
  chemically synthesized
gagaaggggacagagagagg

SEQ ID NO: 17500 - DNA, 20 bp, Artificial Sequence
  chemically synthesized
agaaggggacagagagaggg

SEQ ID NO: 17501 - DNA, 20 bp, Artificial Sequence
  chemically synthesized
gaaggggacagagagaggga

SEQ ID NO: 17502 - DNA, 20 bp, Artificial Sequence
  chemically synthesized
aggggacagagagagggagg

SEQ ID NO: 17503 - DNA, 20 bp, Artificial Sequence
  chemically synthesized
ggggacagagagagggaggg

SEQ ID NO: 17504 - DNA, 20 bp, Artificial Sequence
  chemically synthesized
gggacagagagagggaggga

SEQ ID NO: 17505 - DNA, 20 bp, Artificial Sequence
  chemically synthesized
gacagagagagggagggagg

SEQ ID NO: 17506 - DNA, 20 bp, Artificial Sequence
  chemically synthesized
cagagagagggagggaggga

SEQ ID NO: 17507 - DNA, 20 bp, Artificial Sequence
  chemically synthesized
gagagagggagggagggaga

SEQ ID NO: 17508 - DNA, 20 bp, Artificial Sequence
  chemically synthesized
gagagggagggagggagaga

SEQ ID NO: 17509 - DNA, 20 bp, Artificial Sequence
  chemically synthesized
gagggagggagggagagaga

SEQ ID NO: 17510 - DNA, 20 bp, Artificial Sequence
  chemically synthesized
gagggagagagagagaacga

SEQ ID NO: 17511 - DNA, 20 bp, Artificial Sequence
  chemically synthesized
agagagagagaacgaaagaa

SEQ ID NO: 17512 - DNA, 20 bp, Artificial Sequence
  chemically synthesized
agagagagaacgaaagaaaa

SEQ ID NO: 17513 - DNA, 20 bp, Artificial Sequence
  chemically synthesized
gagaacgaaagaaaagagaa

SEQ ID NO: 17514 - DNA, 20 bp, Artificial Sequence
  chemically synthesized
acgaaagaaaagagaaaaga

SEQ ID NO: 17515 - DNA, 20 bp, Artificial Sequence
  chemically synthesized
aagaaaagagaaaagaaaga

SEQ ID NO: 17516 - DNA, 20 bp, Artificial Sequence
  chemically synthesized
aaagagaaaagaaagaaaga

SEQ ID NO: 17517 - DNA, 20 bp, Artificial Sequence
  chemically synthesized
aagagaaaagaaagaaagaa

SEQ ID NO: 17518 - DNA, 20 bp, Artificial Sequence
  chemically synthesized
gaaaagaaagaaagaaagga

SEQ ID NO: 17519 - DNA, 20 bp, Artificial Sequence
  chemically synthesized
aaaagaaagaaagaaaggaa

SEQ ID NO: 17520 - DNA, 20 bp, Artificial Sequence
  chemically synthesized
aagaaagaaagaaaggaaag

SEQ ID NO: 17521 - DNA, 20 bp, Artificial Sequence
  chemically synthesized
gaaagaaagaaaggaaagga

SEQ ID NO: 17522 - DNA, 20 bp, Artificial Sequence
  chemically synthesized
aaagaaagaaaggaaaggag

SEQ ID NO: 17523 - DNA, 20 bp, Artificial Sequence
  chemically synthesized
agaaagaaaggaaaggagag

SEQ ID NO: 17524 - DNA, 20 bp, Artificial Sequence
  chemically synthesized
aaagaaaggaaaggagagga

SEQ ID NO: 17525 - DNA, 20 bp, Artificial Sequence
  chemically synthesized
aagaaaggaaaggagaggag

SEQ ID NO: 17526 - DNA, 20 bp, Artificial Sequence
  chemically synthesized
aaggaaaggagaggagagga

SEQ ID NO: 17527 - DNA, 20 bp, Artificial Sequence
  chemically synthesized
aggaaaggagaggagaggaa

SEQ ID NO: 17528 - DNA, 20 bp, Artificial Sequence
  chemically synthesized
aaaggagaggagaggaaagg

SEQ ID NO: 17529 - DNA, 20 bp, Artificial Sequence
  chemically synthesized
aggagaggagaggaaaggaa

SEQ ID NO: 17530 - DNA, 20 bp, Artificial Sequence
  chemically synthesized
gagaggagaggaaaggaaga

SEQ ID NO: 17531 - DNA, 20 bp, Artificial Sequence
  chemically synthesized
agaggagaggaaaggaagag

SEQ ID NO: 17532 - DNA, 20 bp, Artificial Sequence
  chemically synthesized
ggagaggaaaggaagagagg

SEQ ID NO: 17533 - DNA, 20 bp, Artificial Sequence
  chemically synthesized
gagaggaaaggaagagaggc

SEQ ID NO: 17534 - DNA, 20 bp, Artificial Sequence
  chemically synthesized
gaggaaaggaagagaggcgg

SEQ ID NO: 17535 - DNA, 20 bp, Artificial Sequence
  chemically synthesized
aggaaaggaagagaggcggg

SEQ ID NO: 17536 - DNA, 20 bp, Artificial Sequence
  chemically synthesized
ggaaaggaagagaggcggga

SEQ ID NO: 17537 - DNA, 20 bp, Artificial Sequence
  chemically synthesized
aaaggaagagaggcgggagg

SEQ ID NO: 17538 - DNA, 20 bp, Artificial Sequence
  chemically synthesized
aaggaagagaggcgggaggg

SEQ ID NO: 17539 - DNA, 20 bp, Artificial Sequence
  chemically synthesized
aggaagagaggcgggaggga

SEQ ID NO: 17540 - DNA, 20 bp, Artificial Sequence
  chemically synthesized
aagagaggcgggagggaggg

SEQ ID NO: 17541 - DNA, 20 bp, Artificial Sequence
  chemically synthesized
agagaggcgggagggagggc

SEQ ID NO: 17542 - DNA, 20 bp, Artificial Sequence
  chemically synthesized
gaggcgggagggagggcagg

SEQ ID NO: 17543 - DNA, 20 bp, Artificial Sequence
  chemically synthesized
aggcgggagggagggcagga

SEQ ID NO: 17544 - DNA, 20 bp, Artificial Sequence
  chemically synthesized
cgggagggagggcaggaagg

SEQ ID NO: 17545 - DNA, 20 bp, Artificial Sequence
  chemically synthesized
gggagggagggcaggaagga

SEQ ID NO: 17546 - DNA, 20 bp, Artificial Sequence
  chemically synthesized
agggagggcaggaaggaagg

SEQ ID NO: 17547 - DNA, 20 bp, Artificial Sequence
  chemically synthesized
gggagggcaggaaggaagga

SEQ ID NO: 17548 - DNA, 20 bp, Artificial Sequence
  chemically synthesized
ggcaggaaggaaggaaggaa

SEQ ID NO: 17549 - DNA, 20 bp, Artificial Sequence
  chemically synthesized
ggaaggaaggaaggaaaaga

SEQ ID NO: 17550 - DNA, 20 bp, Artificial Sequence
  chemically synthesized
gaaggaaggaaggaaaagac

SEQ ID NO: 17551 - DNA, 20 bp, Artificial Sequence
  chemically synthesized
aaggaaggaaggaaaagaca

SEQ ID NO: 17552 - DNA, 20 bp, Artificial Sequence
  chemically synthesized
aaggaaggaaaagacagggt

SEQ ID NO: 17553 - DNA, 20 bp, Artificial Sequence
  chemically synthesized
ggaaggaaaagacagggtga

SEQ ID NO: 17554 - DNA, 20 bp, Artificial Sequence
  chemically synthesized
gaaggaaaagacagggtgag

SEQ ID NO: 17555 - DNA, 20 bp, Artificial Sequence
  chemically synthesized
ggaaaagacagggtgagagg

SEQ ID NO: 17556 - DNA, 20 bp, Artificial Sequence
  chemically synthesized
gaaaagacagggtgagagga

SEQ ID NO: 17557 - DNA, 20 bp, Artificial Sequence
  chemically synthesized
aagacagggtgagaggaagg

SEQ ID NO: 17558 - DNA, 20 bp, Artificial Sequence
  chemically synthesized
agacagggtgagaggaagga

SEQ ID NO: 17559 - DNA, 20 bp, Artificial Sequence
  chemically synthesized
cagggtgagaggaaggaagg

SEQ ID NO: 17560 - DNA, 20 bp, Artificial Sequence
  chemically synthesized
gtgagaggaaggaaggaaga

SEQ ID NO: 17561 - DNA, 20 bp, Artificial Sequence
  chemically synthesized
gaggaaggaaggaagaaaga

SEQ ID NO: 17562 - DNA, 20 bp, Artificial Sequence
  chemically synthesized
ggaaggaagaaagaaagatt

SEQ ID NO: 17563 - DNA, 20 bp, Artificial Sequence
  chemically synthesized
aagatttggtcataacaatg

SEQ ID NO: 17564 - DNA, 20 bp, Artificial Sequence
  chemically synthesized
ataacaatgaagtgctactt

SEQ ID NO: 17565 - DNA, 20 bp, Artificial Sequence
  chemically synthesized
acaatgaagtgctactttag

SEQ ID NO: 17566 - DNA, 20 bp, Artificial Sequence
  chemically synthesized
caatgaagtgctactttaga

SEQ ID NO: 17567 - DNA, 20 bp, Artificial Sequence
  chemically synthesized
ccatcttcatccttctaaag

SEQ ID NO: 17568 - DNA, 20 bp, Artificial Sequence
  chemically synthesized
tttccatcttcatccttcta

SEQ ID NO: 17569 - DNA, 20 bp, Artificial Sequence
  chemically synthesized
agtgctactttagaaggatg

SEQ ID NO: 17570 - DNA, 20 bp, Artificial Sequence
  chemically synthesized
ctactttagaaggatgaaga

SEQ ID NO: 17571 - DNA, 20 bp, Artificial Sequence
  chemically synthesized
aaatgacatgtgcttttcct

SEQ ID NO: 17572 - DNA, 20 bp, Artificial Sequence
  chemically synthesized
atacacttactgctaaggaa

SEQ ID NO: 17573 - DNA, 20 bp, Artificial Sequence
  chemically synthesized
tgacatgtgcttttccttag

SEQ ID NO: 17574 - DNA, 20 bp, Artificial Sequence
  chemically synthesized
atgtgcttttccttagcagt

SEQ ID NO: 17575 - DNA, 20 bp, Artificial Sequence
  chemically synthesized
tgtttatacacttactgcta

SEQ ID NO: 17576 - DNA, 20 bp, Artificial Sequence
  chemically synthesized
ttgtttatacacttactgct

SEQ ID NO: 17577 - DNA, 20 bp, Artificial Sequence
  chemically synthesized
cagtaagtgtataaacaaaa

SEQ ID NO: 17578 - DNA, 20 bp, Artificial Sequence
  chemically synthesized
agtaagtgtataaacaaaac

SEQ ID NO: 17579 - DNA, 20 bp, Artificial Sequence
  chemically synthesized
ttgaagataggtttgtgttg

SEQ ID NO: 17580 - DNA, 20 bp, Artificial Sequence
  chemically synthesized
ttcaccagaattttgaagat

SEQ ID NO: 17581 - DNA, 20 bp, Artificial Sequence
  chemically synthesized
cttcaccagaattttgaaga

SEQ ID NO: 17582 - DNA, 20 bp, Artificial Sequence
  chemically synthesized
ttttcttcaccagaattttg

SEQ ID NO: 17583 - DNA, 20 bp, Artificial Sequence
  chemically synthesized
caaacctatcttcaaaattc

SEQ ID NO: 17584 - DNA, 20 bp, Artificial Sequence
  chemically synthesized
ctatcttcaaaattctggtg

SEQ ID NO: 17585 - DNA, 20 bp, Artificial Sequence
  chemically synthesized
gtaatggatgttttcttcac

SEQ ID NO: 17586 - DNA, 20 bp, Artificial Sequence
  chemically synthesized
taacttctctattggagtaa

SEQ ID NO: 17587 - DNA, 20 bp, Artificial Sequence
  chemically synthesized
gaaaacatccattactccaa

SEQ ID NO: 17588 - DNA, 20 bp, Artificial Sequence
  chemically synthesized
aaacatccattactccaata

SEQ ID NO: 17589 - DNA, 20 bp, Artificial Sequence
  chemically synthesized
tttgattaacttctctattg

SEQ ID NO: 17590 - DNA, 20 bp, Artificial Sequence
  chemically synthesized
catccattactccaatagag

SEQ ID NO: 17591 - DNA, 20 bp, Artificial Sequence
  chemically synthesized
tgtttgattaacttctctat

SEQ ID NO: 17592 - DNA, 20 bp, Artificial Sequence
  chemically synthesized
aatcaaacaaaccacttaaa

SEQ ID NO: 17593 - DNA, 20 bp, Artificial Sequence
  chemically synthesized
tttatgatgatctgtttaag

SEQ ID NO: 17594 - DNA, 20 bp, Artificial Sequence
  chemically synthesized
agctttatgatgatctgttt

SEQ ID NO: 17595 - DNA, 20 bp, Artificial Sequence
  chemically synthesized
cacttaaacagatcatcata

SEQ ID NO: 17596 - DNA, 20 bp, Artificial Sequence
  chemically synthesized
tcatcataaagcttaaccca

SEQ ID NO: 17597 - DNA, 20 bp, Artificial Sequence
  chemically synthesized
attttaagctaccgtgggtt

SEQ ID NO: 17598 - DNA, 20 bp, Artificial Sequence
  chemically synthesized
tcataaagcttaacccacgg

SEQ ID NO: 17599 - DNA, 20 bp, Artificial Sequence
  chemically synthesized
taaaaattttaagctaccgt

SEQ ID NO: 17600 - DNA, 20 bp, Artificial Sequence
  chemically synthesized
ttaaaaattttaagctaccg

SEQ ID NO: 17601 - DNA, 20 bp, Artificial Sequence
  chemically synthesized
ttgttatttttaaaaatttt

SEQ ID NO: 17602 - DNA, 20 bp, Artificial Sequence
  chemically synthesized
aaatttttaaaaataacaac

SEQ ID NO: 17603 - DNA, 20 bp, Artificial Sequence
  chemically synthesized
ttaagtttaatattggtttc

SEQ ID NO: 17604 - DNA, 20 bp, Artificial Sequence
  chemically synthesized
tattgtcttaagtttaatat

SEQ ID NO: 17605 - DNA, 20 bp, Artificial Sequence
  chemically synthesized
tggaaaccaatattaaactt

SEQ ID NO: 17606 - DNA, 20 bp, Artificial Sequence
  chemically synthesized
agtattatcagtattgtctt

SEQ ID NO: 17607 - DNA, 20 bp, Artificial Sequence
  chemically synthesized
gacccttatcagagtattat

SEQ ID NO: 17608 - DNA, 20 bp, Artificial Sequence
  chemically synthesized
aatactgataatactctgat

SEQ ID NO: 17609 - DNA, 20 bp, Artificial Sequence
  chemically synthesized
atactgataatactctgata

SEQ ID NO: 17610 - DNA, 20 bp, Artificial Sequence
  chemically synthesized
tactgataatactctgataa

SEQ ID NO: 17611 - DNA, 20 bp, Artificial Sequence
  chemically synthesized
ttcagaaaagacccttatca

SEQ ID NO: 17612 - DNA, 20 bp, Artificial Sequence
  chemically synthesized
ttttcagaaaagacccttat

SEQ ID NO: 17613 - DNA, 20 bp, Artificial Sequence
  chemically synthesized
aattcctgcaattttcagaa

SEQ ID NO: 17614 - DNA, 20 bp, Artificial Sequence
  chemically synthesized
agggtcttttctgaaaattg

SEQ ID NO: 17615 - DNA, 20 bp, Artificial Sequence
  chemically synthesized
gttaaaattcctgcaatttt

SEQ ID NO: 17616 - DNA, 20 bp, Artificial Sequence
  chemically synthesized
gggtcttttctgaaaattgc

SEQ ID NO: 17617 - DNA, 20 bp, Artificial Sequence
  chemically synthesized
tgggcctgctcatgaacagt

SEQ ID NO: 17618 - DNA, 20 bp, Artificial Sequence
  chemically synthesized
aattttaactaactgttcat

SEQ ID NO: 17619 - DNA, 20 bp, Artificial Sequence
  chemically synthesized
ttactgggcctgctcatgaa

SEQ ID NO: 17620 - DNA, 20 bp, Artificial Sequence
  chemically synthesized
tttaactaactgttcatgag

SEQ ID NO: 17621 - DNA, 20 bp, Artificial Sequence
  chemically synthesized
ttaactaactgttcatgagc

SEQ ID NO: 17622 - DNA, 20 bp, Artificial Sequence
  chemically synthesized
taactgttcatgagcaggcc

SEQ ID NO: 17623 - DNA, 20 bp, Artificial Sequence
  chemically synthesized
tgttcatgagcaggcccagt

SEQ ID NO: 17624 - DNA, 20 bp, Artificial Sequence
  chemically synthesized
ttcatgagcaggcccagtaa

SEQ ID NO: 17625 - DNA, 20 bp, Artificial Sequence
  chemically synthesized
tcatgagcaggcccagtaag

SEQ ID NO: 17626 - DNA, 20 bp, Artificial Sequence
  chemically synthesized
gatatcaccgacctcttact

SEQ ID NO: 17627 - DNA, 20 bp, Artificial Sequence
  chemically synthesized
agatatcaccgacctcttac

SEQ ID NO: 17628 - DNA, 20 bp, Artificial Sequence
  chemically synthesized
gagcaggcccagtaagaggt

SEQ ID NO: 17629 - DNA, 20 bp, Artificial Sequence
  chemically synthesized
aagaggtcggtgatatctct

SEQ ID NO: 17630 - DNA, 20 bp, Artificial Sequence
  chemically synthesized
tggctgccatgaaaagctga

SEQ ID NO: 17631 - DNA, 20 bp, Artificial Sequence
  chemically synthesized
gctggctgccatgaaaagct

SEQ ID NO: 17632 - DNA, 20 bp, Artificial Sequence
  chemically synthesized
tgatatctctcagcttttca

SEQ ID NO: 17633 - DNA, 20 bp, Artificial Sequence
  chemically synthesized
tatctctcagcttttcatgg

SEQ ID NO: 17634 - DNA, 20 bp, Artificial Sequence
  chemically synthesized
agatagctggctgccatgaa

SEQ ID NO: 17635 - DNA, 20 bp, Artificial Sequence
  chemically synthesized
tctcagcttttcatggcagc

SEQ ID NO: 17636 - DNA, 20 bp, Artificial Sequence
  chemically synthesized
cagccttccatagagatagc

SEQ ID NO: 17637 - DNA, 20 bp, Artificial Sequence
  chemically synthesized
atggcagccagctatctcta

SEQ ID NO: 17638 - DNA, 20 bp, Artificial Sequence
  chemically synthesized
caatcagccttccatagaga

SEQ ID NO: 17639 - DNA, 20 bp, Artificial Sequence
  chemically synthesized
gcagccagctatctctatgg

SEQ ID NO: 17640 - DNA, 20 bp, Artificial Sequence
  chemically synthesized
cagccagctatctctatgga

SEQ ID NO: 17641 - DNA, 20 bp, Artificial Sequence
  chemically synthesized
agtccaatcagccttccata

SEQ ID NO: 17642 - DNA, 20 bp, Artificial Sequence
  chemically synthesized
atagtccaatcagccttcca

SEQ ID NO: 17643 - DNA, 20 bp, Artificial Sequence
  chemically synthesized
tatctctatggaaggctgat

SEQ ID NO: 17644 - DNA, 20 bp, Artificial Sequence
  chemically synthesized
gtagaccctaatagtccaat

SEQ ID NO: 17645 - DNA, 20 bp, Artificial Sequence
  chemically synthesized
tggaaggctgattggactat

SEQ ID NO: 17646 - DNA, 20 bp, Artificial Sequence
  chemically synthesized
ggaaggctgattggactatt

SEQ ID NO: 17647 - DNA, 20 bp, Artificial Sequence
  chemically synthesized
gaaggctgattggactatta

SEQ ID NO: 17648 - DNA, 20 bp, Artificial Sequence
  chemically synthesized
gaattgaaggtagaccctaa

SEQ ID NO: 17649 - DNA, 20 bp, Artificial Sequence
  chemically synthesized
gcctttcccagaattgaagg

SEQ ID NO: 17650 - DNA, 20 bp, Artificial Sequence
  chemically synthesized
ttagggtctaccttcaattc

SEQ ID NO: 17651 - DNA, 20 bp, Artificial Sequence
  chemically synthesized
gtggcctttcccagaattga

SEQ ID NO: 17652 - DNA, 20 bp, Artificial Sequence
  chemically synthesized
tagggtctaccttcaattct

SEQ ID NO: 17653 - DNA, 20 bp, Artificial Sequence
  chemically synthesized
ggtggcctttcccagaattg

SEQ ID NO: 17654 - DNA, 20 bp, Artificial Sequence
  chemically synthesized
gtctaccttcaattctggga

SEQ ID NO: 17655 - DNA, 20 bp, Artificial Sequence
  chemically synthesized
tctaccttcaattctgggaa

SEQ ID NO: 17656 - DNA, 20 bp, Artificial Sequence
  chemically synthesized
tataaagaggtggcctttcc

SEQ ID NO: 17657 - DNA, 20 bp, Artificial Sequence
  chemically synthesized
atttggtatttataaagagg

SEQ ID NO: 17658 - DNA, 20 bp, Artificial Sequence
  chemically synthesized
acaatttggtatttataaag

SEQ ID NO: 17659 - DNA, 20 bp, Artificial Sequence
  chemically synthesized
tacaatttggtatttataaa

SEQ ID NO: 17660 - DNA, 20 bp, Artificial Sequence
  chemically synthesized
actacaatttggtatttata

SEQ ID NO: 17661 - DNA, 20 bp, Artificial Sequence
  chemically synthesized
tctttataaataccaaattg

SEQ ID NO: 17662 - DNA, 20 bp, Artificial Sequence
  chemically synthesized
tagtaagagttactacaatt

SEQ ID NO: 17663 - DNA, 20 bp, Artificial Sequence
  chemically synthesized
agtaactaagtaattagtaa

SEQ ID NO: 17664 - DNA, 20 bp, Artificial Sequence
  chemically synthesized
ctagtaactaagtaattagt

SEQ ID NO: 17665 - DNA, 20 bp, Artificial Sequence
  chemically synthesized
agtaactcttactaattact

SEQ ID NO: 17666 - DNA, 20 bp, Artificial Sequence
  chemically synthesized
ctcactagtaactaagtaat

SEQ ID NO: 17667 - DNA, 20 bp, Artificial Sequence
  chemically synthesized
cttactaattacttagttac

SEQ ID NO: 17668 - DNA, 20 bp, Artificial Sequence
  chemically synthesized
atgaatactcactagtaact

SEQ ID NO: 17669 - DNA, 20 bp, Artificial Sequence
  chemically synthesized
ctaattacttagttactagt

SEQ ID NO: 17670 - DNA, 20 bp, Artificial Sequence
  chemically synthesized
ttggacggatgaatactcac

SEQ ID NO: 17671 - DNA, 20 bp, Artificial Sequence
  chemically synthesized
gtgagtattcatccgtccaa

SEQ ID NO: 17672 - DNA, 20 bp, Artificial Sequence
  chemically synthesized
tgagtattcatccgtccaaa

SEQ ID NO: 17673 - DNA, 20 bp, Artificial Sequence
  chemically synthesized
gagtattcatccgtccaaaa

SEQ ID NO: 17674 - DNA, 20 bp, Artificial Sequence
  chemically synthesized
ccttttacaccccttttgga

SEQ ID NO: 17675 - DNA, 20 bp, Artificial Sequence
  chemically synthesized
agtattcatccgtccaaaag

SEQ ID NO: 17676 - DNA, 20 bp, Artificial Sequence
  chemically synthesized
cattccttttacaccccttt

SEQ ID NO: 17677 - DNA, 20 bp, Artificial Sequence
  chemically synthesized
tccgtccaaaaggggtgtaa

SEQ ID NO: 17678 - DNA, 20 bp, Artificial Sequence
  chemically synthesized
ccgtccaaaaggggtgtaaa

SEQ ID NO: 17679 - DNA, 20 bp, Artificial Sequence
  chemically synthesized
gggtgtaaaaggaatgtcta

SEQ ID NO: 17680 - DNA, 20 bp, Artificial Sequence
  chemically synthesized
ctgtgggccctttggttcca

SEQ ID NO: 17681 - DNA, 20 bp, Artificial Sequence
  chemically synthesized
aaggaatgtctatggaacca

SEQ ID NO: 17682 - DNA, 20 bp, Artificial Sequence
  chemically synthesized
aggaatgtctatggaaccaa

SEQ ID NO: 17683 - DNA, 20 bp, Artificial Sequence
  chemically synthesized
ggaatgtctatggaaccaaa

SEQ ID NO: 17684 - DNA, 20 bp, Artificial Sequence
  chemically synthesized
taatcagactgtgggccctt

SEQ ID NO: 17685 - DNA, 20 bp, Artificial Sequence
  chemically synthesized
ctatggaaccaaagggccca

SEQ ID NO: 17686 - DNA, 20 bp, Artificial Sequence
  chemically synthesized
ttgtgtattaatcagactgt

SEQ ID NO: 17687 - DNA, 20 bp, Artificial Sequence
  chemically synthesized
tttgtgtattaatcagactg

SEQ ID NO: 17688 - DNA, 20 bp, Artificial Sequence
  chemically synthesized
ttggctttttgtgtattaat

SEQ ID NO: 17689 - DNA, 20 bp, Artificial Sequence
  chemically synthesized
cagtctgattaatacacaaa

SEQ ID NO: 17690 - DNA, 20 bp, Artificial Sequence
  chemically synthesized
gattaatacacaaaaagcca

SEQ ID NO: 17691 - DNA, 20 bp, Artificial Sequence
  chemically synthesized
attaatacacaaaaagccaa

SEQ ID NO: 17692 - DNA, 20 bp, Artificial Sequence
  chemically synthesized
tccttcacttaggtttcctt

SEQ ID NO: 17693 - DNA, 20 bp, Artificial Sequence
  chemically synthesized
caaaaagccaaaggaaacct

SEQ ID NO: 17694 - DNA, 20 bp, Artificial Sequence
  chemically synthesized
agccaaaggaaacctaagtg

SEQ ID NO: 17695 - DNA, 20 bp, Artificial Sequence
  chemically synthesized
gccaaaggaaacctaagtga

SEQ ID NO: 17696 - DNA, 20 bp, Artificial Sequence
  chemically synthesized
ctaaaaaccctccttcactt

SEQ ID NO: 17697 - DNA, 20 bp, Artificial Sequence
  chemically synthesized
caaaggaaacctaagtgaag

SEQ ID NO: 17698 - DNA, 20 bp, Artificial Sequence
  chemically synthesized
cctaaaaaccctccttcact

SEQ ID NO: 17699 - DNA, 20 bp, Artificial Sequence
  chemically synthesized
aaaggaaacctaagtgaagg

SEQ ID NO: 17700 - DNA, 20 bp, Artificial Sequence
  chemically synthesized
aaggaaacctaagtgaagga

SEQ ID NO: 17701 - DNA, 20 bp, Artificial Sequence
  chemically synthesized
cctaagtgaaggagggtttt

SEQ ID NO: 17702 - DNA, 20 bp, Artificial Sequence
  chemically synthesized
ctaagtgaaggagggttttt

SEQ ID NO: 17703 - DNA, 20 bp, Artificial Sequence
  chemically synthesized
aagtgaaggagggtttttag

SEQ ID NO: 17704 - DNA, 20 bp, Artificial Sequence
  chemically synthesized
gggtttttaggagttacttt

SEQ ID NO: 17705 - DNA, 20 bp, Artificial Sequence
  chemically synthesized
ggtttttaggagttactttc

SEQ ID NO: 17706 - DNA, 20 bp, Artificial Sequence
  chemically synthesized
tttaggagttactttcagga

SEQ ID NO: 17707 - DNA, 20 bp, Artificial Sequence
  chemically synthesized
taatagattttccatcctga

SEQ ID NO: 17708 - DNA, 20 bp, Artificial Sequence
  chemically synthesized
ggccgattccattttattaa

SEQ ID NO: 17709 - DNA, 20 bp, Artificial Sequence
  chemically synthesized
tggaaaatctattaataaaa

SEQ ID NO: 17710 - DNA, 20 bp, Artificial Sequence
  chemically synthesized
atctattaataaaatggaat

SEQ ID NO: 17711 - DNA, 20 bp, Artificial Sequence
  chemically synthesized
attaataaaatggaatcggc

SEQ ID NO: 17712 - DNA, 20 bp, Artificial Sequence
  chemically synthesized
ttaataaaatggaatcggcc

SEQ ID NO: 17713 - DNA, 20 bp, Artificial Sequence
  chemically synthesized
atggaatcggccaggtgtga

SEQ ID NO: 17714 - DNA, 20 bp, Artificial Sequence
  chemically synthesized
caggcatgagccatcacacc

SEQ ID NO: 17715 - DNA, 20 bp, Artificial Sequence
  chemically synthesized
agtgctgggattacaggcat

SEQ ID NO: 17716 - DNA, 20 bp, Artificial Sequence
  chemically synthesized
atggctcatgcctgtaatcc

SEQ ID NO: 17717 - DNA, 20 bp, Artificial Sequence
  chemically synthesized
tcccaaagtgctgggattac

SEQ ID NO: 17718 - DNA, 20 bp, Artificial Sequence
  chemically synthesized
ctcccaaagtgctgggatta

SEQ ID NO: 17719 - DNA, 20 bp, Artificial Sequence
  chemically synthesized
tgcctgtaatcccagcactt

SEQ ID NO: 17720 - DNA, 20 bp, Artificial Sequence
  chemically synthesized
cctcagcctcccaaagtgct

SEQ ID NO: 17721 - DNA, 20 bp, Artificial Sequence
  chemically synthesized
gcctgtaatcccagcacttt

SEQ ID NO: 17722 - DNA, 20 bp, Artificial Sequence
  chemically synthesized
acctcagcctcccaaagtgc

SEQ ID NO: 17723 - DNA, 20 bp, Artificial Sequence
  chemically synthesized
ctgtaatcccagcactttgg

SEQ ID NO: 17724 - DNA, 20 bp, Artificial Sequence
  chemically synthesized
tgtaatcccagcactttggg

SEQ ID NO: 17725 - DNA, 20 bp, Artificial Sequence
  chemically synthesized
ccgcccacctcagcctccca

SEQ ID NO: 17726 - DNA, 20 bp, Artificial Sequence
  chemically synthesized
tcccagcactttgggaggct

SEQ ID NO: 17727 - DNA, 20 bp, Artificial Sequence
  chemically synthesized
cccagcactttgggaggctg

SEQ ID NO: 17728 - DNA, 20 bp, Artificial Sequence
  chemically synthesized
agcactttgggaggctgagg

SEQ ID NO: 17729 - DNA, 20 bp, Artificial Sequence
  chemically synthesized
gcactttgggaggctgaggt

SEQ ID NO: 17730 - DNA, 20 bp, Artificial Sequence
  chemically synthesized
ctttgggaggctgaggtggg

SEQ ID NO: 17731 - DNA, 20 bp, Artificial Sequence
  chemically synthesized
accttgtgatccgcccacct

SEQ ID NO: 17732 - DNA, 20 bp, Artificial Sequence
  chemically synthesized
ggctgaggtgggcggatcac

SEQ ID NO: 17733 - DNA, 20 bp, Artificial Sequence
  chemically synthesized
gctgaggtgggcggatcaca

SEQ ID NO: 17734 - DNA, 20 bp, Artificial Sequence
  chemically synthesized
ggtgggcggatcacaaggtc

SEQ ID NO: 17735 - DNA, 20 bp, Artificial Sequence
  chemically synthesized
tgggcggatcacaaggtcaa

SEQ ID NO: 17736 - DNA, 20 bp, Artificial Sequence
  chemically synthesized
gatcacaaggtcaagagatt

SEQ ID NO: 17737 - DNA, 20 bp, Artificial Sequence
  chemically synthesized
tcaagagattgagaccatcc

SEQ ID NO: 17738 - DNA, 20 bp, Artificial Sequence
  chemically synthesized
tttcaccatgttggccagga

SEQ ID NO: 17739 - DNA, 20 bp, Artificial Sequence
  chemically synthesized
aaggtttcaccatgttggcc

SEQ ID NO: 17740 - DNA, 20 bp, Artificial Sequence
  chemically synthesized
tgagaccatcctggccaaca

SEQ ID NO: 17741 - DNA, 20 bp, Artificial Sequence
  chemically synthesized
gaaggtttcaccatgttggc

SEQ ID NO: 17742 - DNA, 20 bp, Artificial Sequence
  chemically synthesized
tagagaaggtttcaccatgt

SEQ ID NO: 17743 - DNA, 20 bp, Artificial Sequence
  chemically synthesized
ttttgtatttttaatagaga

SEQ ID NO: 17744 - DNA, 20 bp, Artificial Sequence
  chemically synthesized
tttttgtatttttaatagag

SEQ ID NO: 17745 - DNA, 20 bp, Artificial Sequence
  chemically synthesized
taatttttgtatttttaata

SEQ ID NO: 17746 - DNA, 20 bp, Artificial Sequence
  chemically synthesized
gctaatttttgtatttttaa

SEQ ID NO: 17747 - DNA, 20 bp, Artificial Sequence
  chemically synthesized
tctattaaaaatacaaaaat

SEQ ID NO: 17748 - DNA, 20 bp, Artificial Sequence
  chemically synthesized
ttaaaaatacaaaaattagc

SEQ ID NO: 17749 - DNA, 20 bp, Artificial Sequence
  chemically synthesized
taaaaatacaaaaattagct

SEQ ID NO: 17750 - DNA, 20 bp, Artificial Sequence
  chemically synthesized
atacaaaaattagctgggcg

SEQ ID NO: 17751 - DNA, 20 bp, Artificial Sequence
  chemically synthesized
caaaaattagctgggcgtgg

SEQ ID NO: 17752 - DNA, 20 bp, Artificial Sequence
  chemically synthesized
caggcacgtgccaccacgcc

SEQ ID NO: 17753 - DNA, 20 bp, Artificial Sequence
  chemically synthesized
ggcgtggtggcacgtgcctg

SEQ ID NO: 17754 - DNA, 20 bp, Artificial Sequence
  chemically synthesized
gtggcacgtgcctgtagtcc

SEQ ID NO: 17755 - DNA, 20 bp, Artificial Sequence
  chemically synthesized
tcccaagtagctgggactac

SEQ ID NO: 17756 - DNA, 20 bp, Artificial Sequence
  chemically synthesized
ctcccaagtagctgggacta

SEQ ID NO: 17757 - DNA, 20 bp, Artificial Sequence
  chemically synthesized
tgcctgtagtcccagctact

SEQ ID NO: 17758 - DNA, 20 bp, Artificial Sequence
  chemically synthesized
cctcagcctcccaagtagct

SEQ ID NO: 17759 - DNA, 20 bp, Artificial Sequence
  chemically synthesized
gcctgtagtcccagctactt

SEQ ID NO: 17760 - DNA, 20 bp, Artificial Sequence
  chemically synthesized
gcctcagcctcccaagtagc

SEQ ID NO: 17761 - DNA, 20 bp, Artificial Sequence
  chemically synthesized
ctgtagtcccagctacttgg

SEQ ID NO: 17762 - DNA, 20 bp, Artificial Sequence
  chemically synthesized
tgtagtcccagctacttggg

SEQ ID NO: 17763 - DNA, 20 bp, Artificial Sequence
  chemically synthesized
tcctgcctcagcctcccaag

SEQ ID NO: 17764 - DNA, 20 bp, Artificial Sequence
  chemically synthesized
ttctcctgcctcagcctccc

SEQ ID NO: 17765 - DNA, 20 bp, Artificial Sequence
  chemically synthesized
tcccagctacttgggaggct

SEQ ID NO: 17766 - DNA, 20 bp, Artificial Sequence
  chemically synthesized
cccagctacttgggaggctg

SEQ ID NO: 17767 - DNA, 20 bp, Artificial Sequence
  chemically synthesized
agctacttgggaggctgagg

SEQ ID NO: 17768 - DNA, 20 bp, Artificial Sequence
  chemically synthesized
gctacttgggaggctgaggc

SEQ ID NO: 17769 - DNA, 20 bp, Artificial Sequence
  chemically synthesized
tacttgggaggctgaggcag

SEQ ID NO: 17770 - DNA, 20 bp, Artificial Sequence
  chemically synthesized
ttcaagtgattctcctgcct

SEQ ID NO: 17771 - DNA, 20 bp, Artificial Sequence
  chemically synthesized
gcaggagaatcacttgaacc

SEQ ID NO: 17772 - DNA, 20 bp, Artificial Sequence
  chemically synthesized
caggagaatcacttgaacct

SEQ ID NO: 17773 - DNA, 20 bp, Artificial Sequence
  chemically synthesized
aacctccacctcccaggttc

SEQ ID NO: 17774 - DNA, 20 bp, Artificial Sequence
  chemically synthesized
ggagaatcacttgaacctgg

SEQ ID NO: 17775 - DNA, 20 bp, Artificial Sequence
  chemically synthesized
gagaatcacttgaacctggg

SEQ ID NO: 17776 - DNA, 20 bp, Artificial Sequence
  chemically synthesized
aatcacttgaacctgggagg

SEQ ID NO: 17777 - DNA, 20 bp, Artificial Sequence
  chemically synthesized
cactgcaacctccacctccc

SEQ ID NO: 17778 - DNA, 20 bp, Artificial Sequence
  chemically synthesized
tcacttgaacctgggaggtg

SEQ ID NO: 17779 - DNA, 20 bp, Artificial Sequence
  chemically synthesized
acactgcaacctccacctcc

SEQ ID NO: 17780 - DNA, 20 bp, Artificial Sequence
  chemically synthesized
cacttgaacctgggaggtgg

SEQ ID NO: 17781 - DNA, 20 bp, Artificial Sequence
  chemically synthesized
aacctgggaggtggaggttg

SEQ ID NO: 17782 - DNA, 20 bp, Artificial Sequence
  chemically synthesized
ggtggaggttgcagtgtgcc

SEQ ID NO: 17783 - DNA, 20 bp, Artificial Sequence
  chemically synthesized
gaggttgcagtgtgccgaga

SEQ ID NO: 17784 - DNA, 20 bp, Artificial Sequence
  chemically synthesized
ggagtccagtggtgccatct

SEQ ID NO: 17785 - DNA, 20 bp, Artificial Sequence
  chemically synthesized
gtgtgccgagatggcaccac

SEQ ID NO: 17786 - DNA, 20 bp, Artificial Sequence
  chemically synthesized
gttgccaggctggagtccag

SEQ ID NO: 17787 - DNA, 20 bp, Artificial Sequence
  chemically synthesized
gagatggcaccactggactc

SEQ ID NO: 17788 - DNA, 20 bp, Artificial Sequence
  chemically synthesized
tctgttgccaggctggagtc

SEQ ID NO: 17789 - DNA, 20 bp, Artificial Sequence
  chemically synthesized
ggcaccactggactccagcc

SEQ ID NO: 17790 - DNA, 20 bp, Artificial Sequence
  chemically synthesized
ctcgctctgttgccaggctg

SEQ ID NO: 17791 - DNA, 20 bp, Artificial Sequence
  chemically synthesized
gtctcgctctgttgccaggc

SEQ ID NO: 17792 - DNA, 20 bp, Artificial Sequence
  chemically synthesized
actggactccagcctggcaa

SEQ ID NO: 17793 - DNA, 20 bp, Artificial Sequence
  chemically synthesized
tggactccagcctggcaaca

SEQ ID NO: 17794 - DNA, 20 bp, Artificial Sequence
  chemically synthesized
cagagtctcgctctgttgcc

SEQ ID NO: 17795 - DNA, 20 bp, Artificial Sequence
  chemically synthesized
acagagtctcgctctgttgc

SEQ ID NO: 17796 - DNA, 20 bp, Artificial Sequence
  chemically synthesized
ctccagcctggcaacagagc

SEQ ID NO: 17797 - DNA, 20 bp, Artificial Sequence
  chemically synthesized
ttttttttttttttgagaca

SEQ ID NO: 17798 - DNA, 20 bp, Artificial Sequence
  chemically synthesized
ttttttttttttttttgaga

SEQ ID NO: 17799 - DNA, 20 bp, Artificial Sequence
  chemically synthesized
tttttttttttttttttttt

SEQ ID NO: 17800 - DNA, 20 bp, Artificial Sequence
  chemically synthesized
aaaaaaaaaaaaaaaaaaaa

SEQ ID NO: 17801 - DNA, 20 bp, Artificial Sequence
  chemically synthesized
aaaaaaaaaaaaaaagtaat

SEQ ID NO: 17802 - DNA, 20 bp, Artificial Sequence
  chemically synthesized
aaaaaagtaatcagttgacc

SEQ ID NO: 17803 - DNA, 20 bp, Artificial Sequence
  chemically synthesized
aaaaagtaatcagttgaccc

SEQ ID NO: 17804 - DNA, 20 bp, Artificial Sequence
  chemically synthesized
aaaagtaatcagttgacccg

SEQ ID NO: 17805 - DNA, 20 bp, Artificial Sequence
  chemically synthesized
ctggttagacagcattcccc

SEQ ID NO: 17806 - DNA, 20 bp, Artificial Sequence
  chemically synthesized
gctggttagacagcattccc

SEQ ID NO: 17807 - DNA, 20 bp, Artificial Sequence
  chemically synthesized
cccggggaatgctgtctaac

SEQ ID NO: 17808 - DNA, 20 bp, Artificial Sequence
  chemically synthesized
gagacttttggctggttaga

SEQ ID NO: 17809 - DNA, 20 bp, Artificial Sequence
  chemically synthesized
tcaggagacttttggctggt

SEQ ID NO: 17810 - DNA, 20 bp, Artificial Sequence
  chemically synthesized
aatgctgtctaaccagccaa

SEQ ID NO: 17811 - DNA, 20 bp, Artificial Sequence
  chemically synthesized
catatcaggagacttttggc

SEQ ID NO: 17812 - DNA, 20 bp, Artificial Sequence
  chemically synthesized
atgccatatcaggagacttt

SEQ ID NO: 17813 - DNA, 20 bp, Artificial Sequence
  chemically synthesized
cagccaaaagtctcctgata

SEQ ID NO: 17814 - DNA, 20 bp, Artificial Sequence
  chemically synthesized
atgttaaaatgccatatcag

SEQ ID NO: 17815 - DNA, 20 bp, Artificial Sequence
  chemically synthesized
aaatgttaaaatgccatatc

SEQ ID NO: 17816 - DNA, 20 bp, Artificial Sequence
  chemically synthesized
caaatgttaaaatgccatat

SEQ ID NO: 17817 - DNA, 20 bp, Artificial Sequence
  chemically synthesized
atatggcattttaacatttg

SEQ ID NO: 17818 - DNA, 20 bp, Artificial Sequence
  chemically synthesized
atggcattttaacatttgca

SEQ ID NO: 17819 - DNA, 20 bp, Artificial Sequence
  chemically synthesized
ttttaacatttgcagagaaa

SEQ ID NO: 17820 - DNA, 20 bp, Artificial Sequence
  chemically synthesized
ttgcagagaaacagaatctc

SEQ ID NO: 17821 - DNA, 20 bp, Artificial Sequence
  chemically synthesized
attgcattttagagattctg

SEQ ID NO: 17822 - DNA, 20 bp, Artificial Sequence
  chemically synthesized
ggattgcattttagagattc

SEQ ID NO: 17823 - DNA, 20 bp, Artificial Sequence
  chemically synthesized
catctgtggattgcatttta

SEQ ID NO: 17824 - DNA, 20 bp, Artificial Sequence
  chemically synthesized
atcatctgtggattgcattt

SEQ ID NO: 17825 - DNA, 20 bp, Artificial Sequence
  chemically synthesized
aatctctaaaatgcaatcca

SEQ ID NO: 17826 - DNA, 20 bp, Artificial Sequence
  chemically synthesized
ctataacaaaacatcatctg

SEQ ID NO: 17827 - DNA, 20 bp, Artificial Sequence
  chemically synthesized
ccacagatgatgttttgtta

SEQ ID NO: 17828 - DNA, 20 bp, Artificial Sequence
  chemically synthesized
tgatgttttgttatagataa

SEQ ID NO: 17829 - DNA, 20 bp, Artificial Sequence
  chemically synthesized
ataaaagcaactgttaacat

SEQ ID NO: 17830 - DNA, 20 bp, Artificial Sequence
  chemically synthesized
aaatatcctgccaatgttaa

SEQ ID NO: 17831 - DNA, 20 bp, Artificial Sequence
  chemically synthesized
aaagcaactgttaacattgg

SEQ ID NO: 17832 - DNA, 20 bp, Artificial Sequence
  chemically synthesized
aagcaactgttaacattggc

SEQ ID NO: 17833 - DNA, 20 bp, Artificial Sequence
  chemically synthesized
tgattatctaaagtgtgttg

SEQ ID NO: 17834 - DNA, 20 bp, Artificial Sequence
  chemically synthesized
tttcatgccacaacacactt

SEQ ID NO: 17835 - DNA, 20 bp, Artificial Sequence
  chemically synthesized
atgttagctatgattatcta

SEQ ID NO: 17836 - DNA, 20 bp, Artificial Sequence
  chemically synthesized
caacacactttagataatca

SEQ ID NO: 17837 - DNA, 20 bp, Artificial Sequence
  chemically synthesized
agaaggtgcccagtgaatgt

SEQ ID NO: 17838 - DNA, 20 bp, Artificial Sequence
  chemically synthesized
taatcatagctaacattcac

SEQ ID NO: 17839 - DNA, 20 bp, Artificial Sequence
  chemically synthesized
aatcatagctaacattcact

SEQ ID NO: 17840 - DNA, 20 bp, Artificial Sequence
  chemically synthesized
gtggatacatagaaggtgcc

SEQ ID NO: 17841 - DNA, 20 bp, Artificial Sequence
  chemically synthesized
agctgtagtggatacataga

SEQ ID NO: 17842 - DNA, 20 bp, Artificial Sequence
  chemically synthesized
gagctgtagtggatacatag

SEQ ID NO: 17843 - DNA, 20 bp, Artificial Sequence
  chemically synthesized
taagagctgtagtggataca

SEQ ID NO: 17844 - DNA, 20 bp, Artificial Sequence
  chemically synthesized
caccttctatgtatccacta

SEQ ID NO: 17845 - DNA, 20 bp, Artificial Sequence
  chemically synthesized
aaagcacttaagagctgtag

SEQ ID NO: 17846 - DNA, 20 bp, Artificial Sequence
  chemically synthesized
agcaaagcacttaagagctg

SEQ ID NO: 17847 - DNA, 20 bp, Artificial Sequence
  chemically synthesized
atgtatccactacagctctt

SEQ ID NO: 17848 - DNA, 20 bp, Artificial Sequence
  chemically synthesized
aatagaagcaaagcacttaa

SEQ ID NO: 17849 - DNA, 20 bp, Artificial Sequence
  chemically synthesized
ccaatagaagcaaagcactt

SEQ ID NO: 17850 - DNA, 20 bp, Artificial Sequence
  chemically synthesized
taaatgaaccaatagaagca

SEQ ID NO: 17851 - DNA, 20 bp, Artificial Sequence
  chemically synthesized
cttaagtgctttgcttctat

SEQ ID NO: 17852 - DNA, 20 bp, Artificial Sequence
  chemically synthesized
aggattaaatgaaccaatag

SEQ ID NO: 17853 - DNA, 20 bp, Artificial Sequence
  chemically synthesized
gtgaggattaaatgaaccaa

SEQ ID NO: 17854 - DNA, 20 bp, Artificial Sequence
  chemically synthesized
aactcctggaggtgattgtg

SEQ ID NO: 17855 - DNA, 20 bp, Artificial Sequence
  chemically synthesized
gaactcctggaggtgattgt

SEQ ID NO: 17856 - DNA, 20 bp, Artificial Sequence
  chemically synthesized
ttaatcctcacaatcacctc

SEQ ID NO: 17857 - DNA, 20 bp, Artificial Sequence
  chemically synthesized
taatcctcacaatcacctcc

SEQ ID NO: 17858 - DNA, 20 bp, Artificial Sequence
  chemically synthesized
atcctcacaatcacctccag

SEQ ID NO: 17859 - DNA, 20 bp, Artificial Sequence
  chemically synthesized
cctggcccctgaactcctgg

SEQ ID NO: 17860 - DNA, 20 bp, Artificial Sequence
  chemically synthesized
tcctggcccctgaactcctg

SEQ ID NO: 17861 - DNA, 20 bp, Artificial Sequence
  chemically synthesized
cacaatcacctccaggagtt

SEQ ID NO: 17862 - DNA, 20 bp, Artificial Sequence
  chemically synthesized
acaatcacctccaggagttc

SEQ ID NO: 17863 - DNA, 20 bp, Artificial Sequence
  chemically synthesized
cttcctggcccctgaactcc

SEQ ID NO: 17864 - DNA, 20 bp, Artificial Sequence
  chemically synthesized
caatcacctccaggagttca

SEQ ID NO: 17865 - DNA, 20 bp, Artificial Sequence
  chemically synthesized
aatcacctccaggagttcag

SEQ ID NO: 17866 - DNA, 20 bp, Artificial Sequence
  chemically synthesized
acctccaggagttcaggggc

SEQ ID NO: 17867 - DNA, 20 bp, Artificial Sequence
  chemically synthesized
cctccaggagttcaggggcc

SEQ ID NO: 17868 - DNA, 20 bp, Artificial Sequence
  chemically synthesized
ccaggagttcaggggccagg

SEQ ID NO: 17869 - DNA, 20 bp, Artificial Sequence
  chemically synthesized
caggagttcaggggccagga

SEQ ID NO: 17870 - DNA, 20 bp, Artificial Sequence
  chemically synthesized
gacacatttcttaaccttcc

SEQ ID NO: 17871 - DNA, 20 bp, Artificial Sequence
  chemically synthesized
gttcaggggccaggaaggtt

SEQ ID NO: 17872 - DNA, 20 bp, Artificial Sequence
  chemically synthesized
aaggttaagaaatgtgtcca

SEQ ID NO: 17873 - DNA, 20 bp, Artificial Sequence
  chemically synthesized
atttgctggctgtgtgactg

SEQ ID NO: 17874 - DNA, 20 bp, Artificial Sequence
  chemically synthesized
gaaatgtgtccacagtcaca

SEQ ID NO: 17875 - DNA, 20 bp, Artificial Sequence
  chemically synthesized
tgtgtccacagtcacacagc

SEQ ID NO: 17876 - DNA, 20 bp, Artificial Sequence
  chemically synthesized
acagtcacacagccagcaaa

SEQ ID NO: 17877 - DNA, 20 bp, Artificial Sequence
  chemically synthesized
atctgagctctgctatttgc

SEQ ID NO: 17878 - DNA, 20 bp, Artificial Sequence
  chemically synthesized
gtcacacagccagcaaatag

SEQ ID NO: 17879 - DNA, 20 bp, Artificial Sequence
  chemically synthesized
cacacagccagcaaatagca

SEQ ID NO: 17880 - DNA, 20 bp, Artificial Sequence
  chemically synthesized
agccagcaaatagcagagct

SEQ ID NO: 17881 - DNA, 20 bp, Artificial Sequence
  chemically synthesized
caaatagcagagctcagatt

SEQ ID NO: 17882 - DNA, 20 bp, Artificial Sequence
  chemically synthesized
ctgtgcctgagtccaaatct

SEQ ID NO: 17883 - DNA, 20 bp, Artificial Sequence
  chemically synthesized
gcagagctcagatttggact

SEQ ID NO: 17884 - DNA, 20 bp, Artificial Sequence
  chemically synthesized
cagagctcagatttggactc

SEQ ID NO: 17885 - DNA, 20 bp, Artificial Sequence
  chemically synthesized
ctcagatttggactcaggca

SEQ ID NO: 17886 - DNA, 20 bp, Artificial Sequence
  chemically synthesized
tttgaaaccgaactgtgcct

SEQ ID NO: 17887 - DNA, 20 bp, Artificial Sequence
  chemically synthesized
atttggactcaggcacagtt

SEQ ID NO: 17888 - DNA, 20 bp, Artificial Sequence
  chemically synthesized
tcaggcacagttcggtttca

SEQ ID NO: 17889 - DNA, 20 bp, Artificial Sequence
  chemically synthesized
ggcagagtggttaagtgcat

SEQ ID NO: 17890 - DNA, 20 bp, Artificial Sequence
  chemically synthesized
tggcagagtggttaagtgca

SEQ ID NO: 17891 - DNA, 20 bp, Artificial Sequence
  chemically synthesized
aagtgactggcagagtggtt

SEQ ID NO: 17892 - DNA, 20 bp, Artificial Sequence
  chemically synthesized
tatgcacttaaccactctgc

SEQ ID NO: 17893 - DNA, 20 bp, Artificial Sequence
  chemically synthesized
tggagaagtgactggcagag

SEQ ID NO: 17894 - DNA, 20 bp, Artificial Sequence
  chemically synthesized
atctggagaagtgactggca

SEQ ID NO: 17895 - DNA, 20 bp, Artificial Sequence
  chemically synthesized
atatctggagaagtgactgg

SEQ ID NO: 17896 - DNA, 20 bp, Artificial Sequence
  chemically synthesized
agaatatctggagaagtgac

SEQ ID NO: 17897 - DNA, 20 bp, Artificial Sequence
  chemically synthesized
cactctgccagtcacttctc

SEQ ID NO: 17898 - DNA, 20 bp, Artificial Sequence
  chemically synthesized
gcattccagaatatctggag

SEQ ID NO: 17899 - DNA, 20 bp, Artificial Sequence
  chemically synthesized
aaagcattccagaatatctg

SEQ ID NO: 17900 - DNA, 20 bp, Artificial Sequence
  chemically synthesized
agtcacttctccagatattc

SEQ ID NO: 17901 - DNA, 20 bp, Artificial Sequence
  chemically synthesized
agaaagcattccagaatatc

SEQ ID NO: 17902 - DNA, 20 bp, Artificial Sequence
  chemically synthesized
acataaatgagaaagcattc

SEQ ID NO: 17903 - DNA, 20 bp, Artificial Sequence
  chemically synthesized
tcagtaacacataaatgaga

SEQ ID NO: 17904 - DNA, 20 bp, Artificial Sequence
  chemically synthesized
aggatcagtaacacataaat

SEQ ID NO: 17905 - DNA, 20 bp, Artificial Sequence
  chemically synthesized
ggagactgaggtgggaggat

SEQ ID NO: 17906 - DNA, 20 bp, Artificial Sequence
  chemically synthesized
tgttactgatcctcccacct

SEQ ID NO: 17907 - DNA, 20 bp, Artificial Sequence
  chemically synthesized
actcaggagactgaggtggg

SEQ ID NO: 17908 - DNA, 20 bp, Artificial Sequence
  chemically synthesized
tactcaggagactgaggtgg

SEQ ID NO: 17909 - DNA, 20 bp, Artificial Sequence
  chemically synthesized
gctactcaggagactgaggt

SEQ ID NO: 17910 - DNA, 20 bp, Artificial Sequence
  chemically synthesized
agctactcaggagactgagg

SEQ ID NO: 17911 - DNA, 20 bp, Artificial Sequence
  chemically synthesized
cccagctactcaggagactg

SEQ ID NO: 17912 - DNA, 20 bp, Artificial Sequence
  chemically synthesized
tcccagctactcaggagact

SEQ ID NO: 17913 - DNA, 20 bp, Artificial Sequence
  chemically synthesized
tcctcccacctcagtctcct

SEQ ID NO: 17914 - DNA, 20 bp, Artificial Sequence
  chemically synthesized
tcccacctcagtctcctgag

SEQ ID NO: 17915 - DNA, 20 bp, Artificial Sequence
  chemically synthesized
ctgtagtcccagctactcag

SEQ ID NO: 17916 - DNA, 20 bp, Artificial Sequence
  chemically synthesized
acctcagtctcctgagtagc

SEQ ID NO: 17917 - DNA, 20 bp, Artificial Sequence
  chemically synthesized
ccctgtagtcccagctactc

SEQ ID NO: 17918 - DNA, 20 bp, Artificial Sequence
  chemically synthesized
cctcagtctcctgagtagct

SEQ ID NO: 17919 - DNA, 20 bp, Artificial Sequence
  chemically synthesized
cccctgtagtcccagctact

SEQ ID NO: 17920 - DNA, 20 bp, Artificial Sequence
  chemically synthesized
ctcctgagtagctgggacta

SEQ ID NO: 17921 - DNA, 20 bp, Artificial Sequence
  chemically synthesized
tcctgagtagctgggactac

SEQ ID NO: 17922 - DNA, 20 bp, Artificial Sequence
  chemically synthesized
gtggcatgcccctgtagtcc

SEQ ID NO: 17923 - DNA, 20 bp, Artificial Sequence
  chemically synthesized
cctgagtagctgggactaca

SEQ ID NO: 17924 - DNA, 20 bp, Artificial Sequence
  chemically synthesized
ctgagtagctgggactacag

SEQ ID NO: 17925 - DNA, 20 bp, Artificial Sequence
  chemically synthesized
tgcatggtggcatgcccctg

SEQ ID NO: 17926 - DNA, 20 bp, Artificial Sequence
  chemically synthesized
caggggcatgccaccatgca

SEQ ID NO: 17927 - DNA, 20 bp, Artificial Sequence
  chemically synthesized
attattgttgccatgcatgg

SEQ ID NO: 17928 - DNA, 20 bp, Artificial Sequence
  chemically synthesized
tgtattattgttgccatgca

SEQ ID NO: 17929 - DNA, 20 bp, Artificial Sequence
  chemically synthesized
gtatatttcaaaataactaa

SEQ ID NO: 17930 - DNA, 20 bp, Artificial Sequence
  chemically synthesized
atatttcaaaataactaaaa

SEQ ID NO: 17931 - DNA, 20 bp, Artificial Sequence
  chemically synthesized
tttcaaaataactaaaagag

SEQ ID NO: 17932 - DNA, 20 bp, Artificial Sequence
  chemically synthesized
cattcccaattctactcttt

SEQ ID NO: 17933 - DNA, 20 bp, Artificial Sequence
  chemically synthesized
aataactaaaagagtagaat

SEQ ID NO: 17934 - DNA, 20 bp, Artificial Sequence
  chemically synthesized
ataactaaaagagtagaatt

SEQ ID NO: 17935 - DNA, 20 bp, Artificial Sequence
  chemically synthesized
aattgggaatgtttctaaca

SEQ ID NO: 17936 - DNA, 20 bp, Artificial Sequence
  chemically synthesized
ttgggaatgtttctaacaca

SEQ ID NO: 17937 - DNA, 20 bp, Artificial Sequence
  chemically synthesized
gaacaagtatttctctgtgt

SEQ ID NO: 17938 - DNA, 20 bp, Artificial Sequence
  chemically synthesized
cagtctcaactgttgagaac

SEQ ID NO: 17939 - DNA, 20 bp, Artificial Sequence
  chemically synthesized
agagaaatacttgttctcaa

SEQ ID NO: 17940 - DNA, 20 bp, Artificial Sequence
  chemically synthesized
aatacttgttctcaacagtt

SEQ ID NO: 17941 - DNA, 20 bp, Artificial Sequence
  chemically synthesized
aaattacagtctcaactgtt

SEQ ID NO: 17942 - DNA, 20 bp, Artificial Sequence
  chemically synthesized
atgaaaatgagaataaatta

SEQ ID NO: 17943 - DNA, 20 bp, Artificial Sequence
  chemically synthesized
atgtagaatgatatgaaaat

SEQ ID NO: 17944 - DNA, 20 bp, Artificial Sequence
  chemically synthesized
gcacagttgttgtaataatg

SEQ ID NO: 17945 - DNA, 20 bp, Artificial Sequence
  chemically synthesized
attattacaacaactgtgca

SEQ ID NO: 17946 - DNA, 20 bp, Artificial Sequence
  chemically synthesized
aaatgaataccatctatgca

SEQ ID NO: 17947 - DNA, 20 bp, Artificial Sequence
  chemically synthesized
ttacaacaactgtgcataga

SEQ ID NO: 17948 - DNA, 20 bp, Artificial Sequence
  chemically synthesized
attcatttttgtcatacaaa

SEQ ID NO: 17949 - DNA, 20 bp, Artificial Sequence
  chemically synthesized
tcatttttgtcatacaaata

SEQ ID NO: 17950 - DNA, 20 bp, Artificial Sequence
  chemically synthesized
gtcatacaaatagagaaatt

SEQ ID NO: 17951 - DNA, 20 bp, Artificial Sequence
  chemically synthesized
atacaaatagagaaattcag

SEQ ID NO: 17952 - DNA, 20 bp, Artificial Sequence
  chemically synthesized
aaatagagaaattcagaaga

SEQ ID NO: 17953 - DNA, 20 bp, Artificial Sequence
  chemically synthesized
agagaaattcagaagataga

SEQ ID NO: 17954 - DNA, 20 bp, Artificial Sequence
  chemically synthesized
aattcagaagatagatggaa

SEQ ID NO: 17955 - DNA, 20 bp, Artificial Sequence
  chemically synthesized
ggaaaagcaacttactcatt

SEQ ID NO: 17956 - DNA, 20 bp, Artificial Sequence
  chemically synthesized
acttagtattccaaatgagt

SEQ ID NO: 17957 - DNA, 20 bp, Artificial Sequence
  chemically synthesized
ttgtacttagtattccaaat

SEQ ID NO: 17958 - DNA, 20 bp, Artificial Sequence
  chemically synthesized
acttactcatttggaatact

SEQ ID NO: 17959 - DNA, 20 bp, Artificial Sequence
  chemically synthesized
atttggaatactaagtacaa

SEQ ID NO: 17960 - DNA, 20 bp, Artificial Sequence
  chemically synthesized
tttctgcctcctgttgtact

SEQ ID NO: 17961 - DNA, 20 bp, Artificial Sequence
  chemically synthesized
tttggaatactaagtacaac

SEQ ID NO: 17962 - DNA, 20 bp, Artificial Sequence
  chemically synthesized
tggaatactaagtacaacag

SEQ ID NO: 17963 - DNA, 20 bp, Artificial Sequence
  chemically synthesized
ggaatactaagtacaacagg

SEQ ID NO: 17964 - DNA, 20 bp, Artificial Sequence
  chemically synthesized
atactaagtacaacaggagg

SEQ ID NO: 17965 - DNA, 20 bp, Artificial Sequence
  chemically synthesized
gtacaacaggaggcagaaaa

SEQ ID NO: 17966 - DNA, 20 bp, Artificial Sequence
  chemically synthesized
gaaaacagatgtaaaataaa

SEQ ID NO: 17967 - DNA, 20 bp, Artificial Sequence
  chemically synthesized
ataaacagattttgacactc

SEQ ID NO: 17968 - DNA, 20 bp, Artificial Sequence
  chemically synthesized
tgcttcacctatgagagctg

SEQ ID NO: 17969 - DNA, 20 bp, Artificial Sequence
  chemically synthesized
ttttgacactccagctctca

SEQ ID NO: 17970 - DNA, 20 bp, Artificial Sequence
  chemically synthesized
tatgcttcacctatgagagc

SEQ ID NO: 17971 - DNA, 20 bp, Artificial Sequence
  chemically synthesized
tttgacactccagctctcat

SEQ ID NO: 17972 - DNA, 20 bp, Artificial Sequence
  chemically synthesized
tcaatatgcttcacctatga

SEQ ID NO: 17973 - DNA, 20 bp, Artificial Sequence
  chemically synthesized
cactccagctctcataggtg

SEQ ID NO: 17974 - DNA, 20 bp, Artificial Sequence
  chemically synthesized
attcaatatgcttcacctat

SEQ ID NO: 17975 - DNA, 20 bp, Artificial Sequence
  chemically synthesized
ggtgaagcatattgaatata

SEQ ID NO: 17976 - DNA, 20 bp, Artificial Sequence
  chemically synthesized
aagcatattgaatataaagt

SEQ ID NO: 17977 - DNA, 20 bp, Artificial Sequence
  chemically synthesized
tttattgtttagataacgtc

SEQ ID NO: 17978 - DNA, 20 bp, Artificial Sequence
  chemically synthesized
ttgacgttatctaaacaata

SEQ ID NO: 17979 - DNA, 20 bp, Artificial Sequence
  chemically synthesized
attttaaggactttattgtt

SEQ ID NO: 17980 - DNA, 20 bp, Artificial Sequence
  chemically synthesized
cttcttcagtaaacatttta

SEQ ID NO: 17981 - DNA, 20 bp, Artificial Sequence
  chemically synthesized
tcttcttcagtaaacatttt

SEQ ID NO: 17982 - DNA, 20 bp, Artificial Sequence
  chemically synthesized
agtccttaaaatgtttactg

SEQ ID NO: 17983 - DNA, 20 bp, Artificial Sequence
  chemically synthesized
ccttaaaatgtttactgaag

SEQ ID NO: 17984 - DNA, 20 bp, Artificial Sequence
  chemically synthesized
cgattttgtagtatcttctt

SEQ ID NO: 17985 - DNA, 20 bp, Artificial Sequence
  chemically synthesized
tttttgtggtttcgattttg

SEQ ID NO: 17986 - DNA, 20 bp, Artificial Sequence
  chemically synthesized
tacaaaatcgaaaccacaaa

SEQ ID NO: 17987 - DNA, 20 bp, Artificial Sequence
  chemically synthesized
ggagtgcagatatctttttg

SEQ ID NO: 17988 - DNA, 20 bp, Artificial Sequence
  chemically synthesized
ctgcagtcaacatgggagtg

SEQ ID NO: 17989 - DNA, 20 bp, Artificial Sequence
  chemically synthesized
caatgctgcagtcaacatgg

SEQ ID NO: 17990 - DNA, 20 bp, Artificial Sequence
  chemically synthesized
aacaatgctgcagtcaacat

SEQ ID NO: 17991 - DNA, 20 bp, Artificial Sequence
  chemically synthesized
gaacaatgctgcagtcaaca

SEQ ID NO: 17992 - DNA, 20 bp, Artificial Sequence
  chemically synthesized
ctgcactcccatgttgactg

SEQ ID NO: 17993 - DNA, 20 bp, Artificial Sequence
  chemically synthesized
ggctattgtgaacaatgctg

SEQ ID NO: 17994 - DNA, 20 bp, Artificial Sequence
  chemically synthesized
gactgcagcattgttcacaa

SEQ ID NO: 17995 - DNA, 20 bp, Artificial Sequence
  chemically synthesized
cagcattgttcacaatagcc

SEQ ID NO: 17996 - DNA, 20 bp, Artificial Sequence
  chemically synthesized
tgttcacaatagccaagata

SEQ ID NO: 17997 - DNA, 20 bp, Artificial Sequence
  chemically synthesized
cttaggttgattctatatct

SEQ ID NO: 17998 - DNA, 20 bp, Artificial Sequence
  chemically synthesized
ccaagatatagaatcaacct

SEQ ID NO: 17999 - DNA, 20 bp, Artificial Sequence
  chemically synthesized
tcatccactgatgggcgctt

SEQ ID NO: 18000 - DNA, 20 bp, Artificial Sequence
  chemically synthesized
ttcatccactgatgggcgct

SEQ ID NO: 18001 - DNA, 20 bp, Artificial Sequence
  chemically synthesized
gaatcaacctaagcgcccat

SEQ ID NO: 18002 - DNA, 20 bp, Artificial Sequence
  chemically synthesized
tcaacctaagcgcccatcag

SEQ ID NO: 18003 - DNA, 20 bp, Artificial Sequence
  chemically synthesized
ttatgcattcatccactgat

SEQ ID NO: 18004 - DNA, 20 bp, Artificial Sequence
  chemically synthesized
tttatgcattcatccactga

SEQ ID NO: 18005 - DNA, 20 bp, Artificial Sequence
  chemically synthesized
catcagtggatgaatgcata

SEQ ID NO: 18006 - DNA, 20 bp, Artificial Sequence
  chemically synthesized
aatattccattatgtgttta

SEQ ID NO: 18007 - DNA, 20 bp, Artificial Sequence
  chemically synthesized
aatgtactataaacacataa

SEQ ID NO: 18008 - DNA, 20 bp, Artificial Sequence
  chemically synthesized
acacataatggaatattatt

SEQ ID NO: 18009 - DNA, 20 bp, Artificial Sequence
  chemically synthesized
taatgggatttcatttttta

SEQ ID NO: 18010 - DNA, 20 bp, Artificial Sequence
  chemically synthesized
tacatgttgctgcaaataat

SEQ ID NO: 18011 - DNA, 20 bp, Artificial Sequence
  chemically synthesized
aaatgaaatcccattatttg

SEQ ID NO: 18012 - DNA, 20 bp, Artificial Sequence
  chemically synthesized
gtacatgttgctgcaaataa

SEQ ID NO: 18013 - DNA, 20 bp, Artificial Sequence
  chemically synthesized
attatttgcagcaacatgta

SEQ ID NO: 18014 - DNA, 20 bp, Artificial Sequence
  chemically synthesized
tgcagcaacatgtacggaac

SEQ ID NO: 18015 - DNA, 20 bp, Artificial Sequence
  chemically synthesized
agcaacatgtacggaaccgg

SEQ ID NO: 18016 - DNA, 20 bp, Artificial Sequence
  chemically synthesized
gatctcaacataacgtcttc

SEQ ID NO: 18017 - DNA, 20 bp, Artificial Sequence
  chemically synthesized
gaaccggaagacgttatgtt

SEQ ID NO: 18018 - DNA, 20 bp, Artificial Sequence
  chemically synthesized
ggaagacgttatgttgagat

SEQ ID NO: 18019 - DNA, 20 bp, Artificial Sequence
  chemically synthesized
atgttgagatcagccacaca

SEQ ID NO: 18020 - DNA, 20 bp, Artificial Sequence
  chemically synthesized
gatacttgtctttctgtgtg

SEQ ID NO: 18021 - DNA, 20 bp, Artificial Sequence
  chemically synthesized
tgagatcagccacacacaga

SEQ ID NO: 18022 - DNA, 20 bp, Artificial Sequence
  chemically synthesized
tcagccacacacagaaagac

SEQ ID NO: 18023 - DNA, 20 bp, Artificial Sequence
  chemically synthesized
ccacacatgagtgagaacat

SEQ ID NO: 18024 - DNA, 20 bp, Artificial Sequence
  chemically synthesized
cccacacatgagtgagaaca

SEQ ID NO: 18025 - DNA, 20 bp, Artificial Sequence
  chemically synthesized
tttagctcccacacatgagt

SEQ ID NO: 18026 - DNA, 20 bp, Artificial Sequence
  chemically synthesized
cccatgttctcactcatgtg

SEQ ID NO: 18027 - DNA, 20 bp, Artificial Sequence
  chemically synthesized
ccatgttctcactcatgtgt

SEQ ID NO: 18028 - DNA, 20 bp, Artificial Sequence
  chemically synthesized
tttttttagctcccacacat

SEQ ID NO: 18029 - DNA, 20 bp, Artificial Sequence
  chemically synthesized
atgttctcactcatgtgtgg

SEQ ID NO: 18030 - DNA, 20 bp, Artificial Sequence
  chemically synthesized
tttttttttttttttttttt

SEQ ID NO: 18031 - DNA, 20 bp, Artificial Sequence
  chemically synthesized
aaaaaaaaaaattgaactca

SEQ ID NO: 18032 - DNA, 20 bp, Artificial Sequence
  chemically synthesized
aaaaaaaaattgaactcatg

SEQ ID NO: 18033 - DNA, 20 bp, Artificial Sequence
  chemically synthesized
aaaaattgaactcatggaga

SEQ ID NO: 18034 - DNA, 20 bp, Artificial Sequence
  chemically synthesized
tgattttactctatctccat

SEQ ID NO: 18035 - DNA, 20 bp, Artificial Sequence
  chemically synthesized
aaattgaactcatggagata

SEQ ID NO: 18036 - DNA, 20 bp, Artificial Sequence
  chemically synthesized
tagagtaaaatcatgactac

SEQ ID NO: 18037 - DNA, 20 bp, Artificial Sequence
  chemically synthesized
gagtaaaatcatgactacca

SEQ ID NO: 18038 - DNA, 20 bp, Artificial Sequence
  chemically synthesized
ctacatttcccagactctgg

SEQ ID NO: 18039 - DNA, 20 bp, Artificial Sequence
  chemically synthesized
aaatcatgactaccagagtc

SEQ ID NO: 18040 - DNA, 20 bp, Artificial Sequence
  chemically synthesized
aatcatgactaccagagtct

SEQ ID NO: 18041 - DNA, 20 bp, Artificial Sequence
  chemically synthesized
tcactacatttcccagactc

SEQ ID NO: 18042 - DNA, 20 bp, Artificial Sequence
  chemically synthesized
ctaccagagtctgggaaatg

SEQ ID NO: 18043 - DNA, 20 bp, Artificial Sequence
  chemically synthesized
ccgatcttcactacatttcc

SEQ ID NO: 18044 - DNA, 20 bp, Artificial Sequence
  chemically synthesized
agagtctgggaaatgtagtg

SEQ ID NO: 18045 - DNA, 20 bp, Artificial Sequence
  chemically synthesized
ctgggaaatgtagtgaagat

SEQ ID NO: 18046 - DNA, 20 bp, Artificial Sequence
  chemically synthesized
tgggaaatgtagtgaagatc

SEQ ID NO: 18047 - DNA, 20 bp, Artificial Sequence
  chemically synthesized
gggaaatgtagtgaagatcg

SEQ ID NO: 18048 - DNA, 20 bp, Artificial Sequence
  chemically synthesized
ggaaatgtagtgaagatcgg

SEQ ID NO: 18049 - DNA, 20 bp, Artificial Sequence
  chemically synthesized
gtgaagatcgggggataaaa

SEQ ID NO: 18050 - DNA, 20 bp, Artificial Sequence
  chemically synthesized
tgaagatcgggggataaaaa

SEQ ID NO: 18051 - DNA, 20 bp, Artificial Sequence
  chemically synthesized
gaagatcgggggataaaaaa

SEQ ID NO: 18052 - DNA, 20 bp, Artificial Sequence
  chemically synthesized
atcgggggataaaaaaggga

SEQ ID NO: 18053 - DNA, 20 bp, Artificial Sequence
  chemically synthesized
gataaaaaagggatggttaa

SEQ ID NO: 18054 - DNA, 20 bp, Artificial Sequence
  chemically synthesized
ataaaaaagggatggttaat

SEQ ID NO: 18055 - DNA, 20 bp, Artificial Sequence
  chemically synthesized
ggttaatgggtacaaaaata

SEQ ID NO: 18056 - DNA, 20 bp, Artificial Sequence
  chemically synthesized
aatgggtacaaaaatacagt

SEQ ID NO: 18057 - DNA, 20 bp, Artificial Sequence
  chemically synthesized
gggtacaaaaatacagtaag

SEQ ID NO: 18058 - DNA, 20 bp, Artificial Sequence
  chemically synthesized
cagtaagaagaaatatgatc

SEQ ID NO: 18059 - DNA, 20 bp, Artificial Sequence
  chemically synthesized
aagaaatatgatctagtgtt

SEQ ID NO: 18060 - DNA, 20 bp, Artificial Sequence
  chemically synthesized
cttattgtgctaccaaacac

SEQ ID NO: 18061 - DNA, 20 bp, Artificial Sequence
  chemically synthesized
aaatatgatctagtgtttgg

SEQ ID NO: 18062 - DNA, 20 bp, Artificial Sequence
  chemically synthesized
ctagtgtttggtagcacaat

SEQ ID NO: 18063 - DNA, 20 bp, Artificial Sequence
  chemically synthesized
tagtgtttggtagcacaata

SEQ ID NO: 18064 - DNA, 20 bp, Artificial Sequence
  chemically synthesized
gtagcacaataaggccacta

SEQ ID NO: 18065 - DNA, 20 bp, Artificial Sequence
  chemically synthesized
aaatatattgattactatag

SEQ ID NO: 18066 - DNA, 20 bp, Artificial Sequence
  chemically synthesized
taaaaatatattgattacta

SEQ ID NO: 18067 - DNA, 20 bp, Artificial Sequence
  chemically synthesized
tatatttttaaatcttttta

SEQ ID NO: 18068 - DNA, 20 bp, Artificial Sequence
  chemically synthesized
agtgagaccctatctgtaaa

SEQ ID NO: 18069 - DNA, 20 bp, Artificial Sequence
  chemically synthesized
tttttaaatctttttacaga

SEQ ID NO: 18070 - DNA, 20 bp, Artificial Sequence
  chemically synthesized
ttttaaatctttttacagat

SEQ ID NO: 18071 - DNA, 20 bp, Artificial Sequence
  chemically synthesized
tttaaatctttttacagata

SEQ ID NO: 18072 - DNA, 20 bp, Artificial Sequence
  chemically synthesized
tccaacatggacagcatagt

SEQ ID NO: 18073 - DNA, 20 bp, Artificial Sequence
  chemically synthesized
acactccaacatggacagca

SEQ ID NO: 18074 - DNA, 20 bp, Artificial Sequence
  chemically synthesized
tctcactatgctgtccatgt

SEQ ID NO: 18075 - DNA, 20 bp, Artificial Sequence
  chemically synthesized
tcactacactccaacatgga

SEQ ID NO: 18076 - DNA, 20 bp, Artificial Sequence
  chemically synthesized
tcactatgctgtccatgttg

SEQ ID NO: 18077 - DNA, 20 bp, Artificial Sequence
  chemically synthesized
atagtcactacactccaaca

SEQ ID NO: 18078 - DNA, 20 bp, Artificial Sequence
  chemically synthesized
atgctgtccatgttggagtg

SEQ ID NO: 18079 - DNA, 20 bp, Artificial Sequence
  chemically synthesized
tggagtgtagtgactattca

SEQ ID NO: 18080 - DNA, 20 bp, Artificial Sequence
  chemically synthesized
ggagtgtagtgactattcac

SEQ ID NO: 18081 - DNA, 20 bp, Artificial Sequence
  chemically synthesized
acaacaattgcacctgtgaa

SEQ ID NO: 18082 - DNA, 20 bp, Artificial Sequence
  chemically synthesized
ggtgcaattgttgtgcatta

SEQ ID NO: 18083 - DNA, 20 bp, Artificial Sequence
  chemically synthesized
cacttgcgcccaggaattca

SEQ ID NO: 18084 - DNA, 20 bp, Artificial Sequence
  chemically synthesized
gcattacagccttgaattcc

SEQ ID NO: 18085 - DNA, 20 bp, Artificial Sequence
  chemically synthesized
tcacttgcgcccaggaattc

SEQ ID NO: 18086 - DNA, 20 bp, Artificial Sequence
  chemically synthesized
cattacagccttgaattcct

SEQ ID NO: 18087 - DNA, 20 bp, Artificial Sequence
  chemically synthesized
agccttgaattcctgggcgc

SEQ ID NO: 18088 - DNA, 20 bp, Artificial Sequence
  chemically synthesized
tgggaggatcacttgcgccc

SEQ ID NO: 18089 - DNA, 20 bp, Artificial Sequence
  chemically synthesized
gtgggaggatcacttgcgcc

SEQ ID NO: 18090 - DNA, 20 bp, Artificial Sequence
  chemically synthesized
cgcaagtgatcctcccacct

SEQ ID NO: 18091 - DNA, 20 bp, Artificial Sequence
  chemically synthesized
tttcaggaggctgaggtggg

SEQ ID NO: 18092 - DNA, 20 bp, Artificial Sequence
  chemically synthesized
gtttcaggaggctgaggtgg

SEQ ID NO: 18093 - DNA, 20 bp, Artificial Sequence
  chemically synthesized
gcgtttcaggaggctgaggt

SEQ ID NO: 18094 - DNA, 20 bp, Artificial Sequence
  chemically synthesized
agcgtttcaggaggctgagg

SEQ ID NO: 18095 - DNA, 20 bp, Artificial Sequence
  chemically synthesized
accagcgtttcaggaggctg

SEQ ID NO: 18096 - DNA, 20 bp, Artificial Sequence
  chemically synthesized
gaccagcgtttcaggaggct

SEQ ID NO: 18097 - DNA, 20 bp, Artificial Sequence
  chemically synthesized
tgtaggaccagcgtttcagg

SEQ ID NO: 18098 - DNA, 20 bp, Artificial Sequence
  chemically synthesized
ctgtaggaccagcgtttcag

SEQ ID NO: 18099 - DNA, 20 bp, Artificial Sequence
  chemically synthesized
acctcagcctcctgaaacgc

SEQ ID NO: 18100 - DNA, 20 bp, Artificial Sequence
  chemically synthesized
acctgtaggaccagcgtttc

SEQ ID NO: 18101 - DNA, 20 bp, Artificial Sequence
  chemically synthesized
cacctgtaggaccagcgttt

SEQ ID NO: 18102 - DNA, 20 bp, Artificial Sequence
  chemically synthesized
ctcctgaaacgctggtccta

SEQ ID NO: 18103 - DNA, 20 bp, Artificial Sequence
  chemically synthesized
tcctgaaacgctggtcctac

SEQ ID NO: 18104 - DNA, 20 bp, Artificial Sequence
  chemically synthesized
gtagcacgcacctgtaggac

SEQ ID NO: 18105 - DNA, 20 bp, Artificial Sequence
  chemically synthesized
gcatggtagcacgcacctgt

SEQ ID NO: 18106 - DNA, 20 bp, Artificial Sequence
  chemically synthesized
tgcatggtagcacgcacctg

SEQ ID NO: 18107 - DNA, 20 bp, Artificial Sequence
  chemically synthesized
caggtgcgtgctaccatgca

SEQ ID NO: 18108 - DNA, 20 bp, Artificial Sequence
  chemically synthesized
attattgttgccatgcatgg

SEQ ID NO: 18109 - DNA, 20 bp, Artificial Sequence
  chemically synthesized
taaattattgttgccatgca

SEQ ID NO: 18110 - DNA, 20 bp, Artificial Sequence
  chemically synthesized
gtatatttcaaaataactaa

SEQ ID NO: 18111 - DNA, 20 bp, Artificial Sequence
  chemically synthesized
atatttcaaaataactaaaa

SEQ ID NO: 18112 - DNA, 20 bp, Artificial Sequence
  chemically synthesized
acattcccatttcactcttt

SEQ ID NO: 18113 - DNA, 20 bp, Artificial Sequence
  chemically synthesized
aaataactaaaagagtgaaa

SEQ ID NO: 18114 - DNA, 20 bp, Artificial Sequence
  chemically synthesized
aataactaaaagagtgaaat

SEQ ID NO: 18115 - DNA, 20 bp, Artificial Sequence
  chemically synthesized
tgaaatgggaatgttcctac

SEQ ID NO: 18116 - DNA, 20 bp, Artificial Sequence
  chemically synthesized
aaatgggaatgttcctacca

SEQ ID NO: 18117 - DNA, 20 bp, Artificial Sequence
  chemically synthesized
acattcatcatttctctggt

SEQ ID NO: 18118 - DNA, 20 bp, Artificial Sequence
  chemically synthesized
aacattcatcatttctctgg

SEQ ID NO: 18119 - DNA, 20 bp, Artificial Sequence
  chemically synthesized
tcaaacattcatcatttctc

SEQ ID NO: 18120 - DNA, 20 bp, Artificial Sequence
  chemically synthesized
cagagaaatgatgaatgttt

SEQ ID NO: 18121 - DNA, 20 bp, Artificial Sequence
  chemically synthesized
atgatgaatgtttgagatga

SEQ ID NO: 18122 - DNA, 20 bp, Artificial Sequence
  chemically synthesized
taacacaatcagagtaattg

SEQ ID NO: 18123 - DNA, 20 bp, Artificial Sequence
  chemically synthesized
gtaacacaatcagagtaatt

SEQ ID NO: 18124 - DNA, 20 bp, Artificial Sequence
  chemically synthesized
ggtaacacaatcagagtaat

SEQ ID NO: 18125 - DNA, 20 bp, Artificial Sequence
  chemically synthesized
tgtgtagggtaacacaatca

SEQ ID NO: 18126 - DNA, 20 bp, Artificial Sequence
  chemically synthesized
aatgtgtagggtaacacaat

SEQ ID NO: 18127 - DNA, 20 bp, Artificial Sequence
  chemically synthesized
atacaagcatacaatgtgta

SEQ ID NO: 18128 - DNA, 20 bp, Artificial Sequence
  chemically synthesized
gatacaagcatacaatgtgt

SEQ ID NO: 18129 - DNA, 20 bp, Artificial Sequence
  chemically synthesized
tgatacaagcatacaatgtg

SEQ ID NO: 18130 - DNA, 20 bp, Artificial Sequence
  chemically synthesized
tacatgtgatattttgatac

SEQ ID NO: 18131 - DNA, 20 bp, Artificial Sequence
  chemically synthesized
atcacatgtaacccataaat

SEQ ID NO: 18132 - DNA, 20 bp, Artificial Sequence
  chemically synthesized
acataatagtactcatttat

SEQ ID NO: 18133 - DNA, 20 bp, Artificial Sequence
  chemically synthesized
cacataatagtactcattta

SEQ ID NO: 18134 - DNA, 20 bp, Artificial Sequence
  chemically synthesized
taattattatggacacataa

SEQ ID NO: 18135 - DNA, 20 bp, Artificial Sequence
  chemically synthesized
taaaatatttttaattatta

SEQ ID NO: 18136 - DNA, 20 bp, Artificial Sequence
  chemically synthesized
cagtcatttaacaggtaaaa

SEQ ID NO: 18137 - DNA, 20 bp, Artificial Sequence
  chemically synthesized
tgcactgccagtcatttaac

SEQ ID NO: 18138 - DNA, 20 bp, Artificial Sequence
  chemically synthesized
ctgcactgccagtcatttaa

SEQ ID NO: 18139 - DNA, 20 bp, Artificial Sequence
  chemically synthesized
ttttttacctgttaaatgac

SEQ ID NO: 18140 - DNA, 20 bp, Artificial Sequence
  chemically synthesized
tttacctgttaaatgactgg

SEQ ID NO: 18141 - DNA, 20 bp, Artificial Sequence
  chemically synthesized
ctgttaaatgactggcagtg

SEQ ID NO: 18142 - DNA, 20 bp, Artificial Sequence
  chemically synthesized
tgttaaatgactggcagtgc

SEQ ID NO: 18143 - DNA, 20 bp, Artificial Sequence
  chemically synthesized
atttcacaaacctgcactgc

SEQ ID NO: 18144 - DNA, 20 bp, Artificial Sequence
  chemically synthesized
cattgtaacatcatagcacg

SEQ ID NO: 18145 - DNA, 20 bp, Artificial Sequence
  chemically synthesized
ctgtagccattgtaacatca

SEQ ID NO: 18146 - DNA, 20 bp, Artificial Sequence
  chemically synthesized
ttcgtgctatgatgttacaa

SEQ ID NO: 18147 - DNA, 20 bp, Artificial Sequence
  chemically synthesized
ctatgatgttacaatggcta

SEQ ID NO: 18148 - DNA, 20 bp, Artificial Sequence
  chemically synthesized
cgcattactttgtgacactg

SEQ ID NO: 18149 - DNA, 20 bp, Artificial Sequence
  chemically synthesized
acaatggctacagtgtcaca

SEQ ID NO: 18150 - DNA, 20 bp, Artificial Sequence
  chemically synthesized
acaaagtaatgcgaattttt

SEQ ID NO: 18151 - DNA, 20 bp, Artificial Sequence
  chemically synthesized
aacgtaagaagagattataa

SEQ ID NO: 18152 - DNA, 20 bp, Artificial Sequence
  chemically synthesized
ccataagatcaacgtaagaa

SEQ ID NO: 18153 - DNA, 20 bp, Artificial Sequence
  chemically synthesized
tcccataagatcaacgtaag

SEQ ID NO: 18154 - DNA, 20 bp, Artificial Sequence
  chemically synthesized
tggtcccataagatcaacgt

SEQ ID NO: 18155 - DNA, 20 bp, Artificial Sequence
  chemically synthesized
ctcttcttacgttgatctta

SEQ ID NO: 18156 - DNA, 20 bp, Artificial Sequence
  chemically synthesized
tcttcttacgttgatcttat

SEQ ID NO: 18157 - DNA, 20 bp, Artificial Sequence
  chemically synthesized
atatactatggtggtcccat

SEQ ID NO: 18158 - DNA, 20 bp, Artificial Sequence
  chemically synthesized
ttgatcttatgggaccacca

SEQ ID NO: 18159 - DNA, 20 bp, Artificial Sequence
  chemically synthesized
acaggccatatatactatgg

SEQ ID NO: 18160 - DNA, 20 bp, Artificial Sequence
  chemically synthesized
atgacaggccatatatacta

SEQ ID NO: 18161 - DNA, 20 bp, Artificial Sequence
  chemically synthesized
tgggaccaccatagtatata

SEQ ID NO: 18162 - DNA, 20 bp, Artificial Sequence
  chemically synthesized
atgacgttttggtcaatgac

SEQ ID NO: 18163 - DNA, 20 bp, Artificial Sequence
  chemically synthesized
aatgacgttttggtcaatga

SEQ ID NO: 18164 - DNA, 20 bp, Artificial Sequence
  chemically synthesized
tgtgctgaagaatgacgttt

SEQ ID NO: 18165 - DNA, 20 bp, Artificial Sequence
  chemically synthesized
ttgaccaaaacgtcattctt

SEQ ID NO: 18166 - DNA, 20 bp, Artificial Sequence
  chemically synthesized
aactatacagtcatgtgctg

SEQ ID NO: 18167 - DNA, 20 bp, Artificial Sequence
  chemically synthesized
ttcttcagcacatgactgta

SEQ ID NO: 18168 - DNA, 20 bp, Artificial Sequence
  chemically synthesized
ttttaggtgggaaaactata

SEQ ID NO: 18169 - DNA, 20 bp, Artificial Sequence
  chemically synthesized
tgtatagttttcccacctaa

SEQ ID NO: 18170 - DNA, 20 bp, Artificial Sequence
  chemically synthesized
accaagtatcacttttaggt

SEQ ID NO: 18171 - DNA, 20 bp, Artificial Sequence
  chemically synthesized
aaccaagtatcacttttagg

SEQ ID NO: 18172 - DNA, 20 bp, Artificial Sequence
  chemically synthesized
taaaaccaagtatcactttt

SEQ ID NO: 18173 - DNA, 20 bp, Artificial Sequence
  chemically synthesized
ataaaaccaagtatcacttt

SEQ ID NO: 18174 - DNA, 20 bp, Artificial Sequence
  chemically synthesized
tcccacctaaaagtgatact

SEQ ID NO: 18175 - DNA, 20 bp, Artificial Sequence
  chemically synthesized
gtctatcttcagataaaacc

SEQ ID NO: 18176 - DNA, 20 bp, Artificial Sequence
  chemically synthesized
gtgatacttggttttatctg

SEQ ID NO: 18177 - DNA, 20 bp, Artificial Sequence
  chemically synthesized
tacttggttttatctgaaga

SEQ ID NO: 18178 - DNA, 20 bp, Artificial Sequence
  chemically synthesized
atagctgtttagtctatctt

SEQ ID NO: 18179 - DNA, 20 bp, Artificial Sequence
  chemically synthesized
ttatctgaagatagactaaa

SEQ ID NO: 18180 - DNA, 20 bp, Artificial Sequence
  chemically synthesized
ctaatcccaacatagctgtt

SEQ ID NO: 18181 - DNA, 20 bp, Artificial Sequence
  chemically synthesized
gatagactaaacagctatgt

SEQ ID NO: 18182 - DNA, 20 bp, Artificial Sequence
  chemically synthesized
atagactaaacagctatgtt

SEQ ID NO: 18183 - DNA, 20 bp, Artificial Sequence
  chemically synthesized
aaaatactctaatcccaaca

SEQ ID NO: 18184 - DNA, 20 bp, Artificial Sequence
  chemically synthesized
ctaaacagctatgttgggat

SEQ ID NO: 18185 - DNA, 20 bp, Artificial Sequence
  chemically synthesized
aaacagctatgttgggatta

SEQ ID NO: 18186 - DNA, 20 bp, Artificial Sequence
  chemically synthesized
ggattagagtattttcaata

SEQ ID NO: 18187 - DNA, 20 bp, Artificial Sequence
  chemically synthesized
tagagtattttcaataaaga

SEQ ID NO: 18188 - DNA, 20 bp, Artificial Sequence
  chemically synthesized
agagtattttcaataaagat

SEQ ID NO: 18189 - DNA, 20 bp, Artificial Sequence
  chemically synthesized
gtgtgtgcatgtatgtgttt

SEQ ID NO: 18190 - DNA, 20 bp, Artificial Sequence
  chemically synthesized
tgtgtgcatgtatgtgtttt

SEQ ID NO: 18191 - DNA, 20 bp, Artificial Sequence
  chemically synthesized
gtgtgcatgtatgtgttttg

SEQ ID NO: 18192 - DNA, 20 bp, Artificial Sequence
  chemically synthesized
tgtgcatgtatgtgttttgg

SEQ ID NO: 18193 - DNA, 20 bp, Artificial Sequence
  chemically synthesized
tgcatgtatgtgttttgggg

SEQ ID NO: 18194 - DNA, 20 bp, Artificial Sequence
  chemically synthesized
gcatgtatgtgttttggggg

SEQ ID NO: 18195 - DNA, 20 bp, Artificial Sequence
  chemically synthesized
catgtatgtgttttggggga

SEQ ID NO: 18196 - DNA, 20 bp, Artificial Sequence
  chemically synthesized
atgtatgtgttttgggggag

SEQ ID NO: 18197 - DNA, 20 bp, Artificial Sequence
  chemically synthesized
tagattgtaatagaatgaga

SEQ ID NO: 18198 - DNA, 20 bp, Artificial Sequence
  chemically synthesized
attttagattgtaatagaat

SEQ ID NO: 18199 - DNA, 20 bp, Artificial Sequence
  chemically synthesized
atatgaattttagattgtaa

SEQ ID NO: 18200 - DNA, 20 bp, Artificial Sequence
  chemically synthesized
gtgatcccctatatgaattt

SEQ ID NO: 18201 - DNA, 20 bp, Artificial Sequence
  chemically synthesized
attacaatctaaaattcata

SEQ ID NO: 18202 - DNA, 20 bp, Artificial Sequence
  chemically synthesized
ttacaatctaaaattcatat

SEQ ID NO: 18203 - DNA, 20 bp, Artificial Sequence
  chemically synthesized
tacaatctaaaattcatata

SEQ ID NO: 18204 - DNA, 20 bp, Artificial Sequence
  chemically synthesized
acaatctaaaattcatatag

SEQ ID NO: 18205 - DNA, 20 bp, Artificial Sequence
  chemically synthesized
gagactagattgaaatgaca

SEQ ID NO: 18206 - DNA, 20 bp, Artificial Sequence
  chemically synthesized
cggagactagattgaaatga

SEQ ID NO: 18207 - DNA, 20 bp, Artificial Sequence
  chemically synthesized
aacactctgtcatttcaatc

SEQ ID NO: 18208 - DNA, 20 bp, Artificial Sequence
  chemically synthesized
gcttcaaccagttcggagac

SEQ ID NO: 18209 - DNA, 20 bp, Artificial Sequence
  chemically synthesized
tttcaatctagtctccgaac

SEQ ID NO: 18210 - DNA, 20 bp, Artificial Sequence
  chemically synthesized
ttatggcttcaaccagttcg

SEQ ID NO: 18211 - DNA, 20 bp, Artificial Sequence
  chemically synthesized
tgttatggcttcaaccagtt

SEQ ID NO: 18212 - DNA, 20 bp, Artificial Sequence
  chemically synthesized
tctagtctccgaactggttg

SEQ ID NO: 18213 - DNA, 20 bp, Artificial Sequence
  chemically synthesized
catcatgttatggcttcaac

SEQ ID NO: 18214 - DNA, 20 bp, Artificial Sequence
  chemically synthesized
gtgcaatttacatcatgtta

SEQ ID NO: 18215 - DNA, 20 bp, Artificial Sequence
  chemically synthesized
atgatgtaaattgcacgatg

SEQ ID NO: 18216 - DNA, 20 bp, Artificial Sequence
  chemically synthesized
gtaaattgcacgatgtagac

SEQ ID NO: 18217 - DNA, 20 bp, Artificial Sequence
  chemically synthesized
ccacagtggcacaatgaatc

SEQ ID NO: 18218 - DNA, 20 bp, Artificial Sequence
  chemically synthesized
ctagattcattgtgccactg

SEQ ID NO: 18219 - DNA, 20 bp, Artificial Sequence
  chemically synthesized
tagattcattgtgccactgt

SEQ ID NO: 18220 - DNA, 20 bp, Artificial Sequence
  chemically synthesized
atgagaaaacaggcccacag

SEQ ID NO: 18221 - DNA, 20 bp, Artificial Sequence
  chemically synthesized
cagatgagaaaacaggccca

SEQ ID NO: 18222 - DNA, 20 bp, Artificial Sequence
  chemically synthesized
cctttttcagatgagaaaac

SEQ ID NO: 18223 - DNA, 20 bp, Artificial Sequence
  chemically synthesized
tcctttttcagatgagaaaa

SEQ ID NO: 18224 - DNA, 20 bp, Artificial Sequence
  chemically synthesized
gcacctctcctttttcagat

SEQ ID NO: 18225 - DNA, 20 bp, Artificial Sequence
  chemically synthesized
gcctgttttctcatctgaaa

SEQ ID NO: 18226 - DNA, 20 bp, Artificial Sequence
  chemically synthesized
cctgttttctcatctgaaaa

SEQ ID NO: 18227 - DNA, 20 bp, Artificial Sequence
  chemically synthesized
tgttttctcatctgaaaaag

SEQ ID NO: 18228 - DNA, 20 bp, Artificial Sequence
  chemically synthesized
tttctgcacctctccttttt

SEQ ID NO: 18229 - DNA, 20 bp, Artificial Sequence
  chemically synthesized
ttttctcatctgaaaaagga

SEQ ID NO: 18230 - DNA, 20 bp, Artificial Sequence
  chemically synthesized
tttctcatctgaaaaaggag

SEQ ID NO: 18231 - DNA, 20 bp, Artificial Sequence
  chemically synthesized
catctgaaaaaggagaggtg

SEQ ID NO: 18232 - DNA, 20 bp, Artificial Sequence
  chemically synthesized
gagaggtgcagaaaatcctc

SEQ ID NO: 18233 - DNA, 20 bp, Artificial Sequence
  chemically synthesized
agaggtgcagaaaatcctca

SEQ ID NO: 18234 - DNA, 20 bp, Artificial Sequence
  chemically synthesized
gactgcctgaaggaaccttg

SEQ ID NO: 18235 - DNA, 20 bp, Artificial Sequence
  chemically synthesized
agactgcctgaaggaacctt

SEQ ID NO: 18236 - DNA, 20 bp, Artificial Sequence
  chemically synthesized
gaaaatcctcaaggttcctt

SEQ ID NO: 18237 - DNA, 20 bp, Artificial Sequence
  chemically synthesized
aaaatcctcaaggttccttc

SEQ ID NO: 18238 - DNA, 20 bp, Artificial Sequence
  chemically synthesized
atcctcaaggttccttcagg

SEQ ID NO: 18239 - DNA, 20 bp, Artificial Sequence
  chemically synthesized
gagtcacatagactgcctga

SEQ ID NO: 18240 - DNA, 20 bp, Artificial Sequence
  chemically synthesized
tgagtcacatagactgcctg

SEQ ID NO: 18241 - DNA, 20 bp, Artificial Sequence
  chemically synthesized
tgccctggcagtgagtcaca

SEQ ID NO: 18242 - DNA, 20 bp, Artificial Sequence
  chemically synthesized
cagtctatgtgactcactgc

SEQ ID NO: 18243 - DNA, 20 bp, Artificial Sequence
  chemically synthesized
agtctatgtgactcactgcc

SEQ ID NO: 18244 - DNA, 20 bp, Artificial Sequence
  chemically synthesized
gtctatgtgactcactgcca

SEQ ID NO: 18245 - DNA, 20 bp, Artificial Sequence
  chemically synthesized
gccaagcctgccctggcagt

SEQ ID NO: 18246 - DNA, 20 bp, Artificial Sequence
  chemically synthesized
tatgtgactcactgccaggg

SEQ ID NO: 18247 - DNA, 20 bp, Artificial Sequence
  chemically synthesized
atgtgactcactgccagggc

SEQ ID NO: 18248 - DNA, 20 bp, Artificial Sequence
  chemically synthesized
taaggccaagcctgccctgg

SEQ ID NO: 18249 - DNA, 20 bp, Artificial Sequence
  chemically synthesized
tagtaaggccaagcctgccc

SEQ ID NO: 18250 - DNA, 20 bp, Artificial Sequence
  chemically synthesized
actcactgccagggcaggct

SEQ ID NO: 18251 - DNA, 20 bp, Artificial Sequence
  chemically synthesized
tttacgaccttagtaaggcc

SEQ ID NO: 18252 - DNA, 20 bp, Artificial Sequence
  chemically synthesized
agggcaggcttggccttact

SEQ ID NO: 18253 - DNA, 20 bp, Artificial Sequence
  chemically synthesized
gggcaggcttggccttacta

SEQ ID NO: 18254 - DNA, 20 bp, Artificial Sequence
  chemically synthesized
tgatttttacgaccttagta

SEQ ID NO: 18255 - DNA, 20 bp, Artificial Sequence
  chemically synthesized
ttgatttttacgaccttagt

SEQ ID NO: 18256 - DNA, 20 bp, Artificial Sequence
  chemically synthesized
tagattgatttttacgacct

SEQ ID NO: 18257 - DNA, 20 bp, Artificial Sequence
  chemically synthesized
aaacagccctgttgagagat

SEQ ID NO: 18258 - DNA, 20 bp, Artificial Sequence
  chemically synthesized
aaatcaatctaatctctcaa

SEQ ID NO: 18259 - DNA, 20 bp, Artificial Sequence
  chemically synthesized
aatcaatctaatctctcaac

SEQ ID NO: 18260 - DNA, 20 bp, Artificial Sequence
  chemically synthesized
atcaatctaatctctcaaca

SEQ ID NO: 18261 - DNA, 20 bp, Artificial Sequence
  chemically synthesized
catggaaacagccctgttga

SEQ ID NO: 18262 - DNA, 20 bp, Artificial Sequence
  chemically synthesized
tccatggaaacagccctgtt

SEQ ID NO: 18263 - DNA, 20 bp, Artificial Sequence
  chemically synthesized
tctcaacagggctgtttcca

SEQ ID NO: 18264 - DNA, 20 bp, Artificial Sequence
  chemically synthesized
tttctcatattccatggaaa

SEQ ID NO: 18265 - DNA, 20 bp, Artificial Sequence
  chemically synthesized
tgttcctttctcatattcca

SEQ ID NO: 18266 - DNA, 20 bp, Artificial Sequence
  chemically synthesized
gggctgtttccatggaatat

SEQ ID NO: 18267 - DNA, 20 bp, Artificial Sequence
  chemically synthesized
tgtttccatggaatatgaga

SEQ ID NO: 18268 - DNA, 20 bp, Artificial Sequence
  chemically synthesized
gtttccatggaatatgagaa

SEQ ID NO: 18269 - DNA, 20 bp, Artificial Sequence
  chemically synthesized
atggaatatgagaaaggaac

SEQ ID NO: 18270 - DNA, 20 bp, Artificial Sequence
  chemically synthesized
aatatgagaaaggaacaagc

SEQ ID NO: 18271 - DNA, 20 bp, Artificial Sequence
  chemically synthesized
agctgtaattaatatattgc

SEQ ID NO: 18272 - DNA, 20 bp, Artificial Sequence
  chemically synthesized
agctggcaatatattaatta

SEQ ID NO: 18273 - DNA, 20 bp, Artificial Sequence
  chemically synthesized
tgcaacgagtttaagagata

SEQ ID NO: 18274 - DNA, 20 bp, Artificial Sequence
  chemically synthesized
aagttttgcaacgagtttaa

SEQ ID NO: 18275 - DNA, 20 bp, Artificial Sequence
  chemically synthesized
taaagttttgcaacgagttt

SEQ ID NO: 18276 - DNA, 20 bp, Artificial Sequence
  chemically synthesized
tagaagtaaagttttgcaac

SEQ ID NO: 18277 - DNA, 20 bp, Artificial Sequence
  chemically synthesized
ttttggtagtgatagaagta

SEQ ID NO: 18278 - DNA, 20 bp, Artificial Sequence
  chemically synthesized
actcattttggtagtgatag

SEQ ID NO: 18279 - DNA, 20 bp, Artificial Sequence
  chemically synthesized
ttgactcattttggtagtga

SEQ ID NO: 18280 - DNA, 20 bp, Artificial Sequence
  chemically synthesized
acttctatcactaccaaaat

SEQ ID NO: 18281 - DNA, 20 bp, Artificial Sequence
  chemically synthesized
gggaaattgactcattttgg

SEQ ID NO: 18282 - DNA, 20 bp, Artificial Sequence
  chemically synthesized
actgggaaattgactcattt

SEQ ID NO: 18283 - DNA, 20 bp, Artificial Sequence
  chemically synthesized
accaaaatgagtcaatttcc

SEQ ID NO: 18284 - DNA, 20 bp, Artificial Sequence
  chemically synthesized
ttgcagtcaacacatttact

SEQ ID NO: 18285 - DNA, 20 bp, Artificial Sequence
  chemically synthesized
attgcagtcaacacatttac

SEQ ID NO: 18286 - DNA, 20 bp, Artificial Sequence
  chemically synthesized
tccacattaatagcatattg

SEQ ID NO: 18287 - DNA, 20 bp, Artificial Sequence
  chemically synthesized
actgcaatatgctattaatg

SEQ ID NO: 18288 - DNA, 20 bp, Artificial Sequence
  chemically synthesized
aggatatgtttccacattaa

SEQ ID NO: 18289 - DNA, 20 bp, Artificial Sequence
  chemically synthesized
tagatactaaatgaggcaac

SEQ ID NO: 18290 - DNA, 20 bp, Artificial Sequence
  chemically synthesized
gtagatactaaatgaggcaa

SEQ ID NO: 18291 - DNA, 20 bp, Artificial Sequence
  chemically synthesized
acatatcctgttgcctcatt

SEQ ID NO: 18292 - DNA, 20 bp, Artificial Sequence
  chemically synthesized
atcttcgtagatactaaatg

SEQ ID NO: 18293 - DNA, 20 bp, Artificial Sequence
  chemically synthesized
tatcttcgtagatactaaat

SEQ ID NO: 18294 - DNA, 20 bp, Artificial Sequence
  chemically synthesized
tgcctcatttagtatctacg

SEQ ID NO: 18295 - DNA, 20 bp, Artificial Sequence
  chemically synthesized
ctttgacagtggtatcttcg

SEQ ID NO: 18296 - DNA, 20 bp, Artificial Sequence
  chemically synthesized
ctacgaagataccactgtca

SEQ ID NO: 18297 - DNA, 20 bp, Artificial Sequence
  chemically synthesized
taaatttatggctttgacag

SEQ ID NO: 18298 - DNA, 20 bp, Artificial Sequence
  chemically synthesized
ctgtaaatttatggctttga

SEQ ID NO: 18299 - DNA, 20 bp, Artificial Sequence
  chemically synthesized
gaatagtcactgtaaattta

SEQ ID NO: 18300 - DNA, 20 bp, Artificial Sequence
  chemically synthesized
ctgtcaaagccataaattta

SEQ ID NO: 18301 - DNA, 20 bp, Artificial Sequence
  chemically synthesized
ccatggatatgaaaaaggaa

SEQ ID NO: 18302 - DNA, 20 bp, Artificial Sequence
  chemically synthesized
cacatccatggatatgaaaa

SEQ ID NO: 18303 - DNA, 20 bp, Artificial Sequence
  chemically synthesized
tcacatccatggatatgaaa

SEQ ID NO: 18304 - DNA, 20 bp, Artificial Sequence
  chemically synthesized
ctattcctttttcatatcca

SEQ ID NO: 18305 - DNA, 20 bp, Artificial Sequence
  chemically synthesized
aggaaatgaagtcacatcca

SEQ ID NO: 18306 - DNA, 20 bp, Artificial Sequence
  chemically synthesized
atggatgtgacttcatttcc

SEQ ID NO: 18307 - DNA, 20 bp, Artificial Sequence
  chemically synthesized
atccattaagccaggaaatg

SEQ ID NO: 18308 - DNA, 20 bp, Artificial Sequence
  chemically synthesized
gacttcatttcctggcttaa

SEQ ID NO: 18309 - DNA, 20 bp, Artificial Sequence
  chemically synthesized
aaggaattatccattaagcc

SEQ ID NO: 18310 - DNA, 20 bp, Artificial Sequence
  chemically synthesized
caaggaattatccattaagc

SEQ ID NO: 18311 - DNA, 20 bp, Artificial Sequence
  chemically synthesized
cttccaaggaattatccatt

SEQ ID NO: 18312 - DNA, 20 bp, Artificial Sequence
  chemically synthesized
tggcttaatggataattcct

SEQ ID NO: 18313 - DNA, 20 bp, Artificial Sequence
  chemically synthesized
cttaatggataattccttgg

SEQ ID NO: 18314 - DNA, 20 bp, Artificial Sequence
  chemically synthesized
aaatcactataggtcttcca

SEQ ID NO: 18315 - DNA, 20 bp, Artificial Sequence
  chemically synthesized
aaaatcactataggtcttcc

SEQ ID NO: 18316 - DNA, 20 bp, Artificial Sequence
  chemically synthesized
ataattccttggaagaccta

SEQ ID NO: 18317 - DNA, 20 bp, Artificial Sequence
  chemically synthesized
gcttatttaaaaatcactat

SEQ ID NO: 18318 - DNA, 20 bp, Artificial Sequence
  chemically synthesized
tgcttatttaaaaatcacta

SEQ ID NO: 18319 - DNA, 20 bp, Artificial Sequence
  chemically synthesized
acctatagtgatttttaaat

SEQ ID NO: 18320 - DNA, 20 bp, Artificial Sequence
  chemically synthesized
aataagcaaaattttacatt

SEQ ID NO: 18321 - DNA, 20 bp, Artificial Sequence
  chemically synthesized
aattttacatttagacctga

SEQ ID NO: 18322 - DNA, 20 bp, Artificial Sequence
  chemically synthesized
attttacatttagacctgat

SEQ ID NO: 18323 - DNA, 20 bp, Artificial Sequence
  chemically synthesized
agaaaaggaaatcacctatc

SEQ ID NO: 18324 - DNA, 20 bp, Artificial Sequence
  chemically synthesized
tagaaaaggaaatcacctat

SEQ ID NO: 18325 - DNA, 20 bp, Artificial Sequence
  chemically synthesized
gataggtgatttccttttct

SEQ ID NO: 18326 - DNA, 20 bp, Artificial Sequence
  chemically synthesized
ccccactaaccacttagaaa

SEQ ID NO: 18327 - DNA, 20 bp, Artificial Sequence
  chemically synthesized
aggtgatttccttttctaag

SEQ ID NO: 18328 - DNA, 20 bp, Artificial Sequence
  chemically synthesized
tccccactaaccacttagaa

SEQ ID NO: 18329 - DNA, 20 bp, Artificial Sequence
  chemically synthesized
gatttccttttctaagtggt

SEQ ID NO: 18330 - DNA, 20 bp, Artificial Sequence
  chemically synthesized
atccctccccactaaccact

SEQ ID NO: 18331 - DNA, 20 bp, Artificial Sequence
  chemically synthesized
ttccttttctaagtggttag

SEQ ID NO: 18332 - DNA, 20 bp, Artificial Sequence
  chemically synthesized
tccttttctaagtggttagt

SEQ ID NO: 18333 - DNA, 20 bp, Artificial Sequence
  chemically synthesized
ccttttctaagtggttagtg

SEQ ID NO: 18334 - DNA, 20 bp, Artificial Sequence
  chemically synthesized
ttttctaagtggttagtggg

SEQ ID NO: 18335 - DNA, 20 bp, Artificial Sequence
  chemically synthesized
tttctaagtggttagtgggg

SEQ ID NO: 18336 - DNA, 20 bp, Artificial Sequence
  chemically synthesized
ttctaagtggttagtgggga

SEQ ID NO: 18337 - DNA, 20 bp, Artificial Sequence
  chemically synthesized
tggttagtggggagggatat

SEQ ID NO: 18338 - DNA, 20 bp, Artificial Sequence
  chemically synthesized
ggatatgagaaaacctttaa

SEQ ID NO: 18339 - DNA, 20 bp, Artificial Sequence
  chemically synthesized
ctctctggattatctattaa

SEQ ID NO: 18340 - DNA, 20 bp, Artificial Sequence
  chemically synthesized
actctctggattatctatta

SEQ ID NO: 18341 - DNA, 20 bp, Artificial Sequence
  chemically synthesized
aaaacctttaatagataatc

SEQ ID NO: 18342 - DNA, 20 bp, Artificial Sequence
  chemically synthesized
aacctttaatagataatcca

SEQ ID NO: 18343 - DNA, 20 bp, Artificial Sequence
  chemically synthesized
cctttaatagataatccaga

SEQ ID NO: 18344 - DNA, 20 bp, Artificial Sequence
  chemically synthesized
aatagataatccagagagtg

SEQ ID NO: 18345 - DNA, 20 bp, Artificial Sequence
  chemically synthesized
tgtttgtgtgccacactctc

SEQ ID NO: 18346 - DNA, 20 bp, Artificial Sequence
  chemically synthesized
cccagtagtggcaagaagag

SEQ ID NO: 18347 - DNA, 20 bp, Artificial Sequence
  chemically synthesized
gcccagtagtggcaagaaga

SEQ ID NO: 18348 - DNA, 20 bp, Artificial Sequence
  chemically synthesized
gggcccagtagtggcaagaa

SEQ ID NO: 18349 - DNA, 20 bp, Artificial Sequence
  chemically synthesized
aagggcccagtagtggcaag

SEQ ID NO: 18350 - DNA, 20 bp, Artificial Sequence
  chemically synthesized
gacaagggcccagtagtggc

SEQ ID NO: 18351 - DNA, 20 bp, Artificial Sequence
  chemically synthesized
acctctcttcttgccactac

SEQ ID NO: 18352 - DNA, 20 bp, Artificial Sequence
  chemically synthesized
cctctcttcttgccactact

SEQ ID NO: 18353 - DNA, 20 bp, Artificial Sequence
  chemically synthesized
ttcagacaagggcccagtag

SEQ ID NO: 18354 - DNA, 20 bp, Artificial Sequence
  chemically synthesized
tgattcagacaagggcccag

SEQ ID NO: 18355 - DNA, 20 bp, Artificial Sequence
  chemically synthesized
ttctgattcagacaagggcc

SEQ ID NO: 18356 - DNA, 20 bp, Artificial Sequence
  chemically synthesized
gaatcttctgattcagacaa

SEQ ID NO: 18357 - DNA, 20 bp, Artificial Sequence
  chemically synthesized
tgaatcttctgattcagaca

SEQ ID NO: 18358 - DNA, 20 bp, Artificial Sequence
  chemically synthesized
ctgaatcttctgattcagac

SEQ ID NO: 18359 - DNA, 20 bp, Artificial Sequence
  chemically synthesized
tactgggcccttgtctgaat

SEQ ID NO: 18360 - DNA, 20 bp, Artificial Sequence
  chemically synthesized
tgggcccttgtctgaatcag

SEQ ID NO: 18361 - DNA, 20 bp, Artificial Sequence
  chemically synthesized
aggtactgaatcttctgatt

SEQ ID NO: 18362 - DNA, 20 bp, Artificial Sequence
  chemically synthesized
cttgtctgaatcagaagatt

SEQ ID NO: 18363 - DNA, 20 bp, Artificial Sequence
  chemically synthesized
tcaggttggtacagttagaa

SEQ ID NO: 18364 - DNA, 20 bp, Artificial Sequence
  chemically synthesized
ttcaggttggtacagttaga

SEQ ID NO: 18365 - DNA, 20 bp, Artificial Sequence
  chemically synthesized
ttgtttcaggttggtacagt

SEQ ID NO: 18366 - DNA, 20 bp, Artificial Sequence
  chemically synthesized
tactttgtttcaggttggta

SEQ ID NO: 18367 - DNA, 20 bp, Artificial Sequence
  chemically synthesized
aaccttactttgtttcaggt

SEQ ID NO: 18368 - DNA, 20 bp, Artificial Sequence
  chemically synthesized
aactgtaccaacctgaaaca

SEQ ID NO: 18369 - DNA, 20 bp, Artificial Sequence
  chemically synthesized
tggaaaccttactttgtttc

SEQ ID NO: 18370 - DNA, 20 bp, Artificial Sequence
  chemically synthesized
ctggaaaccttactttgttt

SEQ ID NO: 18371 - DNA, 20 bp, Artificial Sequence
  chemically synthesized
gtaccaacctgaaacaaagt

SEQ ID NO: 18372 - DNA, 20 bp, Artificial Sequence
  chemically synthesized
taccaacctgaaacaaagta

SEQ ID NO: 18373 - DNA, 20 bp, Artificial Sequence
  chemically synthesized
ctgaaacaaagtaaggtttc

SEQ ID NO: 18374 - DNA, 20 bp, Artificial Sequence
  chemically synthesized
tgaaacaaagtaaggtttcc

SEQ ID NO: 18375 - DNA, 20 bp, Artificial Sequence
  chemically synthesized
aacaaagtaaggtttccagg

SEQ ID NO: 18376 - DNA, 20 bp, Artificial Sequence
  chemically synthesized
tttgatttcttgtcaccacc

SEQ ID NO: 18377 - DNA, 20 bp, Artificial Sequence
  chemically synthesized
taaggtttccaggtggtgac

SEQ ID NO: 18378 - DNA, 20 bp, Artificial Sequence
  chemically synthesized
caggtggtgacaagaaatca

SEQ ID NO: 18379 - DNA, 20 bp, Artificial Sequence
  chemically synthesized
aggtggtgacaagaaatcaa

SEQ ID NO: 18380 - DNA, 20 bp, Artificial Sequence
  chemically synthesized
ggaaatcaaatctgcaatgc

SEQ ID NO: 18381 - DNA, 20 bp, Artificial Sequence
  chemically synthesized
gaaatcaaatctgcaatgca

SEQ ID NO: 18382 - DNA, 20 bp, Artificial Sequence
  chemically synthesized
caagtgcattccttgcattg

SEQ ID NO: 18383 - DNA, 20 bp, Artificial Sequence
  chemically synthesized
caatgcaaggaatgcacttg

SEQ ID NO: 18384 - DNA, 20 bp, Artificial Sequence
  chemically synthesized
aatgcaaggaatgcacttgt

SEQ ID NO: 18385 - DNA, 20 bp, Artificial Sequence
  chemically synthesized
aaagtacttgtttatcctac

SEQ ID NO: 18386 - DNA, 20 bp, Artificial Sequence
  chemically synthesized
aatgcacttgtaggataaac

SEQ ID NO: 18387 - DNA, 20 bp, Artificial Sequence
  chemically synthesized
gcctgaggtaaacggtaata

SEQ ID NO: 18388 - DNA, 20 bp, Artificial Sequence
  chemically synthesized
tactttattaccgtttacct

SEQ ID NO: 18389 - DNA, 20 bp, Artificial Sequence
  chemically synthesized
ttctaccagcctgaggtaaa

SEQ ID NO: 18390 - DNA, 20 bp, Artificial Sequence
  chemically synthesized
actttattaccgtttacctc

SEQ ID NO: 18391 - DNA, 20 bp, Artificial Sequence
  chemically synthesized
tattaccgtttacctcaggc

SEQ ID NO: 18392 - DNA, 20 bp, Artificial Sequence
  chemically synthesized
ctgctatttctaccagcctg

SEQ ID NO: 18393 - DNA, 20 bp, Artificial Sequence
  chemically synthesized
taccgtttacctcaggctgg

SEQ ID NO: 18394 - DNA, 20 bp, Artificial Sequence
  chemically synthesized
gctgctatttctaccagcct

SEQ ID NO: 18395 - DNA, 20 bp, Artificial Sequence
  chemically synthesized
ttacctcaggctggtagaaa

SEQ ID NO: 18396 - DNA, 20 bp, Artificial Sequence
  chemically synthesized
tcaaaggctgctatttctac

SEQ ID NO: 18397 - DNA, 20 bp, Artificial Sequence
  chemically synthesized
cctcaggctggtagaaatag

SEQ ID NO: 18398 - DNA, 20 bp, Artificial Sequence
  chemically synthesized
tggtagaaatagcagccttt

SEQ ID NO: 18399 - DNA, 20 bp, Artificial Sequence
  chemically synthesized
ttcagcaagcttgtgctcaa

SEQ ID NO: 18400 - DNA, 20 bp, Artificial Sequence
  chemically synthesized
aaatagcagcctttgagcac

SEQ ID NO: 18401 - DNA, 20 bp, Artificial Sequence
  chemically synthesized
cttcagcaagcttgtgctca

SEQ ID NO: 18402 - DNA, 20 bp, Artificial Sequence
  chemically synthesized
ctttgagcacaagcttgctg

SEQ ID NO: 18403 - DNA, 20 bp, Artificial Sequence
  chemically synthesized
tttgagcacaagcttgctga

SEQ ID NO: 18404 - DNA, 20 bp, Artificial Sequence
  chemically synthesized
gctgggctggttccttcagc

SEQ ID NO: 18405 - DNA, 20 bp, Artificial Sequence
  chemically synthesized
cacaagcttgctgaaggaac

SEQ ID NO: 18406 - DNA, 20 bp, Artificial Sequence
  chemically synthesized
tgaggctgggctggttcctt

SEQ ID NO: 18407 - DNA, 20 bp, Artificial Sequence
  chemically synthesized
gcttgctgaaggaaccagcc

SEQ ID NO: 18408 - DNA, 20 bp, Artificial Sequence
  chemically synthesized
ccttcagaatgaggctgggc

SEQ ID NO: 18409 - DNA, 20 bp, Artificial Sequence
  chemically synthesized
aggaccttcagaatgaggct

SEQ ID NO: 18410 - DNA, 20 bp, Artificial Sequence
  chemically synthesized
taggaccttcagaatgaggc

SEQ ID NO: 18411 - DNA, 20 bp, Artificial Sequence
  chemically synthesized
accagcccagcctcattctg

SEQ ID NO: 18412 - DNA, 20 bp, Artificial Sequence
  chemically synthesized
agtataggaccttcagaatg

SEQ ID NO: 18413 - DNA, 20 bp, Artificial Sequence
  chemically synthesized
ccagcccagcctcattctga

SEQ ID NO: 18414 - DNA, 20 bp, Artificial Sequence
  chemically synthesized
aagtataggaccttcagaat

SEQ ID NO: 18415 - DNA, 20 bp, Artificial Sequence
  chemically synthesized
tgtttgaagtataggacctt

SEQ ID NO: 18416 - DNA, 20 bp, Artificial Sequence
  chemically synthesized
ctgccctttgtttgaagtat

SEQ ID NO: 18417 - DNA, 20 bp, Artificial Sequence
  chemically synthesized
tctgccctttgtttgaagta

SEQ ID NO: 18418 - DNA, 20 bp, Artificial Sequence
  chemically synthesized
aaggtcctatacttcaaaca

SEQ ID NO: 18419 - DNA, 20 bp, Artificial Sequence
  chemically synthesized
aggtcctatacttcaaacaa

SEQ ID NO: 18420 - DNA, 20 bp, Artificial Sequence
  chemically synthesized
tgtcctctgccctttgtttg

SEQ ID NO: 18421 - DNA, 20 bp, Artificial Sequence
  chemically synthesized
ggtcctatacttcaaacaaa

SEQ ID NO: 18422 - DNA, 20 bp, Artificial Sequence
  chemically synthesized
cctatacttcaaacaaaggg

SEQ ID NO: 18423 - DNA, 20 bp, Artificial Sequence
  chemically synthesized
tatacttcaaacaaagggca

SEQ ID NO: 18424 - DNA, 20 bp, Artificial Sequence
  chemically synthesized
atacttcaaacaaagggcag

SEQ ID NO: 18425 - DNA, 20 bp, Artificial Sequence
  chemically synthesized
gctgtagggaaagataacag

SEQ ID NO: 18426 - DNA, 20 bp, Artificial Sequence
  chemically synthesized
ttgctgtagggaaagataac

SEQ ID NO: 18427 - DNA, 20 bp, Artificial Sequence
  chemically synthesized
tttgctgtagggaaagataa

SEQ ID NO: 18428 - DNA, 20 bp, Artificial Sequence
  chemically synthesized
actcctgttatctttcccta

SEQ ID NO: 18429 - DNA, 20 bp, Artificial Sequence
  chemically synthesized
tacaatgtttgctgtaggga

SEQ ID NO: 18430 - DNA, 20 bp, Artificial Sequence
  chemically synthesized
aaaatacaatgtttgctgta

SEQ ID NO: 18431 - DNA, 20 bp, Artificial Sequence
  chemically synthesized
aaaaatacaatgtttgctgt

SEQ ID NO: 18432 - DNA, 20 bp, Artificial Sequence
  chemically synthesized
taaaaatacaatgtttgctg

SEQ ID NO: 18433 - DNA, 20 bp, Artificial Sequence
  chemically synthesized
acattgtatttttatgcacg

SEQ ID NO: 18434 - DNA, 20 bp, Artificial Sequence
  chemically synthesized
ttatgcacgtggcacaatga

SEQ ID NO: 18435 - DNA, 20 bp, Artificial Sequence
  chemically synthesized
tatgcacgtggcacaatgaa

SEQ ID NO: 18436 - DNA, 20 bp, Artificial Sequence
  chemically synthesized
cacgtggcacaatgaaaggc

SEQ ID NO: 18437 - DNA, 20 bp, Artificial Sequence
  chemically synthesized
acgtggcacaatgaaaggca

SEQ ID NO: 18438 - DNA, 20 bp, Artificial Sequence
  chemically synthesized
atgaaaggcaaggtgaccgc

SEQ ID NO: 18439 - DNA, 20 bp, Artificial Sequence
  chemically synthesized
tcctcggccaggtgcactgg

SEQ ID NO: 18440 - DNA, 20 bp, Artificial Sequence
  chemically synthesized
aaggtgaccgccagtgcacc

SEQ ID NO: 18441 - DNA, 20 bp, Artificial Sequence
  chemically synthesized
ttttcctcggccaggtgcac

SEQ ID NO: 18442 - DNA, 20 bp, Artificial Sequence
  chemically synthesized
gaccgccagtgcacctggcc

SEQ ID NO: 18443 - DNA, 20 bp, Artificial Sequence
  chemically synthesized
accgccagtgcacctggccg

SEQ ID NO: 18444 - DNA, 20 bp, Artificial Sequence
  chemically synthesized
tggcatgcttttcctcggcc

SEQ ID NO: 18445 - DNA, 20 bp, Artificial Sequence
  chemically synthesized
ctggcatgcttttcctcggc

SEQ ID NO: 18446 - DNA, 20 bp, Artificial Sequence
  chemically synthesized
cagtgcacctggccgaggaa

SEQ ID NO: 18447 - DNA, 20 bp, Artificial Sequence
  chemically synthesized
ggccctggcatgcttttcct

SEQ ID NO: 18448 - DNA, 20 bp, Artificial Sequence
  chemically synthesized
ctggccgaggaaaagcatgc

SEQ ID NO: 18449 - DNA, 20 bp, Artificial Sequence
  chemically synthesized
tggccgaggaaaagcatgcc

SEQ ID NO: 18450 - DNA, 20 bp, Artificial Sequence
  chemically synthesized
ggccgaggaaaagcatgcca

SEQ ID NO: 18451 - DNA, 20 bp, Artificial Sequence
  chemically synthesized
gaggaaaagcatgccagggc

SEQ ID NO: 18452 - DNA, 20 bp, Artificial Sequence
  chemically synthesized
aggaaaagcatgccagggcc

SEQ ID NO: 18453 - DNA, 20 bp, Artificial Sequence
  chemically synthesized
aggaatccacgtcctggccc

SEQ ID NO: 18454 - DNA, 20 bp, Artificial Sequence
  chemically synthesized
agcatgccagggccaggacg

SEQ ID NO: 18455 - DNA, 20 bp, Artificial Sequence
  chemically synthesized
atacttaggaatccacgtcc

SEQ ID NO: 18456 - DNA, 20 bp, Artificial Sequence
  chemically synthesized
gggccaggacgtggattcct

SEQ ID NO: 18457 - DNA, 20 bp, Artificial Sequence
  chemically synthesized
gtaaatacttaggaatactt

SEQ ID NO: 18458 - DNA, 20 bp, Artificial Sequence
  chemically synthesized
tgtaaatacttaggaatact

SEQ ID NO: 18459 - DNA, 20 bp, Artificial Sequence
  chemically synthesized
gtggattcctaagtattcct

SEQ ID NO: 18460 - DNA, 20 bp, Artificial Sequence
  chemically synthesized
tggatccattgtaaatactt

SEQ ID NO: 18461 - DNA, 20 bp, Artificial Sequence
  chemically synthesized
atggatccattgtaaatact

SEQ ID NO: 18462 - DNA, 20 bp, Artificial Sequence
  chemically synthesized
gtattcctaagtatttacaa

SEQ ID NO: 18463 - DNA, 20 bp, Artificial Sequence
  chemically synthesized
caatttgcaatcaggttgaa

SEQ ID NO: 18464 - DNA, 20 bp, Artificial Sequence
  chemically synthesized
cgttttagcaatttgcaatc

SEQ ID NO: 18465 - DNA, 20 bp, Artificial Sequence
  chemically synthesized
gcgttttagcaatttgcaat

SEQ ID NO: 18466 - DNA, 20 bp, Artificial Sequence
  chemically synthesized
ttgcaaattgctaaaacgct

SEQ ID NO: 18467 - DNA, 20 bp, Artificial Sequence
  chemically synthesized
tggggagcctctcagcgttt

SEQ ID NO: 18468 - DNA, 20 bp, Artificial Sequence
  chemically synthesized
gcaaattgctaaaacgctga

SEQ ID NO: 18469 - DNA, 20 bp, Artificial Sequence
  chemically synthesized
caaattgctaaaacgctgag

SEQ ID NO: 18470 - DNA, 20 bp, Artificial Sequence
  chemically synthesized
cttagatttggggagcctct

SEQ ID NO: 18471 - DNA, 20 bp, Artificial Sequence
  chemically synthesized
tttcattacttagatttggg

SEQ ID NO: 18472 - DNA, 20 bp, Artificial Sequence
  chemically synthesized
ctgagaggctccccaaatct

SEQ ID NO: 18473 - DNA, 20 bp, Artificial Sequence
  chemically synthesized
gctttcattacttagatttg

SEQ ID NO: 18474 - DNA, 20 bp, Artificial Sequence
  chemically synthesized
ggctttcattacttagattt

SEQ ID NO: 18475 - DNA, 20 bp, Artificial Sequence
  chemically synthesized
aggctttcattacttagatt

SEQ ID NO: 18476 - DNA, 20 bp, Artificial Sequence
  chemically synthesized
atggcgaggctttcattact

SEQ ID NO: 18477 - DNA, 20 bp, Artificial Sequence
  chemically synthesized
tccccaaatctaagtaatga

SEQ ID NO: 18478 - DNA, 20 bp, Artificial Sequence
  chemically synthesized
taaattccatatgtatggcg

SEQ ID NO: 18479 - DNA, 20 bp, Artificial Sequence
  chemically synthesized
gtaaattccatatgtatggc

SEQ ID NO: 18480 - DNA, 20 bp, Artificial Sequence
  chemically synthesized
tgaaagcctcgccatacata

SEQ ID NO: 18481 - DNA, 20 bp, Artificial Sequence
  chemically synthesized
gctagtaaattccatatgta

SEQ ID NO: 18482 - DNA, 20 bp, Artificial Sequence
  chemically synthesized
gccatacatatggaatttac

SEQ ID NO: 18483 - DNA, 20 bp, Artificial Sequence
  chemically synthesized
tagtatttctaatcagatgc

SEQ ID NO: 18484 - DNA, 20 bp, Artificial Sequence
  chemically synthesized
ggaatttactagcatctgat

SEQ ID NO: 18485 - DNA, 20 bp, Artificial Sequence
  chemically synthesized
gcaaatgtagtatttctaat

SEQ ID NO: 18486 - DNA, 20 bp, Artificial Sequence
  chemically synthesized
attagaaatactacatttgc

SEQ ID NO: 18487 - DNA, 20 bp, Artificial Sequence
  chemically synthesized
gtttgaagtgctggcaaatg

SEQ ID NO: 18488 - DNA, 20 bp, Artificial Sequence
  chemically synthesized
gaggaattagtttgaagtgc

SEQ ID NO: 18489 - DNA, 20 bp, Artificial Sequence
  chemically synthesized
ggggaagaggaattagtttg

SEQ ID NO: 18490 - DNA, 20 bp, Artificial Sequence
  chemically synthesized
ccttgagggggaagaggaat

SEQ ID NO: 18491 - DNA, 20 bp, Artificial Sequence
  chemically synthesized
ggggacccttgagggggaag

SEQ ID NO: 18492 - DNA, 20 bp, Artificial Sequence
  chemically synthesized
aggggacccttgagggggaa

SEQ ID NO: 18493 - DNA, 20 bp, Artificial Sequence
  chemically synthesized
actaattcctcttccccctc

SEQ ID NO: 18494 - DNA, 20 bp, Artificial Sequence
  chemically synthesized
acaggggacccttgaggggg

SEQ ID NO: 18495 - DNA, 20 bp, Artificial Sequence
  chemically synthesized
ctaattcctcttccccctca

SEQ ID NO: 18496 - DNA, 20 bp, Artificial Sequence
  chemically synthesized
taattcctcttccccctcaa

SEQ ID NO: 18497 - DNA, 20 bp, Artificial Sequence
  chemically synthesized
aagacaggggacccttgagg

SEQ ID NO: 18498 - DNA, 20 bp, Artificial Sequence
  chemically synthesized
caagacaggggacccttgag

SEQ ID NO: 18499 - DNA, 20 bp, Artificial Sequence
  chemically synthesized
acaagacaggggacccttga

SEQ ID NO: 18500 - DNA, 20 bp, Artificial Sequence
  chemically synthesized
aacaagacaggggacccttg

SEQ ID NO: 18501 - DNA, 20 bp, Artificial Sequence
  chemically synthesized
taacaagacaggggaccctt

SEQ ID NO: 18502 - DNA, 20 bp, Artificial Sequence
  chemically synthesized
gaaaaggtataacaagacag

SEQ ID NO: 18503 - DNA, 20 bp, Artificial Sequence
  chemically synthesized
agaaaaggtataacaagaca

SEQ ID NO: 18504 - DNA, 20 bp, Artificial Sequence
  chemically synthesized
aagaaaaggtataacaagac

SEQ ID NO: 18505 - DNA, 20 bp, Artificial Sequence
  chemically synthesized
taagaaaaggtataacaaga

SEQ ID NO: 18506 - DNA, 20 bp, Artificial Sequence
  chemically synthesized
agaataagaaaaggtataac

SEQ ID NO: 18507 - DNA, 20 bp, Artificial Sequence
  chemically synthesized
gtcctggatagaataagaaa

SEQ ID NO: 18508 - DNA, 20 bp, Artificial Sequence
  chemically synthesized
agtcctggatagaataagaa

SEQ ID NO: 18509 - DNA, 20 bp, Artificial Sequence
  chemically synthesized
tcctgagtcctggatagaat

SEQ ID NO: 18510 - DNA, 20 bp, Artificial Sequence
  chemically synthesized
ataccttttcttattctatc

SEQ ID NO: 18511 - DNA, 20 bp, Artificial Sequence
  chemically synthesized
taccttttcttattctatcc

SEQ ID NO: 18512 - DNA, 20 bp, Artificial Sequence
  chemically synthesized
tacttttcctgagtcctgga

SEQ ID NO: 18513 - DNA, 20 bp, Artificial Sequence
  chemically synthesized
ttcttattctatccaggact

SEQ ID NO: 18514 - DNA, 20 bp, Artificial Sequence
  chemically synthesized
tcttattctatccaggactc

SEQ ID NO: 18515 - DNA, 20 bp, Artificial Sequence
  chemically synthesized
cagctacttttcctgagtcc

SEQ ID NO: 18516 - DNA, 20 bp, Artificial Sequence
  chemically synthesized
ttctatccaggactcaggaa

SEQ ID NO: 18517 - DNA, 20 bp, Artificial Sequence
  chemically synthesized
aaacaacagctacttttcct

SEQ ID NO: 18518 - DNA, 20 bp, Artificial Sequence
  chemically synthesized
tatccaggactcaggaaaag

SEQ ID NO: 18519 - DNA, 20 bp, Artificial Sequence
  chemically synthesized
caggaaaagtagctgttgtt

SEQ ID NO: 18520 - DNA, 20 bp, Artificial Sequence
  chemically synthesized
agcttcccaaggccaaacaa

SEQ ID NO: 18521 - DNA, 20 bp, Artificial Sequence
  chemically synthesized
aagtagctgttgtttggcct

SEQ ID NO: 18522 - DNA, 20 bp, Artificial Sequence
  chemically synthesized
agtagctgttgtttggcctt

SEQ ID NO: 18523 - DNA, 20 bp, Artificial Sequence
  chemically synthesized
agctgttgtttggccttggg

SEQ ID NO: 18524 - DNA, 20 bp, Artificial Sequence
  chemically synthesized
ttctgctctccagcttccca

SEQ ID NO: 18525 - DNA, 20 bp, Artificial Sequence
  chemically synthesized
gttgtttggccttgggaagc

SEQ ID NO: 18526 - DNA, 20 bp, Artificial Sequence
  chemically synthesized
cttctgctctccagcttccc

SEQ ID NO: 18527 - DNA, 20 bp, Artificial Sequence
  chemically synthesized
tgtttggccttgggaagctg

SEQ ID NO: 18528 - DNA, 20 bp, Artificial Sequence
  chemically synthesized
tttggccttgggaagctgga

SEQ ID NO: 18529 - DNA, 20 bp, Artificial Sequence
  chemically synthesized
ggccttgggaagctggagag

SEQ ID NO: 18530 - DNA, 20 bp, Artificial Sequence
  chemically synthesized
tttctgatacttctgctctc

SEQ ID NO: 18531 - DNA, 20 bp, Artificial Sequence
  chemically synthesized
cttgggaagctggagagcag

SEQ ID NO: 18532 - DNA, 20 bp, Artificial Sequence
  chemically synthesized
aagctggagagcagaagtat

SEQ ID NO: 18533 - DNA, 20 bp, Artificial Sequence
  chemically synthesized
agtatcagaaactacatatt

SEQ ID NO: 18534 - DNA, 20 bp, Artificial Sequence
  chemically synthesized
gtatcagaaactacatattt

SEQ ID NO: 18535 - DNA, 20 bp, Artificial Sequence
  chemically synthesized
ctacctcattcccaaatatg

SEQ ID NO: 18536 - DNA, 20 bp, Artificial Sequence
  chemically synthesized
gaaactacatatttgggaat

SEQ ID NO: 18537 - DNA, 20 bp, Artificial Sequence
  chemically synthesized
aaactacatatttgggaatg

SEQ ID NO: 18538 - DNA, 20 bp, Artificial Sequence
  chemically synthesized
ctacatatttgggaatgagg

SEQ ID NO: 18539 - DNA, 20 bp, Artificial Sequence
  chemically synthesized
tgggaatgaggtagtaaatg

SEQ ID NO: 18540 - DNA, 20 bp, Artificial Sequence
  chemically synthesized
gaatgaggtagtaaatgtgg

SEQ ID NO: 18541 - DNA, 20 bp, Artificial Sequence
  chemically synthesized
tgaggtagtaaatgtggcgg

SEQ ID NO: 18542 - DNA, 20 bp, Artificial Sequence
  chemically synthesized
gaggtagtaaatgtggcggt

SEQ ID NO: 18543 - DNA, 20 bp, Artificial Sequence
  chemically synthesized
aaatgtggcggtgggcatac

SEQ ID NO: 18544 - DNA, 20 bp, Artificial Sequence
  chemically synthesized
tggcggtgggcatactggac

SEQ ID NO: 18545 - DNA, 20 bp, Artificial Sequence
  chemically synthesized
ggcggtgggcatactggact

SEQ ID NO: 18546 - DNA, 20 bp, Artificial Sequence
  chemically synthesized
gaagggtttgattcctagtc

SEQ ID NO: 18547 - DNA, 20 bp, Artificial Sequence
  chemically synthesized
tggtggaagggtttgattcc

SEQ ID NO: 18548 - DNA, 20 bp, Artificial Sequence
  chemically synthesized
taggaatcaaacccttccac

SEQ ID NO: 18549 - DNA, 20 bp, Artificial Sequence
  chemically synthesized
aagtccctcagctggtggaa

SEQ ID NO: 18550 - DNA, 20 bp, Artificial Sequence
  chemically synthesized
aaagtccctcagctggtgga

SEQ ID NO: 18551 - DNA, 20 bp, Artificial Sequence
  chemically synthesized
taaagtccctcagctggtgg

SEQ ID NO: 18552 - DNA, 20 bp, Artificial Sequence
  chemically synthesized
atcaaacccttccaccagct

SEQ ID NO: 18553 - DNA, 20 bp, Artificial Sequence
  chemically synthesized
tcaaacccttccaccagctg

SEQ ID NO: 18554 - DNA, 20 bp, Artificial Sequence
  chemically synthesized
ccttaaagtccctcagctgg

SEQ ID NO: 18555 - DNA, 20 bp, Artificial Sequence
  chemically synthesized
caaacccttccaccagctga

SEQ ID NO: 18556 - DNA, 20 bp, Artificial Sequence
  chemically synthesized
cgcccttaaagtccctcagc

SEQ ID NO: 18557 - DNA, 20 bp, Artificial Sequence
  chemically synthesized
tttgcgcccttaaagtccct

SEQ ID NO: 18558 - DNA, 20 bp, Artificial Sequence
  chemically synthesized
tccaccagctgagggacttt

SEQ ID NO: 18559 - DNA, 20 bp, Artificial Sequence
  chemically synthesized
ccaccagctgagggacttta

SEQ ID NO: 18560 - DNA, 20 bp, Artificial Sequence
  chemically synthesized
caccagctgagggactttaa

SEQ ID NO: 18561 - DNA, 20 bp, Artificial Sequence
  chemically synthesized
ataatttatttgcgccctta

SEQ ID NO: 18562 - DNA, 20 bp, Artificial Sequence
  chemically synthesized
tgcttttattattgtttaag

SEQ ID NO: 18563 - DNA, 20 bp, Artificial Sequence
  chemically synthesized
ttttgcttttattattgttt

SEQ ID NO: 18564 - DNA, 20 bp, Artificial Sequence
  chemically synthesized
atccacttaaacaataataa

SEQ ID NO: 18565 - DNA, 20 bp, Artificial Sequence
  chemically synthesized
taataaaagcaaaatctcca

SEQ ID NO: 18566 - DNA, 20 bp, Artificial Sequence
  chemically synthesized
aacagaatagtcaggctttg

SEQ ID NO: 18567 - DNA, 20 bp, Artificial Sequence
  chemically synthesized
ggaacagaatagtcaggctt

SEQ ID NO: 18568 - DNA, 20 bp, Artificial Sequence
  chemically synthesized
ttgaggggaacagaatagtc

SEQ ID NO: 18569 - DNA, 20 bp, Artificial Sequence
  chemically synthesized
tttgaggggaacagaatagt

SEQ ID NO: 18570 - DNA, 20 bp, Artificial Sequence
  chemically synthesized
agtctttgaggggaacagaa

SEQ ID NO: 18571 - DNA, 20 bp, Artificial Sequence
  chemically synthesized
caccaagtctttgaggggaa

SEQ ID NO: 18572 - DNA, 20 bp, Artificial Sequence
  chemically synthesized
tgactattctgttcccctca

SEQ ID NO: 18573 - DNA, 20 bp, Artificial Sequence
  chemically synthesized
atcctcaccaagtctttgag

SEQ ID NO: 18574 - DNA, 20 bp, Artificial Sequence
  chemically synthesized
aatcctcaccaagtctttga

SEQ ID NO: 18575 - DNA, 20 bp, Artificial Sequence
  chemically synthesized
taatcctcaccaagtctttg

SEQ ID NO: 18576 - DNA, 20 bp, Artificial Sequence
  chemically synthesized
ttctgttcccctcaaagact

SEQ ID NO: 18577 - DNA, 20 bp, Artificial Sequence
  chemically synthesized
ttaatcctcaccaagtcttt

SEQ ID NO: 18578 - DNA, 20 bp, Artificial Sequence
  chemically synthesized
gttcccctcaaagacttggt

SEQ ID NO: 18579 - DNA, 20 bp, Artificial Sequence
  chemically synthesized
ttcccctcaaagacttggtg

SEQ ID NO: 18580 - DNA, 20 bp, Artificial Sequence
  chemically synthesized
tctctcatttaatcctcacc

SEQ ID NO: 18581 - DNA, 20 bp, Artificial Sequence
  chemically synthesized
agacttggtgaggattaaat

SEQ ID NO: 18582 - DNA, 20 bp, Artificial Sequence
  chemically synthesized
acttggtgaggattaaatga

SEQ ID NO: 18583 - DNA, 20 bp, Artificial Sequence
  chemically synthesized
tgagagaattcatgtgaaca

SEQ ID NO: 18584 - DNA, 20 bp, Artificial Sequence
  chemically synthesized
tcatgtgaacaaagttttgt

SEQ ID NO: 18585 - DNA, 20 bp, Artificial Sequence
  chemically synthesized
tgtgaacaaagttttgttag

SEQ ID NO: 18586 - DNA, 20 bp, Artificial Sequence
  chemically synthesized
caaagttttgttagtagcaa

SEQ ID NO: 18587 - DNA, 20 bp, Artificial Sequence
  chemically synthesized
atggtaacaatattatttat

SEQ ID NO: 18588 - DNA, 20 bp, Artificial Sequence
  chemically synthesized
aatattatttataagcataa

SEQ ID NO: 18589 - DNA, 20 bp, Artificial Sequence
  chemically synthesized
atattatttataagcataat

SEQ ID NO: 18590 - DNA, 20 bp, Artificial Sequence
  chemically synthesized
ataagcataataggtacaaa

SEQ ID NO: 18591 - DNA, 20 bp, Artificial Sequence
  chemically synthesized
gcataataggtacaaatggt

SEQ ID NO: 18592 - DNA, 20 bp, Artificial Sequence
  chemically synthesized
cataataggtacaaatggta

SEQ ID NO: 18593 - DNA, 20 bp, Artificial Sequence
  chemically synthesized
taataggtacaaatggtaag

SEQ ID NO: 18594 - DNA, 20 bp, Artificial Sequence
  chemically synthesized
taggtacaaatggtaaggag

SEQ ID NO: 18595 - DNA, 20 bp, Artificial Sequence
  chemically synthesized
ttgctttcactatcatgaaa

SEQ ID NO: 18596 - DNA, 20 bp, Artificial Sequence
  chemically synthesized
aaggagaagctgtttcatga

SEQ ID NO: 18597 - DNA, 20 bp, Artificial Sequence
  chemically synthesized
aagctgtttcatgatagtga

SEQ ID NO: 18598 - DNA, 20 bp, Artificial Sequence
  chemically synthesized
atgatagtgaaagcaaacta

SEQ ID NO: 18599 - DNA, 20 bp, Artificial Sequence
  chemically synthesized
tgatagtgaaagcaaactat

SEQ ID NO: 18600 - DNA, 20 bp, Artificial Sequence
  chemically synthesized
tagtgaaagcaaactatggg

SEQ ID NO: 18601 - DNA, 20 bp, Artificial Sequence
  chemically synthesized
tctggtttcataaccaccca

SEQ ID NO: 18602 - DNA, 20 bp, Artificial Sequence
  chemically synthesized
actatgggtggttatgaaac

SEQ ID NO: 18603 - DNA, 20 bp, Artificial Sequence
  chemically synthesized
tatgggtggttatgaaacca

SEQ ID NO: 18604 - DNA, 20 bp, Artificial Sequence
  chemically synthesized
gggtggttatgaaaccagag

SEQ ID NO: 18605 - DNA, 20 bp, Artificial Sequence
  chemically synthesized
ggtggttatgaaaccagagt

SEQ ID NO: 18606 - DNA, 20 bp, Artificial Sequence
  chemically synthesized
ctctcagacctttcctactc

SEQ ID NO: 18607 - DNA, 20 bp, Artificial Sequence
  chemically synthesized
gttatgaaaccagagtagga

SEQ ID NO: 18608 - DNA, 20 bp, Artificial Sequence
  chemically synthesized
ttatgaaaccagagtaggaa

SEQ ID NO: 18609 - DNA, 20 bp, Artificial Sequence
  chemically synthesized
aaccagagtaggaaaggtct

SEQ ID NO: 18610 - DNA, 20 bp, Artificial Sequence
  chemically synthesized
ccagagtaggaaaggtctga

SEQ ID NO: 18611 - DNA, 20 bp, Artificial Sequence
  chemically synthesized
taattcctctatttaactct

SEQ ID NO: 18612 - DNA, 20 bp, Artificial Sequence
  chemically synthesized
ggaaaggtctgagagttaaa

SEQ ID NO: 18613 - DNA, 20 bp, Artificial Sequence
  chemically synthesized
aaaggtctgagagttaaata

SEQ ID NO: 18614 - DNA, 20 bp, Artificial Sequence
  chemically synthesized
aaggtctgagagttaaatag

SEQ ID NO: 18615 - DNA, 20 bp, Artificial Sequence
  chemically synthesized
tgagagttaaatagaggaat

SEQ ID NO: 18616 - DNA, 20 bp, Artificial Sequence
  chemically synthesized
gagagttaaatagaggaatt

SEQ ID NO: 18617 - DNA, 20 bp, Artificial Sequence
  chemically synthesized
aggaattaggatttgttcac

SEQ ID NO: 18618 - DNA, 20 bp, Artificial Sequence
  chemically synthesized
aggatttgttcactagacaa

SEQ ID NO: 18619 - DNA, 20 bp, Artificial Sequence
  chemically synthesized
gtcagtatctttctgttgtc

SEQ ID NO: 18620 - DNA, 20 bp, Artificial Sequence
  chemically synthesized
tttgttcactagacaacaga

SEQ ID NO: 18621 - DNA, 20 bp, Artificial Sequence
  chemically synthesized
gatgccgtccttgaaaatgt

SEQ ID NO: 18622 - DNA, 20 bp, Artificial Sequence
  chemically synthesized
agaaagatactgacattttc

SEQ ID NO: 18623 - DNA, 20 bp, Artificial Sequence
  chemically synthesized
gaaagatactgacattttca

SEQ ID NO: 18624 - DNA, 20 bp, Artificial Sequence
  chemically synthesized
gatactgacattttcaagga

SEQ ID NO: 18625 - DNA, 20 bp, Artificial Sequence
  chemically synthesized
ttttcaaggacggcatcata

SEQ ID NO: 18626 - DNA, 20 bp, Artificial Sequence
  chemically synthesized
tttcaaggacggcatcatat

SEQ ID NO: 18627 - DNA, 20 bp, Artificial Sequence
  chemically synthesized
ctcatactagttttagagaa

SEQ ID NO: 18628 - DNA, 20 bp, Artificial Sequence
  chemically synthesized
gaaatgcttttctctaaaac

SEQ ID NO: 18629 - DNA, 20 bp, Artificial Sequence
  chemically synthesized
ttgccctcatactagtttta

SEQ ID NO: 18630 - DNA, 20 bp, Artificial Sequence
  chemically synthesized
tattgccctcatactagttt

SEQ ID NO: 18631 - DNA, 20 bp, Artificial Sequence
  chemically synthesized
cttttctctaaaactagtat

SEQ ID NO: 18632 - DNA, 20 bp, Artificial Sequence
  chemically synthesized
ttttctctaaaactagtatg

SEQ ID NO: 18633 - DNA, 20 bp, Artificial Sequence
  chemically synthesized
tttctctaaaactagtatga

SEQ ID NO: 18634 - DNA, 20 bp, Artificial Sequence
  chemically synthesized
tggtcttattgccctcatac

SEQ ID NO: 18635 - DNA, 20 bp, Artificial Sequence
  chemically synthesized
aaaactagtatgagggcaat

SEQ ID NO: 18636 - DNA, 20 bp, Artificial Sequence
  chemically synthesized
agggcaataagaccaatgaa

SEQ ID NO: 18637 - DNA, 20 bp, Artificial Sequence
  chemically synthesized
gggcaataagaccaatgaaa

SEQ ID NO: 18638 - DNA, 20 bp, Artificial Sequence
  chemically synthesized
cacactccagtccttttcat

SEQ ID NO: 18639 - DNA, 20 bp, Artificial Sequence
  chemically synthesized
ataagaccaatgaaaaggac

SEQ ID NO: 18640 - DNA, 20 bp, Artificial Sequence
  chemically synthesized
aagaccaatgaaaaggactg

SEQ ID NO: 18641 - DNA, 20 bp, Artificial Sequence
  chemically synthesized
atgaaaaggactggagtgtg

SEQ ID NO: 18642 - DNA, 20 bp, Artificial Sequence
  chemically synthesized
caagcctccacttcacactc

SEQ ID NO: 18643 - DNA, 20 bp, Artificial Sequence
  chemically synthesized
aaaaggactggagtgtgaag

SEQ ID NO: 18644 - DNA, 20 bp, Artificial Sequence
  chemically synthesized
aaggactggagtgtgaagtg

SEQ ID NO: 18645 - DNA, 20 bp, Artificial Sequence
  chemically synthesized
aggactggagtgtgaagtgg

SEQ ID NO: 18646 - DNA, 20 bp, Artificial Sequence
  chemically synthesized
agtgtgaagtggaggcttgc

SEQ ID NO: 18647 - DNA, 20 bp, Artificial Sequence
  chemically synthesized
gtgtgaagtggaggcttgct

SEQ ID NO: 18648 - DNA, 20 bp, Artificial Sequence
  chemically synthesized
tgaagtggaggcttgctagg

SEQ ID NO: 18649 - DNA, 20 bp, Artificial Sequence
  chemically synthesized
cattgcactggcttcctagc

SEQ ID NO: 18650 - DNA, 20 bp, Artificial Sequence
  chemically synthesized
gtggaggcttgctaggaagc

SEQ ID NO: 18651 - DNA, 20 bp, Artificial Sequence
  chemically synthesized
tcatcattgcactggcttcc

SEQ ID NO: 18652 - DNA, 20 bp, Artificial Sequence
  chemically synthesized
aggccttctcatcattgcac

SEQ ID NO: 18653 - DNA, 20 bp, Artificial Sequence
  chemically synthesized
taggaagccagtgcaatgat

SEQ ID NO: 18654 - DNA, 20 bp, Artificial Sequence
  chemically synthesized
gaagccagtgcaatgatgag

SEQ ID NO: 18655 - DNA, 20 bp, Artificial Sequence
  chemically synthesized
aagccagtgcaatgatgaga

SEQ ID NO: 18656 - DNA, 20 bp, Artificial Sequence
  chemically synthesized
agtgcaatgatgagaaggcc

SEQ ID NO: 18657 - DNA, 20 bp, Artificial Sequence
  chemically synthesized
gccattcttacattgtttcc

SEQ ID NO: 18658 - DNA, 20 bp, Artificial Sequence
  chemically synthesized
tgccattcttacattgtttc

SEQ ID NO: 18659 - DNA, 20 bp, Artificial Sequence
  chemically synthesized
agaaggcctggaaacaatgt

SEQ ID NO: 18660 - DNA, 20 bp, Artificial Sequence
  chemically synthesized
gcctggaaacaatgtaagaa

SEQ ID NO: 18661 - DNA, 20 bp, Artificial Sequence
  chemically synthesized
aaacaatgtaagaatggcaa

SEQ ID NO: 18662 - DNA, 20 bp, Artificial Sequence
  chemically synthesized
aatgtaagaatggcaatgga

SEQ ID NO: 18663 - DNA, 20 bp, Artificial Sequence
  chemically synthesized
gctgcctctttttttaggga

SEQ ID NO: 18664 - DNA, 20 bp, Artificial Sequence
  chemically synthesized
catgtttctttccctaaaaa

SEQ ID NO: 18665 - DNA, 20 bp, Artificial Sequence
  chemically synthesized
aagtgctgcctcttttttta

SEQ ID NO: 18666 - DNA, 20 bp, Artificial Sequence
  chemically synthesized
tgtttctttccctaaaaaaa

SEQ ID NO: 18667 - DNA, 20 bp, Artificial Sequence
  chemically synthesized
aaagtgctgcctcttttttt

SEQ ID NO: 18668 - DNA, 20 bp, Artificial Sequence
  chemically synthesized
gtttctttccctaaaaaaag

SEQ ID NO: 18669 - DNA, 20 bp, Artificial Sequence
  chemically synthesized
taaagtgctgcctctttttt

SEQ ID NO: 18670 - DNA, 20 bp, Artificial Sequence
  chemically synthesized
tctttccctaaaaaaagagg

SEQ ID NO: 18671 - DNA, 20 bp, Artificial Sequence
  chemically synthesized
aattagaaaaaaaattagta

SEQ ID NO: 18672 - DNA, 20 bp, Artificial Sequence
  chemically synthesized
tttataattagaaaaaaaat

SEQ ID NO: 18673 - DNA, 20 bp, Artificial Sequence
  chemically synthesized
cttctttgaacatttataat

SEQ ID NO: 18674 - DNA, 20 bp, Artificial Sequence
  chemically synthesized
tttctaattataaatgttca

SEQ ID NO: 18675 - DNA, 20 bp, Artificial Sequence
  chemically synthesized
ctaattataaatgttcaaag

SEQ ID NO: 18676 - DNA, 20 bp, Artificial Sequence
  chemically synthesized
aatgttcaaagaagaaaact

SEQ ID NO: 18677 - DNA, 20 bp, Artificial Sequence
  chemically synthesized
ctgtactatttttattttct

SEQ ID NO: 18678 - DNA, 20 bp, Artificial Sequence
  chemically synthesized
gaaaactcagaaaataaaaa

SEQ ID NO: 18679 - DNA, 20 bp, Artificial Sequence
  chemically synthesized
ctcagaaaataaaaatagta

SEQ ID NO: 18680 - DNA, 20 bp, Artificial Sequence
  chemically synthesized
cagaaaataaaaatagtaca

SEQ ID NO: 18681 - DNA, 20 bp, Artificial Sequence
  chemically synthesized
aatagtacagagaaaatcaa

SEQ ID NO: 18682 - DNA, 20 bp, Artificial Sequence
  chemically synthesized
atatgaatggtggtaacagg

SEQ ID NO: 18683 - DNA, 20 bp, Artificial Sequence
  chemically synthesized
aagatatgaatggtggtaac

SEQ ID NO: 18684 - DNA, 20 bp, Artificial Sequence
  chemically synthesized
caagatatgaatggtggtaa

SEQ ID NO: 18685 - DNA, 20 bp, Artificial Sequence
  chemically synthesized
atcagtcaagatatgaatgg

SEQ ID NO: 18686 - DNA, 20 bp, Artificial Sequence
  chemically synthesized
gaaatcagtcaagatatgaa

SEQ ID NO: 18687 - DNA, 20 bp, Artificial Sequence
  chemically synthesized
agactggggggaaatcagtc

SEQ ID NO: 18688 - DNA, 20 bp, Artificial Sequence
  chemically synthesized
ctatgagactggggggaaat

SEQ ID NO: 18689 - DNA, 20 bp, Artificial Sequence
  chemically synthesized
tatcttgactgatttccccc

SEQ ID NO: 18690 - DNA, 20 bp, Artificial Sequence
  chemically synthesized
atgttttctatgagactggg

SEQ ID NO: 18691 - DNA, 20 bp, Artificial Sequence
  chemically synthesized
aatgttttctatgagactgg

SEQ ID NO: 18692 - DNA, 20 bp, Artificial Sequence
  chemically synthesized
aaatgttttctatgagactg

SEQ ID NO: 18693 - DNA, 20 bp, Artificial Sequence
  chemically synthesized
ctgatttccccccagtctca

SEQ ID NO: 18694 - DNA, 20 bp, Artificial Sequence
  chemically synthesized
gaaatgttttctatgagact

SEQ ID NO: 18695 - DNA, 20 bp, Artificial Sequence
  chemically synthesized
tgaaatgttttctatgagac

SEQ ID NO: 18696 - DNA, 20 bp, Artificial Sequence
  chemically synthesized
agccttgaaatgttttctat

SEQ ID NO: 18697 - DNA, 20 bp, Artificial Sequence
  chemically synthesized
agtctcatagaaaacatttc

SEQ ID NO: 18698 - DNA, 20 bp, Artificial Sequence
  chemically synthesized
gtctcatagaaaacatttca

SEQ ID NO: 18699 - DNA, 20 bp, Artificial Sequence
  chemically synthesized
catagaaaacatttcaaggc

SEQ ID NO: 18700 - DNA, 20 bp, Artificial Sequence
  chemically synthesized
catttcaaggctggatgccg

SEQ ID NO: 18701 - DNA, 20 bp, Artificial Sequence
  chemically synthesized
caggcgtgagccacggcatc

SEQ ID NO: 18702 - DNA, 20 bp, Artificial Sequence
  chemically synthesized
gggagtacaggcgtgagcca

SEQ ID NO: 18703 - DNA, 20 bp, Artificial Sequence
  chemically synthesized
aatgttgggagtacaggcgt

SEQ ID NO: 18704 - DNA, 20 bp, Artificial Sequence
  chemically synthesized
tcccaaaatgttgggagtac

SEQ ID NO: 18705 - DNA, 20 bp, Artificial Sequence
  chemically synthesized
ctcccaaaatgttgggagta

SEQ ID NO: 18706 - DNA, 20 bp, Artificial Sequence
  chemically synthesized
tcagcctcccaaaatgttgg

SEQ ID NO: 18707 - DNA, 20 bp, Artificial Sequence
  chemically synthesized
cgcctgtactcccaacattt

SEQ ID NO: 18708 - DNA, 20 bp, Artificial Sequence
  chemically synthesized
cctcagcctcccaaaatgtt

SEQ ID NO: 18709 - DNA, 20 bp, Artificial Sequence
  chemically synthesized
gcctgtactcccaacatttt

SEQ ID NO: 18710 - DNA, 20 bp, Artificial Sequence
  chemically synthesized
acctcagcctcccaaaatgt

SEQ ID NO: 18711 - DNA, 20 bp, Artificial Sequence
  chemically synthesized
ctgtactcccaacattttgg

SEQ ID NO: 18712 - DNA, 20 bp, Artificial Sequence
  chemically synthesized
tgtactcccaacattttggg

SEQ ID NO: 18713 - DNA, 20 bp, Artificial Sequence
  chemically synthesized
tcccaacattttgggaggct

SEQ ID NO: 18714 - DNA, 20 bp, Artificial Sequence
  chemically synthesized
cccaacattttgggaggctg

SEQ ID NO: 18715 - DNA, 20 bp, Artificial Sequence
  chemically synthesized
aacattttgggaggctgagg

SEQ ID NO: 18716 - DNA, 20 bp, Artificial Sequence
  chemically synthesized
acattttgggaggctgaggt

SEQ ID NO: 18717 - DNA, 20 bp, Artificial Sequence
  chemically synthesized
ttttgggaggctgaggtggg

SEQ ID NO: 18718 - DNA, 20 bp, Artificial Sequence
  chemically synthesized
ctcaagctgtccacccacct

SEQ ID NO: 18719 - DNA, 20 bp, Artificial Sequence
  chemically synthesized
gggaggctgaggtgggtgga

SEQ ID NO: 18720 - DNA, 20 bp, Artificial Sequence
  chemically synthesized
ctgaggtgggtggacagctt

SEQ ID NO: 18721 - DNA, 20 bp, Artificial Sequence
  chemically synthesized
tgggtggacagcttgagccc

SEQ ID NO: 18722 - DNA, 20 bp, Artificial Sequence
  chemically synthesized
ggtctcgagctcttgggctc

SEQ ID NO: 18723 - DNA, 20 bp, Artificial Sequence
  chemically synthesized
ggtggacagcttgagcccaa

SEQ ID NO: 18724 - DNA, 20 bp, Artificial Sequence
  chemically synthesized
taggctggtctcgagctctt

SEQ ID NO: 18725 - DNA, 20 bp, Artificial Sequence
  chemically synthesized
cagcttgagcccaagagctc

SEQ ID NO: 18726 - DNA, 20 bp, Artificial Sequence
  chemically synthesized
ctaggctggtctcgagctct

SEQ ID NO: 18727 - DNA, 20 bp, Artificial Sequence
  chemically synthesized
tgagcccaagagctcgagac

SEQ ID NO: 18728 - DNA, 20 bp, Artificial Sequence
  chemically synthesized
atgttgcctaggctggtctc

SEQ ID NO: 18729 - DNA, 20 bp, Artificial Sequence
  chemically synthesized
ccaagagctcgagaccagcc

SEQ ID NO: 18730 - DNA, 20 bp, Artificial Sequence
  chemically synthesized
caagagctcgagaccagcct

SEQ ID NO: 18731 - DNA, 20 bp, Artificial Sequence
  chemically synthesized
tctcgccatgttgcctaggc

SEQ ID NO: 18732 - DNA, 20 bp, Artificial Sequence
  chemically synthesized
ggtctctcgccatgttgcct

SEQ ID NO: 18733 - DNA, 20 bp, Artificial Sequence
  chemically synthesized
cgagaccagcctaggcaaca

SEQ ID NO: 18734 - DNA, 20 bp, Artificial Sequence
  chemically synthesized
gggtctctcgccatgttgcc

SEQ ID NO: 18735 - DNA, 20 bp, Artificial Sequence
  chemically synthesized
accagcctaggcaacatggc

SEQ ID NO: 18736 - DNA, 20 bp, Artificial Sequence
  chemically synthesized
cagcctaggcaacatggcga

SEQ ID NO: 18737 - DNA, 20 bp, Artificial Sequence
  chemically synthesized
tgtgtgtgtgtgtgtgtaca

SEQ ID NO: 18738 - DNA, 20 bp, Artificial Sequence
  chemically synthesized
gtgtgtgtgtgtgtgtgtac

SEQ ID NO: 18739 - DNA, 20 bp, Artificial Sequence
  chemically synthesized
tgtgtgtgtgtgtgtgtgta

SEQ ID NO: 18740 - DNA, 20 bp, Artificial Sequence
  chemically synthesized
cgccacgcctggcatttttt

SEQ ID NO: 18741 - DNA, 20 bp, Artificial Sequence
  chemically synthesized
cacatacaccaaaaaaatgc

SEQ ID NO: 18742 - DNA, 20 bp, Artificial Sequence
  chemically synthesized
acatacaccaaaaaaatgcc

SEQ ID NO: 18743 - DNA, 20 bp, Artificial Sequence
  chemically synthesized
caccaaaaaaatgccaggcg

SEQ ID NO: 18744 - DNA, 20 bp, Artificial Sequence
  chemically synthesized
caaaaaaatgccaggcgtgg

SEQ ID NO: 18745 - DNA, 20 bp, Artificial Sequence
  chemically synthesized
caggcatggaccgccacgcc

SEQ ID NO: 18746 - DNA, 20 bp, Artificial Sequence
  chemically synthesized
ggcgtggcggtccatgcctg

SEQ ID NO: 18747 - DNA, 20 bp, Artificial Sequence
  chemically synthesized
agtagctgggactacaggca

SEQ ID NO: 18748 - DNA, 20 bp, Artificial Sequence
  chemically synthesized
gcggtccatgcctgtagtcc

SEQ ID NO: 18749 - DNA, 20 bp, Artificial Sequence
  chemically synthesized
tcctgagtagctgggactac

SEQ ID NO: 18750 - DNA, 20 bp, Artificial Sequence
  chemically synthesized
ctcctgagtagctgggacta

SEQ ID NO: 18751 - DNA, 20 bp, Artificial Sequence
  chemically synthesized
tgcctgtagtcccagctact

SEQ ID NO: 18752 - DNA, 20 bp, Artificial Sequence
  chemically synthesized
cctcagcctcctgagtagct

SEQ ID NO: 18753 - DNA, 20 bp, Artificial Sequence
  chemically synthesized
gcctgtagtcccagctactc

SEQ ID NO: 18754 - DNA, 20 bp, Artificial Sequence
  chemically synthesized
acctcagcctcctgagtagc

SEQ ID NO: 18755 - DNA, 20 bp, Artificial Sequence
  chemically synthesized
ctgtagtcccagctactcag

SEQ ID NO: 18756 - DNA, 20 bp, Artificial Sequence
  chemically synthesized
tgtagtcccagctactcagg

SEQ ID NO: 18757 - DNA, 20 bp, Artificial Sequence
  chemically synthesized
tcccacctcagcctcctgag

SEQ ID NO: 18758 - DNA, 20 bp, Artificial Sequence
  chemically synthesized
tcctcccacctcagcctcct

SEQ ID NO: 18759 - DNA, 20 bp, Artificial Sequence
  chemically synthesized
tcccagctactcaggaggct

SEQ ID NO: 18760 - DNA, 20 bp, Artificial Sequence
  chemically synthesized
cccagctactcaggaggctg

SEQ ID NO: 18761 - DNA, 20 bp, Artificial Sequence
  chemically synthesized
agctactcaggaggctgagg

SEQ ID NO: 18762 - DNA, 20 bp, Artificial Sequence
  chemically synthesized
gctactcaggaggctgaggt

SEQ ID NO: 18763 - DNA, 20 bp, Artificial Sequence
  chemically synthesized
tactcaggaggctgaggtgg

SEQ ID NO: 18764 - DNA, 20 bp, Artificial Sequence
  chemically synthesized
actcaggaggctgaggtggg

SEQ ID NO: 18765 - DNA, 20 bp, Artificial Sequence
  chemically synthesized
ctcaagtgatcctcccacct

SEQ ID NO: 18766 - DNA, 20 bp, Artificial Sequence
  chemically synthesized
ctgaggtgggaggatcactt

SEQ ID NO: 18767 - DNA, 20 bp, Artificial Sequence
  chemically synthesized
gtgggaggatcacttgagcc

SEQ ID NO: 18768 - DNA, 20 bp, Artificial Sequence
  chemically synthesized
gggaggatcacttgagccca

SEQ ID NO: 18769 - DNA, 20 bp, Artificial Sequence
  chemically synthesized
cagcctcgacctctgggctc

SEQ ID NO: 18770 - DNA, 20 bp, Artificial Sequence
  chemically synthesized
ggaggatcacttgagcccag

SEQ ID NO: 18771 - DNA, 20 bp, Artificial Sequence
  chemically synthesized
atcacttgagcccagaggtc

SEQ ID NO: 18772 - DNA, 20 bp, Artificial Sequence
  chemically synthesized
tcattgcagcctcgacctct

SEQ ID NO: 18773 - DNA, 20 bp, Artificial Sequence
  chemically synthesized
tcacttgagcccagaggtcg

SEQ ID NO: 18774 - DNA, 20 bp, Artificial Sequence
  chemically synthesized
ctcattgcagcctcgacctc

SEQ ID NO: 18775 - DNA, 20 bp, Artificial Sequence
  chemically synthesized
ccagaggtcgaggctgcaat

SEQ ID NO: 18776 - DNA, 20 bp, Artificial Sequence
  chemically synthesized
ggcacgatcacagctcattg

SEQ ID NO: 18777 - DNA, 20 bp, Artificial Sequence
  chemically synthesized
ggagtgcagtggcacgatca

SEQ ID NO: 18778 - DNA, 20 bp, Artificial Sequence
  chemically synthesized
tcacccaggctggagtgcag

SEQ ID NO: 18779 - DNA, 20 bp, Artificial Sequence
  chemically synthesized
gtgatcgtgccactgcactc

SEQ ID NO: 18780 - DNA, 20 bp, Artificial Sequence
  chemically synthesized
tcgtcacccaggctggagtg

SEQ ID NO: 18781 - DNA, 20 bp, Artificial Sequence
  chemically synthesized
cgtgccactgcactccagcc

SEQ ID NO: 18782 - DNA, 20 bp, Artificial Sequence
  chemically synthesized
gtgccactgcactccagcct

SEQ ID NO: 18783 - DNA, 20 bp, Artificial Sequence
  chemically synthesized
taacttcgtcacccaggctg

SEQ ID NO: 18784 - DNA, 20 bp, Artificial Sequence
  chemically synthesized
tctaacttcgtcacccaggc

SEQ ID NO: 18785 - DNA, 20 bp, Artificial Sequence
  chemically synthesized
ggggtctaacttcgtcaccc

SEQ ID NO: 18786 - DNA, 20 bp, Artificial Sequence
  chemically synthesized
gcactccagcctgggtgacg

SEQ ID NO: 18787 - DNA, 20 bp, Artificial Sequence
  chemically synthesized
aggggtctaacttcgtcacc

SEQ ID NO: 18788 - DNA, 20 bp, Artificial Sequence
  chemically synthesized
tccagcctgggtgacgaagt

SEQ ID NO: 18789 - DNA, 20 bp, Artificial Sequence
  chemically synthesized
ttttgttttgttttcagaag

SEQ ID NO: 18790 - DNA, 20 bp, Artificial Sequence
  chemically synthesized
gttttgttttgttttcagaa

SEQ ID NO: 18791 - DNA, 20 bp, Artificial Sequence
  chemically synthesized
tgttttgttttgttttcaga

SEQ ID NO: 18792 - DNA, 20 bp, Artificial Sequence
  chemically synthesized
gtgttttgttttgttttcag

SEQ ID NO: 18793 - DNA, 20 bp, Artificial Sequence
  chemically synthesized
aatgtgttttgttttgtttt

SEQ ID NO: 18794 - DNA, 20 bp, Artificial Sequence
  chemically synthesized
aaaacacatttcacatttca

SEQ ID NO: 18795 - DNA, 20 bp, Artificial Sequence
  chemically synthesized
aacacatttcacatttcaaa

SEQ ID NO: 18796 - DNA, 20 bp, Artificial Sequence
  chemically synthesized
atttcacatttcaaagagct

SEQ ID NO: 18797 - DNA, 20 bp, Artificial Sequence
  chemically synthesized
ttcacatttcaaagagcttg

SEQ ID NO: 18798 - DNA, 20 bp, Artificial Sequence
  chemically synthesized
atttcaaagagcttggagac

SEQ ID NO: 18799 - DNA, 20 bp, Artificial Sequence
  chemically synthesized
tggttggccagccagtctcc

SEQ ID NO: 18800 - DNA, 20 bp, Artificial Sequence
  chemically synthesized
caaagagcttggagactggc

SEQ ID NO: 18801 - DNA, 20 bp, Artificial Sequence
  chemically synthesized
atgcctcctggttggccagc

SEQ ID NO: 18802 - DNA, 20 bp, Artificial Sequence
  chemically synthesized
ttggagactggctggccaac

SEQ ID NO: 18803 - DNA, 20 bp, Artificial Sequence
  chemically synthesized
tggagactggctggccaacc

SEQ ID NO: 18804 - DNA, 20 bp, Artificial Sequence
  chemically synthesized
ttgaatgcctcctggttggc

SEQ ID NO: 18805 - DNA, 20 bp, Artificial Sequence
  chemically synthesized
gagactggctggccaaccag

SEQ ID NO: 18806 - DNA, 20 bp, Artificial Sequence
  chemically synthesized
agactggctggccaaccagg

SEQ ID NO: 18807 - DNA, 20 bp, Artificial Sequence
  chemically synthesized
tttgttgaatgcctcctggt

SEQ ID NO: 18808 - DNA, 20 bp, Artificial Sequence
  chemically synthesized
catatttgttgaatgcctcc

SEQ ID NO: 18809 - DNA, 20 bp, Artificial Sequence
  chemically synthesized
gaggcattcaacaaatatgc

SEQ ID NO: 18810 - DNA, 20 bp, Artificial Sequence
  chemically synthesized
aggcattcaacaaatatgca

SEQ ID NO: 18811 - DNA, 20 bp, Artificial Sequence
  chemically synthesized
attcaacaaatatgcaagga

SEQ ID NO: 18812 - DNA, 20 bp, Artificial Sequence
  chemically synthesized
gcaaggatggactgaattca

SEQ ID NO: 18813 - DNA, 20 bp, Artificial Sequence
  chemically synthesized
cagtctcaaagctttgaatt

SEQ ID NO: 18814 - DNA, 20 bp, Artificial Sequence
  chemically synthesized
tggactgaattcaaagcttt

SEQ ID NO: 18815 - DNA, 20 bp, Artificial Sequence
  chemically synthesized
gaattcaaagctttgagact

SEQ ID NO: 18816 - DNA, 20 bp, Artificial Sequence
  chemically synthesized
actctgtattctcagtctca

SEQ ID NO: 18817 - DNA, 20 bp, Artificial Sequence
  chemically synthesized
aagctttgagactgagaata

SEQ ID NO: 18818 - DNA, 20 bp, Artificial Sequence
  chemically synthesized
taataacaactctgtattct

SEQ ID NO: 18819 - DNA, 20 bp, Artificial Sequence
  chemically synthesized
gctttgagactgagaataca

SEQ ID NO: 18820 - DNA, 20 bp, Artificial Sequence
  chemically synthesized
agaatacagagttgttatta

SEQ ID NO: 18821 - DNA, 20 bp, Artificial Sequence
  chemically synthesized
aatacagagttgttattaca

SEQ ID NO: 18822 - DNA, 20 bp, Artificial Sequence
  chemically synthesized
cagagttgttattacagaga

SEQ ID NO: 18823 - DNA, 20 bp, Artificial Sequence
  chemically synthesized
agacagaaatgtaaccaaac

SEQ ID NO: 18824 - DNA, 20 bp, Artificial Sequence
  chemically synthesized
acagaaatgtaaccaaacca

SEQ ID NO: 18825 - DNA, 20 bp, Artificial Sequence
  chemically synthesized
ctaagcccatgtctctggtt

SEQ ID NO: 18826 - DNA, 20 bp, Artificial Sequence
  chemically synthesized
atgtaaccaaaccagagaca

SEQ ID NO: 18827 - DNA, 20 bp, Artificial Sequence
  chemically synthesized
tgtaaccaaaccagagacat

SEQ ID NO: 18828 - DNA, 20 bp, Artificial Sequence
  chemically synthesized
ctcccctaagcccatgtctc

SEQ ID NO: 18829 - DNA, 20 bp, Artificial Sequence
  chemically synthesized
ccaaaccagagacatgggct

SEQ ID NO: 18830 - DNA, 20 bp, Artificial Sequence
  chemically synthesized
caaaccagagacatgggctt

SEQ ID NO: 18831 - DNA, 20 bp, Artificial Sequence
  chemically synthesized
aaaccagagacatgggctta

SEQ ID NO: 18832 - DNA, 20 bp, Artificial Sequence
  chemically synthesized
aaccagagacatgggcttag

SEQ ID NO: 18833 - DNA, 20 bp, Artificial Sequence
  chemically synthesized
ccagagacatgggcttaggg

SEQ ID NO: 18834 - DNA, 20 bp, Artificial Sequence
  chemically synthesized
gagacatgggcttaggggag

SEQ ID NO: 18835 - DNA, 20 bp, Artificial Sequence
  chemically synthesized
ggataacctcctactcccct

SEQ ID NO: 18836 - DNA, 20 bp, Artificial Sequence
  chemically synthesized
agacatgggcttaggggagt

SEQ ID NO: 18837 - DNA, 20 bp, Artificial Sequence
  chemically synthesized
acatgggcttaggggagtag

SEQ ID NO: 18838 - DNA, 20 bp, Artificial Sequence
  chemically synthesized
catgggcttaggggagtagg

SEQ ID NO: 18839 - DNA, 20 bp, Artificial Sequence
  chemically synthesized
taggggagtaggaggttatc

SEQ ID NO: 18840 - DNA, 20 bp, Artificial Sequence
  chemically synthesized
agtaggaggttatccagcaa

SEQ ID NO: 18841 - DNA, 20 bp, Artificial Sequence
  chemically synthesized
gtaggaggttatccagcaaa

SEQ ID NO: 18842 - DNA, 20 bp, Artificial Sequence
  chemically synthesized
tgcctgctacatccttttgc

SEQ ID NO: 18843 - DNA, 20 bp, Artificial Sequence
  chemically synthesized
ggttatccagcaaaaggatg

SEQ ID NO: 18844 - DNA, 20 bp, Artificial Sequence
  chemically synthesized
tatccagcaaaaggatgtag

SEQ ID NO: 18845 - DNA, 20 bp, Artificial Sequence
  chemically synthesized
atccagcaaaaggatgtagc

SEQ ID NO: 18846 - DNA, 20 bp, Artificial Sequence
  chemically synthesized
cagcaaaaggatgtagcagg

SEQ ID NO: 18847 - DNA, 20 bp, Artificial Sequence
  chemically synthesized
aaggatgtagcaggcagaaa

SEQ ID NO: 18848 - DNA, 20 bp, Artificial Sequence
  chemically synthesized
tgtagcaggcagaaatggaa

SEQ ID NO: 18849 - DNA, 20 bp, Artificial Sequence
  chemically synthesized
gtagcaggcagaaatggaat

SEQ ID NO: 18850 - DNA, 20 bp, Artificial Sequence
  chemically synthesized
caggcagaaatggaataggt

SEQ ID NO: 18851 - DNA, 20 bp, Artificial Sequence
  chemically synthesized
gaataggttggtctcctgat

SEQ ID NO: 18852 - DNA, 20 bp, Artificial Sequence
  chemically synthesized
aataggttggtctcctgata

SEQ ID NO: 18853 - DNA, 20 bp, Artificial Sequence
  chemically synthesized
ataggttggtctcctgataa

SEQ ID NO: 18854 - DNA, 20 bp, Artificial Sequence
  chemically synthesized
tgggctgccccccttatcag

SEQ ID NO: 18855 - DNA, 20 bp, Artificial Sequence
  chemically synthesized
taggttggtctcctgataag

SEQ ID NO: 18856 - DNA, 20 bp, Artificial Sequence
  chemically synthesized
aggttggtctcctgataagg

SEQ ID NO: 18857 - DNA, 20 bp, Artificial Sequence
  chemically synthesized
cctgggctgccccccttatc

SEQ ID NO: 18858 - DNA, 20 bp, Artificial Sequence
  chemically synthesized
ggttggtctcctgataaggg

SEQ ID NO: 18859 - DNA, 20 bp, Artificial Sequence
  chemically synthesized
ccctgggctgccccccttat

SEQ ID NO: 18860 - DNA, 20 bp, Artificial Sequence
  chemically synthesized
tggtctcctgataagggggg

SEQ ID NO: 18861 - DNA, 20 bp, Artificial Sequence
  chemically synthesized
tcctgataaggggggcagcc

SEQ ID NO: 18862 - DNA, 20 bp, Artificial Sequence
  chemically synthesized
cctgataaggggggcagccc

SEQ ID NO: 18863 - DNA, 20 bp, Artificial Sequence
  chemically synthesized
ctgataaggggggcagccca

SEQ ID NO: 18864 - DNA, 20 bp, Artificial Sequence
  chemically synthesized
taaggggggcagcccaggga

SEQ ID NO: 18865 - DNA, 20 bp, Artificial Sequence
  chemically synthesized
acagaagctctgctttccct

SEQ ID NO: 18866 - DNA, 20 bp, Artificial Sequence
  chemically synthesized
ggggggcagcccagggaaag

SEQ ID NO: 18867 - DNA, 20 bp, Artificial Sequence
  chemically synthesized
tacagaagctctgctttccc

SEQ ID NO: 18868 - DNA, 20 bp, Artificial Sequence
  chemically synthesized
ggggcagcccagggaaagca

SEQ ID NO: 18869 - DNA, 20 bp, Artificial Sequence
  chemically synthesized
gggaaagcagagcttctgta

SEQ ID NO: 18870 - DNA, 20 bp, Artificial Sequence
  chemically synthesized
gataagcggtggccatacag

SEQ ID NO: 18871 - DNA, 20 bp, Artificial Sequence
  chemically synthesized
caggataagcggtggccata

SEQ ID NO: 18872 - DNA, 20 bp, Artificial Sequence
  chemically synthesized
ttggttgtcaggataagcgg

SEQ ID NO: 18873 - DNA, 20 bp, Artificial Sequence
  chemically synthesized
gatttggttgtcaggataag

SEQ ID NO: 18874 - DNA, 20 bp, Artificial Sequence
  chemically synthesized
ttggatttggttgtcaggat

SEQ ID NO: 18875 - DNA, 20 bp, Artificial Sequence
  chemically synthesized
ccctcttggatttggttgtc

SEQ ID NO: 18876 - DNA, 20 bp, Artificial Sequence
  chemically synthesized
gccctcttggatttggttgt

SEQ ID NO: 18877 - DNA, 20 bp, Artificial Sequence
  chemically synthesized
ttatcctgacaaccaaatcc

SEQ ID NO: 18878 - DNA, 20 bp, Artificial Sequence
  chemically synthesized
atcctgacaaccaaatccaa

SEQ ID NO: 18879 - DNA, 20 bp, Artificial Sequence
  chemically synthesized
gcctctggccctcttggatt

SEQ ID NO: 18880 - DNA, 20 bp, Artificial Sequence
  chemically synthesized
tcctgacaaccaaatccaag

SEQ ID NO: 18881 - DNA, 20 bp, Artificial Sequence
  chemically synthesized
cctgacaaccaaatccaaga

SEQ ID NO: 18882 - DNA, 20 bp, Artificial Sequence
  chemically synthesized
acaaccaaatccaagagggc

SEQ ID NO: 18883 - DNA, 20 bp, Artificial Sequence
  chemically synthesized
actgcagcctctggccctct

SEQ ID NO: 18884 - DNA, 20 bp, Artificial Sequence
  chemically synthesized
aaccaaatccaagagggcca

SEQ ID NO: 18885 - DNA, 20 bp, Artificial Sequence
  chemically synthesized
accaaatccaagagggccag

SEQ ID NO: 18886 - DNA, 20 bp, Artificial Sequence
  chemically synthesized
tccaagagggccagaggctg

SEQ ID NO: 18887 - DNA, 20 bp, Artificial Sequence
  chemically synthesized
accatcctcactgcagcctc

SEQ ID NO: 18888 - DNA, 20 bp, Artificial Sequence
  chemically synthesized
agagggccagaggctgcagt

SEQ ID NO: 18889 - DNA, 20 bp, Artificial Sequence
  chemically synthesized
gagggccagaggctgcagtg

SEQ ID NO: 18890 - DNA, 20 bp, Artificial Sequence
  chemically synthesized
agccaccaccatcctcactg

SEQ ID NO: 18891 - DNA, 20 bp, Artificial Sequence
  chemically synthesized
gccagaggctgcagtgagga

SEQ ID NO: 18892 - DNA, 20 bp, Artificial Sequence
  chemically synthesized
agaggctgcagtgaggatgg

SEQ ID NO: 18893 - DNA, 20 bp, Artificial Sequence
  chemically synthesized
ggctgcagtgaggatggtgg

SEQ ID NO: 18894 - DNA, 20 bp, Artificial Sequence
  chemically synthesized
gatggtggtggcttcctgat

SEQ ID NO: 18895 - DNA, 20 bp, Artificial Sequence
  chemically synthesized
ccgagtactgactcatcagg

SEQ ID NO: 18896 - DNA, 20 bp, Artificial Sequence
  chemically synthesized
gtggtggcttcctgatgagt

SEQ ID NO: 18897 - DNA, 20 bp, Artificial Sequence
  chemically synthesized
cgcccgagtactgactcatc

SEQ ID NO: 18898 - DNA, 20 bp, Artificial Sequence
  chemically synthesized
tcgcccgagtactgactcat

SEQ ID NO: 18899 - DNA, 20 bp, Artificial Sequence
  chemically synthesized
cttcctgatgagtcagtact

SEQ ID NO: 18900 - DNA, 20 bp, Artificial Sequence
  chemically synthesized
ttcctgatgagtcagtactc

SEQ ID NO: 18901 - DNA, 20 bp, Artificial Sequence
  chemically synthesized
tgatgagtcagtactcgggc

SEQ ID NO: 18902 - DNA, 20 bp, Artificial Sequence
  chemically synthesized
gattctttgttttctcgccc

SEQ ID NO: 18903 - DNA, 20 bp, Artificial Sequence
  chemically synthesized
agtactcgggcgagaaaaca

SEQ ID NO: 18904 - DNA, 20 bp, Artificial Sequence
  chemically synthesized
gggcgagaaaacaaagaatc

SEQ ID NO: 18905 - DNA, 20 bp, Artificial Sequence
  chemically synthesized
gagaaaacaaagaatccagc

SEQ ID NO: 18906 - DNA, 20 bp, Artificial Sequence
  chemically synthesized
aggctgtattcagggccagc

SEQ ID NO: 18907 - DNA, 20 bp, Artificial Sequence
  chemically synthesized
aactaggctgtattcagggc

SEQ ID NO: 18908 - DNA, 20 bp, Artificial Sequence
  chemically synthesized
aatccagctggccctgaata

SEQ ID NO: 18909 - DNA, 20 bp, Artificial Sequence
  chemically synthesized
agtaaactaggctgtattca

SEQ ID NO: 18910 - DNA, 20 bp, Artificial Sequence
  chemically synthesized
aagtaaactaggctgtattc

SEQ ID NO: 18911 - DNA, 20 bp, Artificial Sequence
  chemically synthesized
aaagtaaactaggctgtatt

SEQ ID NO: 18912 - DNA, 20 bp, Artificial Sequence
  chemically synthesized
agctggccctgaatacagcc

SEQ ID NO: 18913 - DNA, 20 bp, Artificial Sequence
  chemically synthesized
tccctgctgcaaagtaaact

SEQ ID NO: 18914 - DNA, 20 bp, Artificial Sequence
  chemically synthesized
gtccctgctgcaaagtaaac

SEQ ID NO: 18915 - DNA, 20 bp, Artificial Sequence
  chemically synthesized
atacagcctagtttactttg

SEQ ID NO: 18916 - DNA, 20 bp, Artificial Sequence
  chemically synthesized
cagcctagtttactttgcag

SEQ ID NO: 18917 - DNA, 20 bp, Artificial Sequence
  chemically synthesized
agcctagtttactttgcagc

SEQ ID NO: 18918 - DNA, 20 bp, Artificial Sequence
  chemically synthesized
gcctagtttactttgcagca

SEQ ID NO: 18919 - DNA, 20 bp, Artificial Sequence
  chemically synthesized
cagtgatggtccctgctgca

SEQ ID NO: 18920 - DNA, 20 bp, Artificial Sequence
  chemically synthesized
ttgcagcagggaccatcact

SEQ ID NO: 18921 - DNA, 20 bp, Artificial Sequence
  chemically synthesized
ttaaaggtaaggctcagtga

SEQ ID NO: 18922 - DNA, 20 bp, Artificial Sequence
  chemically synthesized
cttgggttaaaggtaaggct

SEQ ID NO: 18923 - DNA, 20 bp, Artificial Sequence
  chemically synthesized
tgtgacttgggttaaaggta

SEQ ID NO: 18924 - DNA, 20 bp, Artificial Sequence
  chemically synthesized
ttgtgacttgggttaaaggt

SEQ ID NO: 18925 - DNA, 20 bp, Artificial Sequence
  chemically synthesized
ctgagccttacctttaaccc

SEQ ID NO: 18926 - DNA, 20 bp, Artificial Sequence
  chemically synthesized
tgcattgtgacttgggttaa

SEQ ID NO: 18927 - DNA, 20 bp, Artificial Sequence
  chemically synthesized
gtgcattgtgacttgggtta

SEQ ID NO: 18928 - DNA, 20 bp, Artificial Sequence
  chemically synthesized
atgtgtgtgcattgtgactt

SEQ ID NO: 18929 - DNA, 20 bp, Artificial Sequence
  chemically synthesized
tatgtgtgtgcattgtgact

SEQ ID NO: 18930 - DNA, 20 bp, Artificial Sequence
  chemically synthesized
cacacacgtgttcatatata

SEQ ID NO: 18931 - DNA, 20 bp, Artificial Sequence
  chemically synthesized
acacacacgtgttcatatat

SEQ ID NO: 18932 - DNA, 20 bp, Artificial Sequence
  chemically synthesized
cacacacacgtgttcatata

SEQ ID NO: 18933 - DNA, 20 bp, Artificial Sequence
  chemically synthesized
aacacgtgtgtgtgtttcac

SEQ ID NO: 18934 - DNA, 20 bp, Artificial Sequence
  chemically synthesized
gtgtgtttcactagaactca

SEQ ID NO: 18935 - DNA, 20 bp, Artificial Sequence
  chemically synthesized
ctcagttactctttgagttc

SEQ ID NO: 18936 - DNA, 20 bp, Artificial Sequence
  chemically synthesized
gtgtttcactagaactcaaa

SEQ ID NO: 18937 - DNA, 20 bp, Artificial Sequence
  chemically synthesized
tcaagtctcagttactcttt

SEQ ID NO: 18938 - DNA, 20 bp, Artificial Sequence
  chemically synthesized
ctagaactcaaagagtaact

SEQ ID NO: 18939 - DNA, 20 bp, Artificial Sequence
  chemically synthesized
tttcccctttagtcaagtct

SEQ ID NO: 18940 - DNA, 20 bp, Artificial Sequence
  chemically synthesized
gagtaactgagacttgacta

SEQ ID NO: 18941 - DNA, 20 bp, Artificial Sequence
  chemically synthesized
agtaactgagacttgactaa

SEQ ID NO: 18942 - DNA, 20 bp, Artificial Sequence
  chemically synthesized
gtaactgagacttgactaaa

SEQ ID NO: 18943 - DNA, 20 bp, Artificial Sequence
  chemically synthesized
atcatttttcccctttagtc

SEQ ID NO: 18944 - DNA, 20 bp, Artificial Sequence
  chemically synthesized
taactgagacttgactaaag

SEQ ID NO: 18945 - DNA, 20 bp, Artificial Sequence
  chemically synthesized
tcctaatcatttttcccctt

SEQ ID NO: 18946 - DNA, 20 bp, Artificial Sequence
  chemically synthesized
gactaaaggggaaaaatgat

SEQ ID NO: 18947 - DNA, 20 bp, Artificial Sequence
  chemically synthesized
actaaaggggaaaaatgatt

SEQ ID NO: 18948 - DNA, 20 bp, Artificial Sequence
  chemically synthesized
atgattaggacctgtaatcc

SEQ ID NO: 18949 - DNA, 20 bp, Artificial Sequence
  chemically synthesized
tcccaaagtgctgggattac

SEQ ID NO: 18950 - DNA, 20 bp, Artificial Sequence
  chemically synthesized
ctcccaaagtgctgggatta

SEQ ID NO: 18951 - DNA, 20 bp, Artificial Sequence
  chemically synthesized
gacctgtaatcccagcactt

SEQ ID NO: 18952 - DNA, 20 bp, Artificial Sequence
  chemically synthesized
cctcggcctcccaaagtgct

SEQ ID NO: 18953 - DNA, 20 bp, Artificial Sequence
  chemically synthesized
acctgtaatcccagcacttt

SEQ ID NO: 18954 - DNA, 20 bp, Artificial Sequence
  chemically synthesized
gcctcggcctcccaaagtgc

SEQ ID NO: 18955 - DNA, 20 bp, Artificial Sequence
  chemically synthesized
ctgtaatcccagcactttgg

SEQ ID NO: 18956 - DNA, 20 bp, Artificial Sequence
  chemically synthesized
tgtaatcccagcactttggg

SEQ ID NO: 18957 - DNA, 20 bp, Artificial Sequence
  chemically synthesized
ccacctgcctcggcctccca

SEQ ID NO: 18958 - DNA, 20 bp, Artificial Sequence
  chemically synthesized
tcccagcactttgggaggcc

SEQ ID NO: 18959 - DNA, 20 bp, Artificial Sequence
  chemically synthesized
cccagcactttgggaggccg

SEQ ID NO: 18960 - DNA, 20 bp, Artificial Sequence
  chemically synthesized
agcactttgggaggccgagg

SEQ ID NO: 18961 - DNA, 20 bp, Artificial Sequence
  chemically synthesized
gcactttgggaggccgaggc

SEQ ID NO: 18962 - DNA, 20 bp, Artificial Sequence
  chemically synthesized
ctttgggaggccgaggcagg

SEQ ID NO: 18963 - DNA, 20 bp, Artificial Sequence
  chemically synthesized
ctcaagcaatccacctgcct

SEQ ID NO: 18964 - DNA, 20 bp, Artificial Sequence
  chemically synthesized
ccgaggcaggtggattgctt

SEQ ID NO: 18965 - DNA, 20 bp, Artificial Sequence
  chemically synthesized
gcaggtggattgcttgagat

SEQ ID NO: 18966 - DNA, 20 bp, Artificial Sequence
  chemically synthesized
caggtggattgcttgagatc

SEQ ID NO: 18967 - DNA, 20 bp, Artificial Sequence
  chemically synthesized
gagctcaaactcctgatctc

SEQ ID NO: 18968 - DNA, 20 bp, Artificial Sequence
  chemically synthesized
ggtggattgcttgagatcag

SEQ ID NO: 18969 - DNA, 20 bp, Artificial Sequence
  chemically synthesized
ttgcttgagatcaggagttt

SEQ ID NO: 18970 - DNA, 20 bp, Artificial Sequence
  chemically synthesized
tgagatcaggagtttgagct

SEQ ID NO: 18971 - DNA, 20 bp, Artificial Sequence
  chemically synthesized
tcaggagtttgagctcagcc

SEQ ID NO: 18972 - DNA, 20 bp, Artificial Sequence
  chemically synthesized
ttcaccatgttggccaggct

SEQ ID NO: 18973 - DNA, 20 bp, Artificial Sequence
  chemically synthesized
agggtttcaccatgttggcc

SEQ ID NO: 18974 - DNA, 20 bp, Artificial Sequence
  chemically synthesized
tgagctcagcctggccaaca

SEQ ID NO: 18975 - DNA, 20 bp, Artificial Sequence
  chemically synthesized
cagggtttcaccatgttggc

SEQ ID NO: 18976 - DNA, 20 bp, Artificial Sequence
  chemically synthesized
gagacagggtttcaccatgt

SEQ ID NO: 18977 - DNA, 20 bp, Artificial Sequence
  chemically synthesized
gctaattttttgtggagaca

SEQ ID NO: 18978 - DNA, 20 bp, Artificial Sequence
  chemically synthesized
ggctaattttttgtggagac

SEQ ID NO: 18979 - DNA, 20 bp, Artificial Sequence
  chemically synthesized
tggctaattttttgtggaga

SEQ ID NO: 18980 - DNA, 20 bp, Artificial Sequence
  chemically synthesized
tgcctggctaattttttgtg

SEQ ID NO: 18981 - DNA, 20 bp, Artificial Sequence
  chemically synthesized
catgcctggctaattttttg

SEQ ID NO: 18982 - DNA, 20 bp, Artificial Sequence
  chemically synthesized
accctgtctccacaaaaaat

SEQ ID NO: 18983 - DNA, 20 bp, Artificial Sequence
  chemically synthesized
tgtctccacaaaaaattagc

SEQ ID NO: 18984 - DNA, 20 bp, Artificial Sequence
  chemically synthesized
gtctccacaaaaaattagcc

SEQ ID NO: 18985 - DNA, 20 bp, Artificial Sequence
  chemically synthesized
cacaaaaaattagccaggca

SEQ ID NO: 18986 - DNA, 20 bp, Artificial Sequence
  chemically synthesized
aaaaaattagccaggcatgg

SEQ ID NO: 18987 - DNA, 20 bp, Artificial Sequence
  chemically synthesized
agggtgcctgccaccatgcc

SEQ ID NO: 18988 - DNA, 20 bp, Artificial Sequence
  chemically synthesized
aaattagccaggcatggtgg

SEQ ID NO: 18989 - DNA, 20 bp, Artificial Sequence
  chemically synthesized
aattagccaggcatggtggc

SEQ ID NO: 18990 - DNA, 20 bp, Artificial Sequence
  chemically synthesized
cccgagtagctgggattaca

SEQ ID NO: 18991 - DNA, 20 bp, Artificial Sequence
  chemically synthesized
tggcaggcaccctgtaatcc

SEQ ID NO: 18992 - DNA, 20 bp, Artificial Sequence
  chemically synthesized
tcccgagtagctgggattac

SEQ ID NO: 18993 - DNA, 20 bp, Artificial Sequence
  chemically synthesized
ctcccgagtagctgggatta

SEQ ID NO: 18994 - DNA, 20 bp, Artificial Sequence
  chemically synthesized
accctgtaatcccagctact

SEQ ID NO: 18995 - DNA, 20 bp, Artificial Sequence
  chemically synthesized
cctcagcctcccgagtagct

SEQ ID NO: 18996 - DNA, 20 bp, Artificial Sequence
  chemically synthesized
ccctgtaatcccagctactc

SEQ ID NO: 18997 - DNA, 20 bp, Artificial Sequence
  chemically synthesized
gcctcagcctcccgagtagc

SEQ ID NO: 18998 - DNA, 20 bp, Artificial Sequence
  chemically synthesized
ctgtaatcccagctactcgg

SEQ ID NO: 18999 - DNA, 20 bp, Artificial Sequence
  chemically synthesized
tgtaatcccagctactcggg

SEQ ID NO: 19000 - DNA, 20 bp, Artificial Sequence
  chemically synthesized
tcatgcctcagcctcccgag

SEQ ID NO: 19001 - DNA, 20 bp, Artificial Sequence
  chemically synthesized
ttgtcatgcctcagcctccc

SEQ ID NO: 19002 - DNA, 20 bp, Artificial Sequence
  chemically synthesized
tcccagctactcgggaggct

SEQ ID NO: 19003 - DNA, 20 bp, Artificial Sequence
  chemically synthesized
cccagctactcgggaggctg

SEQ ID NO: 19004 - DNA, 20 bp, Artificial Sequence
  chemically synthesized
ttcaagcaattgtcatgcct

SEQ ID NO: 19005 - DNA, 20 bp, Artificial Sequence
  chemically synthesized
ggcatgacaattgcttgaac

SEQ ID NO: 19006 - DNA, 20 bp, Artificial Sequence
  chemically synthesized
gcatgacaattgcttgaacc

SEQ ID NO: 19007 - DNA, 20 bp, Artificial Sequence
  chemically synthesized
catgacaattgcttgaacca

SEQ ID NO: 19008 - DNA, 20 bp, Artificial Sequence
  chemically synthesized
aacctccgcctccctggttc

SEQ ID NO: 19009 - DNA, 20 bp, Artificial Sequence
  chemically synthesized
tgacaattgcttgaaccagg

SEQ ID NO: 19010 - DNA, 20 bp, Artificial Sequence
  chemically synthesized
gacaattgcttgaaccaggg

SEQ ID NO: 19011 - DNA, 20 bp, Artificial Sequence
  chemically synthesized
aattgcttgaaccagggagg

SEQ ID NO: 19012 - DNA, 20 bp, Artificial Sequence
  chemically synthesized
cactgcaacctccgcctccc

SEQ ID NO: 19013 - DNA, 20 bp, Artificial Sequence
  chemically synthesized
ttgcttgaaccagggaggcg

SEQ ID NO: 19014 - DNA, 20 bp, Artificial Sequence
  chemically synthesized
tgcttgaaccagggaggcgg

SEQ ID NO: 19015 - DNA, 20 bp, Artificial Sequence
  chemically synthesized
aaccagggaggcggaggttg

SEQ ID NO: 19016 - DNA, 20 bp, Artificial Sequence
  chemically synthesized
agggaggcggaggttgcagt

SEQ ID NO: 19017 - DNA, 20 bp, Artificial Sequence
  chemically synthesized
ggcggaggttgcagtgagcc

SEQ ID NO: 19018 - DNA, 20 bp, Artificial Sequence
  chemically synthesized
ggagtgcaatggcgcgatct

SEQ ID NO: 19019 - DNA, 20 bp, Artificial Sequence
  chemically synthesized
tcgcccaggctggagtgcaa

SEQ ID NO: 19020 - DNA, 20 bp, Artificial Sequence
  chemically synthesized
gagatcgcgccattgcactc

SEQ ID NO: 19021 - DNA, 20 bp, Artificial Sequence
  chemically synthesized
cgcgccattgcactccagcc

SEQ ID NO: 19022 - DNA, 20 bp, Artificial Sequence
  chemically synthesized
gcgccattgcactccagcct

SEQ ID NO: 19023 - DNA, 20 bp, Artificial Sequence
  chemically synthesized
tccctctgtcgcccaggctg

SEQ ID NO: 19024 - DNA, 20 bp, Artificial Sequence
  chemically synthesized
tctccctctgtcgcccaggc

SEQ ID NO: 19025 - DNA, 20 bp, Artificial Sequence
  chemically synthesized
ttgcactccagcctgggcga

SEQ ID NO: 19026 - DNA, 20 bp, Artificial Sequence
  chemically synthesized
ggagtctccctctgtcgccc

SEQ ID NO: 19027 - DNA, 20 bp, Artificial Sequence
  chemically synthesized
gcactccagcctgggcgaca

SEQ ID NO: 19028 - DNA, 20 bp, Artificial Sequence
  chemically synthesized
tggagtctccctctgtcgcc

SEQ ID NO: 19029 - DNA, 20 bp, Artificial Sequence
  chemically synthesized
cactccagcctgggcgacag

SEQ ID NO: 19030 - DNA, 20 bp, Artificial Sequence
  chemically synthesized
actccagcctgggcgacaga

SEQ ID NO: 19031 - DNA, 20 bp, Artificial Sequence
  chemically synthesized
tccagcctgggcgacagagg

SEQ ID NO: 19032 - DNA, 20 bp, Artificial Sequence
  chemically synthesized
ttttgttttgttttgagatg

SEQ ID NO: 19033 - DNA, 20 bp, Artificial Sequence
  chemically synthesized
tgttttgttttgttttgaga

SEQ ID NO: 19034 - DNA, 20 bp, Artificial Sequence
  chemically synthesized
tttttgttttgttttgtttt

SEQ ID NO: 19035 - DNA, 20 bp, Artificial Sequence
  chemically synthesized
caaaaaaaacacacaaccaa

SEQ ID NO: 19036 - DNA, 20 bp, Artificial Sequence
  chemically synthesized
aaaacacacaaccaaaagat

SEQ ID NO: 19037 - DNA, 20 bp, Artificial Sequence
  chemically synthesized
aaacacacaaccaaaagatt

SEQ ID NO: 19038 - DNA, 20 bp, Artificial Sequence
  chemically synthesized
cgagttatttcctaatcttt

SEQ ID NO: 19039 - DNA, 20 bp, Artificial Sequence
  chemically synthesized
taggaaataactcgcgttta

SEQ ID NO: 19040 - DNA, 20 bp, Artificial Sequence
  chemically synthesized
aaacaacttgccataaacgc

SEQ ID NO: 19041 - DNA, 20 bp, Artificial Sequence
  chemically synthesized
aaataactcgcgtttatggc

SEQ ID NO: 19042 - DNA, 20 bp, Artificial Sequence
  chemically synthesized
atggcaagttgttttataat

SEQ ID NO: 19043 - DNA, 20 bp, Artificial Sequence
  chemically synthesized
ttaaaaaatcaaaatgaacc

SEQ ID NO: 19044 - DNA, 20 bp, Artificial Sequence
  chemically synthesized
ttaatggccacaggcaatct

SEQ ID NO: 19045 - DNA, 20 bp, Artificial Sequence
  chemically synthesized
attaatggccacaggcaatc

SEQ ID NO: 19046 - DNA, 20 bp, Artificial Sequence
  chemically synthesized
aaatgaacctagattgcctg

SEQ ID NO: 19047 - DNA, 20 bp, Artificial Sequence
  chemically synthesized
caatgaatattaatggccac

SEQ ID NO: 19048 - DNA, 20 bp, Artificial Sequence
  chemically synthesized
acaatgaatattaatggcca

SEQ ID NO: 19049 - DNA, 20 bp, Artificial Sequence
  chemically synthesized
ttccatacaatgaatattaa

SEQ ID NO: 19050 - DNA, 20 bp, Artificial Sequence
  chemically synthesized
ggccattaatattcattgta

SEQ ID NO: 19051 - DNA, 20 bp, Artificial Sequence
  chemically synthesized
cattaatattcattgtatgg

SEQ ID NO: 19052 - DNA, 20 bp, Artificial Sequence
  chemically synthesized
aatcatcaaaatgtagacac

SEQ ID NO: 19053 - DNA, 20 bp, Artificial Sequence
  chemically synthesized
tccaatcaatcatcaaaatg

SEQ ID NO: 19054 - DNA, 20 bp, Artificial Sequence
  chemically synthesized
tctacattttgatgattgat

SEQ ID NO: 19055 - DNA, 20 bp, Artificial Sequence
  chemically synthesized
caaaccttccaaaatgcaga

SEQ ID NO: 19056 - DNA, 20 bp, Artificial Sequence
  chemically synthesized
ttgatcatctatctgcattt

SEQ ID NO: 19057 - DNA, 20 bp, Artificial Sequence
  chemically synthesized
tacccaaaccttccaaaatg

SEQ ID NO: 19058 - DNA, 20 bp, Artificial Sequence
  chemically synthesized
atcatctatctgcattttgg

SEQ ID NO: 19059 - DNA, 20 bp, Artificial Sequence
  chemically synthesized
tcatctatctgcattttgga

SEQ ID NO: 19060 - DNA, 20 bp, Artificial Sequence
  chemically synthesized
tatctgcattttggaaggtt

SEQ ID NO: 19061 - DNA, 20 bp, Artificial Sequence
  chemically synthesized
atctgcattttggaaggttt

SEQ ID NO: 19062 - DNA, 20 bp, Artificial Sequence
  chemically synthesized
attttggaaggtttgggtat

SEQ ID NO: 19063 - DNA, 20 bp, Artificial Sequence
  chemically synthesized
ttttggaaggtttgggtatg

SEQ ID NO: 19064 - DNA, 20 bp, Artificial Sequence
  chemically synthesized
ttggaaggtttgggtatgag

SEQ ID NO: 19065 - DNA, 20 bp, Artificial Sequence
  chemically synthesized
tggaaggtttgggtatgagg

SEQ ID NO: 19066 - DNA, 20 bp, Artificial Sequence
  chemically synthesized
ggtttgggtatgaggaggaa

SEQ ID NO: 19067 - DNA, 20 bp, Artificial Sequence
  chemically synthesized
gtaaatgtaaaatgcatgtg

SEQ ID NO: 19068 - DNA, 20 bp, Artificial Sequence
  chemically synthesized
ttgtaaatgtaaaatgcatg

SEQ ID NO: 19069 - DNA, 20 bp, Artificial Sequence
  chemically synthesized
ttgccaaaattatggcaaat

SEQ ID NO: 19070 - DNA, 20 bp, Artificial Sequence
  chemically synthesized
caactaatttgccataattt

SEQ ID NO: 19071 - DNA, 20 bp, Artificial Sequence
  chemically synthesized
gaattattttgccaaaatta

SEQ ID NO: 19072 - DNA, 20 bp, Artificial Sequence
  chemically synthesized
ttttggcaaaataattcaaa

SEQ ID NO: 19073 - DNA, 20 bp, Artificial Sequence
  chemically synthesized
taagttcatttatgtaaagt

SEQ ID NO: 19074 - DNA, 20 bp, Artificial Sequence
  chemically synthesized
ataagttcatttatgtaaag

SEQ ID NO: 19075 - DNA, 20 bp, Artificial Sequence
  chemically synthesized
ataataagttcatttatgta

SEQ ID NO: 19076 - DNA, 20 bp, Artificial Sequence
  chemically synthesized
ttaccggatgcacacataat

SEQ ID NO: 19077 - DNA, 20 bp, Artificial Sequence
  chemically synthesized
gaacttattatgtgtgcatc

SEQ ID NO: 19078 - DNA, 20 bp, Artificial Sequence
  chemically synthesized
agttagttggatagatttac

SEQ ID NO: 19079 - DNA, 20 bp, Artificial Sequence
  chemically synthesized
ttatttaatagttagttgga

SEQ ID NO: 19080 - DNA, 20 bp, Artificial Sequence
  chemically synthesized
gtatttatttaatagttagt

SEQ ID NO: 19081 - DNA, 20 bp, Artificial Sequence
  chemically synthesized
ttgagtatttatttaatagt

SEQ ID NO: 19082 - DNA, 20 bp, Artificial Sequence
  chemically synthesized
cagtttgagtatttatttaa

SEQ ID NO: 19083 - DNA, 20 bp, Artificial Sequence
  chemically synthesized
ttaggtgtttaaagcagttt

SEQ ID NO: 19084 - DNA, 20 bp, Artificial Sequence
  chemically synthesized
gaatatttaggtgtttaaag

SEQ ID NO: 19085 - DNA, 20 bp, Artificial Sequence
  chemically synthesized
tgtgaatatttaggtgttta

SEQ ID NO: 19086 - DNA, 20 bp, Artificial Sequence
  chemically synthesized
gcagatcactgtgaatattt

SEQ ID NO: 19087 - DNA, 20 bp, Artificial Sequence
  chemically synthesized
ggcagatcactgtgaatatt

SEQ ID NO: 19088 - DNA, 20 bp, Artificial Sequence
  chemically synthesized
tttaaacacctaaatattca

SEQ ID NO: 19089 - DNA, 20 bp, Artificial Sequence
  chemically synthesized
aatattcacagtgatctgcc

SEQ ID NO: 19090 - DNA, 20 bp, Artificial Sequence
  chemically synthesized
atattcacagtgatctgccc

SEQ ID NO: 19091 - DNA, 20 bp, Artificial Sequence
  chemically synthesized
actatagaaggtttcctggg

SEQ ID NO: 19092 - DNA, 20 bp, Artificial Sequence
  chemically synthesized
gaaactatagaaggtttcct

SEQ ID NO: 19093 - DNA, 20 bp, Artificial Sequence
  chemically synthesized
tgaaactatagaaggtttcc

SEQ ID NO: 19094 - DNA, 20 bp, Artificial Sequence
  chemically synthesized
tctgcccaggaaaccttcta

SEQ ID NO: 19095 - DNA, 20 bp, Artificial Sequence
  chemically synthesized
gactaggatgaaactataga

SEQ ID NO: 19096 - DNA, 20 bp, Artificial Sequence
  chemically synthesized
agactaggatgaaactatag

SEQ ID NO: 19097 - DNA, 20 bp, Artificial Sequence
  chemically synthesized
cacagactaggatgaaacta

SEQ ID NO: 19098 - DNA, 20 bp, Artificial Sequence
  chemically synthesized
aaccttctatagtttcatcc

SEQ ID NO: 19099 - DNA, 20 bp, Artificial Sequence
  chemically synthesized
tatagtttcatcctagtctg

SEQ ID NO: 19100 - DNA, 20 bp, Artificial Sequence
  chemically synthesized
gaagtctttgaccacagact

SEQ ID NO: 19101 - DNA, 20 bp, Artificial Sequence
  chemically synthesized
tgaagtctttgaccacagac

SEQ ID NO: 19102 - DNA, 20 bp, Artificial Sequence
  chemically synthesized
ttcatcctagtctgtggtca

SEQ ID NO: 19103 - DNA, 20 bp, Artificial Sequence
  chemically synthesized
atatctgaagtctttgacca

SEQ ID NO: 19104 - DNA, 20 bp, Artificial Sequence
  chemically synthesized
tagtctgtggtcaaagactt

SEQ ID NO: 19105 - DNA, 20 bp, Artificial Sequence
  chemically synthesized
aactaactgggttatatctg

SEQ ID NO: 19106 - DNA, 20 bp, Artificial Sequence
  chemically synthesized
caaagacttcagatataacc

SEQ ID NO: 19107 - DNA, 20 bp, Artificial Sequence
  chemically synthesized
gacttcagatataacccagt

SEQ ID NO: 19108 - DNA, 20 bp, Artificial Sequence
  chemically synthesized
aactagctgtagaactaact

SEQ ID NO: 19109 - DNA, 20 bp, Artificial Sequence
  chemically synthesized
gaactagctgtagaactaac

SEQ ID NO: 19110 - DNA, 20 bp, Artificial Sequence
  chemically synthesized
atataacccagttagttcta

SEQ ID NO: 19111 - DNA, 20 bp, Artificial Sequence
  chemically synthesized
aacccagttagttctacagc

SEQ ID NO: 19112 - DNA, 20 bp, Artificial Sequence
  chemically synthesized
ttacaaaatggaactagctg

SEQ ID NO: 19113 - DNA, 20 bp, Artificial Sequence
  chemically synthesized
tgagatttacaaaatggaac

SEQ ID NO: 19114 - DNA, 20 bp, Artificial Sequence
  chemically synthesized
aatggctgagatttacaaaa

SEQ ID NO: 19115 - DNA, 20 bp, Artificial Sequence
  chemically synthesized
tagttccattttgtaaatct

SEQ ID NO: 19116 - DNA, 20 bp, Artificial Sequence
  chemically synthesized
taattctattaacaatggct

SEQ ID NO: 19117 - DNA, 20 bp, Artificial Sequence
  chemically synthesized
taaatctcagccattgttaa

SEQ ID NO: 19118 - DNA, 20 bp, Artificial Sequence
  chemically synthesized
cattctaattctattaacaa

SEQ ID NO: 19119 - DNA, 20 bp, Artificial Sequence
  chemically synthesized
tcagccattgttaatagaat

SEQ ID NO: 19120 - DNA, 20 bp, Artificial Sequence
  chemically synthesized
cattgttaatagaattagaa

SEQ ID NO: 19121 - DNA, 20 bp, Artificial Sequence
  chemically synthesized
taatagaattagaatggatt

SEQ ID NO: 19122 - DNA, 20 bp, Artificial Sequence
  chemically synthesized
tggattgagaaaccctacat

SEQ ID NO: 19123 - DNA, 20 bp, Artificial Sequence
  chemically synthesized
agagctgtttttcttatgta

SEQ ID NO: 19124 - DNA, 20 bp, Artificial Sequence
  chemically synthesized
aagagctgtttttcttatgt

SEQ ID NO: 19125 - DNA, 20 bp, Artificial Sequence
  chemically synthesized
taagagctgtttttcttatg

SEQ ID NO: 19126 - DNA, 20 bp, Artificial Sequence
  chemically synthesized
gaaaccctacataagaaaaa

SEQ ID NO: 19127 - DNA, 20 bp, Artificial Sequence
  chemically synthesized
tacataagaaaaacagctct

SEQ ID NO: 19128 - DNA, 20 bp, Artificial Sequence
  chemically synthesized
ttggttttttcaagtgctaa

SEQ ID NO: 19129 - DNA, 20 bp, Artificial Sequence
  chemically synthesized
ttttggttttttcaagtgct

SEQ ID NO: 19130 - DNA, 20 bp, Artificial Sequence
  chemically synthesized
tttttgtttttggttttttc

SEQ ID NO: 19131 - DNA, 20 bp, Artificial Sequence
  chemically synthesized
tgttcttatgtttttgtttt

SEQ ID NO: 19132 - DNA, 20 bp, Artificial Sequence
  chemically synthesized
aaaaccaaaaacaaaaacat

SEQ ID NO: 19133 - DNA, 20 bp, Artificial Sequence
  chemically synthesized
tttcggtatcacattattca

SEQ ID NO: 19134 - DNA, 20 bp, Artificial Sequence
  chemically synthesized
tgtgaataatgtgataccga

SEQ ID NO: 19135 - DNA, 20 bp, Artificial Sequence
  chemically synthesized
ttgaaggagtaagatgcttt

SEQ ID NO: 19136 - DNA, 20 bp, Artificial Sequence
  chemically synthesized
gctatcagtattgaaggagt

SEQ ID NO: 19137 - DNA, 20 bp, Artificial Sequence
  chemically synthesized
taacgctatcagtattgaag

SEQ ID NO: 19138 - DNA, 20 bp, Artificial Sequence
  chemically synthesized
tgtaacgctatcagtattga

SEQ ID NO: 19139 - DNA, 20 bp, Artificial Sequence
  chemically synthesized
ttgtaacgctatcagtattg

SEQ ID NO: 19140 - DNA, 20 bp, Artificial Sequence
  chemically synthesized
tcttactccttcaatactga

SEQ ID NO: 19141 - DNA, 20 bp, Artificial Sequence
  chemically synthesized
tgttctaattgtaacgctat

SEQ ID NO: 19142 - DNA, 20 bp, Artificial Sequence
  chemically synthesized
aatactgatagcgttacaat

SEQ ID NO: 19143 - DNA, 20 bp, Artificial Sequence
  chemically synthesized
tacaattagaacaacttttg

SEQ ID NO: 19144 - DNA, 20 bp, Artificial Sequence
  chemically synthesized
attagaacaacttttgaaga

SEQ ID NO: 19145 - DNA, 20 bp, Artificial Sequence
  chemically synthesized
tttttgtggcctttcttcaa

SEQ ID NO: 19146 - DNA, 20 bp, Artificial Sequence
  chemically synthesized
ttagaacaacttttgaagaa

SEQ ID NO: 19147 - DNA, 20 bp, Artificial Sequence
  chemically synthesized
aataatataaacattttttg

SEQ ID NO: 19148 - DNA, 20 bp, Artificial Sequence
  chemically synthesized
aatgtttatattattttgtc

SEQ ID NO: 19149 - DNA, 20 bp, Artificial Sequence
  chemically synthesized
attctcaggcgtgtgattgc

SEQ ID NO: 19150 - DNA, 20 bp, Artificial Sequence
  chemically synthesized
tgtctggcaatcacacgcct

SEQ ID NO: 19151 - DNA, 20 bp, Artificial Sequence
  chemically synthesized
tctttataggatcaattctc

SEQ ID NO: 19152 - DNA, 20 bp, Artificial Sequence
  chemically synthesized
ttctttataggatcaattct

SEQ ID NO: 19153 - DNA, 20 bp, Artificial Sequence
  chemically synthesized
gcctgagaattgatcctata

SEQ ID NO: 19154 - DNA, 20 bp, Artificial Sequence
  chemically synthesized
gagaattgatcctataaaga

SEQ ID NO: 19155 - DNA, 20 bp, Artificial Sequence
  chemically synthesized
gtctttgaagctttctttat

SEQ ID NO: 19156 - DNA, 20 bp, Artificial Sequence
  chemically synthesized
tgtctttgaagctttcttta

SEQ ID NO: 19157 - DNA, 20 bp, Artificial Sequence
  chemically synthesized
atcctataaagaaagcttca

SEQ ID NO: 19158 - DNA, 20 bp, Artificial Sequence
  chemically synthesized
tcgtttagcttttgtctttg

SEQ ID NO: 19159 - DNA, 20 bp, Artificial Sequence
  chemically synthesized
aaagaaagcttcaaagacaa

SEQ ID NO: 19160 - DNA, 20 bp, Artificial Sequence
  chemically synthesized
aaagacaaaagctaaacgat

SEQ ID NO: 19161 - DNA, 20 bp, Artificial Sequence
  chemically synthesized
aagacaaaagctaaacgata

SEQ ID NO: 19162 - DNA, 20 bp, Artificial Sequence
  chemically synthesized
caatgaacatccttatcgtt

SEQ ID NO: 19163 - DNA, 20 bp, Artificial Sequence
  chemically synthesized
aacgataaggatgttcattg

SEQ ID NO: 19164 - DNA, 20 bp, Artificial Sequence
  chemically synthesized
tctaatttttattaggtaga

SEQ ID NO: 19165 - DNA, 20 bp, Artificial Sequence
  chemically synthesized
ggcctctaatttttattagg

SEQ ID NO: 19166 - DNA, 20 bp, Artificial Sequence
  chemically synthesized
cctggcctctaatttttatt

SEQ ID NO: 19167 - DNA, 20 bp, Artificial Sequence
  chemically synthesized
gcctggcctctaatttttat

SEQ ID NO: 19168 - DNA, 20 bp, Artificial Sequence
  chemically synthesized
actatctacctaataaaaat

SEQ ID NO: 19169 - DNA, 20 bp, Artificial Sequence
  chemically synthesized
tatctacctaataaaaatta

SEQ ID NO: 19170 - DNA, 20 bp, Artificial Sequence
  chemically synthesized
atctacctaataaaaattag

SEQ ID NO: 19171 - DNA, 20 bp, Artificial Sequence
  chemically synthesized
acctaataaaaattagaggc

SEQ ID NO: 19172 - DNA, 20 bp, Artificial Sequence
  chemically synthesized
cctaataaaaattagaggcc

SEQ ID NO: 19173 - DNA, 20 bp, Artificial Sequence
  chemically synthesized
taaaaattagaggccaggca

SEQ ID NO: 19174 - DNA, 20 bp, Artificial Sequence
  chemically synthesized
aaattagaggccaggcacgg

SEQ ID NO: 19175 - DNA, 20 bp, Artificial Sequence
  chemically synthesized
caggcgtaagccaccgtgcc

SEQ ID NO: 19176 - DNA, 20 bp, Artificial Sequence
  chemically synthesized
agtgctcggattacaggcgt

SEQ ID NO: 19177 - DNA, 20 bp, Artificial Sequence
  chemically synthesized
gtggcttacgcctgtaatcc

SEQ ID NO: 19178 - DNA, 20 bp, Artificial Sequence
  chemically synthesized
tcccaaagtgctcggattac

SEQ ID NO: 19179 - DNA, 20 bp, Artificial Sequence
  chemically synthesized
ctcccaaagtgctcggatta

SEQ ID NO: 19180 - DNA, 20 bp, Artificial Sequence
  chemically synthesized
cgcctgtaatccgagcactt

SEQ ID NO: 19181 - DNA, 20 bp, Artificial Sequence
  chemically synthesized
cctcgaactcccaaagtgct

SEQ ID NO: 19182 - DNA, 20 bp, Artificial Sequence
  chemically synthesized
gcctgtaatccgagcacttt

SEQ ID NO: 19183 - DNA, 20 bp, Artificial Sequence
  chemically synthesized
ctgtaatccgagcactttgg

SEQ ID NO: 19184 - DNA, 20 bp, Artificial Sequence
  chemically synthesized
ccacctgcctcgaactccca

SEQ ID NO: 19185 - DNA, 20 bp, Artificial Sequence
  chemically synthesized
tccgagcactttgggagttc

SEQ ID NO: 19186 - DNA, 20 bp, Artificial Sequence
  chemically synthesized
ccgagcactttgggagttcg

SEQ ID NO: 19187 - DNA, 20 bp, Artificial Sequence
  chemically synthesized
agcactttgggagttcgagg

SEQ ID NO: 19188 - DNA, 20 bp, Artificial Sequence
  chemically synthesized
gcactttgggagttcgaggc

SEQ ID NO: 19189 - DNA, 20 bp, Artificial Sequence
  chemically synthesized
ctttgggagttcgaggcagg

SEQ ID NO: 19190 - DNA, 20 bp, Artificial Sequence
  chemically synthesized
tcgaggcaggtggatcacct

SEQ ID NO: 19191 - DNA, 20 bp, Artificial Sequence
  chemically synthesized
cgaggcaggtggatcacctg

SEQ ID NO: 19192 - DNA, 20 bp, Artificial Sequence
  chemically synthesized
gcaggtggatcacctgaggt

SEQ ID NO: 19193 - DNA, 20 bp, Artificial Sequence
  chemically synthesized
caggtggatcacctgaggtc

SEQ ID NO: 19194 - DNA, 20 bp, Artificial Sequence
  chemically synthesized
ggtctcaaactcctgacctc

SEQ ID NO: 19195 - DNA, 20 bp, Artificial Sequence
  chemically synthesized
ggtggatcacctgaggtcag

SEQ ID NO: 19196 - DNA, 20 bp, Artificial Sequence
  chemically synthesized
tggtctcaaactcctgacct

SEQ ID NO: 19197 - DNA, 20 bp, Artificial Sequence
  chemically synthesized
tcacctgaggtcaggagttt

SEQ ID NO: 19198 - DNA, 20 bp, Artificial Sequence
  chemically synthesized
tgaggtcaggagtttgagac

SEQ ID NO: 19199 - DNA, 20 bp, Artificial Sequence
  chemically synthesized
tcaggagtttgagaccagcc

SEQ ID NO: 19200 - DNA, 20 bp, Artificial Sequence
  chemically synthesized
tttcaccaggttggccaggc

SEQ ID NO: 19201 - DNA, 20 bp, Artificial Sequence
  chemically synthesized
agggtttcaccaggttggcc

SEQ ID NO: 19202 - DNA, 20 bp, Artificial Sequence
  chemically synthesized
tgagaccagcctggccaacc

SEQ ID NO: 19203 - DNA, 20 bp, Artificial Sequence
  chemically synthesized
cagggtttcaccaggttggc

SEQ ID NO: 19204 - DNA, 20 bp, Artificial Sequence
  chemically synthesized
gagacagggtttcaccaggt

SEQ ID NO: 19205 - DNA, 20 bp, Artificial Sequence
  chemically synthesized
agtagagacagggtttcacc

SEQ ID NO: 19206 - DNA, 20 bp, Artificial Sequence
  chemically synthesized
tagtagagacagggtttcac

SEQ ID NO: 19207 - DNA, 20 bp, Artificial Sequence
  chemically synthesized
ttgtatttttagtagagaca

SEQ ID NO: 19208 - DNA, 20 bp, Artificial Sequence
  chemically synthesized
tttgtatttttagtagagac

SEQ ID NO: 19209 - DNA, 20 bp, Artificial Sequence
  chemically synthesized
ttttgtatttttagtagaga

SEQ ID NO: 19210 - DNA, 20 bp, Artificial Sequence
  chemically synthesized
taatttttgtatttttagta

SEQ ID NO: 19211 - DNA, 20 bp, Artificial Sequence
  chemically synthesized
gctaatttttgtatttttag

SEQ ID NO: 19212 - DNA, 20 bp, Artificial Sequence
  chemically synthesized
caagctaatttttgtatttt

SEQ ID NO: 19213 - DNA, 20 bp, Artificial Sequence
  chemically synthesized
tctactaaaaatacaaaaat

SEQ ID NO: 19214 - DNA, 20 bp, Artificial Sequence
  chemically synthesized
taaaaatacaaaaattagct

SEQ ID NO: 19215 - DNA, 20 bp, Artificial Sequence
  chemically synthesized
aaaaatacaaaaattagctt

SEQ ID NO: 19216 - DNA, 20 bp, Artificial Sequence
  chemically synthesized
aaaatacaaaaattagcttg

SEQ ID NO: 19217 - DNA, 20 bp, Artificial Sequence
  chemically synthesized
atacaaaaattagcttgggg

SEQ ID NO: 19218 - DNA, 20 bp, Artificial Sequence
  chemically synthesized
caaaaattagcttggggtgg

SEQ ID NO: 19219 - DNA, 20 bp, Artificial Sequence
  chemically synthesized
caggcgcccaccgccacccc

SEQ ID NO: 19220 - DNA, 20 bp, Artificial Sequence
  chemically synthesized
aaattagcttggggtggcgg

SEQ ID NO: 19221 - DNA, 20 bp, Artificial Sequence
  chemically synthesized
aattagcttggggtggcggt

SEQ ID NO: 19222 - DNA, 20 bp, Artificial Sequence
  chemically synthesized
gcggtgggcgcctgtaatcc

SEQ ID NO: 19223 - DNA, 20 bp, Artificial Sequence
  chemically synthesized
tcccgagtagctgggattac

SEQ ID NO: 19224 - DNA, 20 bp, Artificial Sequence
  chemically synthesized
ctcccgagtagctgggatta

SEQ ID NO: 19225 - DNA, 20 bp, Artificial Sequence
  chemically synthesized
cgcctgtaatcccagctact

SEQ ID NO: 19226 - DNA, 20 bp, Artificial Sequence
  chemically synthesized
cctcagcctcccgagtagct

SEQ ID NO: 19227 - DNA, 20 bp, Artificial Sequence
  chemically synthesized
gcctgtaatcccagctactc

SEQ ID NO: 19228 - DNA, 20 bp, Artificial Sequence
  chemically synthesized
acctcagcctcccgagtagc

SEQ ID NO: 19229 - DNA, 20 bp, Artificial Sequence
  chemically synthesized
ctgtaatcccagctactcgg

SEQ ID NO: 19230 - DNA, 20 bp, Artificial Sequence
  chemically synthesized
tgtaatcccagctactcggg

SEQ ID NO: 19231 - DNA, 20 bp, Artificial Sequence
  chemically synthesized
tgctacctcagcctcccgag

SEQ ID NO: 19232 - DNA, 20 bp, Artificial Sequence
  chemically synthesized
ttctgctacctcagcctccc

SEQ ID NO: 19233 - DNA, 20 bp, Artificial Sequence
  chemically synthesized
tcccagctactcgggaggct

SEQ ID NO: 19234 - DNA, 20 bp, Artificial Sequence
  chemically synthesized
cccagctactcgggaggctg

SEQ ID NO: 19235 - DNA, 20 bp, Artificial Sequence
  chemically synthesized
agctactcgggaggctgagg

SEQ ID NO: 19236 - DNA, 20 bp, Artificial Sequence
  chemically synthesized
tactcgggaggctgaggtag

SEQ ID NO: 19237 - DNA, 20 bp, Artificial Sequence
  chemically synthesized
ttcaagtgattctgctacct

SEQ ID NO: 19238 - DNA, 20 bp, Artificial Sequence
  chemically synthesized
gtagcagaatcacttgaacc

SEQ ID NO: 19239 - DNA, 20 bp, Artificial Sequence
  chemically synthesized
tagcagaatcacttgaaccc

SEQ ID NO: 19240 - DNA, 20 bp, Artificial Sequence
  chemically synthesized
aacctccacctcccgggttc

SEQ ID NO: 19241 - DNA, 20 bp, Artificial Sequence
  chemically synthesized
gcagaatcacttgaacccgg

SEQ ID NO: 19242 - DNA, 20 bp, Artificial Sequence
  chemically synthesized
cagaatcacttgaacccggg

SEQ ID NO: 19243 - DNA, 20 bp, Artificial Sequence
  chemically synthesized
aatcacttgaacccgggagg

SEQ ID NO: 19244 - DNA, 20 bp, Artificial Sequence
  chemically synthesized
cactgcaacctccacctccc

SEQ ID NO: 19245 - DNA, 20 bp, Artificial Sequence
  chemically synthesized
tcacttgaacccgggaggtg

SEQ ID NO: 19246 - DNA, 20 bp, Artificial Sequence
  chemically synthesized
tcactgcaacctccacctcc

SEQ ID NO: 19247 - DNA, 20 bp, Artificial Sequence
  chemically synthesized
cacttgaacccgggaggtgg

SEQ ID NO: 19248 - DNA, 20 bp, Artificial Sequence
  chemically synthesized
aacccgggaggtggaggttg

SEQ ID NO: 19249 - DNA, 20 bp, Artificial Sequence
  chemically synthesized
cgggaggtggaggttgcagt

SEQ ID NO: 19250 - DNA, 20 bp, Artificial Sequence
  chemically synthesized
gaggtggaggttgcagtgag

SEQ ID NO: 19251 - DNA, 20 bp, Artificial Sequence
  chemically synthesized
ggtggaggttgcagtgagca

SEQ ID NO: 19252 - DNA, 20 bp, Artificial Sequence
  chemically synthesized
ccaggctggagtgcagtggt

SEQ ID NO: 19253 - DNA, 20 bp, Artificial Sequence
  chemically synthesized
tcacccaggctggagtgcag

SEQ ID NO: 19254 - DNA, 20 bp, Artificial Sequence
  chemically synthesized
gagatctcaccactgcactc

SEQ ID NO: 19255 - DNA, 20 bp, Artificial Sequence
  chemically synthesized
ctgtcacccaggctggagtg

SEQ ID NO: 19256 - DNA, 20 bp, Artificial Sequence
  chemically synthesized
ctcaccactgcactccagcc

SEQ ID NO: 19257 - DNA, 20 bp, Artificial Sequence
  chemically synthesized
tcaccactgcactccagcct

SEQ ID NO: 19258 - DNA, 20 bp, Artificial Sequence
  chemically synthesized
tcgctctgtcacccaggctg

SEQ ID NO: 19259 - DNA, 20 bp, Artificial Sequence
  chemically synthesized
tctcgctctgtcacccaggc

SEQ ID NO: 19260 - DNA, 20 bp, Artificial Sequence
  chemically synthesized
ctgcactccagcctgggtga

SEQ ID NO: 19261 - DNA, 20 bp, Artificial Sequence
  chemically synthesized
gcagtctcgctctgtcaccc

SEQ ID NO: 19262 - DNA, 20 bp, Artificial Sequence
  chemically synthesized
gcactccagcctgggtgaca

SEQ ID NO: 19263 - DNA, 20 bp, Artificial Sequence
  chemically synthesized
tgcagtctcgctctgtcacc

SEQ ID NO: 19264 - DNA, 20 bp, Artificial Sequence
  chemically synthesized
tccagcctgggtgacagagc

SEQ ID NO: 19265 - DNA, 20 bp, Artificial Sequence
  chemically synthesized
tttttttcttttttgagttg

SEQ ID NO: 19266 - DNA, 20 bp, Artificial Sequence
  chemically synthesized
agcgagactgcaactcaaaa

SEQ ID NO: 19267 - DNA, 20 bp, Artificial Sequence
  chemically synthesized
tttttttttttttctttttt

SEQ ID NO: 19268 - DNA, 20 bp, Artificial Sequence
  chemically synthesized
aaaaagaaaaaaaaaaaaaa

SEQ ID NO: 19269 - DNA, 20 bp, Artificial Sequence
  chemically synthesized
aaaagaaaaaaaaaaaaaaa

SEQ ID NO: 19270 - DNA, 20 bp, Artificial Sequence
  chemically synthesized
gaaaaaaaaaaaaaaaagga

SEQ ID NO: 19271 - DNA, 20 bp, Artificial Sequence
  chemically synthesized
aaaaaaaaaaaaaaaggaaa

SEQ ID NO: 19272 - DNA, 20 bp, Artificial Sequence
  chemically synthesized
aaggaaagagaaaaaaaaat

SEQ ID NO: 19273 - DNA, 20 bp, Artificial Sequence
  chemically synthesized
agagaaaaaaaaattagaac

SEQ ID NO: 19274 - DNA, 20 bp, Artificial Sequence
  chemically synthesized
agaacaagatgaatgtctac

SEQ ID NO: 19275 - DNA, 20 bp, Artificial Sequence
  chemically synthesized
acaagatgaatgtctaccag

SEQ ID NO: 19276 - DNA, 20 bp, Artificial Sequence
  chemically synthesized
aagatgaatgtctaccagtg

SEQ ID NO: 19277 - DNA, 20 bp, Artificial Sequence
  chemically synthesized
atgcctgagcactccactgg

SEQ ID NO: 19278 - DNA, 20 bp, Artificial Sequence
  chemically synthesized
caaatgcctgagcactccac

SEQ ID NO: 19279 - DNA, 20 bp, Artificial Sequence
  chemically synthesized
atgtctaccagtggagtgct

SEQ ID NO: 19280 - DNA, 20 bp, Artificial Sequence
  chemically synthesized
tgtctaccagtggagtgctc

SEQ ID NO: 19281 - DNA, 20 bp, Artificial Sequence
  chemically synthesized
cagtggagtgctcaggcatt

SEQ ID NO: 19282 - DNA, 20 bp, Artificial Sequence
  chemically synthesized
cctcttcttcccaaatgcct

SEQ ID NO: 19283 - DNA, 20 bp, Artificial Sequence
  chemically synthesized
agtggagtgctcaggcattt

SEQ ID NO: 19284 - DNA, 20 bp, Artificial Sequence
  chemically synthesized
ggagtgctcaggcatttggg

SEQ ID NO: 19285 - DNA, 20 bp, Artificial Sequence
  chemically synthesized
gtgctcaggcatttgggaag

SEQ ID NO: 19286 - DNA, 20 bp, Artificial Sequence
  chemically synthesized
gctcaggcatttgggaagaa

SEQ ID NO: 19287 - DNA, 20 bp, Artificial Sequence
  chemically synthesized
ctcaggcatttgggaagaag

SEQ ID NO: 19288 - DNA, 20 bp, Artificial Sequence
  chemically synthesized
tcaggcatttgggaagaaga

SEQ ID NO: 19289 - DNA, 20 bp, Artificial Sequence
  chemically synthesized
tgggaagaagagggtgtttc

SEQ ID NO: 19290 - DNA, 20 bp, Artificial Sequence
  chemically synthesized
gggaagaagagggtgtttct

SEQ ID NO: 19291 - DNA, 20 bp, Artificial Sequence
  chemically synthesized
ggaagaagagggtgtttctg

SEQ ID NO: 19292 - DNA, 20 bp, Artificial Sequence
  chemically synthesized
ctctgtcgtagtcagtgccc

SEQ ID NO: 19293 - DNA, 20 bp, Artificial Sequence
  chemically synthesized
ttctggggcactgactacga

SEQ ID NO: 19294 - DNA, 20 bp, Artificial Sequence
  chemically synthesized
tgctttttctctgtcgtagt

SEQ ID NO: 19295 - DNA, 20 bp, Artificial Sequence
  chemically synthesized
ctggggcactgactacgaca

SEQ ID NO: 19296 - DNA, 20 bp, Artificial Sequence
  chemically synthesized
ccattgctttttctctgtcg

SEQ ID NO: 19297 - DNA, 20 bp, Artificial Sequence
  chemically synthesized
cactgactacgacagagaaa

SEQ ID NO: 19298 - DNA, 20 bp, Artificial Sequence
  chemically synthesized
ctacgacagagaaaaagcaa

SEQ ID NO: 19299 - DNA, 20 bp, Artificial Sequence
  chemically synthesized
tacgacagagaaaaagcaat

SEQ ID NO: 19300 - DNA, 20 bp, Artificial Sequence
  chemically synthesized
acagagaaaaagcaatggga

SEQ ID NO: 19301 - DNA, 20 bp, Artificial Sequence
  chemically synthesized
cagagaaaaagcaatgggac

SEQ ID NO: 19302 - DNA, 20 bp, Artificial Sequence
  chemically synthesized
gaaaaagcaatgggacagga

SEQ ID NO: 19303 - DNA, 20 bp, Artificial Sequence
  chemically synthesized
aaaaagcaatgggacaggat

SEQ ID NO: 19304 - DNA, 20 bp, Artificial Sequence
  chemically synthesized
agcaatgggacaggatagga

SEQ ID NO: 19305 - DNA, 20 bp, Artificial Sequence
  chemically synthesized
caatgggacaggataggaaa

SEQ ID NO: 19306 - DNA, 20 bp, Artificial Sequence
  chemically synthesized
ggacaggataggaaagagaa

SEQ ID NO: 19307 - DNA, 20 bp, Artificial Sequence
  chemically synthesized
ggataggaaagagaacggac

SEQ ID NO: 19308 - DNA, 20 bp, Artificial Sequence
  chemically synthesized
ataggaaagagaacggacaa

SEQ ID NO: 19309 - DNA, 20 bp, Artificial Sequence
  chemically synthesized
agaacggacaagagtgtgtt

SEQ ID NO: 19310 - DNA, 20 bp, Artificial Sequence
  chemically synthesized
cggacaagagtgtgttcagt

SEQ ID NO: 19311 - DNA, 20 bp, Artificial Sequence
  chemically synthesized
agagtgtgttcagtcagtga

SEQ ID NO: 19312 - DNA, 20 bp, Artificial Sequence
  chemically synthesized
gttcagtcagtgatggacat

SEQ ID NO: 19313 - DNA, 20 bp, Artificial Sequence
  chemically synthesized
cagtcagtgatggacattag

SEQ ID NO: 19314 - DNA, 20 bp, Artificial Sequence
  chemically synthesized
gtcagtgatggacattagca

SEQ ID NO: 19315 - DNA, 20 bp, Artificial Sequence
  chemically synthesized
cagtgatggacattagcaga

SEQ ID NO: 19316 - DNA, 20 bp, Artificial Sequence
  chemically synthesized
tagcagagagtatacacctc

SEQ ID NO: 19317 - DNA, 20 bp, Artificial Sequence
  chemically synthesized
cctattattccaaagtctag

SEQ ID NO: 19318 - DNA, 20 bp, Artificial Sequence
  chemically synthesized
gagtatacacctctagactt

SEQ ID NO: 19319 - DNA, 20 bp, Artificial Sequence
  chemically synthesized
ccctattattccaaagtcta

SEQ ID NO: 19320 - DNA, 20 bp, Artificial Sequence
  chemically synthesized
tcccctattattccaaagtc

SEQ ID NO: 19321 - DNA, 20 bp, Artificial Sequence
  chemically synthesized
gacattcccctattattcca

SEQ ID NO: 19322 - DNA, 20 bp, Artificial Sequence
  chemically synthesized
acctctagactttggaataa

SEQ ID NO: 19323 - DNA, 20 bp, Artificial Sequence
  chemically synthesized
cctctagactttggaataat

SEQ ID NO: 19324 - DNA, 20 bp, Artificial Sequence
  chemically synthesized
ctctagactttggaataata

SEQ ID NO: 19325 - DNA, 20 bp, Artificial Sequence
  chemically synthesized
tctagactttggaataatag

SEQ ID NO: 19326 - DNA, 20 bp, Artificial Sequence
  chemically synthesized
ggaataataggggaatgtca

SEQ ID NO: 19327 - DNA, 20 bp, Artificial Sequence
  chemically synthesized
aggggaatgtcaaagctaca

SEQ ID NO: 19328 - DNA, 20 bp, Artificial Sequence
  chemically synthesized
ggggaatgtcaaagctacaa

SEQ ID NO: 19329 - DNA, 20 bp, Artificial Sequence
  chemically synthesized
aatgtcaaagctacaaagga

SEQ ID NO: 19330 - DNA, 20 bp, Artificial Sequence
  chemically synthesized
ttttttaaaactgtcctttg

SEQ ID NO: 19331 - DNA, 20 bp, Artificial Sequence
  chemically synthesized
caaaggacagttttaaaaaa

SEQ ID NO: 19332 - DNA, 20 bp, Artificial Sequence
  chemically synthesized
aaaggacagttttaaaaaaa

SEQ ID NO: 19333 - DNA, 20 bp, Artificial Sequence
  chemically synthesized
gacagttttaaaaaaaagga

SEQ ID NO: 19334 - DNA, 20 bp, Artificial Sequence
  chemically synthesized
ctgttggtaaattgttagca

SEQ ID NO: 19335 - DNA, 20 bp, Artificial Sequence
  chemically synthesized
aatggctgttggtaaattgt

SEQ ID NO: 19336 - DNA, 20 bp, Artificial Sequence
  chemically synthesized
ctgtgctaacaatttaccaa

SEQ ID NO: 19337 - DNA, 20 bp, Artificial Sequence
  chemically synthesized
agcctcctttcaatggctgt

SEQ ID NO: 19338 - DNA, 20 bp, Artificial Sequence
  chemically synthesized
aatttaccaacagccattga

SEQ ID NO: 19339 - DNA, 20 bp, Artificial Sequence
  chemically synthesized
atttaccaacagccattgaa

SEQ ID NO: 19340 - DNA, 20 bp, Artificial Sequence
  chemically synthesized
ttaccaacagccattgaaag

SEQ ID NO: 19341 - DNA, 20 bp, Artificial Sequence
  chemically synthesized
tcattatagcctcctttcaa

SEQ ID NO: 19342 - DNA, 20 bp, Artificial Sequence
  chemically synthesized
taccaacagccattgaaagg

SEQ ID NO: 19343 - DNA, 20 bp, Artificial Sequence
  chemically synthesized
ttgaaaggaggctataatga

SEQ ID NO: 19344 - DNA, 20 bp, Artificial Sequence
  chemically synthesized
tttctctaattctatcatta

SEQ ID NO: 19345 - DNA, 20 bp, Artificial Sequence
  chemically synthesized
ggaggctataatgatagaat

SEQ ID NO: 19346 - DNA, 20 bp, Artificial Sequence
  chemically synthesized
aggctataatgatagaatta

SEQ ID NO: 19347 - DNA, 20 bp, Artificial Sequence
  chemically synthesized
tataatgatagaattagaga

SEQ ID NO: 19348 - DNA, 20 bp, Artificial Sequence
  chemically synthesized
ataatgatagaattagagaa

SEQ ID NO: 19349 - DNA, 20 bp, Artificial Sequence
  chemically synthesized
atagaattagagaaaggact

SEQ ID NO: 19350 - DNA, 20 bp, Artificial Sequence
  chemically synthesized
agaattagagaaaggactca

SEQ ID NO: 19351 - DNA, 20 bp, Artificial Sequence
  chemically synthesized
agagaaaggactcagagact

SEQ ID NO: 19352 - DNA, 20 bp, Artificial Sequence
  chemically synthesized
aggcgagtctcttagtctct

SEQ ID NO: 19353 - DNA, 20 bp, Artificial Sequence
  chemically synthesized
agaaaggactcagagactaa

SEQ ID NO: 19354 - DNA, 20 bp, Artificial Sequence
  chemically synthesized
gcctttgtaggcgagtctct

SEQ ID NO: 19355 - DNA, 20 bp, Artificial Sequence
  chemically synthesized
gactaagagactcgcctaca

SEQ ID NO: 19356 - DNA, 20 bp, Artificial Sequence
  chemically synthesized
agaaaatggcctttgtaggc

SEQ ID NO: 19357 - DNA, 20 bp, Artificial Sequence
  chemically synthesized
actaagagactcgcctacaa

SEQ ID NO: 19358 - DNA, 20 bp, Artificial Sequence
  chemically synthesized
tataagaaaatggcctttgt

SEQ ID NO: 19359 - DNA, 20 bp, Artificial Sequence
  chemically synthesized
atataagaaaatggcctttg

SEQ ID NO: 19360 - DNA, 20 bp, Artificial Sequence
  chemically synthesized
atcctatgtatataagaaaa

SEQ ID NO: 19361 - DNA, 20 bp, Artificial Sequence
  chemically synthesized
aggccattttcttatataca

SEQ ID NO: 19362 - DNA, 20 bp, Artificial Sequence
  chemically synthesized
cacagaaatcctatgtatat

SEQ ID NO: 19363 - DNA, 20 bp, Artificial Sequence
  chemically synthesized
ggccattttcttatatacat

SEQ ID NO: 19364 - DNA, 20 bp, Artificial Sequence
  chemically synthesized
ttatatacataggatttctg

SEQ ID NO: 19365 - DNA, 20 bp, Artificial Sequence
  chemically synthesized
atacataggatttctgtggc

SEQ ID NO: 19366 - DNA, 20 bp, Artificial Sequence
  chemically synthesized
acataggatttctgtggcta

SEQ ID NO: 19367 - DNA, 20 bp, Artificial Sequence
  chemically synthesized
aggaaataagtctctagcca

SEQ ID NO: 19368 - DNA, 20 bp, Artificial Sequence
  chemically synthesized
caagggaggaaataagtctc

SEQ ID NO: 19369 - DNA, 20 bp, Artificial Sequence
  chemically synthesized
agttcagcaagggaggaaat

SEQ ID NO: 19370 - DNA, 20 bp, Artificial Sequence
  chemically synthesized
gggaagaagttcagcaaggg

SEQ ID NO: 19371 - DNA, 20 bp, Artificial Sequence
  chemically synthesized
ggggaagaagttcagcaagg

SEQ ID NO: 19372 - DNA, 20 bp, Artificial Sequence
  chemically synthesized
gaggggaagaagttcagcaa

SEQ ID NO: 19373 - DNA, 20 bp, Artificial Sequence
  chemically synthesized
agaggggaagaagttcagca

SEQ ID NO: 19374 - DNA, 20 bp, Artificial Sequence
  chemically synthesized
tagaggggaagaagttcagc

SEQ ID NO: 19375 - DNA, 20 bp, Artificial Sequence
  chemically synthesized
gtgctagaggggaagaagtt

SEQ ID NO: 19376 - DNA, 20 bp, Artificial Sequence
  chemically synthesized
ttgaggtgctagaggggaag

SEQ ID NO: 19377 - DNA, 20 bp, Artificial Sequence
  chemically synthesized
ttgctgaacttcttcccctc

SEQ ID NO: 19378 - DNA, 20 bp, Artificial Sequence
  chemically synthesized
ttattgaggtgctagagggg

SEQ ID NO: 19379 - DNA, 20 bp, Artificial Sequence
  chemically synthesized
cagttattgaggtgctagag

SEQ ID NO: 19380 - DNA, 20 bp, Artificial Sequence
  chemically synthesized
acagttattgaggtgctaga

SEQ ID NO: 19381 - DNA, 20 bp, Artificial Sequence
  chemically synthesized
cacagttattgaggtgctag

SEQ ID NO: 19382 - DNA, 20 bp, Artificial Sequence
  chemically synthesized
ccacagttattgaggtgcta

SEQ ID NO: 19383 - DNA, 20 bp, Artificial Sequence
  chemically synthesized
ccccacagttattgaggtgc

SEQ ID NO: 19384 - DNA, 20 bp, Artificial Sequence
  chemically synthesized
cagggaccccacagttattg

SEQ ID NO: 19385 - DNA, 20 bp, Artificial Sequence
  chemically synthesized
gcagggaccccacagttatt

SEQ ID NO: 19386 - DNA, 20 bp, Artificial Sequence
  chemically synthesized
ctctagcacctcaataactg

SEQ ID NO: 19387 - DNA, 20 bp, Artificial Sequence
  chemically synthesized
tctagcacctcaataactgt

SEQ ID NO: 19388 - DNA, 20 bp, Artificial Sequence
  chemically synthesized
ctagcacctcaataactgtg

SEQ ID NO: 19389 - DNA, 20 bp, Artificial Sequence
  chemically synthesized
catctgcagcagggacccca

SEQ ID NO: 19390 - DNA, 20 bp, Artificial Sequence
  chemically synthesized
taactgtggggtccctgctg

SEQ ID NO: 19391 - DNA, 20 bp, Artificial Sequence
  chemically synthesized
agaaatctccatctgcagca

SEQ ID NO: 19392 - DNA, 20 bp, Artificial Sequence
  chemically synthesized
aagaaatctccatctgcagc

SEQ ID NO: 19393 - DNA, 20 bp, Artificial Sequence
  chemically synthesized
tgtggggtccctgctgcaga

SEQ ID NO: 19394 - DNA, 20 bp, Artificial Sequence
  chemically synthesized
aaagaaatctccatctgcag

SEQ ID NO: 19395 - DNA, 20 bp, Artificial Sequence
  chemically synthesized
tggggtccctgctgcagatg

SEQ ID NO: 19396 - DNA, 20 bp, Artificial Sequence
  chemically synthesized
ggaaaagaaatctccatctg

SEQ ID NO: 19397 - DNA, 20 bp, Artificial Sequence
  chemically synthesized
agacagtgctgaggaaggaa

SEQ ID NO: 19398 - DNA, 20 bp, Artificial Sequence
  chemically synthesized
ggagatttcttttccttcct

SEQ ID NO: 19399 - DNA, 20 bp, Artificial Sequence
  chemically synthesized
aaagaagacagtgctgagga

SEQ ID NO: 19400 - DNA, 20 bp, Artificial Sequence
  chemically synthesized
gaaagaagacagtgctgagg

SEQ ID NO: 19401 - DNA, 20 bp, Artificial Sequence
  chemically synthesized
tgggaaagaagacagtgctg

SEQ ID NO: 19402 - DNA, 20 bp, Artificial Sequence
  chemically synthesized
ttgggaaagaagacagtgct

SEQ ID NO: 19403 - DNA, 20 bp, Artificial Sequence
  chemically synthesized
ctaggttttgggaaagaaga

SEQ ID NO: 19404 - DNA, 20 bp, Artificial Sequence
  chemically synthesized
aactctaggttttgggaaag

SEQ ID NO: 19405 - DNA, 20 bp, Artificial Sequence
  chemically synthesized
tggaactctaggttttggga

SEQ ID NO: 19406 - DNA, 20 bp, Artificial Sequence
  chemically synthesized
ctgtcttctttcccaaaacc

SEQ ID NO: 19407 - DNA, 20 bp, Artificial Sequence
  chemically synthesized
cttctggaactctaggtttt

SEQ ID NO: 19408 - DNA, 20 bp, Artificial Sequence
  chemically synthesized
gtcttctttcccaaaaccta

SEQ ID NO: 19409 - DNA, 20 bp, Artificial Sequence
  chemically synthesized
gcttctggaactctaggttt

SEQ ID NO: 19410 - DNA, 20 bp, Artificial Sequence
  chemically synthesized
tttcccaaaacctagagttc

SEQ ID NO: 19411 - DNA, 20 bp, Artificial Sequence
  chemically synthesized
taagcagcttctggaactct

SEQ ID NO: 19412 - DNA, 20 bp, Artificial Sequence
  chemically synthesized
gtaagcagcttctggaactc

SEQ ID NO: 19413 - DNA, 20 bp, Artificial Sequence
  chemically synthesized
cccaaaacctagagttccag

SEQ ID NO: 19414 - DNA, 20 bp, Artificial Sequence
  chemically synthesized
ctctgtaagtaagcagcttc

SEQ ID NO: 19415 - DNA, 20 bp, Artificial Sequence
  chemically synthesized
ttggaacctctgtaagtaag

SEQ ID NO: 19416 - DNA, 20 bp, Artificial Sequence
  chemically synthesized
ttccagaagctgcttactta

SEQ ID NO: 19417 - DNA, 20 bp, Artificial Sequence
  chemically synthesized
ccagaagctgcttacttaca

SEQ ID NO: 19418 - DNA, 20 bp, Artificial Sequence
  chemically synthesized
tatttggaacctctgtaagt

SEQ ID NO: 19419 - DNA, 20 bp, Artificial Sequence
  chemically synthesized
cagaagctgcttacttacag

SEQ ID NO: 19420 - DNA, 20 bp, Artificial Sequence
  chemically synthesized
gggatatttggaacctctgt

SEQ ID NO: 19421 - DNA, 20 bp, Artificial Sequence
  chemically synthesized
ggtatgggatttgggatatt

SEQ ID NO: 19422 - DNA, 20 bp, Artificial Sequence
  chemically synthesized
aggcagtaggtatgggattt

SEQ ID NO: 19423 - DNA, 20 bp, Artificial Sequence
  chemically synthesized
taggcagtaggtatgggatt

SEQ ID NO: 19424 - DNA, 20 bp, Artificial Sequence
  chemically synthesized
cttcagtaggcagtaggtat

SEQ ID NO: 19425 - DNA, 20 bp, Artificial Sequence
  chemically synthesized
tcttcagtaggcagtaggta

SEQ ID NO: 19426 - DNA, 20 bp, Artificial Sequence
  chemically synthesized
ttagctcttcagtaggcagt

SEQ ID NO: 19427 - DNA, 20 bp, Artificial Sequence
  chemically synthesized
attagctcttcagtaggcag

SEQ ID NO: 19428 - DNA, 20 bp, Artificial Sequence
  chemically synthesized
cccatacctactgcctactg

SEQ ID NO: 19429 - DNA, 20 bp, Artificial Sequence
  chemically synthesized
catattagctcttcagtagg

SEQ ID NO: 19430 - DNA, 20 bp, Artificial Sequence
  chemically synthesized
catacctactgcctactgaa

SEQ ID NO: 19431 - DNA, 20 bp, Artificial Sequence
  chemically synthesized
tctcatattagctcttcagt

SEQ ID NO: 19432 - DNA, 20 bp, Artificial Sequence
  chemically synthesized
ttctcatattagctcttcag

SEQ ID NO: 19433 - DNA, 20 bp, Artificial Sequence
  chemically synthesized
gttttctcatattagctctt

SEQ ID NO: 19434 - DNA, 20 bp, Artificial Sequence
  chemically synthesized
gcctactgaagagctaatat

SEQ ID NO: 19435 - DNA, 20 bp, Artificial Sequence
  chemically synthesized
agagcttcgttttctcatat

SEQ ID NO: 19436 - DNA, 20 bp, Artificial Sequence
  chemically synthesized
agagctaatatgagaaaacg

SEQ ID NO: 19437 - DNA, 20 bp, Artificial Sequence
  chemically synthesized
tatgagaaaacgaagctctg

SEQ ID NO: 19438 - DNA, 20 bp, Artificial Sequence
  chemically synthesized
atgagaaaacgaagctctgt

SEQ ID NO: 19439 - DNA, 20 bp, Artificial Sequence
  chemically synthesized
aattaattaaaaaacccaca

SEQ ID NO: 19440 - DNA, 20 bp, Artificial Sequence
  chemically synthesized
gaaattaattaaaaaaccca

SEQ ID NO: 19441 - DNA, 20 bp, Artificial Sequence
  chemically synthesized
atatttattctttcatattt

SEQ ID NO: 19442 - DNA, 20 bp, Artificial Sequence
  chemically synthesized
aattaatttctaaaatatga

SEQ ID NO: 19443 - DNA, 20 bp, Artificial Sequence
  chemically synthesized
gaaagaataaatatgttacc

SEQ ID NO: 19444 - DNA, 20 bp, Artificial Sequence
  chemically synthesized
agaataaatatgttacctag

SEQ ID NO: 19445 - DNA, 20 bp, Artificial Sequence
  chemically synthesized
gaataaatatgttacctaga

SEQ ID NO: 19446 - DNA, 20 bp, Artificial Sequence
  chemically synthesized
ttgtaagttattcaccttct

SEQ ID NO: 19447 - DNA, 20 bp, Artificial Sequence
  chemically synthesized
tttgtaagttattcaccttc

SEQ ID NO: 19448 - DNA, 20 bp, Artificial Sequence
  chemically synthesized
aaggtgaataacttacaaat

SEQ ID NO: 19449 - DNA, 20 bp, Artificial Sequence
  chemically synthesized
cggagctgcttccaatttgt

SEQ ID NO: 19450 - DNA, 20 bp, Artificial Sequence
  chemically synthesized
gtgaataacttacaaattgg

SEQ ID NO: 19451 - DNA, 20 bp, Artificial Sequence
  chemically synthesized
aataacttacaaattggaag

SEQ ID NO: 19452 - DNA, 20 bp, Artificial Sequence
  chemically synthesized
ttacaaattggaagcagctc

SEQ ID NO: 19453 - DNA, 20 bp, Artificial Sequence
  chemically synthesized
aacattgagccaagtgtccg

SEQ ID NO: 19454 - DNA, 20 bp, Artificial Sequence
  chemically synthesized
tggaagcagctccggacact

SEQ ID NO: 19455 - DNA, 20 bp, Artificial Sequence
  chemically synthesized
gtaacattgagccaagtgtc

SEQ ID NO: 19456 - DNA, 20 bp, Artificial Sequence
  chemically synthesized
gggggcagtaacattgagcc

SEQ ID NO: 19457 - DNA, 20 bp, Artificial Sequence
  chemically synthesized
cctttgggggcagtaacatt

SEQ ID NO: 19458 - DNA, 20 bp, Artificial Sequence
  chemically synthesized
gctcaatgttactgccccca

SEQ ID NO: 19459 - DNA, 20 bp, Artificial Sequence
  chemically synthesized
ctcaatgttactgcccccaa

SEQ ID NO: 19460 - DNA, 20 bp, Artificial Sequence
  chemically synthesized
gaagttgcatcctttggggg

SEQ ID NO: 19461 - DNA, 20 bp, Artificial Sequence
  chemically synthesized
ggtgaagttgcatcctttgg

SEQ ID NO: 19462 - DNA, 20 bp, Artificial Sequence
  chemically synthesized
gggtgaagttgcatcctttg

SEQ ID NO: 19463 - DNA, 20 bp, Artificial Sequence
  chemically synthesized
tgggtgaagttgcatccttt

SEQ ID NO: 19464 - DNA, 20 bp, Artificial Sequence
  chemically synthesized
ttgggtgaagttgcatcctt

SEQ ID NO: 19465 - DNA, 20 bp, Artificial Sequence
  chemically synthesized
aattccaagacagttgggtg

SEQ ID NO: 19466 - DNA, 20 bp, Artificial Sequence
  chemically synthesized
atccaaattccaagacagtt

SEQ ID NO: 19467 - DNA, 20 bp, Artificial Sequence
  chemically synthesized
gcaacttcacccaactgtct

SEQ ID NO: 19468 - DNA, 20 bp, Artificial Sequence
  chemically synthesized
tatccaaattccaagacagt

SEQ ID NO: 19469 - DNA, 20 bp, Artificial Sequence
  chemically synthesized
attctatccaaattccaaga

SEQ ID NO: 19470 - DNA, 20 bp, Artificial Sequence
  chemically synthesized
cacccaactgtcttggaatt

SEQ ID NO: 19471 - DNA, 20 bp, Artificial Sequence
  chemically synthesized
catgattctatccaaattcc

SEQ ID NO: 19472 - DNA, 20 bp, Artificial Sequence
  chemically synthesized
caactgtcttggaatttgga

SEQ ID NO: 19473 - DNA, 20 bp, Artificial Sequence
  chemically synthesized
ggaatttggatagaatcatg

SEQ ID NO: 19474 - DNA, 20 bp, Artificial Sequence
  chemically synthesized
atttggatagaatcatgcag

SEQ ID NO: 19475 - DNA, 20 bp, Artificial Sequence
  chemically synthesized
tttggatagaatcatgcaga

SEQ ID NO: 19476 - DNA, 20 bp, Artificial Sequence
  chemically synthesized
tggatagaatcatgcagaag

SEQ ID NO: 19477 - DNA, 20 bp, Artificial Sequence
  chemically synthesized
ggatagaatcatgcagaagg

SEQ ID NO: 19478 - DNA, 20 bp, Artificial Sequence
  chemically synthesized
gaatcatgcagaaggaggcc

SEQ ID NO: 19479 - DNA, 20 bp, Artificial Sequence
  chemically synthesized
ttttgtgaccagcgcaggct

SEQ ID NO: 19480 - DNA, 20 bp, Artificial Sequence
  chemically synthesized
attttgtgaccagcgcaggc

SEQ ID NO: 19481 - DNA, 20 bp, Artificial Sequence
  chemically synthesized
gaaggaggcccagcctgcgc

SEQ ID NO: 19482 - DNA, 20 bp, Artificial Sequence
  chemically synthesized
caggattttgtgaccagcgc

SEQ ID NO: 19483 - DNA, 20 bp, Artificial Sequence
  chemically synthesized
acaggattttgtgaccagcg

SEQ ID NO: 19484 - DNA, 20 bp, Artificial Sequence
  chemically synthesized
gttcaacaggattttgtgac

SEQ ID NO: 19485 - DNA, 20 bp, Artificial Sequence
  chemically synthesized
aagcaagtggcaagttcaac

SEQ ID NO: 19486 - DNA, 20 bp, Artificial Sequence
  chemically synthesized
caagcaagtggcaagttcaa

SEQ ID NO: 19487 - DNA, 20 bp, Artificial Sequence
  chemically synthesized
gaccttttcaagcaagtggc

SEQ ID NO: 19488 - DNA, 20 bp, Artificial Sequence
  chemically synthesized
tgtagaccttttcaagcaag

SEQ ID NO: 19489 - DNA, 20 bp, Artificial Sequence
  chemically synthesized
gaacttgccacttgcttgaa

SEQ ID NO: 19490 - DNA, 20 bp, Artificial Sequence
  chemically synthesized
ctttgtagaccttttcaagc

SEQ ID NO: 19491 - DNA, 20 bp, Artificial Sequence
  chemically synthesized
aacttgccacttgcttgaaa

SEQ ID NO: 19492 - DNA, 20 bp, Artificial Sequence
  chemically synthesized
cttcctttgtagaccttttc

SEQ ID NO: 19493 - DNA, 20 bp, Artificial Sequence
  chemically synthesized
cttgcttgaaaaggtctaca

SEQ ID NO: 19494 - DNA, 20 bp, Artificial Sequence
  chemically synthesized
ttgcttgaaaaggtctacaa

SEQ ID NO: 19495 - DNA, 20 bp, Artificial Sequence
  chemically synthesized
cttgaaaaggtctacaaagg

SEQ ID NO: 19496 - DNA, 20 bp, Artificial Sequence
  chemically synthesized
gcaattttcttcttcctttg

SEQ ID NO: 19497 - DNA, 20 bp, Artificial Sequence
  chemically synthesized
gaaaaggtctacaaaggaag

SEQ ID NO: 19498 - DNA, 20 bp, Artificial Sequence
  chemically synthesized
aaggaagaagaaaattgcaa

SEQ ID NO: 19499 - DNA, 20 bp, Artificial Sequence
  chemically synthesized
aaattgcaacagtcaaaaca

SEQ ID NO: 19500 - DNA, 20 bp, Artificial Sequence
  chemically synthesized
cagtcaaaacacagcaccca

SEQ ID NO: 19501 - DNA, 20 bp, Artificial Sequence
  chemically synthesized
caggttctgctggcatccat

SEQ ID NO: 19502 - DNA, 20 bp, Artificial Sequence
  chemically synthesized
aacacagcacccatggatgc

SEQ ID NO: 19503 - DNA, 20 bp, Artificial Sequence
  chemically synthesized
tcaggttctgctggcatcca

SEQ ID NO: 19504 - DNA, 20 bp, Artificial Sequence
  chemically synthesized
acagcacccatggatgccag

SEQ ID NO: 19505 - DNA, 20 bp, Artificial Sequence
  chemically synthesized
agttggatgtcaggttctgc

SEQ ID NO: 19506 - DNA, 20 bp, Artificial Sequence
  chemically synthesized
ctggaattgagttggatgtc

SEQ ID NO: 19507 - DNA, 20 bp, Artificial Sequence
  chemically synthesized
actggaattgagttggatgt

SEQ ID NO: 19508 - DNA, 20 bp, Artificial Sequence
  chemically synthesized
aattgctactggaattgagt

SEQ ID NO: 19509 - DNA, 20 bp, Artificial Sequence
  chemically synthesized
cctgacatccaactcaattc

SEQ ID NO: 19510 - DNA, 20 bp, Artificial Sequence
  chemically synthesized
tgagaattgctactggaatt

SEQ ID NO: 19511 - DNA, 20 bp, Artificial Sequence
  chemically synthesized
gacatccaactcaattccag

SEQ ID NO: 19512 - DNA, 20 bp, Artificial Sequence
  chemically synthesized
ctactcttgagaattgctac

SEQ ID NO: 19513 - DNA, 20 bp, Artificial Sequence
  chemically synthesized
caattccagtagcaattctc

SEQ ID NO: 19514 - DNA, 20 bp, Artificial Sequence
  chemically synthesized
attccagtagcaattctcaa

SEQ ID NO: 19515 - DNA, 20 bp, Artificial Sequence
  chemically synthesized
ccagtagcaattctcaagag

SEQ ID NO: 19516 - DNA, 20 bp, Artificial Sequence
  chemically synthesized
tggaaatactggctactctt

SEQ ID NO: 19517 - DNA, 20 bp, Artificial Sequence
  chemically synthesized
tagcaattctcaagagtagc

SEQ ID NO: 19518 - DNA, 20 bp, Artificial Sequence
  chemically synthesized
accccactctgtggaaatac

SEQ ID NO: 19519 - DNA, 20 bp, Artificial Sequence
  chemically synthesized
aagagtagccagtatttcca

SEQ ID NO: 19520 - DNA, 20 bp, Artificial Sequence
  chemically synthesized
gagtagccagtatttccaca

SEQ ID NO: 19521 - DNA, 20 bp, Artificial Sequence
  chemically synthesized
tagccagtatttccacagag

SEQ ID NO: 19522 - DNA, 20 bp, Artificial Sequence
  chemically synthesized
agccagtatttccacagagt

SEQ ID NO: 19523 - DNA, 20 bp, Artificial Sequence
  chemically synthesized
gccagtatttccacagagtg

SEQ ID NO: 19524 - DNA, 20 bp, Artificial Sequence
  chemically synthesized
ttagaagtaaccccactctg

SEQ ID NO: 19525 - DNA, 20 bp, Artificial Sequence
  chemically synthesized
tccagattagcacaaattag

SEQ ID NO: 19526 - DNA, 20 bp, Artificial Sequence
  chemically synthesized
atatccagattagcacaaat

SEQ ID NO: 19527 - DNA, 20 bp, Artificial Sequence
  chemically synthesized
acttctaatttgtgctaatc

SEQ ID NO: 19528 - DNA, 20 bp, Artificial Sequence
  chemically synthesized
aaaataataaatatccagat

SEQ ID NO: 19529 - DNA, 20 bp, Artificial Sequence
  chemically synthesized
tcataaaaataataaatatc

SEQ ID NO: 19530 - DNA, 20 bp, Artificial Sequence
  chemically synthesized
atttattatttttatgaatc

SEQ ID NO: 19531 - DNA, 20 bp, Artificial Sequence
  chemically synthesized
tatcacacttcatatatata

SEQ ID NO: 19532 - DNA, 20 bp, Artificial Sequence
  chemically synthesized
atgatcactgtatatatatg

SEQ ID NO: 19533 - DNA, 20 bp, Artificial Sequence
  chemically synthesized
cagtgacacagtttatgtaa

SEQ ID NO: 19534 - DNA, 20 bp, Artificial Sequence
  chemically synthesized
ttgcgcttcttgcagtgaca

SEQ ID NO: 19535 - DNA, 20 bp, Artificial Sequence
  chemically synthesized
tacataaactgtgtcactgc

SEQ ID NO: 19536 - DNA, 20 bp, Artificial Sequence
  chemically synthesized
ataaactgtgtcactgcaag

SEQ ID NO: 19537 - DNA, 20 bp, Artificial Sequence
  chemically synthesized
gtgtaagcttgcgcttcttg

SEQ ID NO: 19538 - DNA, 20 bp, Artificial Sequence
  chemically synthesized
tgtgtcactgcaagaagcgc

SEQ ID NO: 19539 - DNA, 20 bp, Artificial Sequence
  chemically synthesized
taagtgtcgagggtacgtgt

SEQ ID NO: 19540 - DNA, 20 bp, Artificial Sequence
  chemically synthesized
agaagaaatttaagtgtcga

SEQ ID NO: 19541 - DNA, 20 bp, Artificial Sequence
  chemically synthesized
tagaagaaatttaagtgtcg

SEQ ID NO: 19542 - DNA, 20 bp, Artificial Sequence
  chemically synthesized
ttagaagaaatttaagtgtc

SEQ ID NO: 19543 - DNA, 20 bp, Artificial Sequence
  chemically synthesized
ttctggcttagaagaaattt

SEQ ID NO: 19544 - DNA, 20 bp, Artificial Sequence
  chemically synthesized
tcgacacttaaatttcttct

SEQ ID NO: 19545 - DNA, 20 bp, Artificial Sequence
  chemically synthesized
cacttaaatttcttctaagc

SEQ ID NO: 19546 - DNA, 20 bp, Artificial Sequence
  chemically synthesized
aggattatgttctggcttag

SEQ ID NO: 19547 - DNA, 20 bp, Artificial Sequence
  chemically synthesized
ccaaggattatgttctggct

SEQ ID NO: 19548 - DNA, 20 bp, Artificial Sequence
  chemically synthesized
aattcccaaggattatgttc

SEQ ID NO: 19549 - DNA, 20 bp, Artificial Sequence
  chemically synthesized
ctaagccagaacataatcct

SEQ ID NO: 19550 - DNA, 20 bp, Artificial Sequence
  chemically synthesized
taagccagaacataatcctt

SEQ ID NO: 19551 - DNA, 20 bp, Artificial Sequence
  chemically synthesized
cctatatacaataattccca

SEQ ID NO: 19552 - DNA, 20 bp, Artificial Sequence
  chemically synthesized
tcctatatacaataattccc

SEQ ID NO: 19553 - DNA, 20 bp, Artificial Sequence
  chemically synthesized
tccttgggaattattgtata

SEQ ID NO: 19554 - DNA, 20 bp, Artificial Sequence
  chemically synthesized
ccttgggaattattgtatat

SEQ ID NO: 19555 - DNA, 20 bp, Artificial Sequence
  chemically synthesized
aaaacacttattttttgatg

SEQ ID NO: 19556 - DNA, 20 bp, Artificial Sequence
  chemically synthesized
atgtaactacatcaaaaaat

SEQ ID NO: 19557 - DNA, 20 bp, Artificial Sequence
  chemically synthesized
acatcaaaaaataagtgttt

SEQ ID NO: 19558 - DNA, 20 bp, Artificial Sequence
  chemically synthesized
aaaataagtgttttagcatt

SEQ ID NO: 19559 - DNA, 20 bp, Artificial Sequence
  chemically synthesized
aataagtgttttagcattaa

SEQ ID NO: 19560 - DNA, 20 bp, Artificial Sequence
  chemically synthesized
agcattaagagacatataac

SEQ ID NO: 19561 - DNA, 20 bp, Artificial Sequence
  chemically synthesized
agagacatataactggccca

SEQ ID NO: 19562 - DNA, 20 bp, Artificial Sequence
  chemically synthesized
aggagggtggtgctttgggc

SEQ ID NO: 19563 - DNA, 20 bp, Artificial Sequence
  chemically synthesized
tccaaggagggtggtgcttt

SEQ ID NO: 19564 - DNA, 20 bp, Artificial Sequence
  chemically synthesized
gtccaaggagggtggtgctt

SEQ ID NO: 19565 - DNA, 20 bp, Artificial Sequence
  chemically synthesized
gcccaaagcaccaccctcct

SEQ ID NO: 19566 - DNA, 20 bp, Artificial Sequence
  chemically synthesized
tctctggtgtccaaggaggg

SEQ ID NO: 19567 - DNA, 20 bp, Artificial Sequence
  chemically synthesized
gaatctctggtgtccaagga

SEQ ID NO: 19568 - DNA, 20 bp, Artificial Sequence
  chemically synthesized
tgaatctctggtgtccaagg

SEQ ID NO: 19569 - DNA, 20 bp, Artificial Sequence
  chemically synthesized
ttgaatctctggtgtccaag

SEQ ID NO: 19570 - DNA, 20 bp, Artificial Sequence
  chemically synthesized
gcaccaccctccttggacac

SEQ ID NO: 19571 - DNA, 20 bp, Artificial Sequence
  chemically synthesized
ttttgaatctctggtgtcca

SEQ ID NO: 19572 - DNA, 20 bp, Artificial Sequence
  chemically synthesized
tttttgaatctctggtgtcc

SEQ ID NO: 19573 - DNA, 20 bp, Artificial Sequence
  chemically synthesized
accaccctccttggacacca

SEQ ID NO: 19574 - DNA, 20 bp, Artificial Sequence
  chemically synthesized
gtggtacatttttgaatctc

SEQ ID NO: 19575 - DNA, 20 bp, Artificial Sequence
  chemically synthesized
agagattcaaaaatgtacca

SEQ ID NO: 19576 - DNA, 20 bp, Artificial Sequence
  chemically synthesized
attcaaaaatgtaccacagt

SEQ ID NO: 19577 - DNA, 20 bp, Artificial Sequence
  chemically synthesized
ttcaaaaatgtaccacagtt

SEQ ID NO: 19578 - DNA, 20 bp, Artificial Sequence
  chemically synthesized
ccataaagaagtcccaactg

SEQ ID NO: 19579 - DNA, 20 bp, Artificial Sequence
  chemically synthesized
ccacagttgggacttcttta

SEQ ID NO: 19580 - DNA, 20 bp, Artificial Sequence
  chemically synthesized
acagttgggacttctttatg

SEQ ID NO: 19581 - DNA, 20 bp, Artificial Sequence
  chemically synthesized
gatcttatgactccataaag

SEQ ID NO: 19582 - DNA, 20 bp, Artificial Sequence
  chemically synthesized
agtgatcttatgactccata

SEQ ID NO: 19583 - DNA, 20 bp, Artificial Sequence
  chemically synthesized
ggacttctttatggagtcat

SEQ ID NO: 19584 - DNA, 20 bp, Artificial Sequence
  chemically synthesized
tatggagtcataagatcact

SEQ ID NO: 19585 - DNA, 20 bp, Artificial Sequence
  chemically synthesized
tcataagatcactgagcttc

SEQ ID NO: 19586 - DNA, 20 bp, Artificial Sequence
  chemically synthesized
tacatgatggactagaagct

SEQ ID NO: 19587 - DNA, 20 bp, Artificial Sequence
  chemically synthesized
acacatacatgatggactag

SEQ ID NO: 19588 - DNA, 20 bp, Artificial Sequence
  chemically synthesized
ggaacacatacatgatggac

SEQ ID NO: 19589 - DNA, 20 bp, Artificial Sequence
  chemically synthesized
ctgtgggaacacatacatga

SEQ ID NO: 19590 - DNA, 20 bp, Artificial Sequence
  chemically synthesized
ccatcatgtatgtgttccca

SEQ ID NO: 19591 - DNA, 20 bp, Artificial Sequence
  chemically synthesized
catcatgtatgtgttcccac

SEQ ID NO: 19592 - DNA, 20 bp, Artificial Sequence
  chemically synthesized
aactatgcacagtatcctgt

SEQ ID NO: 19593 - DNA, 20 bp, Artificial Sequence
  chemically synthesized
aaactatgcacagtatcctg

SEQ ID NO: 19594 - DNA, 20 bp, Artificial Sequence
  chemically synthesized
ttcccacaggatactgtgca

SEQ ID NO: 19595 - DNA, 20 bp, Artificial Sequence
  chemically synthesized
caacaacaacaaactatgca

SEQ ID NO: 19596 - DNA, 20 bp, Artificial Sequence
  chemically synthesized
tgttgttgttgttgtttttt

SEQ ID NO: 19597 - DNA, 20 bp, Artificial Sequence
  chemically synthesized
gttgttgttgttttttgaga

SEQ ID NO: 19598 - DNA, 20 bp, Artificial Sequence
  chemically synthesized
tgttgttgttttttgagacg

SEQ ID NO: 19599 - DNA, 20 bp, Artificial Sequence
  chemically synthesized
tgcagcctgggcgacagagc

SEQ ID NO: 19600 - DNA, 20 bp, Artificial Sequence
  chemically synthesized
cggagtcttgctctgtcgcc

SEQ ID NO: 19601 - DNA, 20 bp, Artificial Sequence
  chemically synthesized
gcactgcagcctgggcgaca

SEQ ID NO: 19602 - DNA, 20 bp, Artificial Sequence
  chemically synthesized
ggagtcttgctctgtcgccc

SEQ ID NO: 19603 - DNA, 20 bp, Artificial Sequence
  chemically synthesized
ctgcactgcagcctgggcga

SEQ ID NO: 19604 - DNA, 20 bp, Artificial Sequence
  chemically synthesized
ttgctctgtcgcccaggctg

SEQ ID NO: 19605 - DNA, 20 bp, Artificial Sequence
  chemically synthesized
gcaccactgcactgcagcct

SEQ ID NO: 19606 - DNA, 20 bp, Artificial Sequence
  chemically synthesized
cgcaccactgcactgcagcc

SEQ ID NO: 19607 - DNA, 20 bp, Artificial Sequence
  chemically synthesized
ctgtcgcccaggctgcagtg

SEQ ID NO: 19608 - DNA, 20 bp, Artificial Sequence
  chemically synthesized
gagatcgcaccactgcactg

SEQ ID NO: 19609 - DNA, 20 bp, Artificial Sequence
  chemically synthesized
tcgcccaggctgcagtgcag

SEQ ID NO: 19610 - DNA, 20 bp, Artificial Sequence
  chemically synthesized
ggcagaggttgcggtgagca

SEQ ID NO: 19611 - DNA, 20 bp, Artificial Sequence
  chemically synthesized
gaggcagaggttgcggtgag

SEQ ID NO: 19612 - DNA, 20 bp, Artificial Sequence
  chemically synthesized
cgggaggcagaggttgcggt

SEQ ID NO: 19613 - DNA, 20 bp, Artificial Sequence
  chemically synthesized
aacccgggaggcagaggttg

SEQ ID NO: 19614 - DNA, 20 bp, Artificial Sequence
  chemically synthesized
ggcttgaacccgggaggcag

SEQ ID NO: 19615 - DNA, 20 bp, Artificial Sequence
  chemically synthesized
tcaccgcaacctctgcctcc

SEQ ID NO: 19616 - DNA, 20 bp, Artificial Sequence
  chemically synthesized
tggcttgaacccgggaggca

SEQ ID NO: 19617 - DNA, 20 bp, Artificial Sequence
  chemically synthesized
caccgcaacctctgcctccc

SEQ ID NO: 19618 - DNA, 20 bp, Artificial Sequence
  chemically synthesized
aatggcttgaacccgggagg

SEQ ID NO: 19619 - DNA, 20 bp, Artificial Sequence
  chemically synthesized
gagaatggcttgaacccggg

SEQ ID NO: 19620 - DNA, 20 bp, Artificial Sequence
  chemically synthesized
ggagaatggcttgaacccgg

SEQ ID NO: 19621 - DNA, 20 bp, Artificial Sequence
  chemically synthesized
aacctctgcctcccgggttc

SEQ ID NO: 19622 - DNA, 20 bp, Artificial Sequence
  chemically synthesized
caggagaatggcttgaaccc

SEQ ID NO: 19623 - DNA, 20 bp, Artificial Sequence
  chemically synthesized
gcaggagaatggcttgaacc

SEQ ID NO: 19624 - DNA, 20 bp, Artificial Sequence
  chemically synthesized
aggcggctgaggcaggagaa

SEQ ID NO: 19625 - DNA, 20 bp, Artificial Sequence
  chemically synthesized
ttcaagccattctcctgcct

SEQ ID NO: 19626 - DNA, 20 bp, Artificial Sequence
  chemically synthesized
tactcaggcggctgaggcag

SEQ ID NO: 19627 - DNA, 20 bp, Artificial Sequence
  chemically synthesized
gctactcaggcggctgaggc

SEQ ID NO: 19628 - DNA, 20 bp, Artificial Sequence
  chemically synthesized
agctactcaggcggctgagg

SEQ ID NO: 19629 - DNA, 20 bp, Artificial Sequence
  chemically synthesized
cgcagctactcaggcggctg

SEQ ID NO: 19630 - DNA, 20 bp, Artificial Sequence
  chemically synthesized
tcgcagctactcaggcggct

SEQ ID NO: 19631 - DNA, 20 bp, Artificial Sequence
  chemically synthesized
ttctcctgcctcagccgcct

SEQ ID NO: 19632 - DNA, 20 bp, Artificial Sequence
  chemically synthesized
tcctgcctcagccgcctgag

SEQ ID NO: 19633 - DNA, 20 bp, Artificial Sequence
  chemically synthesized
tgtaatcgcagctactcagg

SEQ ID NO: 19634 - DNA, 20 bp, Artificial Sequence
  chemically synthesized
gcctgtaatcgcagctactc

SEQ ID NO: 19635 - DNA, 20 bp, Artificial Sequence
  chemically synthesized
tgcctgtaatcgcagctact

SEQ ID NO: 19636 - DNA, 20 bp, Artificial Sequence
  chemically synthesized
cgcctgagtagctgcgatta

SEQ ID NO: 19637 - DNA, 20 bp, Artificial Sequence
  chemically synthesized
gcctgagtagctgcgattac

SEQ ID NO: 19638 - DNA, 20 bp, Artificial Sequence
  chemically synthesized
atggcatgtgcctgtaatcg

SEQ ID NO: 19639 - DNA, 20 bp, Artificial Sequence
  chemically synthesized
caggcacatgccatcacacc

SEQ ID NO: 19640 - DNA, 20 bp, Artificial Sequence
  chemically synthesized
caaaaattagctgggtgtga

SEQ ID NO: 19641 - DNA, 20 bp, Artificial Sequence
  chemically synthesized
taaaaatacaaaaattagct

SEQ ID NO: 19642 - DNA, 20 bp, Artificial Sequence
  chemically synthesized
gtaaaaatacaaaaattagc

SEQ ID NO: 19643 - DNA, 20 bp, Artificial Sequence
  chemically synthesized
tccagtaaaaatacaaaaat

SEQ ID NO: 19644 - DNA, 20 bp, Artificial Sequence
  chemically synthesized
gctaatttttgtatttttac

SEQ ID NO: 19645 - DNA, 20 bp, Artificial Sequence
  chemically synthesized
taatttttgtatttttactg

SEQ ID NO: 19646 - DNA, 20 bp, Artificial Sequence
  chemically synthesized
atcatggtgaaacacgtctc

SEQ ID NO: 19647 - DNA, 20 bp, Artificial Sequence
  chemically synthesized
ggagacgtgtttcaccatga

SEQ ID NO: 19648 - DNA, 20 bp, Artificial Sequence
  chemically synthesized
acgtgtttcaccatgatggc

SEQ ID NO: 19649 - DNA, 20 bp, Artificial Sequence
  chemically synthesized
caagaccagcctggccatca

SEQ ID NO: 19650 - DNA, 20 bp, Artificial Sequence
  chemically synthesized
cgtgtttcaccatgatggcc

SEQ ID NO: 19651 - DNA, 20 bp, Artificial Sequence
  chemically synthesized
tttcaccatgatggccaggc

SEQ ID NO: 19652 - DNA, 20 bp, Artificial Sequence
  chemically synthesized
tcaggagttcaagaccagcc

SEQ ID NO: 19653 - DNA, 20 bp, Artificial Sequence
  chemically synthesized
tgaggtcaggagttcaagac

SEQ ID NO: 19654 - DNA, 20 bp, Artificial Sequence
  chemically synthesized
tcacttgaggtcaggagttc

SEQ ID NO: 19655 - DNA, 20 bp, Artificial Sequence
  chemically synthesized
ggaggatcacttgaggtcag

SEQ ID NO: 19656 - DNA, 20 bp, Artificial Sequence
  chemically synthesized
ggtcttgaactcctgacctc

SEQ ID NO: 19657 - DNA, 20 bp, Artificial Sequence
  chemically synthesized
taggaggatcacttgaggtc

SEQ ID NO: 19658 - DNA, 20 bp, Artificial Sequence
  chemically synthesized
gtaggaggatcacttgaggt

SEQ ID NO: 19659 - DNA, 20 bp, Artificial Sequence
  chemically synthesized
cgaggtaggaggatcacttg

SEQ ID NO: 19660 - DNA, 20 bp, Artificial Sequence
  chemically synthesized
ccgaggtaggaggatcactt

SEQ ID NO: 19661 - DNA, 20 bp, Artificial Sequence
  chemically synthesized
ctcaagtgatcctcctacct

SEQ ID NO: 19662 - DNA, 20 bp, Artificial Sequence
  chemically synthesized
cttagggaggccgaggtagg

SEQ ID NO: 19663 - DNA, 20 bp, Artificial Sequence
  chemically synthesized
acttagggaggccgaggtag

SEQ ID NO: 19664 - DNA, 20 bp, Artificial Sequence
  chemically synthesized
gcacttagggaggccgaggt

SEQ ID NO: 19665 - DNA, 20 bp, Artificial Sequence
  chemically synthesized
agcacttagggaggccgagg

SEQ ID NO: 19666 - DNA, 20 bp, Artificial Sequence
  chemically synthesized
cccagcacttagggaggccg

SEQ ID NO: 19667 - DNA, 20 bp, Artificial Sequence
  chemically synthesized
tcccagcacttagggaggcc

SEQ ID NO: 19668 - DNA, 20 bp, Artificial Sequence
  chemically synthesized
cctcctacctcggcctccct

SEQ ID NO: 19669 - DNA, 20 bp, Artificial Sequence
  chemically synthesized
tgtaatcccagcacttaggg

SEQ ID NO: 19670 - DNA, 20 bp, Artificial Sequence
  chemically synthesized
ctgtaatcccagcacttagg

SEQ ID NO: 19671 - DNA, 20 bp, Artificial Sequence
  chemically synthesized
acctcggcctccctaagtgc

SEQ ID NO: 19672 - DNA, 20 bp, Artificial Sequence
  chemically synthesized
acctgtaatcccagcactta

SEQ ID NO: 19673 - DNA, 20 bp, Artificial Sequence
  chemically synthesized
cctcggcctccctaagtgct

SEQ ID NO: 19674 - DNA, 20 bp, Artificial Sequence
  chemically synthesized
cacctgtaatcccagcactt

SEQ ID NO: 19675 - DNA, 20 bp, Artificial Sequence
  chemically synthesized
acacctgtaatcccagcact

SEQ ID NO: 19676 - DNA, 20 bp, Artificial Sequence
  chemically synthesized
ctccctaagtgctgggatta

SEQ ID NO: 19677 - DNA, 20 bp, Artificial Sequence
  chemically synthesized
tccctaagtgctgggattac

SEQ ID NO: 19678 - DNA, 20 bp, Artificial Sequence
  chemically synthesized
gtagctcacacctgtaatcc

SEQ ID NO: 19679 - DNA, 20 bp, Artificial Sequence
  chemically synthesized
agtgctgggattacaggtgt

SEQ ID NO: 19680 - DNA, 20 bp, Artificial Sequence
  chemically synthesized
caggtgtgagctactgcgcc

SEQ ID NO: 19681 - DNA, 20 bp, Artificial Sequence
  chemically synthesized
aaatacgcagccaggcgcag

SEQ ID NO: 19682 - DNA, 20 bp, Artificial Sequence
  chemically synthesized
tagaaatacgcagccaggcg

SEQ ID NO: 19683 - DNA, 20 bp, Artificial Sequence
  chemically synthesized
ttaattagaaatacgcagcc

SEQ ID NO: 19684 - DNA, 20 bp, Artificial Sequence
  chemically synthesized
attaattagaaatacgcagc

SEQ ID NO: 19685 - DNA, 20 bp, Artificial Sequence
  chemically synthesized
agctattaattagaaatacg

SEQ ID NO: 19686 - DNA, 20 bp, Artificial Sequence
  chemically synthesized
ggctgcgtatttctaattaa

SEQ ID NO: 19687 - DNA, 20 bp, Artificial Sequence
  chemically synthesized
acatgatgtgagctattaat

SEQ ID NO: 19688 - DNA, 20 bp, Artificial Sequence
  chemically synthesized
atgccagcataacatgatgt

SEQ ID NO: 19689 - DNA, 20 bp, Artificial Sequence
  chemically synthesized
tagctcacatcatgttatgc

SEQ ID NO: 19690 - DNA, 20 bp, Artificial Sequence
  chemically synthesized
gacacatattgaatcaatgc

SEQ ID NO: 19691 - DNA, 20 bp, Artificial Sequence
  chemically synthesized
caatatgtgtctatcgtttt

SEQ ID NO: 19692 - DNA, 20 bp, Artificial Sequence
  chemically synthesized
aagtctcctgccaaaaacga

SEQ ID NO: 19693 - DNA, 20 bp, Artificial Sequence
  chemically synthesized
tatgtgtctatcgtttttgg

SEQ ID NO: 19694 - DNA, 20 bp, Artificial Sequence
  chemically synthesized
atgtgtctatcgtttttggc

SEQ ID NO: 19695 - DNA, 20 bp, Artificial Sequence
  chemically synthesized
gtgtctatcgtttttggcag

SEQ ID NO: 19696 - DNA, 20 bp, Artificial Sequence
  chemically synthesized
tccttccctcaaggggatat

SEQ ID NO: 19697 - DNA, 20 bp, Artificial Sequence
  chemically synthesized
caggagacttatatcccctt

SEQ ID NO: 19698 - DNA, 20 bp, Artificial Sequence
  chemically synthesized
aggagacttatatccccttg

SEQ ID NO: 19699 - DNA, 20 bp, Artificial Sequence
  chemically synthesized
ggagacttatatccccttga

SEQ ID NO: 19700 - DNA, 20 bp, Artificial Sequence
  chemically synthesized
atatggttccttccctcaag

SEQ ID NO: 19701 - DNA, 20 bp, Artificial Sequence
  chemically synthesized
gacttatatccccttgaggg

SEQ ID NO: 19702 - DNA, 20 bp, Artificial Sequence
  chemically synthesized
gatatggttccttccctcaa

SEQ ID NO: 19703 - DNA, 20 bp, Artificial Sequence
  chemically synthesized
acttatatccccttgaggga

SEQ ID NO: 19704 - DNA, 20 bp, Artificial Sequence
  chemically synthesized
agatatggttccttccctca

SEQ ID NO: 19705 - DNA, 20 bp, Artificial Sequence
  chemically synthesized
aagatatggttccttccctc

SEQ ID NO: 19706 - DNA, 20 bp, Artificial Sequence
  chemically synthesized
tgagggaaggaaccatatct

SEQ ID NO: 19707 - DNA, 20 bp, Artificial Sequence
  chemically synthesized
gcacacaactgaccaagata

SEQ ID NO: 19708 - DNA, 20 bp, Artificial Sequence
  chemically synthesized
ggaaggaaccatatcttggt

SEQ ID NO: 19709 - DNA, 20 bp, Artificial Sequence
  chemically synthesized
cttctggcacacaactgacc

SEQ ID NO: 19710 - DNA, 20 bp, Artificial Sequence
  chemically synthesized
tatcttggtcagttgtgtgc

SEQ ID NO: 19711 - DNA, 20 bp, Artificial Sequence
  chemically synthesized
cttggtcagttgtgtgccag

SEQ ID NO: 19712 - DNA, 20 bp, Artificial Sequence
  chemically synthesized
cattctactgtagatacttc

SEQ ID NO: 19713 - DNA, 20 bp, Artificial Sequence
  chemically synthesized
ttgtgtgccagaagtatcta

SEQ ID NO: 19714 - DNA, 20 bp, Artificial Sequence
  chemically synthesized
tgtgccagaagtatctacag

SEQ ID NO: 19715 - DNA, 20 bp, Artificial Sequence
  chemically synthesized
cgggtactgccattctactg

SEQ ID NO: 19716 - DNA, 20 bp, Artificial Sequence
  chemically synthesized
cagaagtatctacagtagaa

SEQ ID NO: 19717 - DNA, 20 bp, Artificial Sequence
  chemically synthesized
aagtatctacagtagaatgg

SEQ ID NO: 19718 - DNA, 20 bp, Artificial Sequence
  chemically synthesized
tacagtagaatggcagtacc

SEQ ID NO: 19719 - DNA, 20 bp, Artificial Sequence
  chemically synthesized
agtagaatggcagtacccgg

SEQ ID NO: 19720 - DNA, 20 bp, Artificial Sequence
  chemically synthesized
gaatggcagtacccggtgga

SEQ ID NO: 19721 - DNA, 20 bp, Artificial Sequence
  chemically synthesized
ttgggcacctactatccacc

SEQ ID NO: 19722 - DNA, 20 bp, Artificial Sequence
  chemically synthesized
attgggcacctactatccac

SEQ ID NO: 19723 - DNA, 20 bp, Artificial Sequence
  chemically synthesized
tggcagtacccggtggatag

SEQ ID NO: 19724 - DNA, 20 bp, Artificial Sequence
  chemically synthesized
ggcagtacccggtggatagt

SEQ ID NO: 19725 - DNA, 20 bp, Artificial Sequence
  chemically synthesized
ttcattctgttacatatatt

SEQ ID NO: 19726 - DNA, 20 bp, Artificial Sequence
  chemically synthesized
attcattctgttacatatat

SEQ ID NO: 19727 - DNA, 20 bp, Artificial Sequence
  chemically synthesized
taggtgcccaatatatgtaa

SEQ ID NO: 19728 - DNA, 20 bp, Artificial Sequence
  chemically synthesized
aacataacattgcaagcatt

SEQ ID NO: 19729 - DNA, 20 bp, Artificial Sequence
  chemically synthesized
agaacaaaacataacattgc

SEQ ID NO: 19730 - DNA, 20 bp, Artificial Sequence
  chemically synthesized
gcaatgttatgttttgttct

SEQ ID NO: 19731 - DNA, 20 bp, Artificial Sequence
  chemically synthesized
atgattaaaattttatatct

SEQ ID NO: 19732 - DNA, 20 bp, Artificial Sequence
  chemically synthesized
gcaacttctaggtgaatata

SEQ ID NO: 19733 - DNA, 20 bp, Artificial Sequence
  chemically synthesized
ggcaacttctaggtgaatat

SEQ ID NO: 19734 - DNA, 20 bp, Artificial Sequence
  chemically synthesized
aatcataccttatattcacc

SEQ ID NO: 19735 - DNA, 20 bp, Artificial Sequence
  chemically synthesized
cataccttatattcacctag

SEQ ID NO: 19736 - DNA, 20 bp, Artificial Sequence
  chemically synthesized
ttttttgaggggcaacttct

SEQ ID NO: 19737 - DNA, 20 bp, Artificial Sequence
  chemically synthesized
tttttttgaggggcaacttc

SEQ ID NO: 19738 - DNA, 20 bp, Artificial Sequence
  chemically synthesized
ttggatttactttttttgag

SEQ ID NO: 19739 - DNA, 20 bp, Artificial Sequence
  chemically synthesized
tagaagttgcccctcaaaaa

SEQ ID NO: 19740 - DNA, 20 bp, Artificial Sequence
  chemically synthesized
cttggatttactttttttga

SEQ ID NO: 19741 - DNA, 20 bp, Artificial Sequence
  chemically synthesized
tcttggatttactttttttg

SEQ ID NO: 19742 - DNA, 20 bp, Artificial Sequence
  chemically synthesized
ttcttggatttacttttttt

SEQ ID NO: 19743 - DNA, 20 bp, Artificial Sequence
  chemically synthesized
ccctcaaaaaaagtaaatcc

SEQ ID NO: 19744 - DNA, 20 bp, Artificial Sequence
  chemically synthesized
caaaaaaagtaaatccaaga

SEQ ID NO: 19745 - DNA, 20 bp, Artificial Sequence
  chemically synthesized
atgggtacagaaagctttct

SEQ ID NO: 19746 - DNA, 20 bp, Artificial Sequence
  chemically synthesized
agtgtgcttatgggtacaga

SEQ ID NO: 19747 - DNA, 20 bp, Artificial Sequence
  chemically synthesized
agaaagctttctgtacccat

SEQ ID NO: 19748 - DNA, 20 bp, Artificial Sequence
  chemically synthesized
ttaaagtgtgcttatgggta

SEQ ID NO: 19749 - DNA, 20 bp, Artificial Sequence
  chemically synthesized
agagtttaaagtgtgcttat

SEQ ID NO: 19750 - DNA, 20 bp, Artificial Sequence
  chemically synthesized
tagagtttaaagtgtgctta

SEQ ID NO: 19751 - DNA, 20 bp, Artificial Sequence
  chemically synthesized
cataagcacactttaaactc

SEQ ID NO: 19752 - DNA, 20 bp, Artificial Sequence
  chemically synthesized
atttaatttcctagagttta

SEQ ID NO: 19753 - DNA, 20 bp, Artificial Sequence
  chemically synthesized
ataagcacactttaaactct

SEQ ID NO: 19754 - DNA, 20 bp, Artificial Sequence
  chemically synthesized
ttaaaacatttaatttccta

SEQ ID NO: 19755 - DNA, 20 bp, Artificial Sequence
  chemically synthesized
tgttaaaacatttaatttcc

SEQ ID NO: 19756 - DNA, 20 bp, Artificial Sequence
  chemically synthesized
taggaaattaaatgttttaa

SEQ ID NO: 19757 - DNA, 20 bp, Artificial Sequence
  chemically synthesized
aggaaattaaatgttttaac

SEQ ID NO: 19758 - DNA, 20 bp, Artificial Sequence
  chemically synthesized
aatgttttaacaggatacct

SEQ ID NO: 19759 - DNA, 20 bp, Artificial Sequence
  chemically synthesized
ttttaacaggatacctaaga

SEQ ID NO: 19760 - DNA, 20 bp, Artificial Sequence
  chemically synthesized
tcaatttttagtgccatctt

SEQ ID NO: 19761 - DNA, 20 bp, Artificial Sequence
  chemically synthesized
ctcaatttttagtgccatct

SEQ ID NO: 19762 - DNA, 20 bp, Artificial Sequence
  chemically synthesized
ctaagatggcactaaaaatt

SEQ ID NO: 19763 - DNA, 20 bp, Artificial Sequence
  chemically synthesized
gtgcgtacaatctcaatttt

SEQ ID NO: 19764 - DNA, 20 bp, Artificial Sequence
  chemically synthesized
aaaaattgagattgtacgca

SEQ ID NO: 19765 - DNA, 20 bp, Artificial Sequence
  chemically synthesized
tatatcggagagcagataaa

SEQ ID NO: 19766 - DNA, 20 bp, Artificial Sequence
  chemically synthesized
taggtatgtatatcggagag

SEQ ID NO: 19767 - DNA, 20 bp, Artificial Sequence
  chemically synthesized
acctaggtatgtatatcgga

SEQ ID NO: 19768 - DNA, 20 bp, Artificial Sequence
  chemically synthesized
acacctaggtatgtatatcg

SEQ ID NO: 19769 - DNA, 20 bp, Artificial Sequence
  chemically synthesized
aaacacctaggtatgtatat

SEQ ID NO: 19770 - DNA, 20 bp, Artificial Sequence
  chemically synthesized
tgctctccgatatacatacc

SEQ ID NO: 19771 - DNA, 20 bp, Artificial Sequence
  chemically synthesized
gctctccgatatacatacct

SEQ ID NO: 19772 - DNA, 20 bp, Artificial Sequence
  chemically synthesized
aactttgaaaataaacacct

SEQ ID NO: 19773 - DNA, 20 bp, Artificial Sequence
  chemically synthesized
taactttgaaaataaacacc

SEQ ID NO: 19774 - DNA, 20 bp, Artificial Sequence
  chemically synthesized
tacctaggtgtttattttca

SEQ ID NO: 19775 - DNA, 20 bp, Artificial Sequence
  chemically synthesized
gtgtttattttcaaagttat

SEQ ID NO: 19776 - DNA, 20 bp, Artificial Sequence
  chemically synthesized
atgcaaaatgagatgtttga

SEQ ID NO: 19777 - DNA, 20 bp, Artificial Sequence
  chemically synthesized
aaaaatattaaatgcaaaat

SEQ ID NO: 19778 - DNA, 20 bp, Artificial Sequence
  chemically synthesized
gagggaacatgtttttaggt

SEQ ID NO: 19779 - DNA, 20 bp, Artificial Sequence
  chemically synthesized
ctaagagggaacatgttttt

SEQ ID NO: 19780 - DNA, 20 bp, Artificial Sequence
  chemically synthesized
actaagagggaacatgtttt

SEQ ID NO: 19781 - DNA, 20 bp, Artificial Sequence
  chemically synthesized
cctaaaaacatgttccctct

SEQ ID NO: 19782 - DNA, 20 bp, Artificial Sequence
  chemically synthesized
aaaaacatgttccctcttag

SEQ ID NO: 19783 - DNA, 20 bp, Artificial Sequence
  chemically synthesized
gtttcgaataactactaaga

SEQ ID NO: 19784 - DNA, 20 bp, Artificial Sequence
  chemically synthesized
tgtttcgaataactactaag

SEQ ID NO: 19785 - DNA, 20 bp, Artificial Sequence
  chemically synthesized
gtgtttcgaataactactaa

SEQ ID NO: 19786 - DNA, 20 bp, Artificial Sequence
  chemically synthesized
tggtgtttcgaataactact

SEQ ID NO: 19787 - DNA, 20 bp, Artificial Sequence
  chemically synthesized
ttattcgaaacaccaactca

SEQ ID NO: 19788 - DNA, 20 bp, Artificial Sequence
  chemically synthesized
taattgaggaagctttgagt

SEQ ID NO: 19789 - DNA, 20 bp, Artificial Sequence
  chemically synthesized
tgaataattgaggaagcttt

SEQ ID NO: 19790 - DNA, 20 bp, Artificial Sequence
  chemically synthesized
attaaattgaataattgagg

SEQ ID NO: 19791 - DNA, 20 bp, Artificial Sequence
  chemically synthesized
aatattaaattgaataattg

SEQ ID NO: 19792 - DNA, 20 bp, Artificial Sequence
  chemically synthesized
taatattaaattgaataatt

SEQ ID NO: 19793 - DNA, 20 bp, Artificial Sequence
  chemically synthesized
ccgtatatatggtatagtga

SEQ ID NO: 19794 - DNA, 20 bp, Artificial Sequence
  chemically synthesized
aatctaccgtatatatggta

SEQ ID NO: 19795 - DNA, 20 bp, Artificial Sequence
  chemically synthesized
ctgtcactataccatatata

SEQ ID NO: 19796 - DNA, 20 bp, Artificial Sequence
  chemically synthesized
gttctaatctaccgtatata

SEQ ID NO: 19797 - DNA, 20 bp, Artificial Sequence
  chemically synthesized
tcactataccatatatacgg

SEQ ID NO: 19798 - DNA, 20 bp, Artificial Sequence
  chemically synthesized
ataccatatatacggtagat

SEQ ID NO: 19799 - DNA, 20 bp, Artificial Sequence
  chemically synthesized
gtagttacttagtataggtt

SEQ ID NO: 19800 - DNA, 20 bp, Artificial Sequence
  chemically synthesized
tgtagttacttagtataggt

SEQ ID NO: 19801 - DNA, 20 bp, Artificial Sequence
  chemically synthesized
attagaacctaacctatact

SEQ ID NO: 19802 - DNA, 20 bp, Artificial Sequence
  chemically synthesized
atattgtagttacttagtat

SEQ ID NO: 19803 - DNA, 20 bp, Artificial Sequence
  chemically synthesized
aatattgtagttacttagta

SEQ ID NO: 19804 - DNA, 20 bp, Artificial Sequence
  chemically synthesized
ctttaaatattgtagttact

SEQ ID NO: 19805 - DNA, 20 bp, Artificial Sequence
  chemically synthesized
cttttctcctttaaatattg

SEQ ID NO: 19806 - DNA, 20 bp, Artificial Sequence
  chemically synthesized
ctaagtaactacaatattta

SEQ ID NO: 19807 - DNA, 20 bp, Artificial Sequence
  chemically synthesized
taagtaactacaatatttaa

SEQ ID NO: 19808 - DNA, 20 bp, Artificial Sequence
  chemically synthesized
agtaactacaatatttaaag

SEQ ID NO: 19809 - DNA, 20 bp, Artificial Sequence
  chemically synthesized
ctacaatatttaaaggagaa

SEQ ID NO: 19810 - DNA, 20 bp, Artificial Sequence
  chemically synthesized
atttaaaggagaaaagcaca

SEQ ID NO: 19811 - DNA, 20 bp, Artificial Sequence
  chemically synthesized
tttaaaggagaaaagcacac

SEQ ID NO: 19812 - DNA, 20 bp, Artificial Sequence
  chemically synthesized
aaatgtatttcggatgagat

SEQ ID NO: 19813 - DNA, 20 bp, Artificial Sequence
  chemically synthesized
aaaatgtatttcggatgaga

SEQ ID NO: 19814 - DNA, 20 bp, Artificial Sequence
  chemically synthesized
ttttaaaatgtatttcggat

SEQ ID NO: 19815 - DNA, 20 bp, Artificial Sequence
  chemically synthesized
aaccattttaaaatgtattt

SEQ ID NO: 19816 - DNA, 20 bp, Artificial Sequence
  chemically synthesized
atccgaaatacattttaaaa

SEQ ID NO: 19817 - DNA, 20 bp, Artificial Sequence
  chemically synthesized
cattttaaaatggttaacaa

SEQ ID NO: 19818 - DNA, 20 bp, Artificial Sequence
  chemically synthesized
aatggttaacaaaagctgtt

SEQ ID NO: 19819 - DNA, 20 bp, Artificial Sequence
  chemically synthesized
acgagagaaaaataactgaa

SEQ ID NO: 19820 - DNA, 20 bp, Artificial Sequence
  chemically synthesized
agttatttttctctcgttct

SEQ ID NO: 19821 - DNA, 20 bp, Artificial Sequence
  chemically synthesized
ttttctcatcctcagaacga

SEQ ID NO: 19822 - DNA, 20 bp, Artificial Sequence
  chemically synthesized
gttatttttctctcgttctg

SEQ ID NO: 19823 - DNA, 20 bp, Artificial Sequence
  chemically synthesized
agttttctcatcctcagaac

SEQ ID NO: 19824 - DNA, 20 bp, Artificial Sequence
  chemically synthesized
ttttctctcgttctgaggat

SEQ ID NO: 19825 - DNA, 20 bp, Artificial Sequence
  chemically synthesized
cacttgagttttctcatcct

SEQ ID NO: 19826 - DNA, 20 bp, Artificial Sequence
  chemically synthesized
ttctgaggatgagaaaactc

SEQ ID NO: 19827 - DNA, 20 bp, Artificial Sequence
  chemically synthesized
tgaggatgagaaaactcaag

SEQ ID NO: 19828 - DNA, 20 bp, Artificial Sequence
  chemically synthesized
cttttatgtagtttccactt

SEQ ID NO: 19829 - DNA, 20 bp, Artificial Sequence
  chemically synthesized
ctcaagtggaaactacataa

SEQ ID NO: 19830 - DNA, 20 bp, Artificial Sequence
  chemically synthesized
ttttggccctcacttttatg

SEQ ID NO: 19831 - DNA, 20 bp, Artificial Sequence
  chemically synthesized
agtggaaactacataaaagt

SEQ ID NO: 19832 - DNA, 20 bp, Artificial Sequence
  chemically synthesized
gtggaaactacataaaagtg

SEQ ID NO: 19833 - DNA, 20 bp, Artificial Sequence
  chemically synthesized
tggaaactacataaaagtga

SEQ ID NO: 19834 - DNA, 20 bp, Artificial Sequence
  chemically synthesized
cataaaagtgagggccaaaa

SEQ ID NO: 19835 - DNA, 20 bp, Artificial Sequence
  chemically synthesized
acaaaatacacaaaccattt

SEQ ID NO: 19836 - DNA, 20 bp, Artificial Sequence
  chemically synthesized
aaaatggtttgtgtattttg

SEQ ID NO: 19837 - DNA, 20 bp, Artificial Sequence
  chemically synthesized
tattttgtggcttactcctg

SEQ ID NO: 19838 - DNA, 20 bp, Artificial Sequence
  chemically synthesized
atcatttctccttcaggagt

SEQ ID NO: 19839 - DNA, 20 bp, Artificial Sequence
  chemically synthesized
attttgtggcttactcctga

SEQ ID NO: 19840 - DNA, 20 bp, Artificial Sequence
  chemically synthesized
tttgtggcttactcctgaag

SEQ ID NO: 19841 - DNA, 20 bp, Artificial Sequence
  chemically synthesized
actgatcatttctccttcag

SEQ ID NO: 19842 - DNA, 20 bp, Artificial Sequence
  chemically synthesized
ctactgatcatttctccttc

SEQ ID NO: 19843 - DNA, 20 bp, Artificial Sequence
  chemically synthesized
cctactgatcatttctcctt

SEQ ID NO: 19844 - DNA, 20 bp, Artificial Sequence
  chemically synthesized
actcctgaaggagaaatgat

SEQ ID NO: 19845 - DNA, 20 bp, Artificial Sequence
  chemically synthesized
cctgaaggagaaatgatcag

SEQ ID NO: 19846 - DNA, 20 bp, Artificial Sequence
  chemically synthesized
ctgaaggagaaatgatcagt

SEQ ID NO: 19847 - DNA, 20 bp, Artificial Sequence
  chemically synthesized
gaaggagaaatgatcagtag

SEQ ID NO: 19848 - DNA, 20 bp, Artificial Sequence
  chemically synthesized
gagaaatgatcagtaggaga

SEQ ID NO: 19849 - DNA, 20 bp, Artificial Sequence
  chemically synthesized
gaaatgatcagtaggagaca

SEQ ID NO: 19850 - DNA, 20 bp, Artificial Sequence
  chemically synthesized
atgatcagtaggagacagag

SEQ ID NO: 19851 - DNA, 20 bp, Artificial Sequence
  chemically synthesized
tcaggacaggcaggagataa

SEQ ID NO: 19852 - DNA, 20 bp, Artificial Sequence
  chemically synthesized
ctaagcttcaggacaggcag

SEQ ID NO: 19853 - DNA, 20 bp, Artificial Sequence
  chemically synthesized
tgctaagcttcaggacaggc

SEQ ID NO: 19854 - DNA, 20 bp, Artificial Sequence
  chemically synthesized
gtgctaagcttcaggacagg

SEQ ID NO: 19855 - DNA, 20 bp, Artificial Sequence
  chemically synthesized
tttatctcctgcctgtcctg

SEQ ID NO: 19856 - DNA, 20 bp, Artificial Sequence
  chemically synthesized
gatgtgctaagcttcaggac

SEQ ID NO: 19857 - DNA, 20 bp, Artificial Sequence
  chemically synthesized
agatgtgctaagcttcagga

SEQ ID NO: 19858 - DNA, 20 bp, Artificial Sequence
  chemically synthesized
ctcctgcctgtcctgaagct

SEQ ID NO: 19859 - DNA, 20 bp, Artificial Sequence
  chemically synthesized
gaggagatgtgctaagcttc

SEQ ID NO: 19860 - DNA, 20 bp, Artificial Sequence
  chemically synthesized
tgaggagatgtgctaagctt

SEQ ID NO: 19861 - DNA, 20 bp, Artificial Sequence
  chemically synthesized
cacatgtgaggagatgtgct

SEQ ID NO: 19862 - DNA, 20 bp, Artificial Sequence
  chemically synthesized
ggcctagccacacatgtgag

SEQ ID NO: 19863 - DNA, 20 bp, Artificial Sequence
  chemically synthesized
gaggcctagccacacatgtg

SEQ ID NO: 19864 - DNA, 20 bp, Artificial Sequence
  chemically synthesized
agcacatctcctcacatgtg

SEQ ID NO: 19865 - DNA, 20 bp, Artificial Sequence
  chemically synthesized
tgaggcctagccacacatgt

SEQ ID NO: 19866 - DNA, 20 bp, Artificial Sequence
  chemically synthesized
catctcctcacatgtgtggc

SEQ ID NO: 19867 - DNA, 20 bp, Artificial Sequence
  chemically synthesized
atctcctcacatgtgtggct

SEQ ID NO: 19868 - DNA, 20 bp, Artificial Sequence
  chemically synthesized
tcacatgtgtggctaggcct

SEQ ID NO: 19869 - DNA, 20 bp, Artificial Sequence
  chemically synthesized
cacatgtgtggctaggcctc

SEQ ID NO: 19870 - DNA, 20 bp, Artificial Sequence
  chemically synthesized
acatgtgtggctaggcctca

SEQ ID NO: 19871 - DNA, 20 bp, Artificial Sequence
  chemically synthesized
ttctctcttcccctgaggcc

SEQ ID NO: 19872 - DNA, 20 bp, Artificial Sequence
  chemically synthesized
catgtgtggctaggcctcag

SEQ ID NO: 19873 - DNA, 20 bp, Artificial Sequence
  chemically synthesized
gtgtggctaggcctcagggg

SEQ ID NO: 19874 - DNA, 20 bp, Artificial Sequence
  chemically synthesized
gtcttttctctcttcccctg

SEQ ID NO: 19875 - DNA, 20 bp, Artificial Sequence
  chemically synthesized
gtggctaggcctcaggggaa

SEQ ID NO: 19876 - DNA, 20 bp, Artificial Sequence
  chemically synthesized
tgtcttttctctcttcccct

SEQ ID NO: 19877 - DNA, 20 bp, Artificial Sequence
  chemically synthesized
ggctaggcctcaggggaaga

SEQ ID NO: 19878 - DNA, 20 bp, Artificial Sequence
  chemically synthesized
ggcctcaggggaagagagaa

SEQ ID NO: 19879 - DNA, 20 bp, Artificial Sequence
  chemically synthesized
caggggaagagagaaaagac

SEQ ID NO: 19880 - DNA, 20 bp, Artificial Sequence
  chemically synthesized
ggaagagagaaaagacaagc

SEQ ID NO: 19881 - DNA, 20 bp, Artificial Sequence
  chemically synthesized
gaagagagaaaagacaagct

SEQ ID NO: 19882 - DNA, 20 bp, Artificial Sequence
  chemically synthesized
aatattaaacaaattcagcc

SEQ ID NO: 19883 - DNA, 20 bp, Artificial Sequence
  chemically synthesized
gtaggaatattaaacaaatt

SEQ ID NO: 19884 - DNA, 20 bp, Artificial Sequence
  chemically synthesized
tgtttaatattcctactgaa

SEQ ID NO: 19885 - DNA, 20 bp, Artificial Sequence
  chemically synthesized
ttataagcaatcttttcagt

SEQ ID NO: 19886 - DNA, 20 bp, Artificial Sequence
  chemically synthesized
cttataagcaatcttttcag

SEQ ID NO: 19887 - DNA, 20 bp, Artificial Sequence
  chemically synthesized
atgcttataagcaatctttt

SEQ ID NO: 19888 - DNA, 20 bp, Artificial Sequence
  chemically synthesized
ctactgaaaagattgcttat

SEQ ID NO: 19889 - DNA, 20 bp, Artificial Sequence
  chemically synthesized
tttccccttgaaatgcttat

SEQ ID NO: 19890 - DNA, 20 bp, Artificial Sequence
  chemically synthesized
agattgcttataagcatttc

SEQ ID NO: 19891 - DNA, 20 bp, Artificial Sequence
  chemically synthesized
gattgcttataagcatttca

SEQ ID NO: 19892 - DNA, 20 bp, Artificial Sequence
  chemically synthesized
attgcttataagcatttcaa

SEQ ID NO: 19893 - DNA, 20 bp, Artificial Sequence
  chemically synthesized
ttgcttataagcatttcaag

SEQ ID NO: 19894 - DNA, 20 bp, Artificial Sequence
  chemically synthesized
ttcaaggggaaaaccaactg

SEQ ID NO: 19895 - DNA, 20 bp, Artificial Sequence
  chemically synthesized
atattgtgaaaggctgcagt

SEQ ID NO: 19896 - DNA, 20 bp, Artificial Sequence
  chemically synthesized
attcatattgtgaaaggctg

SEQ ID NO: 19897 - DNA, 20 bp, Artificial Sequence
  chemically synthesized
ccatccattcatattgtgaa

SEQ ID NO: 19898 - DNA, 20 bp, Artificial Sequence
  chemically synthesized
accatccattcatattgtga

SEQ ID NO: 19899 - DNA, 20 bp, Artificial Sequence
  chemically synthesized
gcagcctttcacaatatgaa

SEQ ID NO: 19900 - DNA, 20 bp, Artificial Sequence
  chemically synthesized
cctttcacaatatgaatgga

SEQ ID NO: 19901 - DNA, 20 bp, Artificial Sequence
  chemically synthesized
aatatgaatggatggtcact

SEQ ID NO: 19902 - DNA, 20 bp, Artificial Sequence
  chemically synthesized
gagtgatggttcagatgacc

SEQ ID NO: 19903 - DNA, 20 bp, Artificial Sequence
  chemically synthesized
atgctagaggagtgatggtt

SEQ ID NO: 19904 - DNA, 20 bp, Artificial Sequence
  chemically synthesized
agccaatgctagaggagtga

SEQ ID NO: 19905 - DNA, 20 bp, Artificial Sequence
  chemically synthesized
catctgaaccatcactcctc

SEQ ID NO: 19906 - DNA, 20 bp, Artificial Sequence
  chemically synthesized
attaaaagccaatgctagag

SEQ ID NO: 19907 - DNA, 20 bp, Artificial Sequence
  chemically synthesized
aaccatcactcctctagcat

SEQ ID NO: 19908 - DNA, 20 bp, Artificial Sequence
  chemically synthesized
aaattaaaagccaatgctag

SEQ ID NO: 19909 - DNA, 20 bp, Artificial Sequence
  chemically synthesized
caaattaaaagccaatgcta

SEQ ID NO: 19910 - DNA, 20 bp, Artificial Sequence
  chemically synthesized
accaaattaaaagccaatgc

SEQ ID NO: 19911 - DNA, 20 bp, Artificial Sequence
  chemically synthesized
tctagcattggcttttaatt

SEQ ID NO: 19912 - DNA, 20 bp, Artificial Sequence
  chemically synthesized
aaactgtaaaaccaaattaa

SEQ ID NO: 19913 - DNA, 20 bp, Artificial Sequence
  chemically synthesized
tggcttttaatttggtttta

SEQ ID NO: 19914 - DNA, 20 bp, Artificial Sequence
  chemically synthesized
aatttggttttacagttttt

SEQ ID NO: 19915 - DNA, 20 bp, Artificial Sequence
  chemically synthesized
ttggttttacagtttttaag

SEQ ID NO: 19916 - DNA, 20 bp, Artificial Sequence
  chemically synthesized
gttttacagtttttaagcag

SEQ ID NO: 19917 - DNA, 20 bp, Artificial Sequence
  chemically synthesized
tttccttttgattacgcatt

SEQ ID NO: 19918 - DNA, 20 bp, Artificial Sequence
  chemically synthesized
atttccttttgattacgcat

SEQ ID NO: 19919 - DNA, 20 bp, Artificial Sequence
  chemically synthesized
agaacccaatgcgtaatcaa

SEQ ID NO: 19920 - DNA, 20 bp, Artificial Sequence
  chemically synthesized
gaacccaatgcgtaatcaaa

SEQ ID NO: 19921 - DNA, 20 bp, Artificial Sequence
  chemically synthesized
gtaatcaaaaggaaattctg

SEQ ID NO: 19922 - DNA, 20 bp, Artificial Sequence
  chemically synthesized
taatcaaaaggaaattctgt

SEQ ID NO: 19923 - DNA, 20 bp, Artificial Sequence
  chemically synthesized
aatcaaaaggaaattctgta

SEQ ID NO: 19924 - DNA, 20 bp, Artificial Sequence
  chemically synthesized
caaaaggaaattctgtaggg

SEQ ID NO: 19925 - DNA, 20 bp, Artificial Sequence
  chemically synthesized
gatagatacgtaccacccta

SEQ ID NO: 19926 - DNA, 20 bp, Artificial Sequence
  chemically synthesized
gtggtacgtatctatccttt

SEQ ID NO: 19927 - DNA, 20 bp, Artificial Sequence
  chemically synthesized
gcttgctgtttcttaaagga

SEQ ID NO: 19928 - DNA, 20 bp, Artificial Sequence
  chemically synthesized
gatagcttgctgtttcttaa

SEQ ID NO: 19929 - DNA, 20 bp, Artificial Sequence
  chemically synthesized
cgtatctatcctttaagaaa

SEQ ID NO: 19930 - DNA, 20 bp, Artificial Sequence
  chemically synthesized
agatagcttgctgtttctta

SEQ ID NO: 19931 - DNA, 20 bp, Artificial Sequence
  chemically synthesized
tctatcctttaagaaacagc

SEQ ID NO: 19932 - DNA, 20 bp, Artificial Sequence
  chemically synthesized
tttattatttgagagacaga

SEQ ID NO: 19933 - DNA, 20 bp, Artificial Sequence
  chemically synthesized
acattttattatttgagaga

SEQ ID NO: 19934 - DNA, 20 bp, Artificial Sequence
  chemically synthesized
actaacattttattatttga

SEQ ID NO: 19935 - DNA, 20 bp, Artificial Sequence
  chemically synthesized
tgactaacattttattattt

SEQ ID NO: 19936 - DNA, 20 bp, Artificial Sequence
  chemically synthesized
tctctcaaataataaaatgt

SEQ ID NO: 19937 - DNA, 20 bp, Artificial Sequence
  chemically synthesized
ataaaatgttagtcacgtca

SEQ ID NO: 19938 - DNA, 20 bp, Artificial Sequence
  chemically synthesized
tgttagtcacgtcacggaat

SEQ ID NO: 19939 - DNA, 20 bp, Artificial Sequence
  chemically synthesized
cgtcacggaattggatgtgt

SEQ ID NO: 19940 - DNA, 20 bp, Artificial Sequence
  chemically synthesized
ggatgtgtcagtacaacttg

SEQ ID NO: 19941 - DNA, 20 bp, Artificial Sequence
  chemically synthesized
gtgtcagtacaacttgcagt

SEQ ID NO: 19942 - DNA, 20 bp, Artificial Sequence
  chemically synthesized
ttttataatcatcttactgc

SEQ ID NO: 19943 - DNA, 20 bp, Artificial Sequence
  chemically synthesized
accatgtgacattcatgttc

SEQ ID NO: 19944 - DNA, 20 bp, Artificial Sequence
  chemically synthesized
tcttgaacatgaatgtcaca

SEQ ID NO: 19945 - DNA, 20 bp, Artificial Sequence
  chemically synthesized
tcacatggtattctttaaat

SEQ ID NO: 19946 - DNA, 20 bp, Artificial Sequence
  chemically synthesized
agtctttgggttcttattta

SEQ ID NO: 19947 - DNA, 20 bp, Artificial Sequence
  chemically synthesized
attctttaaataagaaccca

SEQ ID NO: 19948 - DNA, 20 bp, Artificial Sequence
  chemically synthesized
ttaaataagaacccaaagac

SEQ ID NO: 19949 - DNA, 20 bp, Artificial Sequence
  chemically synthesized
tctgcacttgtctagtcttt

SEQ ID NO: 19950 - DNA, 20 bp, Artificial Sequence
  chemically synthesized
ctctgcacttgtctagtctt

SEQ ID NO: 19951 - DNA, 20 bp, Artificial Sequence
  chemically synthesized
taagaacccaaagactagac

SEQ ID NO: 19952 - DNA, 20 bp, Artificial Sequence
  chemically synthesized
atttaatctctgcacttgtc

SEQ ID NO: 19953 - DNA, 20 bp, Artificial Sequence
  chemically synthesized
acccaaagactagacaagtg

SEQ ID NO: 19954 - DNA, 20 bp, Artificial Sequence
  chemically synthesized
ccaaagactagacaagtgca

SEQ ID NO: 19955 - DNA, 20 bp, Artificial Sequence
  chemically synthesized
aagtcggaaaaataagtgtg

SEQ ID NO: 19956 - DNA, 20 bp, Artificial Sequence
  chemically synthesized
tttctgtaagtcggaaaaat

SEQ ID NO: 19957 - DNA, 20 bp, Artificial Sequence
  chemically synthesized
acacttatttttccgactta

SEQ ID NO: 19958 - DNA, 20 bp, Artificial Sequence
  chemically synthesized
tctaacctctttctgtaagt

SEQ ID NO: 19959 - DNA, 20 bp, Artificial Sequence
  chemically synthesized
ttatttttccgacttacaga

SEQ ID NO: 19960 - DNA, 20 bp, Artificial Sequence
  chemically synthesized
atttttccgacttacagaaa

SEQ ID NO: 19961 - DNA, 20 bp, Artificial Sequence
  chemically synthesized
attttctaacctctttctgt

SEQ ID NO: 19962 - DNA, 20 bp, Artificial Sequence
  chemically synthesized
tttttccgacttacagaaag

SEQ ID NO: 19963 - DNA, 20 bp, Artificial Sequence
  chemically synthesized
tccgacttacagaaagaggt

SEQ ID NO: 19964 - DNA, 20 bp, Artificial Sequence
  chemically synthesized
acagaaagaggttagaaaat

SEQ ID NO: 19965 - DNA, 20 bp, Artificial Sequence
  chemically synthesized
gaaaatcagactttatcccc

SEQ ID NO: 19966 - DNA, 20 bp, Artificial Sequence
  chemically synthesized
acacatgttcctaggggata

SEQ ID NO: 19967 - DNA, 20 bp, Artificial Sequence
  chemically synthesized
aaaatcagactttatcccct

SEQ ID NO: 19968 - DNA, 20 bp, Artificial Sequence
  chemically synthesized
aataaaacacatgttcctag

SEQ ID NO: 19969 - DNA, 20 bp, Artificial Sequence
  chemically synthesized
gaataaaacacatgttccta

SEQ ID NO: 19970 - DNA, 20 bp, Artificial Sequence
  chemically synthesized
tgaataaaacacatgttcct

SEQ ID NO: 19971 - DNA, 20 bp, Artificial Sequence
  chemically synthesized
ctgaataaaacacatgttcc

SEQ ID NO: 19972 - DNA, 20 bp, Artificial Sequence
  chemically synthesized
ctaggaacatgtgttttatt

SEQ ID NO: 19973 - DNA, 20 bp, Artificial Sequence
  chemically synthesized
acatgtgttttattcagaca

SEQ ID NO: 19974 - DNA, 20 bp, Artificial Sequence
  chemically synthesized
atgtaatgtaaaataatacc

SEQ ID NO: 19975 - DNA, 20 bp, Artificial Sequence
  chemically synthesized
atgtaaaataatacctggac

SEQ ID NO: 19976 - DNA, 20 bp, Artificial Sequence
  chemically synthesized
aggattagcttttccagtcc

SEQ ID NO: 19977 - DNA, 20 bp, Artificial Sequence
  chemically synthesized
gaggattagcttttccagtc

SEQ ID NO: 19978 - DNA, 20 bp, Artificial Sequence
  chemically synthesized
aaataatacctggactggaa

SEQ ID NO: 19979 - DNA, 20 bp, Artificial Sequence
  chemically synthesized
agaatgaggattagcttttc

SEQ ID NO: 19980 - DNA, 20 bp, Artificial Sequence
  chemically synthesized
tttaagtagagaatgaggat

SEQ ID NO: 19981 - DNA, 20 bp, Artificial Sequence
  chemically synthesized
aggcatttaagtagagaatg

SEQ ID NO: 19982 - DNA, 20 bp, Artificial Sequence
  chemically synthesized
caggcatttaagtagagaat

SEQ ID NO: 19983 - DNA, 20 bp, Artificial Sequence
  chemically synthesized
aaattgcaggcatttaagta

SEQ ID NO: 19984 - DNA, 20 bp, Artificial Sequence
  chemically synthesized
ttaaattgcaggcatttaag

SEQ ID NO: 19985 - DNA, 20 bp, Artificial Sequence
  chemically synthesized
acattaaattgcaggcattt

SEQ ID NO: 19986 - DNA, 20 bp, Artificial Sequence
  chemically synthesized
cttgtcaaacattaaattgc

SEQ ID NO: 19987 - DNA, 20 bp, Artificial Sequence
  chemically synthesized
ccttgtcaaacattaaattg

SEQ ID NO: 19988 - DNA, 20 bp, Artificial Sequence
  chemically synthesized
cctgcaatttaatgtttgac

SEQ ID NO: 19989 - DNA, 20 bp, Artificial Sequence
  chemically synthesized
ctgcaatttaatgtttgaca

SEQ ID NO: 19990 - DNA, 20 bp, Artificial Sequence
  chemically synthesized
atttaatgtttgacaaggaa

SEQ ID NO: 19991 - DNA, 20 bp, Artificial Sequence
  chemically synthesized
ttttagagtgtcataaaatt

SEQ ID NO: 19992 - DNA, 20 bp, Artificial Sequence
  chemically synthesized
caaattttatgacactctaa

SEQ ID NO: 19993 - DNA, 20 bp, Artificial Sequence
  chemically synthesized
attttatgacactctaaaag

SEQ ID NO: 19994 - DNA, 20 bp, Artificial Sequence
  chemically synthesized
aagatgtagaactgctttta

SEQ ID NO: 19995 - DNA, 20 bp, Artificial Sequence
  chemically synthesized
gtaagatgtagaactgcttt

SEQ ID NO: 19996 - DNA, 20 bp, Artificial Sequence
  chemically synthesized
cagattcctcatgtaagatg

SEQ ID NO: 19997 - DNA, 20 bp, Artificial Sequence
  chemically synthesized
agcagttctacatcttacat

SEQ ID NO: 19998 - DNA, 20 bp, Artificial Sequence
  chemically synthesized
gcagttctacatcttacatg

SEQ ID NO: 19999 - DNA, 20 bp, Artificial Sequence
  chemically synthesized
tgacagcagattcctcatgt

SEQ ID NO: 20000 - DNA, 20 bp, Artificial Sequence
  chemically synthesized
agactgttcttatttgacag

SEQ ID NO: 20001 - DNA, 20 bp, Artificial Sequence
  chemically synthesized
tgaggaatctgctgtcaaat

SEQ ID NO: 20002 - DNA, 20 bp, Artificial Sequence
  chemically synthesized
gacagactgttcttatttga

SEQ ID NO: 20003 - DNA, 20 bp, Artificial Sequence
  chemically synthesized
aatctgctgtcaaataagaa

SEQ ID NO: 20004 - DNA, 20 bp, Artificial Sequence
  chemically synthesized
tagttctagatgggaaatga

SEQ ID NO: 20005 - DNA, 20 bp, Artificial Sequence
  chemically synthesized
acagtctgtcatttcccatc

SEQ ID NO: 20006 - DNA, 20 bp, Artificial Sequence
  chemically synthesized
taattaccctagttctagat

SEQ ID NO: 20007 - DNA, 20 bp, Artificial Sequence
  chemically synthesized
ctaattaccctagttctaga

SEQ ID NO: 20008 - DNA, 20 bp, Artificial Sequence
  chemically synthesized
tgtcatttcccatctagaac

SEQ ID NO: 20009 - DNA, 20 bp, Artificial Sequence
  chemically synthesized
gtcatttcccatctagaact

SEQ ID NO: 20010 - DNA, 20 bp, Artificial Sequence
  chemically synthesized
tcatttcccatctagaacta

SEQ ID NO: 20011 - DNA, 20 bp, Artificial Sequence
  chemically synthesized
ttggctaattaccctagttc

SEQ ID NO: 20012 - DNA, 20 bp, Artificial Sequence
  chemically synthesized
ccatctagaactagggtaat

SEQ ID NO: 20013 - DNA, 20 bp, Artificial Sequence
  chemically synthesized
ttaatgttggctaattaccc

SEQ ID NO: 20014 - DNA, 20 bp, Artificial Sequence
  chemically synthesized
ctgtattcttttattaatgt

SEQ ID NO: 20015 - DNA, 20 bp, Artificial Sequence
  chemically synthesized
taattagccaacattaataa

SEQ ID NO: 20016 - DNA, 20 bp, Artificial Sequence
  chemically synthesized
ccaacattaataaaagaata

SEQ ID NO: 20017 - DNA, 20 bp, Artificial Sequence
  chemically synthesized
tggaagacaagtacagatgt

SEQ ID NO: 20018 - DNA, 20 bp, Artificial Sequence
  chemically synthesized
gcacatttggaagacaagta

SEQ ID NO: 20019 - DNA, 20 bp, Artificial Sequence
  chemically synthesized
gtaaagcacatttggaagac

SEQ ID NO: 20020 - DNA, 20 bp, Artificial Sequence
  chemically synthesized
cctgtgtaaagcacatttgg

SEQ ID NO: 20021 - DNA, 20 bp, Artificial Sequence
  chemically synthesized
ttccctgtgtaaagcacatt

SEQ ID NO: 20022 - DNA, 20 bp, Artificial Sequence
  chemically synthesized
tcttccaaatgtgctttaca

SEQ ID NO: 20023 - DNA, 20 bp, Artificial Sequence
  chemically synthesized
cttccaaatgtgctttacac

SEQ ID NO: 20024 - DNA, 20 bp, Artificial Sequence
  chemically synthesized
ttccaaatgtgctttacaca

SEQ ID NO: 20025 - DNA, 20 bp, Artificial Sequence
  chemically synthesized
tggcatcatttccctgtgta

SEQ ID NO: 20026 - DNA, 20 bp, Artificial Sequence
  chemically synthesized
tttacacagggaaatgatgc

SEQ ID NO: 20027 - DNA, 20 bp, Artificial Sequence
  chemically synthesized
ggaaatgatgccagttttaa

SEQ ID NO: 20028 - DNA, 20 bp, Artificial Sequence
  chemically synthesized
cgtgtcctgtcttttaaaac

SEQ ID NO: 20029 - DNA, 20 bp, Artificial Sequence
  chemically synthesized
atgatgccagttttaaaaga

SEQ ID NO: 20030 - DNA, 20 bp, Artificial Sequence
  chemically synthesized
tgatgccagttttaaaagac

SEQ ID NO: 20031 - DNA, 20 bp, Artificial Sequence
  chemically synthesized
cagttttaaaagacaggaca

SEQ ID NO: 20032 - DNA, 20 bp, Artificial Sequence
  chemically synthesized
ataataggggacgaacaggg

SEQ ID NO: 20033 - DNA, 20 bp, Artificial Sequence
  chemically synthesized
cataataggggacgaacagg

SEQ ID NO: 20034 - DNA, 20 bp, Artificial Sequence
  chemically synthesized
ttcataataggggacgaaca

SEQ ID NO: 20035 - DNA, 20 bp, Artificial Sequence
  chemically synthesized
cttcataataggggacgaac

SEQ ID NO: 20036 - DNA, 20 bp, Artificial Sequence
  chemically synthesized
tcttcataataggggacgaa

SEQ ID NO: 20037 - DNA, 20 bp, Artificial Sequence
  chemically synthesized
gctttgattcttcataatag

SEQ ID NO: 20038 - DNA, 20 bp, Artificial Sequence
  chemically synthesized
cctgttcgtcccctattatg

SEQ ID NO: 20039 - DNA, 20 bp, Artificial Sequence
  chemically synthesized
tgctttgattcttcataata

SEQ ID NO: 20040 - DNA, 20 bp, Artificial Sequence
  chemically synthesized
ctgctttgattcttcataat

SEQ ID NO: 20041 - DNA, 20 bp, Artificial Sequence
  chemically synthesized
tctgctttgattcttcataa

SEQ ID NO: 20042 - DNA, 20 bp, Artificial Sequence
  chemically synthesized
tcccctattatgaagaatca

SEQ ID NO: 20043 - DNA, 20 bp, Artificial Sequence
  chemically synthesized
cctattatgaagaatcaaag

SEQ ID NO: 20044 - DNA, 20 bp, Artificial Sequence
  chemically synthesized
tttaccctctaggaaagggt

SEQ ID NO: 20045 - DNA, 20 bp, Artificial Sequence
  chemically synthesized
aacaattactgaccctttcc

SEQ ID NO: 20046 - DNA, 20 bp, Artificial Sequence
  chemically synthesized
caattactgaccctttccta

SEQ ID NO: 20047 - DNA, 20 bp, Artificial Sequence
  chemically synthesized
agtgtttaccctctaggaaa

SEQ ID NO: 20048 - DNA, 20 bp, Artificial Sequence
  chemically synthesized
aattactgaccctttcctag

SEQ ID NO: 20049 - DNA, 20 bp, Artificial Sequence
  chemically synthesized
aagtgtttaccctctaggaa

SEQ ID NO: 20050 - DNA, 20 bp, Artificial Sequence
  chemically synthesized
attactgaccctttcctaga

SEQ ID NO: 20051 - DNA, 20 bp, Artificial Sequence
  chemically synthesized
gaagtgtttaccctctagga

SEQ ID NO: 20052 - DNA, 20 bp, Artificial Sequence
  chemically synthesized
actagaagtgtttaccctct

SEQ ID NO: 20053 - DNA, 20 bp, Artificial Sequence
  chemically synthesized
aactagaagtgtttaccctc

SEQ ID NO: 20054 - DNA, 20 bp, Artificial Sequence
  chemically synthesized
tcctagagggtaaacacttc

SEQ ID NO: 20055 - DNA, 20 bp, Artificial Sequence
  chemically synthesized
gagggtaaacacttctagtt

SEQ ID NO: 20056 - DNA, 20 bp, Artificial Sequence
  chemically synthesized
aaggctttattcttaactag

SEQ ID NO: 20057 - DNA, 20 bp, Artificial Sequence
  chemically synthesized
ttcaaggctttattcttaac

SEQ ID NO: 20058 - DNA, 20 bp, Artificial Sequence
  chemically synthesized
aacacttctagttaagaata

SEQ ID NO: 20059 - DNA, 20 bp, Artificial Sequence
  chemically synthesized
gttaagaataaagccttgaa

SEQ ID NO: 20060 - DNA, 20 bp, Artificial Sequence
  chemically synthesized
ttaagaataaagccttgaaa

SEQ ID NO: 20061 - DNA, 20 bp, Artificial Sequence
  chemically synthesized
tcctttatttttccttttca

SEQ ID NO: 20062 - DNA, 20 bp, Artificial Sequence
  chemically synthesized
ctcctttatttttccttttc

SEQ ID NO: 20063 - DNA, 20 bp, Artificial Sequence
  chemically synthesized
agccttgaaaaggaaaaata

SEQ ID NO: 20064 - DNA, 20 bp, Artificial Sequence
  chemically synthesized
gccttgaaaaggaaaaataa

SEQ ID NO: 20065 - DNA, 20 bp, Artificial Sequence
  chemically synthesized
cttgaaaaggaaaaataaag

SEQ ID NO: 20066 - DNA, 20 bp, Artificial Sequence
  chemically synthesized
aaaggaaaaataaaggagta

SEQ ID NO: 20067 - DNA, 20 bp, Artificial Sequence
  chemically synthesized
aatagagttcacacatcatt

SEQ ID NO: 20068 - DNA, 20 bp, Artificial Sequence
  chemically synthesized
taataaaacagtggtcaata

SEQ ID NO: 20069 - DNA, 20 bp, Artificial Sequence
  chemically synthesized
cttaataaaacagtggtcaa

SEQ ID NO: 20070 - DNA, 20 bp, Artificial Sequence
  chemically synthesized
aaacaatcttaataaaacag

SEQ ID NO: 20071 - DNA, 20 bp, Artificial Sequence
  chemically synthesized
ctattgaccactgttttatt

SEQ ID NO: 20072 - DNA, 20 bp, Artificial Sequence
  chemically synthesized
tcaaaacaatcttaataaaa

SEQ ID NO: 20073 - DNA, 20 bp, Artificial Sequence
  chemically synthesized
aagagataatgaatttggaa

SEQ ID NO: 20074 - DNA, 20 bp, Artificial Sequence
  chemically synthesized
agtcaaagagataatgaatt

SEQ ID NO: 20075 - DNA, 20 bp, Artificial Sequence
  chemically synthesized
attgtaggtcatcagtcaaa

SEQ ID NO: 20076 - DNA, 20 bp, Artificial Sequence
  chemically synthesized
gcattgtaggtcatcagtca

SEQ ID NO: 20077 - DNA, 20 bp, Artificial Sequence
  chemically synthesized
tccattgcattgtaggtcat

SEQ ID NO: 20078 - DNA, 20 bp, Artificial Sequence
  chemically synthesized
ttgaatttccattgcattgt

SEQ ID NO: 20079 - DNA, 20 bp, Artificial Sequence
  chemically synthesized
gttgaatttccattgcattg

SEQ ID NO: 20080 - DNA, 20 bp, Artificial Sequence
  chemically synthesized
actgatgacctacaatgcaa

SEQ ID NO: 20081 - DNA, 20 bp, Artificial Sequence
  chemically synthesized
taaacattcagtggtcaagt

SEQ ID NO: 20082 - DNA, 20 bp, Artificial Sequence
  chemically synthesized
ttggtaaacattcagtggtc

SEQ ID NO: 20083 - DNA, 20 bp, Artificial Sequence
  chemically synthesized
gaaacttggtaaacattcag

SEQ ID NO: 20084 - DNA, 20 bp, Artificial Sequence
  chemically synthesized
attgaaacttggtaaacatt

SEQ ID NO: 20085 - DNA, 20 bp, Artificial Sequence
  chemically synthesized
ttgaccactgaatgtttacc

SEQ ID NO: 20086 - DNA, 20 bp, Artificial Sequence
  chemically synthesized
ggtttttaggaattgaaact

SEQ ID NO: 20087 - DNA, 20 bp, Artificial Sequence
  chemically synthesized
cagttcaaataagggttttt

SEQ ID NO: 20088 - DNA, 20 bp, Artificial Sequence
  chemically synthesized
gcagttcaaataagggtttt

SEQ ID NO: 20089 - DNA, 20 bp, Artificial Sequence
  chemically synthesized
aacttttgcagttcaaataa

SEQ ID NO: 20090 - DNA, 20 bp, Artificial Sequence
  chemically synthesized
gaacttttgcagttcaaata

SEQ ID NO: 20091 - DNA, 20 bp, Artificial Sequence
  chemically synthesized
agaacttttgcagttcaaat

SEQ ID NO: 20092 - DNA, 20 bp, Artificial Sequence
  chemically synthesized
aacccttatttgaactgcaa

SEQ ID NO: 20093 - DNA, 20 bp, Artificial Sequence
  chemically synthesized
taatttatgtagaacttttg

SEQ ID NO: 20094 - DNA, 20 bp, Artificial Sequence
  chemically synthesized
tttttttttcttaatttatg

SEQ ID NO: 20095 - DNA, 20 bp, Artificial Sequence
  chemically synthesized
gcaaaagttctacataaatt

SEQ ID NO: 20096 - DNA, 20 bp, Artificial Sequence
  chemically synthesized
ggtggctttccataggtgaa

SEQ ID NO: 20097 - DNA, 20 bp, Artificial Sequence
  chemically synthesized
aaaaaaattctattcaccta

SEQ ID NO: 20098 - DNA, 20 bp, Artificial Sequence
  chemically synthesized
aaattctattcacctatgga

SEQ ID NO: 20099 - DNA, 20 bp, Artificial Sequence
  chemically synthesized
aaaccaaggtggctttccat

SEQ ID NO: 20100 - DNA, 20 bp, Artificial Sequence
  chemically synthesized
taaaccaaggtggctttcca

SEQ ID NO: 20101 - DNA, 20 bp, Artificial Sequence
  chemically synthesized
tcacctatggaaagccacct

SEQ ID NO: 20102 - DNA, 20 bp, Artificial Sequence
  chemically synthesized
cttaccaacttaaaccaagg

SEQ ID NO: 20103 - DNA, 20 bp, Artificial Sequence
  chemically synthesized
atggaaagccaccttggttt

SEQ ID NO: 20104 - DNA, 20 bp, Artificial Sequence
  chemically synthesized
ctgcttaccaacttaaacca

SEQ ID NO: 20105 - DNA, 20 bp, Artificial Sequence
  chemically synthesized
tctgcttaccaacttaaacc

SEQ ID NO: 20106 - DNA, 20 bp, Artificial Sequence
  chemically synthesized
aaagccaccttggtttaagt

SEQ ID NO: 20107 - DNA, 20 bp, Artificial Sequence
  chemically synthesized
ccaccttggtttaagttggt

SEQ ID NO: 20108 - DNA, 20 bp, Artificial Sequence
  chemically synthesized
ccttggtttaagttggtaag

SEQ ID NO: 20109 - DNA, 20 bp, Artificial Sequence
  chemically synthesized
tggtttaagttggtaagcag

SEQ ID NO: 20110 - DNA, 20 bp, Artificial Sequence
  chemically synthesized
caaagtagattggtgaagat

SEQ ID NO: 20111 - DNA, 20 bp, Artificial Sequence
  chemically synthesized
gtaaccaaagtagattggtg

SEQ ID NO: 20112 - DNA, 20 bp, Artificial Sequence
  chemically synthesized
ctttagtaaccaaagtagat

SEQ ID NO: 20113 - DNA, 20 bp, Artificial Sequence
  chemically synthesized
taatcttcaccaatctactt

SEQ ID NO: 20114 - DNA, 20 bp, Artificial Sequence
  chemically synthesized
atttgctttagtaaccaaag

SEQ ID NO: 20115 - DNA, 20 bp, Artificial Sequence
  chemically synthesized
gtaatttgctttagtaacca

SEQ ID NO: 20116 - DNA, 20 bp, Artificial Sequence
  chemically synthesized
ccaatctactttggttacta

SEQ ID NO: 20117 - DNA, 20 bp, Artificial Sequence
  chemically synthesized
ccaaagtaggtaatttgctt

SEQ ID NO: 20118 - DNA, 20 bp, Artificial Sequence
  chemically synthesized
ctaaagcaaattacctactt

SEQ ID NO: 20119 - DNA, 20 bp, Artificial Sequence
  chemically synthesized
ttggcttccatgaccaaagt

SEQ ID NO: 20120 - DNA, 20 bp, Artificial Sequence
  chemically synthesized
tttggcttccatgaccaaag

SEQ ID NO: 20121 - DNA, 20 bp, Artificial Sequence
  chemically synthesized
caaattacctactttggtca

SEQ ID NO: 20122 - DNA, 20 bp, Artificial Sequence
  chemically synthesized
ttttttggcttccatgacca

SEQ ID NO: 20123 - DNA, 20 bp, Artificial Sequence
  chemically synthesized
attacctactttggtcatgg

SEQ ID NO: 20124 - DNA, 20 bp, Artificial Sequence
  chemically synthesized
ttagttgctggtaatttttt

SEQ ID NO: 20125 - DNA, 20 bp, Artificial Sequence
  chemically synthesized
atggaagccaaaaaaattac

SEQ ID NO: 20126 - DNA, 20 bp, Artificial Sequence
  chemically synthesized
agggctgagcagttagttgc

SEQ ID NO: 20127 - DNA, 20 bp, Artificial Sequence
  chemically synthesized
attaccagcaactaactgct

SEQ ID NO: 20128 - DNA, 20 bp, Artificial Sequence
  chemically synthesized
atttaagagggctgagcagt

SEQ ID NO: 20129 - DNA, 20 bp, Artificial Sequence
  chemically synthesized
gagcatttaagagggctgag

SEQ ID NO: 20130 - DNA, 20 bp, Artificial Sequence
  chemically synthesized
tctgagcatttaagagggct

SEQ ID NO: 20131 - DNA, 20 bp, Artificial Sequence
  chemically synthesized
gaagatctgagcatttaaga

SEQ ID NO: 20132 - DNA, 20 bp, Artificial Sequence
  chemically synthesized
tgaagatctgagcatttaag

SEQ ID NO: 20133 - DNA, 20 bp, Artificial Sequence
  chemically synthesized
atgaagatctgagcatttaa

SEQ ID NO: 20134 - DNA, 20 bp, Artificial Sequence
  chemically synthesized
gctcagccctcttaaatgct

SEQ ID NO: 20135 - DNA, 20 bp, Artificial Sequence
  chemically synthesized
tgatgaagatctgagcattt

SEQ ID NO: 20136 - DNA, 20 bp, Artificial Sequence
  chemically synthesized
gggcaatctgatgaagatct

SEQ ID NO: 20137 - DNA, 20 bp, Artificial Sequence
  chemically synthesized
ttaaatgctcagatcttcat

SEQ ID NO: 20138 - DNA, 20 bp, Artificial Sequence
  chemically synthesized
caataaggggcaatctgatg

SEQ ID NO: 20139 - DNA, 20 bp, Artificial Sequence
  chemically synthesized
attaattttctttcaataag

SEQ ID NO: 20140 - DNA, 20 bp, Artificial Sequence
  chemically synthesized
atcagattgccccttattga

SEQ ID NO: 20141 - DNA, 20 bp, Artificial Sequence
  chemically synthesized
aattaattttctttcaataa

SEQ ID NO: 20142 - DNA, 20 bp, Artificial Sequence
  chemically synthesized
taattaattttctttcaata

SEQ ID NO: 20143 - DNA, 20 bp, Artificial Sequence
  chemically synthesized
gtaattaattttctttcaat

SEQ ID NO: 20144 - DNA, 20 bp, Artificial Sequence
  chemically synthesized
tgaaagaaaattaattactt

SEQ ID NO: 20145 - DNA, 20 bp, Artificial Sequence
  chemically synthesized
gaaagaaaattaattacttc

SEQ ID NO: 20146 - DNA, 20 bp, Artificial Sequence
  chemically synthesized
attatgtgttatgtggcctg

SEQ ID NO: 20147 - DNA, 20 bp, Artificial Sequence
  chemically synthesized
attctatattatgtgttatg

SEQ ID NO: 20148 - DNA, 20 bp, Artificial Sequence
  chemically synthesized
aggccacataacacataata

SEQ ID NO: 20149 - DNA, 20 bp, Artificial Sequence
  chemically synthesized
atataaatgtttatctccgt

SEQ ID NO: 20150 - DNA, 20 bp, Artificial Sequence
  chemically synthesized
agtatgatatttttcttacg

SEQ ID NO: 20151 - DNA, 20 bp, Artificial Sequence
  chemically synthesized
agagtatgatatttttctta

SEQ ID NO: 20152 - DNA, 20 bp, Artificial Sequence
  chemically synthesized
tatttgaatgttgtttaata

SEQ ID NO: 20153 - DNA, 20 bp, Artificial Sequence
  chemically synthesized
tatatttgaatgttgtttaa

SEQ ID NO: 20154 - DNA, 20 bp, Artificial Sequence
  chemically synthesized
ttatttataaatttattttt

SEQ ID NO: 20155 - DNA, 20 bp, Artificial Sequence
  chemically synthesized
taaaacactgatatagcaac

SEQ ID NO: 20156 - DNA, 20 bp, Artificial Sequence
  chemically synthesized
ttaaaacactgatatagcaa

SEQ ID NO: 20157 - DNA, 20 bp, Artificial Sequence
  chemically synthesized
taaataacctgttgctatat

SEQ ID NO: 20158 - DNA, 20 bp, Artificial Sequence
  chemically synthesized
tctatattaaaacactgata

SEQ ID NO: 20159 - DNA, 20 bp, Artificial Sequence
  chemically synthesized
gctatatcagtgttttaata

SEQ ID NO: 20160 - DNA, 20 bp, Artificial Sequence
  chemically synthesized
agaaaatgctatgcaaataa

SEQ ID NO: 20161 - DNA, 20 bp, Artificial Sequence
  chemically synthesized
atagattgcttttatttgca

SEQ ID NO: 20162 - DNA, 20 bp, Artificial Sequence
  chemically synthesized
cagttttctatatgcaaata

SEQ ID NO: 20163 - DNA, 20 bp, Artificial Sequence
  chemically synthesized
gcattttctatatttgcata

SEQ ID NO: 20164 - DNA, 20 bp, Artificial Sequence
  chemically synthesized
gcatatagaaaactgaaata

SEQ ID NO: 20165 - DNA, 20 bp, Artificial Sequence
  chemically synthesized
ttatgtgaaatgctttattt

SEQ ID NO: 20166 - DNA, 20 bp, Artificial Sequence
  chemically synthesized
cacataacaaatttattaat

SEQ ID NO: 20167 - DNA, 20 bp, Artificial Sequence
  chemically synthesized
ttttcccccatggataaaat

SEQ ID NO: 20168 - DNA, 20 bp, Artificial Sequence
  chemically synthesized
taataagctaattttatcca

SEQ ID NO: 20169 - DNA, 20 bp, Artificial Sequence
  chemically synthesized
aataagctaattttatccat

SEQ ID NO: 20170 - DNA, 20 bp, Artificial Sequence
  chemically synthesized
ataagctaattttatccatg

SEQ ID NO: 20171 - DNA, 20 bp, Artificial Sequence
  chemically synthesized
taagctaattttatccatgg

SEQ ID NO: 20172 - DNA, 20 bp, Artificial Sequence
  chemically synthesized
tttttcctttttttccccca

SEQ ID NO: 20173 - DNA, 20 bp, Artificial Sequence
  chemically synthesized
ttttatccatgggggaaaaa

SEQ ID NO: 20174 - DNA, 20 bp, Artificial Sequence
  chemically synthesized
tttatccatgggggaaaaaa

SEQ ID NO: 20175 - DNA, 20 bp, Artificial Sequence
  chemically synthesized
gggggaaaaaaaggaaaaat

SEQ ID NO: 20176 - DNA, 20 bp, Artificial Sequence
  chemically synthesized
aaaggaaaaataagaatgaa

SEQ ID NO: 20177 - DNA, 20 bp, Artificial Sequence
  chemically synthesized
atgaaaagttttccattttg

SEQ ID NO: 20178 - DNA, 20 bp, Artificial Sequence
  chemically synthesized
gaaagacattttctacaaaa

SEQ ID NO: 20179 - DNA, 20 bp, Artificial Sequence
  chemically synthesized
ttttgtagaaaatgtctttc

SEQ ID NO: 20180 - DNA, 20 bp, Artificial Sequence
  chemically synthesized
atattgattccatgtcttga

SEQ ID NO: 20181 - DNA, 20 bp, Artificial Sequence
  chemically synthesized
agaaaatgtctttcaagaca

SEQ ID NO: 20182 - DNA, 20 bp, Artificial Sequence
  chemically synthesized
caatatgaatgcccatcaat

SEQ ID NO: 20183 - DNA, 20 bp, Artificial Sequence
  chemically synthesized
gtaccatatttctcattgat

SEQ ID NO: 20184 - DNA, 20 bp, Artificial Sequence
  chemically synthesized
tgtaccatatttctcattga

SEQ ID NO: 20185 - DNA, 20 bp, Artificial Sequence
  chemically synthesized
atgcccatcaatgagaaata

SEQ ID NO: 20186 - DNA, 20 bp, Artificial Sequence
  chemically synthesized
aatatggtacatatacacta

SEQ ID NO: 20187 - DNA, 20 bp, Artificial Sequence
  chemically synthesized
tatagctgcatggtattcca

SEQ ID NO: 20188 - DNA, 20 bp, Artificial Sequence
  chemically synthesized
atacactatggaataccatg

SEQ ID NO: 20189 - DNA, 20 bp, Artificial Sequence
  chemically synthesized
cattcttttttatagctgca

SEQ ID NO: 20190 - DNA, 20 bp, Artificial Sequence
  chemically synthesized
aataccatgcagctataaaa

SEQ ID NO: 20191 - DNA, 20 bp, Artificial Sequence
  chemically synthesized
catgatctcattctttttta

SEQ ID NO: 20192 - DNA, 20 bp, Artificial Sequence
  chemically synthesized
atgcagctataaaaaagaat

SEQ ID NO: 20193 - DNA, 20 bp, Artificial Sequence
  chemically synthesized
gagatcatgtcttttgaaca

SEQ ID NO: 20194 - DNA, 20 bp, Artificial Sequence
  chemically synthesized
tccagctaatccgtgttcaa

SEQ ID NO: 20195 - DNA, 20 bp, Artificial Sequence
  chemically synthesized
catgtcttttgaacacggat

SEQ ID NO: 20196 - DNA, 20 bp, Artificial Sequence
  chemically synthesized
tcttttgaacacggattagc

SEQ ID NO: 20197 - DNA, 20 bp, Artificial Sequence
  chemically synthesized
ttttgaacacggattagctg

SEQ ID NO: 20198 - DNA, 20 bp, Artificial Sequence
  chemically synthesized
ttgctaaggataatagtctc

SEQ ID NO: 20199 - DNA, 20 bp, Artificial Sequence
  chemically synthesized
tagctggagactattatcct

SEQ ID NO: 20200 - DNA, 20 bp, Artificial Sequence
  chemically synthesized
cattagtttgctaaggataa

SEQ ID NO: 20201 - DNA, 20 bp, Artificial Sequence
  chemically synthesized
gtttctgcattagtttgcta

SEQ ID NO: 20202 - DNA, 20 bp, Artificial Sequence
  chemically synthesized
tgtttctgcattagtttgct

SEQ ID NO: 20203 - DNA, 20 bp, Artificial Sequence
  chemically synthesized
ttatccttagcaaactaatg

SEQ ID NO: 20204 - DNA, 20 bp, Artificial Sequence
  chemically synthesized
ttacttttctgtttctgcat

SEQ ID NO: 20205 - DNA, 20 bp, Artificial Sequence
  chemically synthesized
ttagcaaactaatgcagaaa

SEQ ID NO: 20206 - DNA, 20 bp, Artificial Sequence
  chemically synthesized
aaactaatgcagaaacagaa

SEQ ID NO: 20207 - DNA, 20 bp, Artificial Sequence
  chemically synthesized
cacttagaagtgagaacatg

SEQ ID NO: 20208 - DNA, 20 bp, Artificial Sequence
  chemically synthesized
tactgcatgttctcacttct

SEQ ID NO: 20209 - DNA, 20 bp, Artificial Sequence
  chemically synthesized
tttagcttccacttagaagt

SEQ ID NO: 20210 - DNA, 20 bp, Artificial Sequence
  chemically synthesized
tgcatgttctcacttctaag

SEQ ID NO: 20211 - DNA, 20 bp, Artificial Sequence
  chemically synthesized
atcatttagcttccacttag

SEQ ID NO: 20212 - DNA, 20 bp, Artificial Sequence
  chemically synthesized
atgttctcacttctaagtgg

SEQ ID NO: 20213 - DNA, 20 bp, Artificial Sequence
  chemically synthesized
ctcatcatttagcttccact

SEQ ID NO: 20214 - DNA, 20 bp, Artificial Sequence
  chemically synthesized
ctaagtggaagctaaatgat

SEQ ID NO: 20215 - DNA, 20 bp, Artificial Sequence
  chemically synthesized
gttcgtgagctctcatcatt

SEQ ID NO: 20216 - DNA, 20 bp, Artificial Sequence
  chemically synthesized
aagtggaagctaaatgatga

SEQ ID NO: 20217 - DNA, 20 bp, Artificial Sequence
  chemically synthesized
tgttgttcccttgtgttcgt

SEQ ID NO: 20218 - DNA, 20 bp, Artificial Sequence
  chemically synthesized
tgatgagagctcacgaacac

SEQ ID NO: 20219 - DNA, 20 bp, Artificial Sequence
  chemically synthesized
gatgagagctcacgaacaca

SEQ ID NO: 20220 - DNA, 20 bp, Artificial Sequence
  chemically synthesized
atgagagctcacgaacacaa

SEQ ID NO: 20221 - DNA, 20 bp, Artificial Sequence
  chemically synthesized
tcacgaacacaagggaacaa

SEQ ID NO: 20222 - DNA, 20 bp, Artificial Sequence
  chemically synthesized
cacaagggaacaacagatac

SEQ ID NO: 20223 - DNA, 20 bp, Artificial Sequence
  chemically synthesized
acaagggaacaacagatact

SEQ ID NO: 20224 - DNA, 20 bp, Artificial Sequence
  chemically synthesized
caagggaacaacagatactg

SEQ ID NO: 20225 - DNA, 20 bp, Artificial Sequence
  chemically synthesized
acaacagatactggggtctt

SEQ ID NO: 20226 - DNA, 20 bp, Artificial Sequence
  chemically synthesized
accctccaccctcaagaccc

SEQ ID NO: 20227 - DNA, 20 bp, Artificial Sequence
  chemically synthesized
caacagatactggggtcttg

SEQ ID NO: 20228 - DNA, 20 bp, Artificial Sequence
  chemically synthesized
aacagatactggggtcttga

SEQ ID NO: 20229 - DNA, 20 bp, Artificial Sequence
  chemically synthesized
agatactggggtcttgaggg

SEQ ID NO: 20230 - DNA, 20 bp, Artificial Sequence
  chemically synthesized
atactggggtcttgagggtg

SEQ ID NO: 20231 - DNA, 20 bp, Artificial Sequence
  chemically synthesized
tccttccaccctccaccctc

SEQ ID NO: 20232 - DNA, 20 bp, Artificial Sequence
  chemically synthesized
tactggggtcttgagggtgg

SEQ ID NO: 20233 - DNA, 20 bp, Artificial Sequence
  chemically synthesized
actggggtcttgagggtgga

SEQ ID NO: 20234 - DNA, 20 bp, Artificial Sequence
  chemically synthesized
ggggtcttgagggtggaggg

SEQ ID NO: 20235 - DNA, 20 bp, Artificial Sequence
  chemically synthesized
gtcttgagggtggagggtgg

SEQ ID NO: 20236 - DNA, 20 bp, Artificial Sequence
  chemically synthesized
tcttgagggtggagggtgga

SEQ ID NO: 20237 - DNA, 20 bp, Artificial Sequence
  chemically synthesized
ttgagggtggagggtggaag

SEQ ID NO: 20238 - DNA, 20 bp, Artificial Sequence
  chemically synthesized
tgagggtggagggtggaagg

SEQ ID NO: 20239 - DNA, 20 bp, Artificial Sequence
  chemically synthesized
gagggtggagggtggaagga

SEQ ID NO: 20240 - DNA, 20 bp, Artificial Sequence
  chemically synthesized
gggtggagggtggaaggagg

SEQ ID NO: 20241 - DNA, 20 bp, Artificial Sequence
  chemically synthesized
gtggagggtggaaggaggga

SEQ ID NO: 20242 - DNA, 20 bp, Artificial Sequence
  chemically synthesized
tggagggtggaaggagggag

SEQ ID NO: 20243 - DNA, 20 bp, Artificial Sequence
  chemically synthesized
gagggtggaaggagggagag

SEQ ID NO: 20244 - DNA, 20 bp, Artificial Sequence
  chemically synthesized
ggtggaaggagggagaggag

SEQ ID NO: 20245 - DNA, 20 bp, Artificial Sequence
  chemically synthesized
aaggagggagaggagcagaa

SEQ ID NO: 20246 - DNA, 20 bp, Artificial Sequence
  chemically synthesized
ggagcagaaaagacaactgt

SEQ ID NO: 20247 - DNA, 20 bp, Artificial Sequence
  chemically synthesized
gagcagaaaagacaactgtt

SEQ ID NO: 20248 - DNA, 20 bp, Artificial Sequence
  chemically synthesized
gggttaagcgcagtacccaa

SEQ ID NO: 20249 - DNA, 20 bp, Artificial Sequence
  chemically synthesized
cagcataaatgggttaagcg

SEQ ID NO: 20250 - DNA, 20 bp, Artificial Sequence
  chemically synthesized
gcctccagcataaatgggtt

SEQ ID NO: 20251 - DNA, 20 bp, Artificial Sequence
  chemically synthesized
atgcagcctccagcataaat

SEQ ID NO: 20252 - DNA, 20 bp, Artificial Sequence
  chemically synthesized
tgcgcttaacccatttatgc

SEQ ID NO: 20253 - DNA, 20 bp, Artificial Sequence
  chemically synthesized
tatgcagcctccagcataaa

SEQ ID NO: 20254 - DNA, 20 bp, Artificial Sequence
  chemically synthesized
cgcttaacccatttatgctg

SEQ ID NO: 20255 - DNA, 20 bp, Artificial Sequence
  chemically synthesized
gcttaacccatttatgctgg

SEQ ID NO: 20256 - DNA, 20 bp, Artificial Sequence
  chemically synthesized
aaaaagtaatatgcagcctc

SEQ ID NO: 20257 - DNA, 20 bp, Artificial Sequence
  chemically synthesized
ttttcacaaaaagtaatatg

SEQ ID NO: 20258 - DNA, 20 bp, Artificial Sequence
  chemically synthesized
caaggtctgattttcacaaa

SEQ ID NO: 20259 - DNA, 20 bp, Artificial Sequence
  chemically synthesized
atattactttttgtgaaaat

SEQ ID NO: 20260 - DNA, 20 bp, Artificial Sequence
  chemically synthesized
tttttgtgaaaatcagacct

SEQ ID NO: 20261 - DNA, 20 bp, Artificial Sequence
  chemically synthesized
actgctcaaggtcatcgcca

SEQ ID NO: 20262 - DNA, 20 bp, Artificial Sequence
  chemically synthesized
tactgctcaaggtcatcgcc

SEQ ID NO: 20263 - DNA, 20 bp, Artificial Sequence
  chemically synthesized
cagaccttggcgatgacctt

SEQ ID NO: 20264 - DNA, 20 bp, Artificial Sequence
  chemically synthesized
accttggcgatgaccttgag

SEQ ID NO: 20265 - DNA, 20 bp, Artificial Sequence
  chemically synthesized
ttggcgatgaccttgagcag

SEQ ID NO: 20266 - DNA, 20 bp, Artificial Sequence
  chemically synthesized
tattcctatcctactgctca

SEQ ID NO: 20267 - DNA, 20 bp, Artificial Sequence
  chemically synthesized
tggcgatgaccttgagcagt

SEQ ID NO: 20268 - DNA, 20 bp, Artificial Sequence
  chemically synthesized
ttattcctatcctactgctc

SEQ ID NO: 20269 - DNA, 20 bp, Artificial Sequence
  chemically synthesized
gatgaccttgagcagtagga

SEQ ID NO: 20270 - DNA, 20 bp, Artificial Sequence
  chemically synthesized
atgaccttgagcagtaggat

SEQ ID NO: 20271 - DNA, 20 bp, Artificial Sequence
  chemically synthesized
aggataggaataattcccac

SEQ ID NO: 20272 - DNA, 20 bp, Artificial Sequence
  chemically synthesized
aggaataattcccacaagct

SEQ ID NO: 20273 - DNA, 20 bp, Artificial Sequence
  chemically synthesized
tattggaacactaagcttgt

SEQ ID NO: 20274 - DNA, 20 bp, Artificial Sequence
  chemically synthesized
ttattggaacactaagcttg

SEQ ID NO: 20275 - DNA, 20 bp, Artificial Sequence
  chemically synthesized
tgttccattattggaacact

SEQ ID NO: 20276 - DNA, 20 bp, Artificial Sequence
  chemically synthesized
caagcttagtgttccaataa

SEQ ID NO: 20277 - DNA, 20 bp, Artificial Sequence
  chemically synthesized
tatgcctagtgttccattat

SEQ ID NO: 20278 - DNA, 20 bp, Artificial Sequence
  chemically synthesized
gtgttccaataatggaacac

SEQ ID NO: 20279 - DNA, 20 bp, Artificial Sequence
  chemically synthesized
tgttccaataatggaacact

SEQ ID NO: 20280 - DNA, 20 bp, Artificial Sequence
  chemically synthesized
ggtattaacccatttatgcc

SEQ ID NO: 20281 - DNA, 20 bp, Artificial Sequence
  chemically synthesized
aatggaacactaggcataaa

SEQ ID NO: 20282 - DNA, 20 bp, Artificial Sequence
  chemically synthesized
atggaacactaggcataaat

SEQ ID NO: 20283 - DNA, 20 bp, Artificial Sequence
  chemically synthesized
gcataaatgggttaatacct

SEQ ID NO: 20284 - DNA, 20 bp, Artificial Sequence
  chemically synthesized
tacagattatttcatcactc

SEQ ID NO: 20285 - DNA, 20 bp, Artificial Sequence
  chemically synthesized
gtacagattatttcatcact

SEQ ID NO: 20286 - DNA, 20 bp, Artificial Sequence
  chemically synthesized
cgtcacgggggtttgttgta

SEQ ID NO: 20287 - DNA, 20 bp, Artificial Sequence
  chemically synthesized
taggtaaactcacgtcacgg

SEQ ID NO: 20288 - DNA, 20 bp, Artificial Sequence
  chemically synthesized
ataggtaaactcacgtcacg

SEQ ID NO: 20289 - DNA, 20 bp, Artificial Sequence
  chemically synthesized
acaacaaacccccgtgacgt

SEQ ID NO: 20290 - DNA, 20 bp, Artificial Sequence
  chemically synthesized
cataggtaaactcacgtcac

SEQ ID NO: 20291 - DNA, 20 bp, Artificial Sequence
  chemically synthesized
acataggtaaactcacgtca

SEQ ID NO: 20292 - DNA, 20 bp, Artificial Sequence
  chemically synthesized
acgtgagtttacctatgtaa

SEQ ID NO: 20293 - DNA, 20 bp, Artificial Sequence
  chemically synthesized
tatgtgaaggtctgttacat

SEQ ID NO: 20294 - DNA, 20 bp, Artificial Sequence
  chemically synthesized
ttatgtgaaggtctgttaca

SEQ ID NO: 20295 - DNA, 20 bp, Artificial Sequence
  chemically synthesized
ggtttcggggtattatgtga

SEQ ID NO: 20296 - DNA, 20 bp, Artificial Sequence
  chemically synthesized
aggtttcggggtattatgtg

SEQ ID NO: 20297 - DNA, 20 bp, Artificial Sequence
  chemically synthesized
aactttaattttaggtttcg

SEQ ID NO: 20298 - DNA, 20 bp, Artificial Sequence
  chemically synthesized
taactttaattttaggtttc

SEQ ID NO: 20299 - DNA, 20 bp, Artificial Sequence
  chemically synthesized
ttaactttaattttaggttt

SEQ ID NO: 20300 - DNA, 20 bp, Artificial Sequence
  chemically synthesized
taccccgaaacctaaaatta

SEQ ID NO: 20301 - DNA, 20 bp, Artificial Sequence
  chemically synthesized
cactttttaactttaatttt

SEQ ID NO: 20302 - DNA, 20 bp, Artificial Sequence
  chemically synthesized
acactttttaactttaattt

SEQ ID NO: 20303 - DNA, 20 bp, Artificial Sequence
  chemically synthesized
aacctaaaattaaagttaaa

SEQ ID NO: 20304 - DNA, 20 bp, Artificial Sequence
  chemically synthesized
agttaaaaagtgtctttcaa

SEQ ID NO: 20305 - DNA, 20 bp, Artificial Sequence
  chemically synthesized
agaagccaaaaaactattga

SEQ ID NO: 20306 - DNA, 20 bp, Artificial Sequence
  chemically synthesized
agtgtctttcaatagttttt

SEQ ID NO: 20307 - DNA, 20 bp, Artificial Sequence
  chemically synthesized
gctttccgtaataaaataag

SEQ ID NO: 20308 - DNA, 20 bp, Artificial Sequence
  chemically synthesized
gtagctttccgtaataaaat

SEQ ID NO: 20309 - DNA, 20 bp, Artificial Sequence
  chemically synthesized
tttggcttcttattttatta

SEQ ID NO: 20310 - DNA, 20 bp, Artificial Sequence
  chemically synthesized
gcttcttattttattacgga

SEQ ID NO: 20311 - DNA, 20 bp, Artificial Sequence
  chemically synthesized
attttattacggaaagctac

SEQ ID NO: 20312 - DNA, 20 bp, Artificial Sequence
  chemically synthesized
taccaatatctaagggccag

SEQ ID NO: 20313 - DNA, 20 bp, Artificial Sequence
  chemically synthesized
tacggaaagctactggccct

SEQ ID NO: 20314 - DNA, 20 bp, Artificial Sequence
  chemically synthesized
ttttaccaatatctaagggc

SEQ ID NO: 20315 - DNA, 20 bp, Artificial Sequence
  chemically synthesized
ttctttttaccaatatctaa

SEQ ID NO: 20316 - DNA, 20 bp, Artificial Sequence
  chemically synthesized
agctactggcccttagatat

SEQ ID NO: 20317 - DNA, 20 bp, Artificial Sequence
  chemically synthesized
tttctttttaccaatatcta

SEQ ID NO: 20318 - DNA, 20 bp, Artificial Sequence
  chemically synthesized
ttttctttttaccaatatct

SEQ ID NO: 20319 - DNA, 20 bp, Artificial Sequence
  chemically synthesized
ggcccttagatattggtaaa

SEQ ID NO: 20320 - DNA, 20 bp, Artificial Sequence
  chemically synthesized
tagatattggtaaaaagaaa

SEQ ID NO: 20321 - DNA, 20 bp, Artificial Sequence
  chemically synthesized
agatattggtaaaaagaaaa

SEQ ID NO: 20322 - DNA, 20 bp, Artificial Sequence
  chemically synthesized
atattggtaaaaagaaaaag

SEQ ID NO: 20323 - DNA, 20 bp, Artificial Sequence
  chemically synthesized
agaaaaaggagaaaatattt

SEQ ID NO: 20324 - DNA, 20 bp, Artificial Sequence
  chemically synthesized
tttcagaataattcgcctat

SEQ ID NO: 20325 - DNA, 20 bp, Artificial Sequence
  chemically synthesized
tgtgattttgaagtgctaat

SEQ ID NO: 20326 - DNA, 20 bp, Artificial Sequence
  chemically synthesized
ttgtgattttgaagtgctaa

SEQ ID NO: 20327 - DNA, 20 bp, Artificial Sequence
  chemically synthesized
acctatcctttgtgattttg

SEQ ID NO: 20328 - DNA, 20 bp, Artificial Sequence
  chemically synthesized
attagcacttcaaaatcaca

SEQ ID NO: 20329 - DNA, 20 bp, Artificial Sequence
  chemically synthesized
ttagcacttcaaaatcacaa

SEQ ID NO: 20330 - DNA, 20 bp, Artificial Sequence
  chemically synthesized
cacttcaaaatcacaaagga

SEQ ID NO: 20331 - DNA, 20 bp, Artificial Sequence
  chemically synthesized
acttcaaaatcacaaaggat

SEQ ID NO: 20332 - DNA, 20 bp, Artificial Sequence
  chemically synthesized
tcacaaaggataggtcccaa

SEQ ID NO: 20333 - DNA, 20 bp, Artificial Sequence
  chemically synthesized
caaaggataggtcccaatgg

SEQ ID NO: 20334 - DNA, 20 bp, Artificial Sequence
  chemically synthesized
caccgaaaataaccgccatt

SEQ ID NO: 20335 - DNA, 20 bp, Artificial Sequence
  chemically synthesized
tcaccgaaaataaccgccat

SEQ ID NO: 20336 - DNA, 20 bp, Artificial Sequence
  chemically synthesized
gtcccaatggcggttatttt

SEQ ID NO: 20337 - DNA, 20 bp, Artificial Sequence
  chemically synthesized
tgaacaatatgctcaacttc

SEQ ID NO: 20338 - DNA, 20 bp, Artificial Sequence
  chemically synthesized
aattttagtagctggaagtt

SEQ ID NO: 20339 - DNA, 20 bp, Artificial Sequence
  chemically synthesized
taataaattttagtagctgg

SEQ ID NO: 20340 - DNA, 20 bp, Artificial Sequence
  chemically synthesized
atttaataaattttagtagc

SEQ ID NO: 20341 - DNA, 20 bp, Artificial Sequence
  chemically synthesized
agggatttaataaattttag

SEQ ID NO: 20342 - DNA, 20 bp, Artificial Sequence
  chemically synthesized
ctgagggatttaataaattt

SEQ ID NO: 20343 - DNA, 20 bp, Artificial Sequence
  chemically synthesized
ctaaaatttattaaatccct

SEQ ID NO: 20344 - DNA, 20 bp, Artificial Sequence
  chemically synthesized
caggatttctttttgactga

SEQ ID NO: 20345 - DNA, 20 bp, Artificial Sequence
  chemically synthesized
ccaggatttctttttgactg

SEQ ID NO: 20346 - DNA, 20 bp, Artificial Sequence
  chemically synthesized
tattaaatccctcagtcaaa

SEQ ID NO: 20347 - DNA, 20 bp, Artificial Sequence
  chemically synthesized
cccaggatttctttttgact

SEQ ID NO: 20348 - DNA, 20 bp, Artificial Sequence
  chemically synthesized
cctcagtcaaaaagaaatcc

SEQ ID NO: 20349 - DNA, 20 bp, Artificial Sequence
  chemically synthesized
ctcagtcaaaaagaaatcct

SEQ ID NO: 20350 - DNA, 20 bp, Artificial Sequence
  chemically synthesized
tgtttagtccattagtgccc

SEQ ID NO: 20351 - DNA, 20 bp, Artificial Sequence
  chemically synthesized
ttgtttagtccattagtgcc

SEQ ID NO: 20352 - DNA, 20 bp, Artificial Sequence
  chemically synthesized
aaagaaatcctgggcactaa

SEQ ID NO: 20353 - DNA, 20 bp, Artificial Sequence
  chemically synthesized
taggaatttgtttagtccat

SEQ ID NO: 20354 - DNA, 20 bp, Artificial Sequence
  chemically synthesized
tccagtgataggaatttgtt

SEQ ID NO: 20355 - DNA, 20 bp, Artificial Sequence
  chemically synthesized
actaaacaaattcctatcac

SEQ ID NO: 20356 - DNA, 20 bp, Artificial Sequence
  chemically synthesized
taagaaaattttccagtgat

SEQ ID NO: 20357 - DNA, 20 bp, Artificial Sequence
  chemically synthesized
ataagaaaattttccagtga

SEQ ID NO: 20358 - DNA, 20 bp, Artificial Sequence
  chemically synthesized
agaaagataagaaaattttc

SEQ ID NO: 20359 - DNA, 20 bp, Artificial Sequence
  chemically synthesized
ttcttaagagggagaaagat

SEQ ID NO: 20360 - DNA, 20 bp, Artificial Sequence
  chemically synthesized
accttttcttaagagggaga

SEQ ID NO: 20361 - DNA, 20 bp, Artificial Sequence
  chemically synthesized
ttcttatctttctccctctt

SEQ ID NO: 20362 - DNA, 20 bp, Artificial Sequence
  chemically synthesized
atctaccttttcttaagagg

SEQ ID NO: 20363 - DNA, 20 bp, Artificial Sequence
  chemically synthesized
tgatctaccttttcttaaga

SEQ ID NO: 20364 - DNA, 20 bp, Artificial Sequence
  chemically synthesized
ttgatctaccttttcttaag

SEQ ID NO: 20365 - DNA, 20 bp, Artificial Sequence
  chemically synthesized
atctttctccctcttaagaa

SEQ ID NO: 20366 - DNA, 20 bp, Artificial Sequence
  chemically synthesized
tttgatctaccttttcttaa

SEQ ID NO: 20367 - DNA, 20 bp, Artificial Sequence
  chemically synthesized
tctttctccctcttaagaaa

SEQ ID NO: 20368 - DNA, 20 bp, Artificial Sequence
  chemically synthesized
attttgatctaccttttctt

SEQ ID NO: 20369 - DNA, 20 bp, Artificial Sequence
  chemically synthesized
ttctccctcttaagaaaagg

SEQ ID NO: 20370 - DNA, 20 bp, Artificial Sequence
  chemically synthesized
tttaacaaatccactttata

SEQ ID NO: 20371 - DNA, 20 bp, Artificial Sequence
  chemically synthesized
acctgagttgctgtataaag

SEQ ID NO: 20372 - DNA, 20 bp, Artificial Sequence
  chemically synthesized
aagacctgagttgctgtata

SEQ ID NO: 20373 - DNA, 20 bp, Artificial Sequence
  chemically synthesized
atccactttatacagcaact

SEQ ID NO: 20374 - DNA, 20 bp, Artificial Sequence
  chemically synthesized
tccactttatacagcaactc

SEQ ID NO: 20375 - DNA, 20 bp, Artificial Sequence
  chemically synthesized
ttttaactccttgaagacct

SEQ ID NO: 20376 - DNA, 20 bp, Artificial Sequence
  chemically synthesized
atacagcaactcaggtcttc

SEQ ID NO: 20377 - DNA, 20 bp, Artificial Sequence
  chemically synthesized
tacagcaactcaggtcttca

SEQ ID NO: 20378 - DNA, 20 bp, Artificial Sequence
  chemically synthesized
cagcaactcaggtcttcaag

SEQ ID NO: 20379 - DNA, 20 bp, Artificial Sequence
  chemically synthesized
gtgacaattttaactccttg

SEQ ID NO: 20380 - DNA, 20 bp, Artificial Sequence
  chemically synthesized
ctacctgactgaaaagtatt

SEQ ID NO: 20381 - DNA, 20 bp, Artificial Sequence
  chemically synthesized
aattgtcaccaaatactttt

SEQ ID NO: 20382 - DNA, 20 bp, Artificial Sequence
  chemically synthesized
gtcaccaaatacttttcagt

SEQ ID NO: 20383 - DNA, 20 bp, Artificial Sequence
  chemically synthesized
tcaccaaatacttttcagtc

SEQ ID NO: 20384 - DNA, 20 bp, Artificial Sequence
  chemically synthesized
cttccttctacctgactgaa

SEQ ID NO: 20385 - DNA, 20 bp, Artificial Sequence
  chemically synthesized
ccaaatacttttcagtcagg

SEQ ID NO: 20386 - DNA, 20 bp, Artificial Sequence
  chemically synthesized
aatacttttcagtcaggtag

SEQ ID NO: 20387 - DNA, 20 bp, Artificial Sequence
  chemically synthesized
atacttttcagtcaggtaga

SEQ ID NO: 20388 - DNA, 20 bp, Artificial Sequence
  chemically synthesized
cttttcagtcaggtagaagg

SEQ ID NO: 20389 - DNA, 20 bp, Artificial Sequence
  chemically synthesized
gtagaaggaagttatacatt

SEQ ID NO: 20390 - DNA, 20 bp, Artificial Sequence
  chemically synthesized
gcattcacatgtcatctgca

SEQ ID NO: 20391 - DNA, 20 bp, Artificial Sequence
  chemically synthesized
ttttggcactgttttctttg

SEQ ID NO: 20392 - DNA, 20 bp, Artificial Sequence
  chemically synthesized
catgtcatctgcaaagaaaa

SEQ ID NO: 20393 - DNA, 20 bp, Artificial Sequence
  chemically synthesized
gtttcccctcaaatatattt

SEQ ID NO: 20394 - DNA, 20 bp, Artificial Sequence
  chemically synthesized
aacagtgccaaaatatattt

SEQ ID NO: 20395 - DNA, 20 bp, Artificial Sequence
  chemically synthesized
acagtgccaaaatatatttg

SEQ ID NO: 20396 - DNA, 20 bp, Artificial Sequence
  chemically synthesized
cagtgccaaaatatatttga

SEQ ID NO: 20397 - DNA, 20 bp, Artificial Sequence
  chemically synthesized
agtgccaaaatatatttgag

SEQ ID NO: 20398 - DNA, 20 bp, Artificial Sequence
  chemically synthesized
tttgataagagtttgtattc

SEQ ID NO: 20399 - DNA, 20 bp, Artificial Sequence
  chemically synthesized
ttttgataagagtttgtatt

SEQ ID NO: 20400 - DNA, 20 bp, Artificial Sequence
  chemically synthesized
gttcacattagttttgataa

SEQ ID NO: 20401 - DNA, 20 bp, Artificial Sequence
  chemically synthesized
acgttcacattagttttgat

SEQ ID NO: 20402 - DNA, 20 bp, Artificial Sequence
  chemically synthesized
attgtgaactacgttcacat

SEQ ID NO: 20403 - DNA, 20 bp, Artificial Sequence
  chemically synthesized
tatcaaaactaatgtgaacg

SEQ ID NO: 20404 - DNA, 20 bp, Artificial Sequence
  chemically synthesized
taccaagtccttgaacatgt

SEQ ID NO: 20405 - DNA, 20 bp, Artificial Sequence
  chemically synthesized
aattgaaatccgacatgttc

SEQ ID NO: 20406 - DNA, 20 bp, Artificial Sequence
  chemically synthesized
attgaaatccgacatgttca

SEQ ID NO: 20407 - DNA, 20 bp, Artificial Sequence
  chemically synthesized
atccgacatgttcaaggact

SEQ ID NO: 20408 - DNA, 20 bp, Artificial Sequence
  chemically synthesized
cgacatgttcaaggacttgg

SEQ ID NO: 20409 - DNA, 20 bp, Artificial Sequence
  chemically synthesized
attcatcatagtcatctacc

SEQ ID NO: 20410 - DNA, 20 bp, Artificial Sequence
  chemically synthesized
cctgactattacattcatca

SEQ ID NO: 20411 - DNA, 20 bp, Artificial Sequence
  chemically synthesized
gatgactatgatgaatgtaa

SEQ ID NO: 20412 - DNA, 20 bp, Artificial Sequence
  chemically synthesized
actatgatgaatgtaatagt

SEQ ID NO: 20413 - DNA, 20 bp, Artificial Sequence
  chemically synthesized
ctatgatgaatgtaatagtc

SEQ ID NO: 20414 - DNA, 20 bp, Artificial Sequence
  chemically synthesized
tgatgaatgtaatagtcagg

SEQ ID NO: 20415 - DNA, 20 bp, Artificial Sequence
  chemically synthesized
gtattgctttttaaaatttc

SEQ ID NO: 20416 - DNA, 20 bp, Artificial Sequence
  chemically synthesized
ggtattgctttttaaaattt

SEQ ID NO: 20417 - DNA, 20 bp, Artificial Sequence
  chemically synthesized
ggtggtcctgaaattttaaa

SEQ ID NO: 20418 - DNA, 20 bp, Artificial Sequence
  chemically synthesized
ttttctttcttattttgata

SEQ ID NO: 20419 - DNA, 20 bp, Artificial Sequence
  chemically synthesized
tttttctttcttattttgat

SEQ ID NO: 20420 - DNA, 20 bp, Artificial Sequence
  chemically synthesized
aagcaataccttatcaaaat

SEQ ID NO: 20421 - DNA, 20 bp, Artificial Sequence
  chemically synthesized
aataccttatcaaaataaga

SEQ ID NO: 20422 - DNA, 20 bp, Artificial Sequence
  chemically synthesized
atcaaaataagaaagaaaaa

SEQ ID NO: 20423 - DNA, 20 bp, Artificial Sequence
  chemically synthesized
tcaaaataagaaagaaaaaa

SEQ ID NO: 20424 - DNA, 20 bp, Artificial Sequence
  chemically synthesized
agaaaaaaaggtataaattt

SEQ ID NO: 20425 - DNA, 20 bp, Artificial Sequence
  chemically synthesized
aggtataaattttagttcaa

SEQ ID NO: 20426 - DNA, 20 bp, Artificial Sequence
  chemically synthesized
ggtataaattttagttcaaa

SEQ ID NO: 20427 - DNA, 20 bp, Artificial Sequence
  chemically synthesized
ataaattttagttcaaaagg

SEQ ID NO: 20428 - DNA, 20 bp, Artificial Sequence
  chemically synthesized
aattttagttcaaaaggtag

SEQ ID NO: 20429 - DNA, 20 bp, Artificial Sequence
  chemically synthesized
tttagttcaaaaggtagtag

SEQ ID NO: 20430 - DNA, 20 bp, Artificial Sequence
  chemically synthesized
ggtagtagaagtctacaaca

SEQ ID NO: 20431 - DNA, 20 bp, Artificial Sequence
  chemically synthesized
gtagtagaagtctacaacaa

SEQ ID NO: 20432 - DNA, 20 bp, Artificial Sequence
  chemically synthesized
tttgccttttacctttgttg

SEQ ID NO: 20433 - DNA, 20 bp, Artificial Sequence
  chemically synthesized
gaagtctacaacaaaggtaa

SEQ ID NO: 20434 - DNA, 20 bp, Artificial Sequence
  chemically synthesized
aagtctacaacaaaggtaaa

SEQ ID NO: 20435 - DNA, 20 bp, Artificial Sequence
  chemically synthesized
aacaaaggtaaaaggcaaaa

SEQ ID NO: 20436 - DNA, 20 bp, Artificial Sequence
  chemically synthesized
agttgttttgcaactctttt

SEQ ID NO: 20437 - DNA, 20 bp, Artificial Sequence
  chemically synthesized
ctgggaaggttttctgaaaa

SEQ ID NO: 20438 - DNA, 20 bp, Artificial Sequence
  chemically synthesized
atctgggaaggttttctgaa

SEQ ID NO: 20439 - DNA, 20 bp, Artificial Sequence
  chemically synthesized
ctcttttcagaaaaccttcc

SEQ ID NO: 20440 - DNA, 20 bp, Artificial Sequence
  chemically synthesized
tcccatttggaaatctggga

SEQ ID NO: 20441 - DNA, 20 bp, Artificial Sequence
  chemically synthesized
ctcccatttggaaatctggg

SEQ ID NO: 20442 - DNA, 20 bp, Artificial Sequence
  chemically synthesized
atactcccatttggaaatct

SEQ ID NO: 20443 - DNA, 20 bp, Artificial Sequence
  chemically synthesized
catactcccatttggaaatc

SEQ ID NO: 20444 - DNA, 20 bp, Artificial Sequence
  chemically synthesized
aaccttcccagatttccaaa

SEQ ID NO: 20445 - DNA, 20 bp, Artificial Sequence
  chemically synthesized
accttcccagatttccaaat

SEQ ID NO: 20446 - DNA, 20 bp, Artificial Sequence
  chemically synthesized
cttcccagatttccaaatgg

SEQ ID NO: 20447 - DNA, 20 bp, Artificial Sequence
  chemically synthesized
atcaagaacatactcccatt

SEQ ID NO: 20448 - DNA, 20 bp, Artificial Sequence
  chemically synthesized
aatgggagtatgttcttgat

SEQ ID NO: 20449 - DNA, 20 bp, Artificial Sequence
  chemically synthesized
catgcctcatttcaccaatc

SEQ ID NO: 20450 - DNA, 20 bp, Artificial Sequence
  chemically synthesized
atgttcttgattggtgaaat

SEQ ID NO: 20451 - DNA, 20 bp, Artificial Sequence
  chemically synthesized
tgttcttgattggtgaaatg

SEQ ID NO: 20452 - DNA, 20 bp, Artificial Sequence
  chemically synthesized
atgaggcatgtaataatttt

SEQ ID NO: 20453 - DNA, 20 bp, Artificial Sequence
  chemically synthesized
atgtaataattttgagatct

SEQ ID NO: 20454 - DNA, 20 bp, Artificial Sequence
  chemically synthesized
taataattttgagatctaag

SEQ ID NO: 20455 - DNA, 20 bp, Artificial Sequence
  chemically synthesized
aattttgcctaaattcttct

SEQ ID NO: 20456 - DNA, 20 bp, Artificial Sequence
  chemically synthesized
tttgagatctaagaagaatt

SEQ ID NO: 20457 - DNA, 20 bp, Artificial Sequence
  chemically synthesized
ttgagatctaagaagaattt

SEQ ID NO: 20458 - DNA, 20 bp, Artificial Sequence
  chemically synthesized
agaagaatttaggcaaaatt

SEQ ID NO: 20459 - DNA, 20 bp, Artificial Sequence
  chemically synthesized
aagaagggagcagaaggaat

SEQ ID NO: 20460 - DNA, 20 bp, Artificial Sequence
  chemically synthesized
caattgaagaagggagcaga

SEQ ID NO: 20461 - DNA, 20 bp, Artificial Sequence
  chemically synthesized
acaattgaagaagggagcag

SEQ ID NO: 20462 - DNA, 20 bp, Artificial Sequence
  chemically synthesized
aagacaattgaagaagggag

SEQ ID NO: 20463 - DNA, 20 bp, Artificial Sequence
  chemically synthesized
atgaagacaattgaagaagg

SEQ ID NO: 20464 - DNA, 20 bp, Artificial Sequence
  chemically synthesized
taatgaagacaattgaagaa

SEQ ID NO: 20465 - DNA, 20 bp, Artificial Sequence
  chemically synthesized
ttaatgaagacaattgaaga

SEQ ID NO: 20466 - DNA, 20 bp, Artificial Sequence
  chemically synthesized
cttaatgaagacaattgaag

SEQ ID NO: 20467 - DNA, 20 bp, Artificial Sequence
  chemically synthesized
gagcttaatgaagacaattg

SEQ ID NO: 20468 - DNA, 20 bp, Artificial Sequence
  chemically synthesized
cttcttcaattgtcttcatt

SEQ ID NO: 20469 - DNA, 20 bp, Artificial Sequence
  chemically synthesized
tttttttcttgagcttaatg

SEQ ID NO: 20470 - DNA, 20 bp, Artificial Sequence
  chemically synthesized
caattgtcttcattaagctc

SEQ ID NO: 20471 - DNA, 20 bp, Artificial Sequence
  chemically synthesized
ttctgatttttttttttctt

SEQ ID NO: 20472 - DNA, 20 bp, Artificial Sequence
  chemically synthesized
agctcaagaaaaaaaaaaat

SEQ ID NO: 20473 - DNA, 20 bp, Artificial Sequence
  chemically synthesized
agaaaaaaaaaaatcagaac

SEQ ID NO: 20474 - DNA, 20 bp, Artificial Sequence
  chemically synthesized
gaaaaaaaaaaatcagaact

SEQ ID NO: 20475 - DNA, 20 bp, Artificial Sequence
  chemically synthesized
aaaaaaaaaaatcagaactg

SEQ ID NO: 20476 - DNA, 20 bp, Artificial Sequence
  chemically synthesized
gcacacaagggagatatccc

SEQ ID NO: 20477 - DNA, 20 bp, Artificial Sequence
  chemically synthesized
gttttggattgcacacaagg

SEQ ID NO: 20478 - DNA, 20 bp, Artificial Sequence
  chemically synthesized
ttgttttggattgcacacaa

SEQ ID NO: 20479 - DNA, 20 bp, Artificial Sequence
  chemically synthesized
tttgttttggattgcacaca

SEQ ID NO: 20480 - DNA, 20 bp, Artificial Sequence
  chemically synthesized
gtttgttttggattgcacac

SEQ ID NO: 20481 - DNA, 20 bp, Artificial Sequence
  chemically synthesized
tagagaacaattgtttgttt

SEQ ID NO: 20482 - DNA, 20 bp, Artificial Sequence
  chemically synthesized
aaaacaaacaattgttctct

SEQ ID NO: 20483 - DNA, 20 bp, Artificial Sequence
  chemically synthesized
aacaaacaattgttctctaa

SEQ ID NO: 20484 - DNA, 20 bp, Artificial Sequence
  chemically synthesized
caaacaattgttctctaaga

SEQ ID NO: 20485 - DNA, 20 bp, Artificial Sequence
  chemically synthesized
aacaattgttctctaagaga

SEQ ID NO: 20486 - DNA, 20 bp, Artificial Sequence
  chemically synthesized
ccattcatcactctctctta

SEQ ID NO: 20487 - DNA, 20 bp, Artificial Sequence
  chemically synthesized
ctccattcatcactctctct

SEQ ID NO: 20488 - DNA, 20 bp, Artificial Sequence
  chemically synthesized
ctctaagagagagtgatgaa

SEQ ID NO: 20489 - DNA, 20 bp, Artificial Sequence
  chemically synthesized
ctaagagagagtgatgaatg

SEQ ID NO: 20490 - DNA, 20 bp, Artificial Sequence
  chemically synthesized
taagagagagtgatgaatgg

SEQ ID NO: 20491 - DNA, 20 bp, Artificial Sequence
  chemically synthesized
gattttatgaagtttcagtt

SEQ ID NO: 20492 - DNA, 20 bp, Artificial Sequence
  chemically synthesized
aataagattttatgaagttt

SEQ ID NO: 20493 - DNA, 20 bp, Artificial Sequence
  chemically synthesized
ttttttaataagattttatg

SEQ ID NO: 20494 - DNA, 20 bp, Artificial Sequence
  chemically synthesized
gttttcttttgttttttaat

SEQ ID NO: 20495 - DNA, 20 bp, Artificial Sequence
  chemically synthesized
aaaatcttattaaaaaacaa

SEQ ID NO: 20496 - DNA, 20 bp, Artificial Sequence
  chemically synthesized
aagaaaacgaaaaatgttct

SEQ ID NO: 20497 - DNA, 20 bp, Artificial Sequence
  chemically synthesized
acgaaaaatgttctcagttt

SEQ ID NO: 20498 - DNA, 20 bp, Artificial Sequence
  chemically synthesized
caaacttagcttctcaaact

SEQ ID NO: 20499 - DNA, 20 bp, Artificial Sequence
  chemically synthesized
aaaaatgttctcagtttgag

SEQ ID NO: 20500 - DNA, 20 bp, Artificial Sequence
  chemically synthesized
tgttctcagtttgagaagct

SEQ ID NO: 20501 - DNA, 20 bp, Artificial Sequence
  chemically synthesized
agcccttaatacagcaaact

SEQ ID NO: 20502 - DNA, 20 bp, Artificial Sequence
  chemically synthesized
gaagctaagtttgctgtatt

SEQ ID NO: 20503 - DNA, 20 bp, Artificial Sequence
  chemically synthesized
aagctaagtttgctgtatta

SEQ ID NO: 20504 - DNA, 20 bp, Artificial Sequence
  chemically synthesized
agctaagtttgctgtattaa

SEQ ID NO: 20505 - DNA, 20 bp, Artificial Sequence
  chemically synthesized
atgaaaacaagcccttaata

SEQ ID NO: 20506 - DNA, 20 bp, Artificial Sequence
  chemically synthesized
aggccaaacaaaatgaaaac

SEQ ID NO: 20507 - DNA, 20 bp, Artificial Sequence
  chemically synthesized
gggcttgttttcattttgtt

SEQ ID NO: 20508 - DNA, 20 bp, Artificial Sequence
  chemically synthesized
gcagaagattatgaattgat

SEQ ID NO: 20509 - DNA, 20 bp, Artificial Sequence
  chemically synthesized
tgcagaagattatgaattga

SEQ ID NO: 20510 - DNA, 20 bp, Artificial Sequence
  chemically synthesized
caattcataatcttctgcaa

SEQ ID NO: 20511 - DNA, 20 bp, Artificial Sequence
  chemically synthesized
tacttaggacacttttgcag

SEQ ID NO: 20512 - DNA, 20 bp, Artificial Sequence
  chemically synthesized
tgatacttaggacacttttg

SEQ ID NO: 20513 - DNA, 20 bp, Artificial Sequence
  chemically synthesized
atcttctgcaaaagtgtcct

SEQ ID NO: 20514 - DNA, 20 bp, Artificial Sequence
  chemically synthesized
tgcaaaagtgtcctaagtat

SEQ ID NO: 20515 - DNA, 20 bp, Artificial Sequence
  chemically synthesized
aatggtcttagctgatactt

SEQ ID NO: 20516 - DNA, 20 bp, Artificial Sequence
  chemically synthesized
gaatggtcttagctgatact

SEQ ID NO: 20517 - DNA, 20 bp, Artificial Sequence
  chemically synthesized
aagtgtcctaagtatcagct

SEQ ID NO: 20518 - DNA, 20 bp, Artificial Sequence
  chemically synthesized
tctccagatcagaatggtct

SEQ ID NO: 20519 - DNA, 20 bp, Artificial Sequence
  chemically synthesized
cacctgtctccagatcagaa

SEQ ID NO: 20520 - DNA, 20 bp, Artificial Sequence
  chemically synthesized
cagctaagaccattctgatc

SEQ ID NO: 20521 - DNA, 20 bp, Artificial Sequence
  chemically synthesized
gctaagaccattctgatctg

SEQ ID NO: 20522 - DNA, 20 bp, Artificial Sequence
  chemically synthesized
tggcacacctgtctccagat

SEQ ID NO: 20523 - DNA, 20 bp, Artificial Sequence
  chemically synthesized
agaccattctgatctggaga

SEQ ID NO: 20524 - DNA, 20 bp, Artificial Sequence
  chemically synthesized
gaccattctgatctggagac

SEQ ID NO: 20525 - DNA, 20 bp, Artificial Sequence
  chemically synthesized
gatactggcacacctgtctc

SEQ ID NO: 20526 - DNA, 20 bp, Artificial Sequence
  chemically synthesized
tgatctggagacaggtgtgc

SEQ ID NO: 20527 - DNA, 20 bp, Artificial Sequence
  chemically synthesized
gacaggtgtgccagtatctc

SEQ ID NO: 20528 - DNA, 20 bp, Artificial Sequence
  chemically synthesized
ggctgtgctcctggagatac

SEQ ID NO: 20529 - DNA, 20 bp, Artificial Sequence
  chemically synthesized
acaggtgtgccagtatctcc

SEQ ID NO: 20530 - DNA, 20 bp, Artificial Sequence
  chemically synthesized
aggtgtgccagtatctccag

SEQ ID NO: 20531 - DNA, 20 bp, Artificial Sequence
  chemically synthesized
cggccatggctgtgctcctg

SEQ ID NO: 20532 - DNA, 20 bp, Artificial Sequence
  chemically synthesized
tgccagtatctccaggagca

SEQ ID NO: 20533 - DNA, 20 bp, Artificial Sequence
  chemically synthesized
ggcggccatggctgtgctcc

SEQ ID NO: 20534 - DNA, 20 bp, Artificial Sequence
  chemically synthesized
tatctccaggagcacagcca

SEQ ID NO: 20535 - DNA, 20 bp, Artificial Sequence
  chemically synthesized
aggagcacagccatggccgc

SEQ ID NO: 20536 - DNA, 20 bp, Artificial Sequence
  chemically synthesized
cttcctctcactggcggcca

SEQ ID NO: 20537 - DNA, 20 bp, Artificial Sequence
  chemically synthesized
gcacagccatggccgccagt

SEQ ID NO: 20538 - DNA, 20 bp, Artificial Sequence
  chemically synthesized
acagccatggccgccagtga

SEQ ID NO: 20539 - DNA, 20 bp, Artificial Sequence
  chemically synthesized
gggtggcttcctctcactgg

SEQ ID NO: 20540 - DNA, 20 bp, Artificial Sequence
  chemically synthesized
cagccatggccgccagtgag

SEQ ID NO: 20541 - DNA, 20 bp, Artificial Sequence
  chemically synthesized
caggggtggcttcctctcac

SEQ ID NO: 20542 - DNA, 20 bp, Artificial Sequence
  chemically synthesized
ccatggccgccagtgagagg

SEQ ID NO: 20543 - DNA, 20 bp, Artificial Sequence
  chemically synthesized
gtgagaggaagccacccctg

SEQ ID NO: 20544 - DNA, 20 bp, Artificial Sequence
  chemically synthesized
tcttccatgcacttcagggg

SEQ ID NO: 20545 - DNA, 20 bp, Artificial Sequence
  chemically synthesized
aattcttccatgcacttcag

SEQ ID NO: 20546 - DNA, 20 bp, Artificial Sequence
  chemically synthesized
gaattcttccatgcacttca

SEQ ID NO: 20547 - DNA, 20 bp, Artificial Sequence
  chemically synthesized
ggaattcttccatgcacttc

SEQ ID NO: 20548 - DNA, 20 bp, Artificial Sequence
  chemically synthesized
gaagccacccctgaagtgca

SEQ ID NO: 20549 - DNA, 20 bp, Artificial Sequence
  chemically synthesized
tggaattcttccatgcactt

SEQ ID NO: 20550 - DNA, 20 bp, Artificial Sequence
  chemically synthesized
gccacccctgaagtgcatgg

SEQ ID NO: 20551 - DNA, 20 bp, Artificial Sequence
  chemically synthesized
tggaagaattccaaaatcca

SEQ ID NO: 20552 - DNA, 20 bp, Artificial Sequence
  chemically synthesized
cctttctcgcccatggattt

SEQ ID NO: 20553 - DNA, 20 bp, Artificial Sequence
  chemically synthesized
ggaagaattccaaaatccat

SEQ ID NO: 20554 - DNA, 20 bp, Artificial Sequence
  chemically synthesized
gaattccaaaatccatgggc

SEQ ID NO: 20555 - DNA, 20 bp, Artificial Sequence
  chemically synthesized
ttctttccctttctcgccca

SEQ ID NO: 20556 - DNA, 20 bp, Artificial Sequence
  chemically synthesized
tccaaaatccatgggcgaga

SEQ ID NO: 20557 - DNA, 20 bp, Artificial Sequence
  chemically synthesized
ccaaaatccatgggcgagaa

SEQ ID NO: 20558 - DNA, 20 bp, Artificial Sequence
  chemically synthesized
caaaatccatgggcgagaaa

SEQ ID NO: 20559 - DNA, 20 bp, Artificial Sequence
  chemically synthesized
atccatgggcgagaaaggga

SEQ ID NO: 20560 - DNA, 20 bp, Artificial Sequence
  chemically synthesized
gcgagaaagggaaagaacca

SEQ ID NO: 20561 - DNA, 20 bp, Artificial Sequence
  chemically synthesized
cgagaaagggaaagaaccaa

SEQ ID NO: 20562 - DNA, 20 bp, Artificial Sequence
  chemically synthesized
atgagtcgacatatagcctt

SEQ ID NO: 20563 - DNA, 20 bp, Artificial Sequence
  chemically synthesized
tagtggaatgagtcgacata

SEQ ID NO: 20564 - DNA, 20 bp, Artificial Sequence
  chemically synthesized
cattttgcaaatagtggaat

SEQ ID NO: 20565 - DNA, 20 bp, Artificial Sequence
  chemically synthesized
gacactcattttgcaaatag

SEQ ID NO: 20566 - DNA, 20 bp, Artificial Sequence
  chemically synthesized
tgagacactcattttgcaaa

SEQ ID NO: 20567 - DNA, 20 bp, Artificial Sequence
  chemically synthesized
cattccactatttgcaaaat

SEQ ID NO: 20568 - DNA, 20 bp, Artificial Sequence
  chemically synthesized
tatttgcaaaatgagtgtct

SEQ ID NO: 20569 - DNA, 20 bp, Artificial Sequence
  chemically synthesized
atttgcaaaatgagtgtctc

SEQ ID NO: 20570 - DNA, 20 bp, Artificial Sequence
  chemically synthesized
tttgcaaaatgagtgtctca

SEQ ID NO: 20571 - DNA, 20 bp, Artificial Sequence
  chemically synthesized
tagaaaacaaacaaaaccct

SEQ ID NO: 20572 - DNA, 20 bp, Artificial Sequence
  chemically synthesized
ttttgtttgttttctaatct

SEQ ID NO: 20573 - DNA, 20 bp, Artificial Sequence
  chemically synthesized
ttgtttgttttctaatctga

SEQ ID NO: 20574 - DNA, 20 bp, Artificial Sequence
  chemically synthesized
aatgtagattgctctcagat

SEQ ID NO: 20575 - DNA, 20 bp, Artificial Sequence
  chemically synthesized
gccagaatgtagattgctct

SEQ ID NO: 20576 - DNA, 20 bp, Artificial Sequence
  chemically synthesized
tctgagagcaatctacattc

SEQ ID NO: 20577 - DNA, 20 bp, Artificial Sequence
  chemically synthesized
aggagttaagagccagaatg

SEQ ID NO: 20578 - DNA, 20 bp, Artificial Sequence
  chemically synthesized
ataagctaggagttaagagc

SEQ ID NO: 20579 - DNA, 20 bp, Artificial Sequence
  chemically synthesized
tttgataagctaggagttaa

SEQ ID NO: 20580 - DNA, 20 bp, Artificial Sequence
  chemically synthesized
acattctggctcttaactcc

SEQ ID NO: 20581 - DNA, 20 bp, Artificial Sequence
  chemically synthesized
attttgataagctaggagtt

SEQ ID NO: 20582 - DNA, 20 bp, Artificial Sequence
  chemically synthesized
aaaatattttgataagctag

SEQ ID NO: 20583 - DNA, 20 bp, Artificial Sequence
  chemically synthesized
gaaaaatattttgataagct

SEQ ID NO: 20584 - DNA, 20 bp, Artificial Sequence
  chemically synthesized
tgaaaaatattttgataagc

SEQ ID NO: 20585 - DNA, 20 bp, Artificial Sequence
  chemically synthesized
gacttgaaaaatattttgat

SEQ ID NO: 20586 - DNA, 20 bp, Artificial Sequence
  chemically synthesized
agcttatcaaaatatttttc

SEQ ID NO: 20587 - DNA, 20 bp, Artificial Sequence
  chemically synthesized
aatgcaaaaatgatttatca

SEQ ID NO: 20588 - DNA, 20 bp, Artificial Sequence
  chemically synthesized
atgcaaaaatgatttatcac

SEQ ID NO: 20589 - DNA, 20 bp, Artificial Sequence
  chemically synthesized
caaaaatgatttatcacagg

SEQ ID NO: 20590 - DNA, 20 bp, Artificial Sequence
  chemically synthesized
aaaatgatttatcacaggaa

SEQ ID NO: 20591 - DNA, 20 bp, Artificial Sequence
  chemically synthesized
atttatcacaggaagagcat

SEQ ID NO: 20592 - DNA, 20 bp, Artificial Sequence
  chemically synthesized
tttatcacaggaagagcatt

SEQ ID NO: 20593 - DNA, 20 bp, Artificial Sequence
  chemically synthesized
caggaagagcattaggtcca

SEQ ID NO: 20594 - DNA, 20 bp, Artificial Sequence
  chemically synthesized
agcattaggtccacagcttc

SEQ ID NO: 20595 - DNA, 20 bp, Artificial Sequence
  chemically synthesized
caacagggccctggaagctg

SEQ ID NO: 20596 - DNA, 20 bp, Artificial Sequence
  chemically synthesized
gcattaggtccacagcttcc

SEQ ID NO: 20597 - DNA, 20 bp, Artificial Sequence
  chemically synthesized
cattaggtccacagcttcca

SEQ ID NO: 20598 - DNA, 20 bp, Artificial Sequence
  chemically synthesized
gcattacaacagggccctgg

SEQ ID NO: 20599 - DNA, 20 bp, Artificial Sequence
  chemically synthesized
ttagcattacaacagggccc

SEQ ID NO: 20600 - DNA, 20 bp, Artificial Sequence
  chemically synthesized
gtgtaattagcattacaaca

SEQ ID NO: 20601 - DNA, 20 bp, Artificial Sequence
  chemically synthesized
agtgtaattagcattacaac

SEQ ID NO: 20602 - DNA, 20 bp, Artificial Sequence
  chemically synthesized
aagtgtaattagcattacaa

SEQ ID NO: 20603 - DNA, 20 bp, Artificial Sequence
  chemically synthesized
acagaatggtgaagtgtaat

SEQ ID NO: 20604 - DNA, 20 bp, Artificial Sequence
  chemically synthesized
gcttagcgtacagaatggtg

SEQ ID NO: 20605 - DNA, 20 bp, Artificial Sequence
  chemically synthesized
aggaggcttagcgtacagaa

SEQ ID NO: 20606 - DNA, 20 bp, Artificial Sequence
  chemically synthesized
acttcaccattctgtacgct

SEQ ID NO: 20607 - DNA, 20 bp, Artificial Sequence
  chemically synthesized
gtcacaggaggcttagcgta

SEQ ID NO: 20608 - DNA, 20 bp, Artificial Sequence
  chemically synthesized
gggctctgtcacaggaggct

SEQ ID NO: 20609 - DNA, 20 bp, Artificial Sequence
  chemically synthesized
gtacgctaagcctcctgtga

SEQ ID NO: 20610 - DNA, 20 bp, Artificial Sequence
  chemically synthesized
ttcccgggctctgtcacagg

SEQ ID NO: 20611 - DNA, 20 bp, Artificial Sequence
  chemically synthesized
tttcccgggctctgtcacag

SEQ ID NO: 20612 - DNA, 20 bp, Artificial Sequence
  chemically synthesized
acgctaagcctcctgtgaca

SEQ ID NO: 20613 - DNA, 20 bp, Artificial Sequence
  chemically synthesized
tatttcccgggctctgtcac

SEQ ID NO: 20614 - DNA, 20 bp, Artificial Sequence
  chemically synthesized
ttatttcccgggctctgtca

SEQ ID NO: 20615 - DNA, 20 bp, Artificial Sequence
  chemically synthesized
aagcctcctgtgacagagcc

SEQ ID NO: 20616 - DNA, 20 bp, Artificial Sequence
  chemically synthesized
agcctcctgtgacagagccc

SEQ ID NO: 20617 - DNA, 20 bp, Artificial Sequence
  chemically synthesized
atggcatgtttttatttccc

SEQ ID NO: 20618 - DNA, 20 bp, Artificial Sequence
  chemically synthesized
tatggcatgtttttatttcc

SEQ ID NO: 20619 - DNA, 20 bp, Artificial Sequence
  chemically synthesized
atgtttatgatacgtacgta

SEQ ID NO: 20620 - DNA, 20 bp, Artificial Sequence
  chemically synthesized
acgtacgtatcataaacatt

SEQ ID NO: 20621 - DNA, 20 bp, Artificial Sequence
  chemically synthesized
tacgtatcataaacattcag

SEQ ID NO: 20622 - DNA, 20 bp, Artificial Sequence
  chemically synthesized
tatcataaacattcagcagc

SEQ ID NO: 20623 - DNA, 20 bp, Artificial Sequence
  chemically synthesized
taaacattcagcagccagtt

SEQ ID NO: 20624 - DNA, 20 bp, Artificial Sequence
  chemically synthesized
gcgtggatatgtgtctgaac

SEQ ID NO: 20625 - DNA, 20 bp, Artificial Sequence
  chemically synthesized
agttcagacacatatccacg

SEQ ID NO: 20626 - DNA, 20 bp, Artificial Sequence
  chemically synthesized
ttcagacacatatccacgca

SEQ ID NO: 20627 - DNA, 20 bp, Artificial Sequence
  chemically synthesized
cagacacatatccacgcaga

SEQ ID NO: 20628 - DNA, 20 bp, Artificial Sequence
  chemically synthesized
agacacatatccacgcagag

SEQ ID NO: 20629 - DNA, 20 bp, Artificial Sequence
  chemically synthesized
ggtcaacgtccctctctgcg

SEQ ID NO: 20630 - DNA, 20 bp, Artificial Sequence
  chemically synthesized
gacacatatccacgcagaga

SEQ ID NO: 20631 - DNA, 20 bp, Artificial Sequence
  chemically synthesized
ggagcaagagcacaacaatt

SEQ ID NO: 20632 - DNA, 20 bp, Artificial Sequence
  chemically synthesized
aaattgttgtgctcttgctc

SEQ ID NO: 20633 - DNA, 20 bp, Artificial Sequence
  chemically synthesized
aattgttgtgctcttgctcc

SEQ ID NO: 20634 - DNA, 20 bp, Artificial Sequence
  chemically synthesized
tttatgaccgcctggagcaa

SEQ ID NO: 20635 - DNA, 20 bp, Artificial Sequence
  chemically synthesized
tatttatgaccgcctggagc

SEQ ID NO: 20636 - DNA, 20 bp, Artificial Sequence
  chemically synthesized
tgttgtgctcttgctccagg

SEQ ID NO: 20637 - DNA, 20 bp, Artificial Sequence
  chemically synthesized
ccactatttatgaccgcctg

SEQ ID NO: 20638 - DNA, 20 bp, Artificial Sequence
  chemically synthesized
gaccactatttatgaccgcc

SEQ ID NO: 20639 - DNA, 20 bp, Artificial Sequence
  chemically synthesized
ttgctccaggcggtcataaa

SEQ ID NO: 20640 - DNA, 20 bp, Artificial Sequence
  chemically synthesized
ctccaggcggtcataaatag

SEQ ID NO: 20641 - DNA, 20 bp, Artificial Sequence
  chemically synthesized
gtcaaacaattaataatctg

SEQ ID NO: 20642 - DNA, 20 bp, Artificial Sequence
  chemically synthesized
tcaaacaattaataatctgc

SEQ ID NO: 20643 - DNA, 20 bp, Artificial Sequence
  chemically synthesized
accagcccatggatatcctg

SEQ ID NO: 20644 - DNA, 20 bp, Artificial Sequence
  chemically synthesized
aataatctgcaggatatcca

SEQ ID NO: 20645 - DNA, 20 bp, Artificial Sequence
  chemically synthesized
ataatctgcaggatatccat

SEQ ID NO: 20646 - DNA, 20 bp, Artificial Sequence
  chemically synthesized
tctgcaggatatccatgggc

SEQ ID NO: 20647 - DNA, 20 bp, Artificial Sequence
  chemically synthesized
caagcaaaatgaccagccca

SEQ ID NO: 20648 - DNA, 20 bp, Artificial Sequence
  chemically synthesized
acaacctcaagcaaaatgac

SEQ ID NO: 20649 - DNA, 20 bp, Artificial Sequence
  chemically synthesized
atgggctggtcattttgctt

SEQ ID NO: 20650 - DNA, 20 bp, Artificial Sequence
  chemically synthesized
tgggctggtcattttgcttg

SEQ ID NO: 20651 - DNA, 20 bp, Artificial Sequence
  chemically synthesized
ccttggaccagcacaacctc

SEQ ID NO: 20652 - DNA, 20 bp, Artificial Sequence
  chemically synthesized
cattttgcttgaggttgtgc

SEQ ID NO: 20653 - DNA, 20 bp, Artificial Sequence
  chemically synthesized
gcttgaggttgtgctggtcc

SEQ ID NO: 20654 - DNA, 20 bp, Artificial Sequence
  chemically synthesized
cttgaggttgtgctggtcca

SEQ ID NO: 20655 - DNA, 20 bp, Artificial Sequence
  chemically synthesized
ctgcatgtgatgccttggac

SEQ ID NO: 20656 - DNA, 20 bp, Artificial Sequence
  chemically synthesized
gtcagctgcatgtgatgcct

SEQ ID NO: 20657 - DNA, 20 bp, Artificial Sequence
  chemically synthesized
ctggtccaaggcatcacatg

SEQ ID NO: 20658 - DNA, 20 bp, Artificial Sequence
  chemically synthesized
aaggcatcacatgcagctga

SEQ ID NO: 20659 - DNA, 20 bp, Artificial Sequence
  chemically synthesized
aggcatcacatgcagctgac

SEQ ID NO: 20660 - DNA, 20 bp, Artificial Sequence
  chemically synthesized
agtggatctcttgagcctgt

SEQ ID NO: 20661 - DNA, 20 bp, Artificial Sequence
  chemically synthesized
cacatgcagctgacaggctc

SEQ ID NO: 20662 - DNA, 20 bp, Artificial Sequence
  chemically synthesized
catgcagctgacaggctcaa

SEQ ID NO: 20663 - DNA, 20 bp, Artificial Sequence
  chemically synthesized
ttttttgcagtggatctctt

SEQ ID NO: 20664 - DNA, 20 bp, Artificial Sequence
  chemically synthesized
attttatttgttttttgcag

SEQ ID NO: 20665 - DNA, 20 bp, Artificial Sequence
  chemically synthesized
gtgattttatttgttttttg

SEQ ID NO: 20666 - DNA, 20 bp, Artificial Sequence
  chemically synthesized
ataaaatcacaaatgactca

SEQ ID NO: 20667 - DNA, 20 bp, Artificial Sequence
  chemically synthesized
aaaatcacaaatgactcaaa

SEQ ID NO: 20668 - DNA, 20 bp, Artificial Sequence
  chemically synthesized
aaaggaaggttttactcttt

SEQ ID NO: 20669 - DNA, 20 bp, Artificial Sequence
  chemically synthesized
aaagagtaaaaccttccttt

SEQ ID NO: 20670 - DNA, 20 bp, Artificial Sequence
  chemically synthesized
gaaaaaggacactgaaagga

SEQ ID NO: 20671 - DNA, 20 bp, Artificial Sequence
  chemically synthesized
ggaaaaaggacactgaaagg

SEQ ID NO: 20672 - DNA, 20 bp, Artificial Sequence
  chemically synthesized
agaggaaaaaggacactgaa

SEQ ID NO: 20673 - DNA, 20 bp, Artificial Sequence
  chemically synthesized
cagaggaaaaaggacactga

SEQ ID NO: 20674 - DNA, 20 bp, Artificial Sequence
  chemically synthesized
ctaggattctcagaggaaaa

SEQ ID NO: 20675 - DNA, 20 bp, Artificial Sequence
  chemically synthesized
gctaggattctcagaggaaa

SEQ ID NO: 20676 - DNA, 20 bp, Artificial Sequence
  chemically synthesized
ttcagtgtcctttttcctct

SEQ ID NO: 20677 - DNA, 20 bp, Artificial Sequence
  chemically synthesized
gtcctagctaggattctcag

SEQ ID NO: 20678 - DNA, 20 bp, Artificial Sequence
  chemically synthesized
agtcctagctaggattctca

SEQ ID NO: 20679 - DNA, 20 bp, Artificial Sequence
  chemically synthesized
cctttttcctctgagaatcc

SEQ ID NO: 20680 - DNA, 20 bp, Artificial Sequence
  chemically synthesized
agagtcctagctaggattct

SEQ ID NO: 20681 - DNA, 20 bp, Artificial Sequence
  chemically synthesized
tttcctctgagaatcctagc

SEQ ID NO: 20682 - DNA, 20 bp, Artificial Sequence
  chemically synthesized
ttcctctgagaatcctagct

SEQ ID NO: 20683 - DNA, 20 bp, Artificial Sequence
  chemically synthesized
ggtatgagagagtcctagct

SEQ ID NO: 20684 - DNA, 20 bp, Artificial Sequence
  chemically synthesized
gggtatgagagagtcctagc

SEQ ID NO: 20685 - DNA, 20 bp, Artificial Sequence
  chemically synthesized
taaagggtatgagagagtcc

SEQ ID NO: 20686 - DNA, 20 bp, Artificial Sequence
  chemically synthesized
gtttattaaagggtatgaga

SEQ ID NO: 20687 - DNA, 20 bp, Artificial Sequence
  chemically synthesized
gtgtttattaaagggtatga

SEQ ID NO: 20688 - DNA, 20 bp, Artificial Sequence
  chemically synthesized
tggtgtttattaaagggtat

SEQ ID NO: 20689 - DNA, 20 bp, Artificial Sequence
  chemically synthesized
cacgtttggtgtttattaaa

SEQ ID NO: 20690 - DNA, 20 bp, Artificial Sequence
  chemically synthesized
tcacgtttggtgtttattaa

SEQ ID NO: 20691 - DNA, 20 bp, Artificial Sequence
  chemically synthesized
ttcacgtttggtgtttatta

SEQ ID NO: 20692 - DNA, 20 bp, Artificial Sequence
  chemically synthesized
aagagagtgtggttcacgtt

SEQ ID NO: 20693 - DNA, 20 bp, Artificial Sequence
  chemically synthesized
aacacctttcaaagagagtg

SEQ ID NO: 20694 - DNA, 20 bp, Artificial Sequence
  chemically synthesized
gtgaaccacactctctttga

SEQ ID NO: 20695 - DNA, 20 bp, Artificial Sequence
  chemically synthesized
aataaaacacctttcaaaga

SEQ ID NO: 20696 - DNA, 20 bp, Artificial Sequence
  chemically synthesized
tgaaccacactctctttgaa

SEQ ID NO: 20697 - DNA, 20 bp, Artificial Sequence
  chemically synthesized
aaaataaaacacctttcaaa

SEQ ID NO: 20698 - DNA, 20 bp, Artificial Sequence
  chemically synthesized
taaaaataaaacacctttca

SEQ ID NO: 20699 - DNA, 20 bp, Artificial Sequence
  chemically synthesized
tatttttatgcctcgactct

SEQ ID NO: 20700 - DNA, 20 bp, Artificial Sequence
  chemically synthesized
aactcatcaacttagagtcg

SEQ ID NO: 20701 - DNA, 20 bp, Artificial Sequence
  chemically synthesized
aaactcatcaacttagagtc

SEQ ID NO: 20702 - DNA, 20 bp, Artificial Sequence
  chemically synthesized
tgatcaaactcatcaactta

SEQ ID NO: 20703 - DNA, 20 bp, Artificial Sequence
  chemically synthesized
tgcctcgactctaagttgat

SEQ ID NO: 20704 - DNA, 20 bp, Artificial Sequence
  chemically synthesized
actgatcaaactcatcaact

SEQ ID NO: 20705 - DNA, 20 bp, Artificial Sequence
  chemically synthesized
tctaagttgatgagtttgat

SEQ ID NO: 20706 - DNA, 20 bp, Artificial Sequence
  chemically synthesized
tgatgagtttgatcagtatt

SEQ ID NO: 20707 - DNA, 20 bp, Artificial Sequence
  chemically synthesized
gatgagtttgatcagtattc

SEQ ID NO: 20708 - DNA, 20 bp, Artificial Sequence
  chemically synthesized
tgatcagtattcaggatctg

SEQ ID NO: 20709 - DNA, 20 bp, Artificial Sequence
  chemically synthesized
gtgagatttaagaacaactt

SEQ ID NO: 20710 - DNA, 20 bp, Artificial Sequence
  chemically synthesized
acccaatgccagtgagattt

SEQ ID NO: 20711 - DNA, 20 bp, Artificial Sequence
  chemically synthesized
aagttgttcttaaatctcac

SEQ ID NO: 20712 - DNA, 20 bp, Artificial Sequence
  chemically synthesized
tatcttcacccaatgccagt

SEQ ID NO: 20713 - DNA, 20 bp, Artificial Sequence
  chemically synthesized
ttcttaaatctcactggcat

SEQ ID NO: 20714 - DNA, 20 bp, Artificial Sequence
  chemically synthesized
tcttaaatctcactggcatt

SEQ ID NO: 20715 - DNA, 20 bp, Artificial Sequence
  chemically synthesized
cccatatcttcacccaatgc

SEQ ID NO: 20716 - DNA, 20 bp, Artificial Sequence
  chemically synthesized
aatctcactggcattgggtg

SEQ ID NO: 20717 - DNA, 20 bp, Artificial Sequence
  chemically synthesized
actggcattgggtgaagata

SEQ ID NO: 20718 - DNA, 20 bp, Artificial Sequence
  chemically synthesized
ctggcattgggtgaagatat

SEQ ID NO: 20719 - DNA, 20 bp, Artificial Sequence
  chemically synthesized
attgggtgaagatatgggca

SEQ ID NO: 20720 - DNA, 20 bp, Artificial Sequence
  chemically synthesized
aaagatataattcccatcct

SEQ ID NO: 20721 - DNA, 20 bp, Artificial Sequence
  chemically synthesized
ttccccagtaatccaaggat

SEQ ID NO: 20722 - DNA, 20 bp, Artificial Sequence
  chemically synthesized
attccccagtaatccaagga

SEQ ID NO: 20723 - DNA, 20 bp, Artificial Sequence
  chemically synthesized
agatattccccagtaatcca

SEQ ID NO: 20724 - DNA, 20 bp, Artificial Sequence
  chemically synthesized
aattcccatccttggattac

SEQ ID NO: 20725 - DNA, 20 bp, Artificial Sequence
  chemically synthesized
cagatattccccagtaatcc

SEQ ID NO: 20726 - DNA, 20 bp, Artificial Sequence
  chemically synthesized
attcccatccttggattact

SEQ ID NO: 20727 - DNA, 20 bp, Artificial Sequence
  chemically synthesized
ttcccatccttggattactg

SEQ ID NO: 20728 - DNA, 20 bp, Artificial Sequence
  chemically synthesized
cttaactctcagatattccc

SEQ ID NO: 20729 - DNA, 20 bp, Artificial Sequence
  chemically synthesized
tggattactggggaatatct

SEQ ID NO: 20730 - DNA, 20 bp, Artificial Sequence
  chemically synthesized
gattactggggaatatctga

SEQ ID NO: 20731 - DNA, 20 bp, Artificial Sequence
  chemically synthesized
ctggggaatatctgagagtt

SEQ ID NO: 20732 - DNA, 20 bp, Artificial Sequence
  chemically synthesized
tggggaatatctgagagtta

SEQ ID NO: 20733 - DNA, 20 bp, Artificial Sequence
  chemically synthesized
ggctaggtccccttaactct

SEQ ID NO: 20734 - DNA, 20 bp, Artificial Sequence
  chemically synthesized
ggggaatatctgagagttaa

SEQ ID NO: 20735 - DNA, 20 bp, Artificial Sequence
  chemically synthesized
gggaatatctgagagttaag

SEQ ID NO: 20736 - DNA, 20 bp, Artificial Sequence
  chemically synthesized
atctgagagttaaggggacc

SEQ ID NO: 20737 - DNA, 20 bp, Artificial Sequence
  chemically synthesized
ctgtttatgtagaacaggct

SEQ ID NO: 20738 - DNA, 20 bp, Artificial Sequence
  chemically synthesized
tctgtttatgtagaacaggc

SEQ ID NO: 20739 - DNA, 20 bp, Artificial Sequence
  chemically synthesized
tgactctgtttatgtagaac

SEQ ID NO: 20740 - DNA, 20 bp, Artificial Sequence
  chemically synthesized
ttgactctgtttatgtagaa

SEQ ID NO: 20741 - DNA, 20 bp, Artificial Sequence
  chemically synthesized
cctagcctgttctacataaa

SEQ ID NO: 20742 - DNA, 20 bp, Artificial Sequence
  chemically synthesized
gacaattgactctgtttatg

SEQ ID NO: 20743 - DNA, 20 bp, Artificial Sequence
  chemically synthesized
tagcctgttctacataaaca

SEQ ID NO: 20744 - DNA, 20 bp, Artificial Sequence
  chemically synthesized
gagtcaattgtcacctgaat

SEQ ID NO: 20745 - DNA, 20 bp, Artificial Sequence
  chemically synthesized
acattttttttttcttattc

SEQ ID NO: 20746 - DNA, 20 bp, Artificial Sequence
  chemically synthesized
aacattttttttttcttatt

SEQ ID NO: 20747 - DNA, 20 bp, Artificial Sequence
  chemically synthesized
ataagaaaaaaaaaatgttt

SEQ ID NO: 20748 - DNA, 20 bp, Artificial Sequence
  chemically synthesized
agaaaaaaaaaatgttttag

SEQ ID NO: 20749 - DNA, 20 bp, Artificial Sequence
  chemically synthesized
tgttttagcagaaattttta

SEQ ID NO: 20750 - DNA, 20 bp, Artificial Sequence
  chemically synthesized
ttttagcagaaatttttaaa

SEQ ID NO: 20751 - DNA, 20 bp, Artificial Sequence
  chemically synthesized
ctaatacaagaaagtatcat

SEQ ID NO: 20752 - DNA, 20 bp, Artificial Sequence
  chemically synthesized
tctctaatgctaatacaaga

SEQ ID NO: 20753 - DNA, 20 bp, Artificial Sequence
  chemically synthesized
ccgatgatactttcttgtat

SEQ ID NO: 20754 - DNA, 20 bp, Artificial Sequence
  chemically synthesized
atcttctctaatgctaatac

SEQ ID NO: 20755 - DNA, 20 bp, Artificial Sequence
  chemically synthesized
atactttcttgtattagcat

SEQ ID NO: 20756 - DNA, 20 bp, Artificial Sequence
  chemically synthesized
actttcttgtattagcatta

SEQ ID NO: 20757 - DNA, 20 bp, Artificial Sequence
  chemically synthesized
ttcttgtattagcattagag

SEQ ID NO: 20758 - DNA, 20 bp, Artificial Sequence
  chemically synthesized
tagcattagagaagatctgt

SEQ ID NO: 20759 - DNA, 20 bp, Artificial Sequence
  chemically synthesized
agccatacagattaatctaa

SEQ ID NO: 20760 - DNA, 20 bp, Artificial Sequence
  chemically synthesized
atctgttagattaatctgta

SEQ ID NO: 20761 - DNA, 20 bp, Artificial Sequence
  chemically synthesized
ttagattaatctgtatggct

SEQ ID NO: 20762 - DNA, 20 bp, Artificial Sequence
  chemically synthesized
tttacacaaccttagccata

SEQ ID NO: 20763 - DNA, 20 bp, Artificial Sequence
  chemically synthesized
tagattaatctgtatggcta

SEQ ID NO: 20764 - DNA, 20 bp, Artificial Sequence
  chemically synthesized
aaatagagtttacacaacct

SEQ ID NO: 20765 - DNA, 20 bp, Artificial Sequence
  chemically synthesized
ggttgtgtaaactctatttc

SEQ ID NO: 20766 - DNA, 20 bp, Artificial Sequence
  chemically synthesized
taaatgcatagctagaaata

SEQ ID NO: 20767 - DNA, 20 bp, Artificial Sequence
  chemically synthesized
tataaatgcatagctagaaa

SEQ ID NO: 20768 - DNA, 20 bp, Artificial Sequence
  chemically synthesized
aatgattataaatgcatagc

SEQ ID NO: 20769 - DNA, 20 bp, Artificial Sequence
  chemically synthesized
gcttaatgattataaatgca

SEQ ID NO: 20770 - DNA, 20 bp, Artificial Sequence
  chemically synthesized
gctatgcatttataatcatt

SEQ ID NO: 20771 - DNA, 20 bp, Artificial Sequence
  chemically synthesized
gactgatatttcaaggagaa

SEQ ID NO: 20772 - DNA, 20 bp, Artificial Sequence
  chemically synthesized
gaggtgactgatatttcaag

SEQ ID NO: 20773 - DNA, 20 bp, Artificial Sequence
  chemically synthesized
ctgaggtgactgatatttca

SEQ ID NO: 20774 - DNA, 20 bp, Artificial Sequence
  chemically synthesized
cgcttttctccttgaaatat

SEQ ID NO: 20775 - DNA, 20 bp, Artificial Sequence
  chemically synthesized
gctgaggtgactgatatttc

SEQ ID NO: 20776 - DNA, 20 bp, Artificial Sequence
  chemically synthesized
ccttgaaatatcagtcacct

SEQ ID NO: 20777 - DNA, 20 bp, Artificial Sequence
  chemically synthesized
agggtagcagagagatgctg

SEQ ID NO: 20778 - DNA, 20 bp, Artificial Sequence
  chemically synthesized
tagggtagcagagagatgct

SEQ ID NO: 20779 - DNA, 20 bp, Artificial Sequence
  chemically synthesized
cctaatattagggtagcaga

SEQ ID NO: 20780 - DNA, 20 bp, Artificial Sequence
  chemically synthesized
cacctaatattagggtagca

SEQ ID NO: 20781 - DNA, 20 bp, Artificial Sequence
  chemically synthesized
ttcacctaatattagggtag

SEQ ID NO: 20782 - DNA, 20 bp, Artificial Sequence
  chemically synthesized
tttttcacctaatattaggg

SEQ ID NO: 20783 - DNA, 20 bp, Artificial Sequence
  chemically synthesized
tctctctgctaccctaatat

SEQ ID NO: 20784 - DNA, 20 bp, Artificial Sequence
  chemically synthesized
ctctctgctaccctaatatt

SEQ ID NO: 20785 - DNA, 20 bp, Artificial Sequence
  chemically synthesized
atttttttcacctaatatta

SEQ ID NO: 20786 - DNA, 20 bp, Artificial Sequence
  chemically synthesized
tatttttttcacctaatatt

SEQ ID NO: 20787 - DNA, 20 bp, Artificial Sequence
  chemically synthesized
gtatttttttcacctaatat

SEQ ID NO: 20788 - DNA, 20 bp, Artificial Sequence
  chemically synthesized
ctatagaaaattttagtgga

SEQ ID NO: 20789 - DNA, 20 bp, Artificial Sequence
  chemically synthesized
gcctatagaaaattttagtg

SEQ ID NO: 20790 - DNA, 20 bp, Artificial Sequence
  chemically synthesized
ttgcctatagaaaattttag

SEQ ID NO: 20791 - DNA, 20 bp, Artificial Sequence
  chemically synthesized
agtttgcctatagaaaattt

SEQ ID NO: 20792 - DNA, 20 bp, Artificial Sequence
  chemically synthesized
ctctccactaaaattttcta

SEQ ID NO: 20793 - DNA, 20 bp, Artificial Sequence
  chemically synthesized
tctccactaaaattttctat

SEQ ID NO: 20794 - DNA, 20 bp, Artificial Sequence
  chemically synthesized
caattactttagtttgccta

SEQ ID NO: 20795 - DNA, 20 bp, Artificial Sequence
  chemically synthesized
aattttctataggcaaacta

SEQ ID NO: 20796 - DNA, 20 bp, Artificial Sequence
  chemically synthesized
gatagattatgcaattactt

SEQ ID NO: 20797 - DNA, 20 bp, Artificial Sequence
  chemically synthesized
aagtaattgcataatctatc

SEQ ID NO: 20798 - DNA, 20 bp, Artificial Sequence
  chemically synthesized
cctcaggtctgaaaactgga

SEQ ID NO: 20799 - DNA, 20 bp, Artificial Sequence
  chemically synthesized
tgcataatctatccagtttt

SEQ ID NO: 20800 - DNA, 20 bp, Artificial Sequence
  chemically synthesized
cgagcctcaggtctgaaaac

SEQ ID NO: 20801 - DNA, 20 bp, Artificial Sequence
  chemically synthesized
tctatccagttttcagacct

SEQ ID NO: 20802 - DNA, 20 bp, Artificial Sequence
  chemically synthesized
ctatccagttttcagacctg

SEQ ID NO: 20803 - DNA, 20 bp, Artificial Sequence
  chemically synthesized
aggagaaataagcgagcctc

SEQ ID NO: 20804 - DNA, 20 bp, Artificial Sequence
  chemically synthesized
aaggagaaataagcgagcct

SEQ ID NO: 20805 - DNA, 20 bp, Artificial Sequence
  chemically synthesized
aggtgaaaggagaaataagc

SEQ ID NO: 20806 - DNA, 20 bp, Artificial Sequence
  chemically synthesized
ttgaaggtgaaaggagaaat

SEQ ID NO: 20807 - DNA, 20 bp, Artificial Sequence
  chemically synthesized
atacaatttgaaggtgaaag

SEQ ID NO: 20808 - DNA, 20 bp, Artificial Sequence
  chemically synthesized
aaatacaatttgaaggtgaa

SEQ ID NO: 20809 - DNA, 20 bp, Artificial Sequence
  chemically synthesized
gaaatacaatttgaaggtga

SEQ ID NO: 20810 - DNA, 20 bp, Artificial Sequence
  chemically synthesized
tattatgaaatacaatttga

SEQ ID NO: 20811 - DNA, 20 bp, Artificial Sequence
  chemically synthesized
atattatgaaatacaatttg

SEQ ID NO: 20812 - DNA, 20 bp, Artificial Sequence
  chemically synthesized
tatttcataatattctttct

SEQ ID NO: 20813 - DNA, 20 bp, Artificial Sequence
  chemically synthesized
aagttgttagaggacttaga

SEQ ID NO: 20814 - DNA, 20 bp, Artificial Sequence
  chemically synthesized
tataaagttgttagaggact

SEQ ID NO: 20815 - DNA, 20 bp, Artificial Sequence
  chemically synthesized
cagccttataaagttgttag

SEQ ID NO: 20816 - DNA, 20 bp, Artificial Sequence
  chemically synthesized
tcagccttataaagttgtta

SEQ ID NO: 20817 - DNA, 20 bp, Artificial Sequence
  chemically synthesized
cctcagccttataaagttgt

SEQ ID NO: 20818 - DNA, 20 bp, Artificial Sequence
  chemically synthesized
aagtcctctaacaactttat

SEQ ID NO: 20819 - DNA, 20 bp, Artificial Sequence
  chemically synthesized
agtcctctaacaactttata

SEQ ID NO: 20820 - DNA, 20 bp, Artificial Sequence
  chemically synthesized
tttcctccctcagccttata

SEQ ID NO: 20821 - DNA, 20 bp, Artificial Sequence
  chemically synthesized
tctaacaactttataaggct

SEQ ID NO: 20822 - DNA, 20 bp, Artificial Sequence
  chemically synthesized
ctaacaactttataaggctg

SEQ ID NO: 20823 - DNA, 20 bp, Artificial Sequence
  chemically synthesized
taacaactttataaggctga

SEQ ID NO: 20824 - DNA, 20 bp, Artificial Sequence
  chemically synthesized
acaactttataaggctgagg

SEQ ID NO: 20825 - DNA, 20 bp, Artificial Sequence
  chemically synthesized
caactttataaggctgaggg

SEQ ID NO: 20826 - DNA, 20 bp, Artificial Sequence
  chemically synthesized
tcaagggaattttcctccct

SEQ ID NO: 20827 - DNA, 20 bp, Artificial Sequence
  chemically synthesized
gaggaaaattcccttgatct

SEQ ID NO: 20828 - DNA, 20 bp, Artificial Sequence
  chemically synthesized
taaacacctcctcagatcaa

SEQ ID NO: 20829 - DNA, 20 bp, Artificial Sequence
  chemically synthesized
aggaaaattcccttgatctg

SEQ ID NO: 20830 - DNA, 20 bp, Artificial Sequence
  chemically synthesized
ttaaacacctcctcagatca

SEQ ID NO: 20831 - DNA, 20 bp, Artificial Sequence
  chemically synthesized
attaaacacctcctcagatc

SEQ ID NO: 20832 - DNA, 20 bp, Artificial Sequence
  chemically synthesized
gaaaattcccttgatctgag

SEQ ID NO: 20833 - DNA, 20 bp, Artificial Sequence
  chemically synthesized
aaaattcccttgatctgagg

SEQ ID NO: 20834 - DNA, 20 bp, Artificial Sequence
  chemically synthesized
cataagattaaacacctcct

SEQ ID NO: 20835 - DNA, 20 bp, Artificial Sequence
  chemically synthesized
ggaggtgtttaatcttatgc

SEQ ID NO: 20836 - DNA, 20 bp, Artificial Sequence
  chemically synthesized
gaggtgtttaatcttatgct

SEQ ID NO: 20837 - DNA, 20 bp, Artificial Sequence
  chemically synthesized
aggtgtttaatcttatgctg

SEQ ID NO: 20838 - DNA, 20 bp, Artificial Sequence
  chemically synthesized
taaatttttgtccccagcat

SEQ ID NO: 20839 - DNA, 20 bp, Artificial Sequence
  chemically synthesized
ttttgttaaatttttgtccc

SEQ ID NO: 20840 - DNA, 20 bp, Artificial Sequence
  chemically synthesized
tggggacaaaaatttaacaa

SEQ ID NO: 20841 - DNA, 20 bp, Artificial Sequence
  chemically synthesized
gctgatgttggacaaggttg

SEQ ID NO: 20842 - DNA, 20 bp, Artificial Sequence
  chemically synthesized
tgatttgctgatgttggaca

SEQ ID NO: 20843 - DNA, 20 bp, Artificial Sequence
  chemically synthesized
gtgatttgctgatgttggac

SEQ ID NO: 20844 - DNA, 20 bp, Artificial Sequence
  chemically synthesized
acttcaaccttgtccaacat

SEQ ID NO: 20845 - DNA, 20 bp, Artificial Sequence
  chemically synthesized
agcttgtgatttgctgatgt

SEQ ID NO: 20846 - DNA, 20 bp, Artificial Sequence
  chemically synthesized
gtccaacatcagcaaatcac

SEQ ID NO: 20847 - DNA, 20 bp, Artificial Sequence
  chemically synthesized
aaatcacaagctttattccc

SEQ ID NO: 20848 - DNA, 20 bp, Artificial Sequence
  chemically synthesized
tttcatgacacttgggaata

SEQ ID NO: 20849 - DNA, 20 bp, Artificial Sequence
  chemically synthesized
tgcatcttttcatgacactt

SEQ ID NO: 20850 - DNA, 20 bp, Artificial Sequence
  chemically synthesized
atgcatcttttcatgacact

SEQ ID NO: 20851 - DNA, 20 bp, Artificial Sequence
  chemically synthesized
ttattcccaagtgtcatgaa

SEQ ID NO: 20852 - DNA, 20 bp, Artificial Sequence
  chemically synthesized
tgaaaagatgcatttctcta

SEQ ID NO: 20853 - DNA, 20 bp, Artificial Sequence
  chemically synthesized
tggctaataaattggcttta

SEQ ID NO: 20854 - DNA, 20 bp, Artificial Sequence
  chemically synthesized
tttggctaataaattggctt

SEQ ID NO: 20855 - DNA, 20 bp, Artificial Sequence
  chemically synthesized
tttctctaaagccaatttat

SEQ ID NO: 20856 - DNA, 20 bp, Artificial Sequence
  chemically synthesized
ttctagtttggctaataaat

SEQ ID NO: 20857 - DNA, 20 bp, Artificial Sequence
  chemically synthesized
agccaatttattagccaaac

SEQ ID NO: 20858 - DNA, 20 bp, Artificial Sequence
  chemically synthesized
atgttgttgtgtttctagtt

SEQ ID NO: 20859 - DNA, 20 bp, Artificial Sequence
  chemically synthesized
aagcaatgttgttgtgtttc

SEQ ID NO: 20860 - DNA, 20 bp, Artificial Sequence
  chemically synthesized
aggtgtataaggtagtataa

SEQ ID NO: 20861 - DNA, 20 bp, Artificial Sequence
  chemically synthesized
cagagcttaggtgtataagg

SEQ ID NO: 20862 - DNA, 20 bp, Artificial Sequence
  chemically synthesized
aaccagagcttaggtgtata

SEQ ID NO: 20863 - DNA, 20 bp, Artificial Sequence
  chemically synthesized
caaccagagcttaggtgtat

SEQ ID NO: 20864 - DNA, 20 bp, Artificial Sequence
  chemically synthesized
ttatactaccttatacacct

SEQ ID NO: 20865 - DNA, 20 bp, Artificial Sequence
  chemically synthesized
taccttatacacctaagctc

SEQ ID NO: 20866 - DNA, 20 bp, Artificial Sequence
  chemically synthesized
gagaattccaaccagagctt

SEQ ID NO: 20867 - DNA, 20 bp, Artificial Sequence
  chemically synthesized
tgagaattccaaccagagct

SEQ ID NO: 20868 - DNA, 20 bp, Artificial Sequence
  chemically synthesized
ttatacacctaagctctggt

SEQ ID NO: 20869 - DNA, 20 bp, Artificial Sequence
  chemically synthesized
aggactgagaattccaacca

SEQ ID NO: 20870 - DNA, 20 bp, Artificial Sequence
  chemically synthesized
aaaggactgagaattccaac

SEQ ID NO: 20871 - DNA, 20 bp, Artificial Sequence
  chemically synthesized
taagctctggttggaattct

SEQ ID NO: 20872 - DNA, 20 bp, Artificial Sequence
  chemically synthesized
attccttgcctcaaaggact

SEQ ID NO: 20873 - DNA, 20 bp, Artificial Sequence
  chemically synthesized
gttggaattctcagtccttt

SEQ ID NO: 20874 - DNA, 20 bp, Artificial Sequence
  chemically synthesized
ttggaattctcagtcctttg

SEQ ID NO: 20875 - DNA, 20 bp, Artificial Sequence
  chemically synthesized
aattctcagtcctttgaggc

SEQ ID NO: 20876 - DNA, 20 bp, Artificial Sequence
  chemically synthesized
gcattgattccttgcctcaa

SEQ ID NO: 20877 - DNA, 20 bp, Artificial Sequence
  chemically synthesized
attctcagtcctttgaggca

SEQ ID NO: 20878 - DNA, 20 bp, Artificial Sequence
  chemically synthesized
agcattgattccttgcctca

SEQ ID NO: 20879 - DNA, 20 bp, Artificial Sequence
  chemically synthesized
gcaaggaatcaatgctaatt

SEQ ID NO: 20880 - DNA, 20 bp, Artificial Sequence
  chemically synthesized
gcatgagagatttacttaat

SEQ ID NO: 20881 - DNA, 20 bp, Artificial Sequence
  chemically synthesized
ccttccccctagatgcatga

SEQ ID NO: 20882 - DNA, 20 bp, Artificial Sequence
  chemically synthesized
aagtaaatctctcatgcatc

SEQ ID NO: 20883 - DNA, 20 bp, Artificial Sequence
  chemically synthesized
ccccttccccctagatgcat

SEQ ID NO: 20884 - DNA, 20 bp, Artificial Sequence
  chemically synthesized
agtaaatctctcatgcatct

SEQ ID NO: 20885 - DNA, 20 bp, Artificial Sequence
  chemically synthesized
gtaaatctctcatgcatcta

SEQ ID NO: 20886 - DNA, 20 bp, Artificial Sequence
  chemically synthesized
taaatctctcatgcatctag

SEQ ID NO: 20887 - DNA, 20 bp, Artificial Sequence
  chemically synthesized
aaatctctcatgcatctagg

SEQ ID NO: 20888 - DNA, 20 bp, Artificial Sequence
  chemically synthesized
tctctcatgcatctaggggg

SEQ ID NO: 20889 - DNA, 20 bp, Artificial Sequence
  chemically synthesized
ctctcatgcatctaggggga

SEQ ID NO: 20890 - DNA, 20 bp, Artificial Sequence
  chemically synthesized
tctcatgcatctagggggaa

SEQ ID NO: 20891 - DNA, 20 bp, Artificial Sequence
  chemically synthesized
attgaattgccccttccccc

SEQ ID NO: 20892 - DNA, 20 bp, Artificial Sequence
  chemically synthesized
ctcatgcatctagggggaag

SEQ ID NO: 20893 - DNA, 20 bp, Artificial Sequence
  chemically synthesized
gggcaattcaattataaatg

SEQ ID NO: 20894 - DNA, 20 bp, Artificial Sequence
  chemically synthesized
ataaatgtagttcacataaa

SEQ ID NO: 20895 - DNA, 20 bp, Artificial Sequence
  chemically synthesized
aaatgtagttcacataaata

SEQ ID NO: 20896 - DNA, 20 bp, Artificial Sequence
  chemically synthesized
aatgtagttcacataaatag

SEQ ID NO: 20897 - DNA, 20 bp, Artificial Sequence
  chemically synthesized
aaatagaggtaaatcccgct

SEQ ID NO: 20898 - DNA, 20 bp, Artificial Sequence
  chemically synthesized
gggaaaggtgtttactgagc

SEQ ID NO: 20899 - DNA, 20 bp, Artificial Sequence
  chemically synthesized
tgggaaaggtgtttactgag

SEQ ID NO: 20900 - DNA, 20 bp, Artificial Sequence
  chemically synthesized
tactgggaaaggtgtttact

SEQ ID NO: 20901 - DNA, 20 bp, Artificial Sequence
  chemically synthesized
cgctcagtaaacacctttcc

SEQ ID NO: 20902 - DNA, 20 bp, Artificial Sequence
  chemically synthesized
catttctttattactgggaa

SEQ ID NO: 20903 - DNA, 20 bp, Artificial Sequence
  chemically synthesized
gcatttctttattactggga

SEQ ID NO: 20904 - DNA, 20 bp, Artificial Sequence
  chemically synthesized
aaacacctttcccagtaata

SEQ ID NO: 20905 - DNA, 20 bp, Artificial Sequence
  chemically synthesized
gtttgcatttctttattact

SEQ ID NO: 20906 - DNA, 20 bp, Artificial Sequence
  chemically synthesized
agtttgcatttctttattac

SEQ ID NO: 20907 - DNA, 20 bp, Artificial Sequence
  chemically synthesized
taataaagaaatgcaaactt

SEQ ID NO: 20908 - DNA, 20 bp, Artificial Sequence
  chemically synthesized
aataaagaaatgcaaactta

SEQ ID NO: 20909 - DNA, 20 bp, Artificial Sequence
  chemically synthesized
gaaatgcaaacttaaggctt

SEQ ID NO: 20910 - DNA, 20 bp, Artificial Sequence
  chemically synthesized
gtaaaatatactaaagcctt

SEQ ID NO: 20911 - DNA, 20 bp, Artificial Sequence
  chemically synthesized
ataacttgtaaaatatacta

SEQ ID NO: 20912 - DNA, 20 bp, Artificial Sequence
  chemically synthesized
aaggctttagtatattttac

SEQ ID NO: 20913 - DNA, 20 bp, Artificial Sequence
  chemically synthesized
tatattttacaagttattca

SEQ ID NO: 20914 - DNA, 20 bp, Artificial Sequence
  chemically synthesized
ttttacaagttattcatggc

SEQ ID NO: 20915 - DNA, 20 bp, Artificial Sequence
  chemically synthesized
tcttaatatttaattagaac

SEQ ID NO: 20916 - DNA, 20 bp, Artificial Sequence
  chemically synthesized
tttttttcttaatatttaat

SEQ ID NO: 20917 - DNA, 20 bp, Artificial Sequence
  chemically synthesized
gccagttctaattaaatatt

SEQ ID NO: 20918 - DNA, 20 bp, Artificial Sequence
  chemically synthesized
tattaagaaaaaaacaaaaa

SEQ ID NO: 20919 - DNA, 20 bp, Artificial Sequence
  chemically synthesized
taagaaaaaaacaaaaatag

SEQ ID NO: 20920 - DNA, 20 bp, Artificial Sequence
  chemically synthesized
aatagtggttaatacctatg

SEQ ID NO: 20921 - DNA, 20 bp, Artificial Sequence
  chemically synthesized
atagtggttaatacctatgt

SEQ ID NO: 20922 - DNA, 20 bp, Artificial Sequence
  chemically synthesized
atttttgcacaaacctacat

SEQ ID NO: 20923 - DNA, 20 bp, Artificial Sequence
  chemically synthesized
tatttttgcacaaacctaca

SEQ ID NO: 20924 - DNA, 20 bp, Artificial Sequence
  chemically synthesized
tgtgcgcaatataggtggaa

SEQ ID NO: 20925 - DNA, 20 bp, Artificial Sequence
  chemically synthesized
aaatgtgtgcgcaatatagg

SEQ ID NO: 20926 - DNA, 20 bp, Artificial Sequence
  chemically synthesized
gaaaaatgtgtgcgcaatat

SEQ ID NO: 20927 - DNA, 20 bp, Artificial Sequence
  chemically synthesized
agaaaaatgtgtgcgcaata

SEQ ID NO: 20928 - DNA, 20 bp, Artificial Sequence
  chemically synthesized
ctgttttcctttttttaaaa

SEQ ID NO: 20929 - DNA, 20 bp, Artificial Sequence
  chemically synthesized
acatttttctcttttaaaaa

SEQ ID NO: 20930 - DNA, 20 bp, Artificial Sequence
  chemically synthesized
ttctgttttcctttttttaa

SEQ ID NO: 20931 - DNA, 20 bp, Artificial Sequence
  chemically synthesized
catttttctcttttaaaaaa

SEQ ID NO: 20932 - DNA, 20 bp, Artificial Sequence
  chemically synthesized
ctcttttaaaaaaaggaaaa

SEQ ID NO: 20933 - DNA, 20 bp, Artificial Sequence
  chemically synthesized
aaaaggaaaacagaaaatcc

SEQ ID NO: 20934 - DNA, 20 bp, Artificial Sequence
  chemically synthesized
aaggaaaacagaaaatcctg

SEQ ID NO: 20935 - DNA, 20 bp, Artificial Sequence
  chemically synthesized
catgcttctggggaaactcc

SEQ ID NO: 20936 - DNA, 20 bp, Artificial Sequence
  chemically synthesized
tcatgcttctggggaaactc

SEQ ID NO: 20937 - DNA, 20 bp, Artificial Sequence
  chemically synthesized
agaaaatcctggagtttccc

SEQ ID NO: 20938 - DNA, 20 bp, Artificial Sequence
  chemically synthesized
aaatcctggagtttccccag

SEQ ID NO: 20939 - DNA, 20 bp, Artificial Sequence
  chemically synthesized
atgtctgtttcatgcttctg

SEQ ID NO: 20940 - DNA, 20 bp, Artificial Sequence
  chemically synthesized
catgtctgtttcatgcttct

SEQ ID NO: 20941 - DNA, 20 bp, Artificial Sequence
  chemically synthesized
ccatgtctgtttcatgcttc

SEQ ID NO: 20942 - DNA, 20 bp, Artificial Sequence
  chemically synthesized
gtttccccagaagcatgaaa

SEQ ID NO: 20943 - DNA, 20 bp, Artificial Sequence
  chemically synthesized
ccagaagcatgaaacagaca

SEQ ID NO: 20944 - DNA, 20 bp, Artificial Sequence
  chemically synthesized
gaagcatgaaacagacatgg

SEQ ID NO: 20945 - DNA, 20 bp, Artificial Sequence
  chemically synthesized
gcatgaaacagacatggtgg

SEQ ID NO: 20946 - DNA, 20 bp, Artificial Sequence
  chemically synthesized
tgaaacagacatggtggtgg

SEQ ID NO: 20947 - DNA, 20 bp, Artificial Sequence
  chemically synthesized
aacagacatggtggtggaag

SEQ ID NO: 20948 - DNA, 20 bp, Artificial Sequence
  chemically synthesized
acagacatggtggtggaagc

SEQ ID NO: 20949 - DNA, 20 bp, Artificial Sequence
  chemically synthesized
agacatggtggtggaagcag

SEQ ID NO: 20950 - DNA, 20 bp, Artificial Sequence
  chemically synthesized
tcccttccaagggaggagtg

SEQ ID NO: 20951 - DNA, 20 bp, Artificial Sequence
  chemically synthesized
aggagtctgcactcctccct

SEQ ID NO: 20952 - DNA, 20 bp, Artificial Sequence
  chemically synthesized
ggccttcccttccaagggag

SEQ ID NO: 20953 - DNA, 20 bp, Artificial Sequence
  chemically synthesized
agtctgcactcctcccttgg

SEQ ID NO: 20954 - DNA, 20 bp, Artificial Sequence
  chemically synthesized
ggggccttcccttccaaggg

SEQ ID NO: 20955 - DNA, 20 bp, Artificial Sequence
  chemically synthesized
gtctgcactcctcccttgga

SEQ ID NO: 20956 - DNA, 20 bp, Artificial Sequence
  chemically synthesized
aggggccttcccttccaagg

SEQ ID NO: 20957 - DNA, 20 bp, Artificial Sequence
  chemically synthesized
tctgcactcctcccttggaa

SEQ ID NO: 20958 - DNA, 20 bp, Artificial Sequence
  chemically synthesized
agaggggccttcccttccaa

SEQ ID NO: 20959 - DNA, 20 bp, Artificial Sequence
  chemically synthesized
cagaggggccttcccttcca

SEQ ID NO: 20960 - DNA, 20 bp, Artificial Sequence
  chemically synthesized
gcactcctcccttggaaggg

SEQ ID NO: 20961 - DNA, 20 bp, Artificial Sequence
  chemically synthesized
acagaggggccttcccttcc

SEQ ID NO: 20962 - DNA, 20 bp, Artificial Sequence
  chemically synthesized
cactcctcccttggaaggga

SEQ ID NO: 20963 - DNA, 20 bp, Artificial Sequence
  chemically synthesized
atttcagagcaaaaacagag

SEQ ID NO: 20964 - DNA, 20 bp, Artificial Sequence
  chemically synthesized
tatttcagagcaaaaacaga

SEQ ID NO: 20965 - DNA, 20 bp, Artificial Sequence
  chemically synthesized
gtatttcagagcaaaaacag

SEQ ID NO: 20966 - DNA, 20 bp, Artificial Sequence
  chemically synthesized
agtatttcagagcaaaaaca

SEQ ID NO: 20967 - DNA, 20 bp, Artificial Sequence
  chemically synthesized
agagtatttcagagcaaaaa

SEQ ID NO: 20968 - DNA, 20 bp, Artificial Sequence
  chemically synthesized
tctatctttagagtatttca

SEQ ID NO: 20969 - DNA, 20 bp, Artificial Sequence
  chemically synthesized
tctctatctttagagtattt

SEQ ID NO: 20970 - DNA, 20 bp, Artificial Sequence
  chemically synthesized
ttttgctctgaaatactcta

SEQ ID NO: 20971 - DNA, 20 bp, Artificial Sequence
  chemically synthesized
gctctgaaatactctaaaga

SEQ ID NO: 20972 - DNA, 20 bp, Artificial Sequence
  chemically synthesized
gggtcatttctctatcttta

SEQ ID NO: 20973 - DNA, 20 bp, Artificial Sequence
  chemically synthesized
tctgaaatactctaaagata

SEQ ID NO: 20974 - DNA, 20 bp, Artificial Sequence
  chemically synthesized
aagggtcatttctctatctt

SEQ ID NO: 20975 - DNA, 20 bp, Artificial Sequence
  chemically synthesized
tagagaaatgacccttttca

SEQ ID NO: 20976 - DNA, 20 bp, Artificial Sequence
  chemically synthesized
agtctcagcttccatgaaaa

SEQ ID NO: 20977 - DNA, 20 bp, Artificial Sequence
  chemically synthesized
aagtctcagcttccatgaaa

SEQ ID NO: 20978 - DNA, 20 bp, Artificial Sequence
  chemically synthesized
agaaatgacccttttcatgg

SEQ ID NO: 20979 - DNA, 20 bp, Artificial Sequence
  chemically synthesized
aaagtctcagcttccatgaa

SEQ ID NO: 20980 - DNA, 20 bp, Artificial Sequence
  chemically synthesized
tgacccttttcatggaagct

SEQ ID NO: 20981 - DNA, 20 bp, Artificial Sequence
  chemically synthesized
tcccactttaaagaaagtct

SEQ ID NO: 20982 - DNA, 20 bp, Artificial Sequence
  chemically synthesized
ggaagctgagactttcttta

SEQ ID NO: 20983 - DNA, 20 bp, Artificial Sequence
  chemically synthesized
ccttcctcccactttaaaga

SEQ ID NO: 20984 - DNA, 20 bp, Artificial Sequence
  chemically synthesized
agctgagactttctttaaag

SEQ ID NO: 20985 - DNA, 20 bp, Artificial Sequence
  chemically synthesized
gctgagactttctttaaagt

SEQ ID NO: 20986 - DNA, 20 bp, Artificial Sequence
  chemically synthesized
tcttccttcctcccacttta

SEQ ID NO: 20987 - DNA, 20 bp, Artificial Sequence
  chemically synthesized
tgagactttctttaaagtgg

SEQ ID NO: 20988 - DNA, 20 bp, Artificial Sequence
  chemically synthesized
gagactttctttaaagtggg

SEQ ID NO: 20989 - DNA, 20 bp, Artificial Sequence
  chemically synthesized
actttctttaaagtgggagg

SEQ ID NO: 20990 - DNA, 20 bp, Artificial Sequence
  chemically synthesized
ctttctttaaagtgggagga

SEQ ID NO: 20991 - DNA, 20 bp, Artificial Sequence
  chemically synthesized
tctttaaagtgggaggaagg

SEQ ID NO: 20992 - DNA, 20 bp, Artificial Sequence
  chemically synthesized
tgggaggaaggaagataact

SEQ ID NO: 20993 - DNA, 20 bp, Artificial Sequence
  chemically synthesized
gggaggaaggaagataactt

SEQ ID NO: 20994 - DNA, 20 bp, Artificial Sequence
  chemically synthesized
gaggaaggaagataacttgg

SEQ ID NO: 20995 - DNA, 20 bp, Artificial Sequence
  chemically synthesized
attcttcagataagtctccc

SEQ ID NO: 20996 - DNA, 20 bp, Artificial Sequence
  chemically synthesized
taacttgggagacttatctg

SEQ ID NO: 20997 - DNA, 20 bp, Artificial Sequence
  chemically synthesized
tctcacttgattcttcagat

SEQ ID NO: 20998 - DNA, 20 bp, Artificial Sequence
  chemically synthesized
ggagacttatctgaagaatc

SEQ ID NO: 20999 - DNA, 20 bp, Artificial Sequence
  chemically synthesized
atttttctcacttgattctt

SEQ ID NO: 21000 - DNA, 20 bp, Artificial Sequence
  chemically synthesized
acttatctgaagaatcaagt

SEQ ID NO: 21001 - DNA, 20 bp, Artificial Sequence
  chemically synthesized
atcaagtgagaaaaataata

SEQ ID NO: 21002 - DNA, 20 bp, Artificial Sequence
  chemically synthesized
aaataataaagaattttaaa

SEQ ID NO: 21003 - DNA, 20 bp, Artificial Sequence
  chemically synthesized
agaattttaaaaagcaatgc

SEQ ID NO: 21004 - DNA, 20 bp, Artificial Sequence
  chemically synthesized
gaattttaaaaagcaatgca

SEQ ID NO: 21005 - DNA, 20 bp, Artificial Sequence
  chemically synthesized
attttaaaaagcaatgcaag

SEQ ID NO: 21006 - DNA, 20 bp, Artificial Sequence
  chemically synthesized
ttttaaaaagcaatgcaagg

SEQ ID NO: 21007 - DNA, 20 bp, Artificial Sequence
  chemically synthesized
taaaaagcaatgcaaggagg

SEQ ID NO: 21008 - DNA, 20 bp, Artificial Sequence
  chemically synthesized
aaaaagcaatgcaaggaggc

SEQ ID NO: 21009 - DNA, 20 bp, Artificial Sequence
  chemically synthesized
aaagcaatgcaaggaggcag

SEQ ID NO: 21010 - DNA, 20 bp, Artificial Sequence
  chemically synthesized
aagcaatgcaaggaggcagg

SEQ ID NO: 21011 - DNA, 20 bp, Artificial Sequence
  chemically synthesized
aatgcaaggaggcaggagga

SEQ ID NO: 21012 - DNA, 20 bp, Artificial Sequence
  chemically synthesized
atgcaaggaggcaggaggac

SEQ ID NO: 21013 - DNA, 20 bp, Artificial Sequence
  chemically synthesized
gcaaggaggcaggaggacgg

SEQ ID NO: 21014 - DNA, 20 bp, Artificial Sequence
  chemically synthesized
caaggaggcaggaggacggg

SEQ ID NO: 21015 - DNA, 20 bp, Artificial Sequence
  chemically synthesized
gcaggaggacgggaggacgt

SEQ ID NO: 21016 - DNA, 20 bp, Artificial Sequence
  chemically synthesized
caggaggacgggaggacgtg

SEQ ID NO: 21017 - DNA, 20 bp, Artificial Sequence
  chemically synthesized
ggaggacgggaggacgtgag

SEQ ID NO: 21018 - DNA, 20 bp, Artificial Sequence
  chemically synthesized
gaggacgggaggacgtgagg

SEQ ID NO: 21019 - DNA, 20 bp, Artificial Sequence
  chemically synthesized
aggacgggaggacgtgagga

SEQ ID NO: 21020 - DNA, 20 bp, Artificial Sequence
  chemically synthesized
gggaggacgtgaggagggaa

SEQ ID NO: 21021 - DNA, 20 bp, Artificial Sequence
  chemically synthesized
cgtgaggagggaatggctga

SEQ ID NO: 21022 - DNA, 20 bp, Artificial Sequence
  chemically synthesized
gaggagggaatggctgaaag

SEQ ID NO: 21023 - DNA, 20 bp, Artificial Sequence
  chemically synthesized
cctcccacgcagtcttcttt

SEQ ID NO: 21024 - DNA, 20 bp, Artificial Sequence
  chemically synthesized
atggctgaaagaagactgcg

SEQ ID NO: 21025 - DNA, 20 bp, Artificial Sequence
  chemically synthesized
tggctgaaagaagactgcgt

SEQ ID NO: 21026 - DNA, 20 bp, Artificial Sequence
  chemically synthesized
gctgaaagaagactgcgtgg

SEQ ID NO: 21027 - DNA, 20 bp, Artificial Sequence
  chemically synthesized
ctgaaagaagactgcgtggg

SEQ ID NO: 21028 - DNA, 20 bp, Artificial Sequence
  chemically synthesized
cctcgctccagcctcccacg

SEQ ID NO: 21029 - DNA, 20 bp, Artificial Sequence
  chemically synthesized
aagaagactgcgtgggaggc

SEQ ID NO: 21030 - DNA, 20 bp, Artificial Sequence
  chemically synthesized
gaagactgcgtgggaggctg

SEQ ID NO: 21031 - DNA, 20 bp, Artificial Sequence
  chemically synthesized
actgcgtgggaggctggagc

SEQ ID NO: 21032 - DNA, 20 bp, Artificial Sequence
  chemically synthesized
ctgcgtgggaggctggagcg

SEQ ID NO: 21033 - DNA, 20 bp, Artificial Sequence
  chemically synthesized
tttgtctctggacctcgctc

SEQ ID NO: 21034 - DNA, 20 bp, Artificial Sequence
  chemically synthesized
tgggaggctggagcgaggtc

SEQ ID NO: 21035 - DNA, 20 bp, Artificial Sequence
  chemically synthesized
ggaggctggagcgaggtcca

SEQ ID NO: 21036 - DNA, 20 bp, Artificial Sequence
  chemically synthesized
ggagcgaggtccagagacaa

SEQ ID NO: 21037 - DNA, 20 bp, Artificial Sequence
  chemically synthesized
aagtttgagtcttttgtctc

SEQ ID NO: 21038 - DNA, 20 bp, Artificial Sequence
  chemically synthesized
gagagagagaagaaaagttt

SEQ ID NO: 21039 - DNA, 20 bp, Artificial Sequence
  chemically synthesized
acagaagagagagagaagaa

SEQ ID NO: 21040 - DNA, 20 bp, Artificial Sequence
  chemically synthesized
agcacacagaagagagagag

SEQ ID NO: 21041 - DNA, 20 bp, Artificial Sequence
  chemically synthesized
acaagcacacagaagagaga

SEQ ID NO: 21042 - DNA, 20 bp, Artificial Sequence
  chemically synthesized
aaacaagcacacagaagaga

SEQ ID NO: 21043 - DNA, 20 bp, Artificial Sequence
  chemically synthesized
gaaaacaagcacacagaaga

SEQ ID NO: 21044 - DNA, 20 bp, Artificial Sequence
  chemically synthesized
aggaaaacaagcacacagaa

SEQ ID NO: 21045 - DNA, 20 bp, Artificial Sequence
  chemically synthesized
tgaggaaaacaagcacacag

SEQ ID NO: 21046 - DNA, 20 bp, Artificial Sequence
  chemically synthesized
ctctgaggaaaacaagcaca

SEQ ID NO: 21047 - DNA, 20 bp, Artificial Sequence
  chemically synthesized
atgtgccctctgaggaaaac

SEQ ID NO: 21048 - DNA, 20 bp, Artificial Sequence
  chemically synthesized
ttctgtgtgcttgttttcct

SEQ ID NO: 21049 - DNA, 20 bp, Artificial Sequence
  chemically synthesized
ctgtgtgcttgttttcctca

SEQ ID NO: 21050 - DNA, 20 bp, Artificial Sequence
  chemically synthesized
tgtgtgcttgttttcctcag

SEQ ID NO: 21051 - DNA, 20 bp, Artificial Sequence
  chemically synthesized
gtgtgcttgttttcctcaga

SEQ ID NO: 21052 - DNA, 20 bp, Artificial Sequence
  chemically synthesized
acttgagtatgtgccctctg

SEQ ID NO: 21053 - DNA, 20 bp, Artificial Sequence
  chemically synthesized
cacttgagtatgtgccctct

SEQ ID NO: 21054 - DNA, 20 bp, Artificial Sequence
  chemically synthesized
tcctcagagggcacatactc

SEQ ID NO: 21055 - DNA, 20 bp, Artificial Sequence
  chemically synthesized
tgttcctactacgtgcactt

SEQ ID NO: 21056 - DNA, 20 bp, Artificial Sequence
  chemically synthesized
ggcacatactcaagtgcacg

SEQ ID NO: 21057 - DNA, 20 bp, Artificial Sequence
  chemically synthesized
acatactcaagtgcacgtag

SEQ ID NO: 21058 - DNA, 20 bp, Artificial Sequence
  chemically synthesized
catactcaagtgcacgtagt

SEQ ID NO: 21059 - DNA, 20 bp, Artificial Sequence
  chemically synthesized
gtgcacgtagtaggaacact

SEQ ID NO: 21060 - DNA, 20 bp, Artificial Sequence
  chemically synthesized
agtaggaacacttagaaaca

SEQ ID NO: 21061 - DNA, 20 bp, Artificial Sequence
  chemically synthesized
agctggcataccgtgtttct

SEQ ID NO: 21062 - DNA, 20 bp, Artificial Sequence
  chemically synthesized
cacttagaaacacggtatgc

SEQ ID NO: 21063 - DNA, 20 bp, Artificial Sequence
  chemically synthesized
ctctcttccagtaatggagc

SEQ ID NO: 21064 - DNA, 20 bp, Artificial Sequence
  chemically synthesized
cggtatgccagctccattac

SEQ ID NO: 21065 - DNA, 20 bp, Artificial Sequence
  chemically synthesized
attcctctcttccagtaatg

SEQ ID NO: 21066 - DNA, 20 bp, Artificial Sequence
  chemically synthesized
tatgccagctccattactgg

SEQ ID NO: 21067 - DNA, 20 bp, Artificial Sequence
  chemically synthesized
ccattcctctcttccagtaa

SEQ ID NO: 21068 - DNA, 20 bp, Artificial Sequence
  chemically synthesized
tgccagctccattactggaa

SEQ ID NO: 21069 - DNA, 20 bp, Artificial Sequence
  chemically synthesized
ccagctccattactggaaga

SEQ ID NO: 21070 - DNA, 20 bp, Artificial Sequence
  chemically synthesized
cagctccattactggaagag

SEQ ID NO: 21071 - DNA, 20 bp, Artificial Sequence
  chemically synthesized
agaaatccattcctctcttc

SEQ ID NO: 21072 - DNA, 20 bp, Artificial Sequence
  chemically synthesized
ccattactggaagagaggaa

SEQ ID NO: 21073 - DNA, 20 bp, Artificial Sequence
  chemically synthesized
ttgggaatattggtgtttgg

SEQ ID NO: 21074 - DNA, 20 bp, Artificial Sequence
  chemically synthesized
atgttgggaatattggtgtt

SEQ ID NO: 21075 - DNA, 20 bp, Artificial Sequence
  chemically synthesized
aggaaacatgttgggaatat

SEQ ID NO: 21076 - DNA, 20 bp, Artificial Sequence
  chemically synthesized
agtatataaggaaacatgtt

SEQ ID NO: 21077 - DNA, 20 bp, Artificial Sequence
  chemically synthesized
cagtatataaggaaacatgt

SEQ ID NO: 21078 - DNA, 20 bp, Artificial Sequence
  chemically synthesized
atagcttccttcagtatata

SEQ ID NO: 21079 - DNA, 20 bp, Artificial Sequence
  chemically synthesized
catagcttccttcagtatat

SEQ ID NO: 21080 - DNA, 20 bp, Artificial Sequence
  chemically synthesized
acatgtttccttatatactg

SEQ ID NO: 21081 - DNA, 20 bp, Artificial Sequence
  chemically synthesized
catgtttccttatatactga

SEQ ID NO: 21082 - DNA, 20 bp, Artificial Sequence
  chemically synthesized
gtttccttatatactgaagg

SEQ ID NO: 21083 - DNA, 20 bp, Artificial Sequence
  chemically synthesized
aaaccacccatagcttcctt

SEQ ID NO: 21084 - DNA, 20 bp, Artificial Sequence
  chemically synthesized
ttatatactgaaggaagcta

SEQ ID NO: 21085 - DNA, 20 bp, Artificial Sequence
  chemically synthesized
tatatactgaaggaagctat

SEQ ID NO: 21086 - DNA, 20 bp, Artificial Sequence
  chemically synthesized
atactgaaggaagctatggg

SEQ ID NO: 21087 - DNA, 20 bp, Artificial Sequence
  chemically synthesized
gaaaaacttcaaaccaccca

SEQ ID NO: 21088 - DNA, 20 bp, Artificial Sequence
  chemically synthesized
aggaagctatgggtggtttg

SEQ ID NO: 21089 - DNA, 20 bp, Artificial Sequence
  chemically synthesized
actaaagcagagtaacaaaa

SEQ ID NO: 21090 - DNA, 20 bp, Artificial Sequence
  chemically synthesized
tcttttttgttactctgctt

SEQ ID NO: 21091 - DNA, 20 bp, Artificial Sequence
  chemically synthesized
tatttatgatgactaaagca

SEQ ID NO: 21092 - DNA, 20 bp, Artificial Sequence
  chemically synthesized
aatatttatgatgactaaag

SEQ ID NO: 21093 - DNA, 20 bp, Artificial Sequence
  chemically synthesized
caaaatatttatgatgacta

SEQ ID NO: 21094 - DNA, 20 bp, Artificial Sequence
  chemically synthesized
taaatattttgcctctgatc

SEQ ID NO: 21095 - DNA, 20 bp, Artificial Sequence
  chemically synthesized
aaatattttgcctctgatcc

SEQ ID NO: 21096 - DNA, 20 bp, Artificial Sequence
  chemically synthesized
ttcttaaatgcctggatcag

SEQ ID NO: 21097 - DNA, 20 bp, Artificial Sequence
  chemically synthesized
cttcttaaatgcctggatca

SEQ ID NO: 21098 - DNA, 20 bp, Artificial Sequence
  chemically synthesized
tacttcttaaatgcctggat

SEQ ID NO: 21099 - DNA, 20 bp, Artificial Sequence
  chemically synthesized
tgcctctgatccaggcattt

SEQ ID NO: 21100 - DNA, 20 bp, Artificial Sequence
  chemically synthesized
ctagttacttcttaaatgcc

SEQ ID NO: 21101 - DNA, 20 bp, Artificial Sequence
  chemically synthesized
ctctgatccaggcatttaag

SEQ ID NO: 21102 - DNA, 20 bp, Artificial Sequence
  chemically synthesized
ccaggcatttaagaagtaac

SEQ ID NO: 21103 - DNA, 20 bp, Artificial Sequence
  chemically synthesized
gtgattcgaaaaattttcac

SEQ ID NO: 21104 - DNA, 20 bp, Artificial Sequence
  chemically synthesized
tttcgaatcacttttgtatt

SEQ ID NO: 21105 - DNA, 20 bp, Artificial Sequence
  chemically synthesized
aaataagactcttaatacaa

SEQ ID NO: 21106 - DNA, 20 bp, Artificial Sequence
  chemically synthesized
tcgaatcacttttgtattaa

SEQ ID NO: 21107 - DNA, 20 bp, Artificial Sequence
  chemically synthesized
tttgtattaagagtcttatt

SEQ ID NO: 21108 - DNA, 20 bp, Artificial Sequence
  chemically synthesized
tttccatcacacggctaaat

SEQ ID NO: 21109 - DNA, 20 bp, Artificial Sequence
  chemically synthesized
agtcttatttagccgtgtga

SEQ ID NO: 21110 - DNA, 20 bp, Artificial Sequence
  chemically synthesized
ctctgttcatttccatcaca

SEQ ID NO: 21111 - DNA, 20 bp, Artificial Sequence
  chemically synthesized
agccgtgtgatggaaatgaa

SEQ ID NO: 21112 - DNA, 20 bp, Artificial Sequence
  chemically synthesized
ccgtgtgatggaaatgaaca

SEQ ID NO: 21113 - DNA, 20 bp, Artificial Sequence
  chemically synthesized
cccataaaatgaaatgcatg

SEQ ID NO: 21114 - DNA, 20 bp, Artificial Sequence
  chemically synthesized
actgcatgcatttcatttta

SEQ ID NO: 21115 - DNA, 20 bp, Artificial Sequence
  chemically synthesized
ctgcatgcatttcattttat

SEQ ID NO: 21116 - DNA, 20 bp, Artificial Sequence
  chemically synthesized
tgcatgcatttcattttatg

SEQ ID NO: 21117 - DNA, 20 bp, Artificial Sequence
  chemically synthesized
acctgtacagagataagagc

SEQ ID NO: 21118 - DNA, 20 bp, Artificial Sequence
  chemically synthesized
cacctgtacagagataagag

SEQ ID NO: 21119 - DNA, 20 bp, Artificial Sequence
  chemically synthesized
attcacctgtacagagataa

SEQ ID NO: 21120 - DNA, 20 bp, Artificial Sequence
  chemically synthesized
ccattcacctgtacagagat

SEQ ID NO: 21121 - DNA, 20 bp, Artificial Sequence
  chemically synthesized
ggcctgctcttatctctgta

SEQ ID NO: 21122 - DNA, 20 bp, Artificial Sequence
  chemically synthesized
gcctgctcttatctctgtac

SEQ ID NO: 21123 - DNA, 20 bp, Artificial Sequence
  chemically synthesized
gttacccattcacctgtaca

SEQ ID NO: 21124 - DNA, 20 bp, Artificial Sequence
  chemically synthesized
gtgttacccattcacctgta

SEQ ID NO: 21125 - DNA, 20 bp, Artificial Sequence
  chemically synthesized
cttatctctgtacaggtgaa

SEQ ID NO: 21126 - DNA, 20 bp, Artificial Sequence
  chemically synthesized
ttatctctgtacaggtgaat

SEQ ID NO: 21127 - DNA, 20 bp, Artificial Sequence
  chemically synthesized
acaggtgaatgggtaacaca

SEQ ID NO: 21128 - DNA, 20 bp, Artificial Sequence
  chemically synthesized
tgaatgggtaacacatagaa

SEQ ID NO: 21129 - DNA, 20 bp, Artificial Sequence
  chemically synthesized
cacatagaacagcaaatgtt

SEQ ID NO: 21130 - DNA, 20 bp, Artificial Sequence
  chemically synthesized
atagaacagcaaatgttgag

SEQ ID NO: 21131 - DNA, 20 bp, Artificial Sequence
  chemically synthesized
cagcaaatgttgagtagaaa

SEQ ID NO: 21132 - DNA, 20 bp, Artificial Sequence
  chemically synthesized
atgttgagtagaaatagctc

SEQ ID NO: 21133 - DNA, 20 bp, Artificial Sequence
  chemically synthesized
gttgagtagaaatagctcca

SEQ ID NO: 21134 - DNA, 20 bp, Artificial Sequence
  chemically synthesized
ttgagtagaaatagctccag

SEQ ID NO: 21135 - DNA, 20 bp, Artificial Sequence
  chemically synthesized
tgagtagaaatagctccaga

SEQ ID NO: 21136 - DNA, 20 bp, Artificial Sequence
  chemically synthesized
gagtagaaatagctccagag

SEQ ID NO: 21137 - DNA, 20 bp, Artificial Sequence
  chemically synthesized
gtagaaatagctccagaggg

SEQ ID NO: 21138 - DNA, 20 bp, Artificial Sequence
  chemically synthesized
aattgctttgctcccctctg

SEQ ID NO: 21139 - DNA, 20 bp, Artificial Sequence
  chemically synthesized
gcaattgctttgctcccctc

SEQ ID NO: 21140 - DNA, 20 bp, Artificial Sequence
  chemically synthesized
aatagctccagaggggagca

SEQ ID NO: 21141 - DNA, 20 bp, Artificial Sequence
  chemically synthesized
cttctgctcctgtaatttca

SEQ ID NO: 21142 - DNA, 20 bp, Artificial Sequence
  chemically synthesized
aagcaattgctctgaaatta

SEQ ID NO: 21143 - DNA, 20 bp, Artificial Sequence
  chemically synthesized
agcaattgctctgaaattac

SEQ ID NO: 21144 - DNA, 20 bp, Artificial Sequence
  chemically synthesized
atcttctgctcctgtaattt

SEQ ID NO: 21145 - DNA, 20 bp, Artificial Sequence
  chemically synthesized
caattgctctgaaattacag

SEQ ID NO: 21146 - DNA, 20 bp, Artificial Sequence
  chemically synthesized
ttgctctgaaattacaggag

SEQ ID NO: 21147 - DNA, 20 bp, Artificial Sequence
  chemically synthesized
ctctgaaattacaggagcag

SEQ ID NO: 21148 - DNA, 20 bp, Artificial Sequence
  chemically synthesized
tacaggagcagaagatgaca

SEQ ID NO: 21149 - DNA, 20 bp, Artificial Sequence
  chemically synthesized
ggagcagaagatgacacagt

SEQ ID NO: 21150 - DNA, 20 bp, Artificial Sequence
  chemically synthesized
gagcagaagatgacacagtt

SEQ ID NO: 21151 - DNA, 20 bp, Artificial Sequence
  chemically synthesized
gcagaagatgacacagttag

SEQ ID NO: 21152 - DNA, 20 bp, Artificial Sequence
  chemically synthesized
agaagatgacacagttagga

SEQ ID NO: 21153 - DNA, 20 bp, Artificial Sequence
  chemically synthesized
gttaggagagaaatactgtg

SEQ ID NO: 21154 - DNA, 20 bp, Artificial Sequence
  chemically synthesized
ttttagcagagcacactgca

SEQ ID NO: 21155 - DNA, 20 bp, Artificial Sequence
  chemically synthesized
aaccacatccagttttagca

SEQ ID NO: 21156 - DNA, 20 bp, Artificial Sequence
  chemically synthesized
gcagtgtgctctgctaaaac

SEQ ID NO: 21157 - DNA, 20 bp, Artificial Sequence
  chemically synthesized
ttaaccacatccagttttag

SEQ ID NO: 21158 - DNA, 20 bp, Artificial Sequence
  chemically synthesized
tgtttaaccacatccagttt

SEQ ID NO: 21159 - DNA, 20 bp, Artificial Sequence
  chemically synthesized
tgctctgctaaaactggatg

SEQ ID NO: 21160 - DNA, 20 bp, Artificial Sequence
  chemically synthesized
ttcttgtgtttaaccacatc

SEQ ID NO: 21161 - DNA, 20 bp, Artificial Sequence
  chemically synthesized
aactggatgtggttaaacac

SEQ ID NO: 21162 - DNA, 20 bp, Artificial Sequence
  chemically synthesized
aacacaagaacaatccatca

SEQ ID NO: 21163 - DNA, 20 bp, Artificial Sequence
  chemically synthesized
acaagaacaatccatcacag

SEQ ID NO: 21164 - DNA, 20 bp, Artificial Sequence
  chemically synthesized
tgctcttcagtcttctgtga

SEQ ID NO: 21165 - DNA, 20 bp, Artificial Sequence
  chemically synthesized
caatccatcacagaagactg

SEQ ID NO: 21166 - DNA, 20 bp, Artificial Sequence
  chemically synthesized
atccatcacagaagactgaa

SEQ ID NO: 21167 - DNA, 20 bp, Artificial Sequence
  chemically synthesized
gtttagggaaatgtgctctt

SEQ ID NO: 21168 - DNA, 20 bp, Artificial Sequence
  chemically synthesized
ctgtttgacatgtttgttta

SEQ ID NO: 21169 - DNA, 20 bp, Artificial Sequence
  chemically synthesized
tctgtttgacatgtttgttt

SEQ ID NO: 21170 - DNA, 20 bp, Artificial Sequence
  chemically synthesized
ttctgtttgacatgtttgtt

SEQ ID NO: 21171 - DNA, 20 bp, Artificial Sequence
  chemically synthesized
ccctaaacaaacatgtcaaa

SEQ ID NO: 21172 - DNA, 20 bp, Artificial Sequence
  chemically synthesized
caaacagaattcaactttca

SEQ ID NO: 21173 - DNA, 20 bp, Artificial Sequence
  chemically synthesized
aacagaattcaactttcatg

SEQ ID NO: 21174 - DNA, 20 bp, Artificial Sequence
  chemically synthesized
ttttcaaaatagctccatga

SEQ ID NO: 21175 - DNA, 20 bp, Artificial Sequence
  chemically synthesized
aaatggaaattttttcaaaa

SEQ ID NO: 21176 - DNA, 20 bp, Artificial Sequence
  chemically synthesized
attttgaaaaaatttccatt

SEQ ID NO: 21177 - DNA, 20 bp, Artificial Sequence
  chemically synthesized
ttttgaaaaaatttccattt

SEQ ID NO: 21178 - DNA, 20 bp, Artificial Sequence
  chemically synthesized
atggattgtgtatacctaaa

SEQ ID NO: 21179 - DNA, 20 bp, Artificial Sequence
  chemically synthesized
ggtatacacaatccatgcta

SEQ ID NO: 21180 - DNA, 20 bp, Artificial Sequence
  chemically synthesized
tccttttcgggtccatagca

SEQ ID NO: 21181 - DNA, 20 bp, Artificial Sequence
  chemically synthesized
tcacctccttttcgggtcca

SEQ ID NO: 21182 - DNA, 20 bp, Artificial Sequence
  chemically synthesized
atccatgctatggacccgaa

SEQ ID NO: 21183 - DNA, 20 bp, Artificial Sequence
  chemically synthesized
tccatgctatggacccgaaa

SEQ ID NO: 21184 - DNA, 20 bp, Artificial Sequence
  chemically synthesized
catgctatggacccgaaaag

SEQ ID NO: 21185 - DNA, 20 bp, Artificial Sequence
  chemically synthesized
atgctatggacccgaaaagg

SEQ ID NO: 21186 - DNA, 20 bp, Artificial Sequence
  chemically synthesized
gatattctcacctccttttc

SEQ ID NO: 21187 - DNA, 20 bp, Artificial Sequence
  chemically synthesized
tgatattctcacctcctttt

SEQ ID NO: 21188 - DNA, 20 bp, Artificial Sequence
  chemically synthesized
tatggacccgaaaaggaggt

SEQ ID NO: 21189 - DNA, 20 bp, Artificial Sequence
  chemically synthesized
aaaggaggtgagaatatcaa

SEQ ID NO: 21190 - DNA, 20 bp, Artificial Sequence
  chemically synthesized
aaggaggtgagaatatcaat

SEQ ID NO: 21191 - DNA, 20 bp, Artificial Sequence
  chemically synthesized
aggaggtgagaatatcaata

SEQ ID NO: 21192 - DNA, 20 bp, Artificial Sequence
  chemically synthesized
cattttgaaaagcatatgca

SEQ ID NO: 21193 - DNA, 20 bp, Artificial Sequence
  chemically synthesized
tctaagatgctcattttgaa

SEQ ID NO: 21194 - DNA, 20 bp, Artificial Sequence
  chemically synthesized
atgcatatgcttttcaaaat

SEQ ID NO: 21195 - DNA, 20 bp, Artificial Sequence
  chemically synthesized
gcttttcaaaatgagcatct

SEQ ID NO: 21196 - DNA, 20 bp, Artificial Sequence
  chemically synthesized
ttttcaaaatgagcatctta

SEQ ID NO: 21197 - DNA, 20 bp, Artificial Sequence
  chemically synthesized
aaagtctaggtgtgttctct

SEQ ID NO: 21198 - DNA, 20 bp, Artificial Sequence
  chemically synthesized
agcatcttagagaacacacc

SEQ ID NO: 21199 - DNA, 20 bp, Artificial Sequence
  chemically synthesized
aatgtttcatcaaaaagtct

SEQ ID NO: 21200 - DNA, 20 bp, Artificial Sequence
  chemically synthesized
taatgtttcatcaaaaagtc

SEQ ID NO: 21201 - DNA, 20 bp, Artificial Sequence
  chemically synthesized
acatttaatgtttcatcaaa

SEQ ID NO: 21202 - DNA, 20 bp, Artificial Sequence
  chemically synthesized
gaaacattaaatgtaatgat

SEQ ID NO: 21203 - DNA, 20 bp, Artificial Sequence
  chemically synthesized
atgtaatgattagctctttc

SEQ ID NO: 21204 - DNA, 20 bp, Artificial Sequence
  chemically synthesized
tgtaatgattagctctttct

SEQ ID NO: 21205 - DNA, 20 bp, Artificial Sequence
  chemically synthesized
cttattgagggtcctagaaa

SEQ ID NO: 21206 - DNA, 20 bp, Artificial Sequence
  chemically synthesized
tgcttattgagggtcctaga

SEQ ID NO: 21207 - DNA, 20 bp, Artificial Sequence
  chemically synthesized
tggttgcttattgagggtcc

SEQ ID NO: 21208 - DNA, 20 bp, Artificial Sequence
  chemically synthesized
ctctttctaggaccctcaat

SEQ ID NO: 21209 - DNA, 20 bp, Artificial Sequence
  chemically synthesized
atctgctggttgcttattga

SEQ ID NO: 21210 - DNA, 20 bp, Artificial Sequence
  chemically synthesized
tatctgctggttgcttattg

SEQ ID NO: 21211 - DNA, 20 bp, Artificial Sequence
  chemically synthesized
gtatctgctggttgcttatt

SEQ ID NO: 21212 - DNA, 20 bp, Artificial Sequence
  chemically synthesized
taggaccctcaataagcaac

SEQ ID NO: 21213 - DNA, 20 bp, Artificial Sequence
  chemically synthesized
gaccctcaataagcaaccag

SEQ ID NO: 21214 - DNA, 20 bp, Artificial Sequence
  chemically synthesized
caataagcaaccagcagata

SEQ ID NO: 21215 - DNA, 20 bp, Artificial Sequence
  chemically synthesized
tttcacacaactgtatctgc

SEQ ID NO: 21216 - DNA, 20 bp, Artificial Sequence
  chemically synthesized
ttcctagcttaaggaaacaa

SEQ ID NO: 21217 - DNA, 20 bp, Artificial Sequence
  chemically synthesized
tgtgaaaccattgtttcctt

SEQ ID NO: 21218 - DNA, 20 bp, Artificial Sequence
  chemically synthesized
aaaccattgtttccttaagc

SEQ ID NO: 21219 - DNA, 20 bp, Artificial Sequence
  chemically synthesized
aaccattgtttccttaagct

SEQ ID NO: 21220 - DNA, 20 bp, Artificial Sequence
  chemically synthesized
taatggaaattcctagctta

SEQ ID NO: 21221 - DNA, 20 bp, Artificial Sequence
  chemically synthesized
ttaatggaaattcctagctt

SEQ ID NO: 21222 - DNA, 20 bp, Artificial Sequence
  chemically synthesized
atatatttaatggaaattcc

SEQ ID NO: 21223 - DNA, 20 bp, Artificial Sequence
  chemically synthesized
tatatatataatatatttaa

SEQ ID NO: 21224 - DNA, 20 bp, Artificial Sequence
  chemically synthesized
gtgtgtttgtgtgtattcac

SEQ ID NO: 21225 - DNA, 20 bp, Artificial Sequence
  chemically synthesized
tgtttgtgtgtattcactag

SEQ ID NO: 21226 - DNA, 20 bp, Artificial Sequence
  chemically synthesized
agctttaaagatatatctac

SEQ ID NO: 21227 - DNA, 20 bp, Artificial Sequence
  chemically synthesized
cactagtagatatatcttta

SEQ ID NO: 21228 - DNA, 20 bp, Artificial Sequence
  chemically synthesized
tgggtttttatgtagcttta

SEQ ID NO: 21229 - DNA, 20 bp, Artificial Sequence
  chemically synthesized
agaatacttgggtttttatg

SEQ ID NO: 21230 - DNA, 20 bp, Artificial Sequence
  chemically synthesized
ttaaagctacataaaaaccc

SEQ ID NO: 21231 - DNA, 20 bp, Artificial Sequence
  chemically synthesized
gaagatgtattagaatactt

SEQ ID NO: 21232 - DNA, 20 bp, Artificial Sequence
  chemically synthesized
tgaagatgtattagaatact

SEQ ID NO: 21233 - DNA, 20 bp, Artificial Sequence
  chemically synthesized
tttagaaagtgaagatgtat

SEQ ID NO: 21234 - DNA, 20 bp, Artificial Sequence
  chemically synthesized
taaacataatttagaaagtg

SEQ ID NO: 21235 - DNA, 20 bp, Artificial Sequence
  chemically synthesized
tactgtaaacataatttaga

SEQ ID NO: 21236 - DNA, 20 bp, Artificial Sequence
  chemically synthesized
cctctactgtaaacataatt

SEQ ID NO: 21237 - DNA, 20 bp, Artificial Sequence
  chemically synthesized
cactttctaaattatgttta

SEQ ID NO: 21238 - DNA, 20 bp, Artificial Sequence
  chemically synthesized
tttctaaattatgtttacag

SEQ ID NO: 21239 - DNA, 20 bp, Artificial Sequence
  chemically synthesized
tctaaattatgtttacagta

SEQ ID NO: 21240 - DNA, 20 bp, Artificial Sequence
  chemically synthesized
ctaaattatgtttacagtag

SEQ ID NO: 21241 - DNA, 20 bp, Artificial Sequence
  chemically synthesized
gtttacagtagaggatgcta

SEQ ID NO: 21242 - DNA, 20 bp, Artificial Sequence
  chemically synthesized
tttacagtagaggatgctat

SEQ ID NO: 21243 - DNA, 20 bp, Artificial Sequence
  chemically synthesized
ttcaatggcttcaaagccta

SEQ ID NO: 21244 - DNA, 20 bp, Artificial Sequence
  chemically synthesized
agaggatgctataggctttg

SEQ ID NO: 21245 - DNA, 20 bp, Artificial Sequence
  chemically synthesized
cctgttcttcaatggcttca

SEQ ID NO: 21246 - DNA, 20 bp, Artificial Sequence
  chemically synthesized
tataggctttgaagccattg

SEQ ID NO: 21247 - DNA, 20 bp, Artificial Sequence
  chemically synthesized
acatggtccctgttcttcaa

SEQ ID NO: 21248 - DNA, 20 bp, Artificial Sequence
  chemically synthesized
gctttgaagccattgaagaa

SEQ ID NO: 21249 - DNA, 20 bp, Artificial Sequence
  chemically synthesized
ctttgaagccattgaagaac

SEQ ID NO: 21250 - DNA, 20 bp, Artificial Sequence
  chemically synthesized
tttgaagccattgaagaaca

SEQ ID NO: 21251 - DNA, 20 bp, Artificial Sequence
  chemically synthesized
attgaagaacagggaccatg

SEQ ID NO: 21252 - DNA, 20 bp, Artificial Sequence
  chemically synthesized
gaagaacagggaccatgtgg

SEQ ID NO: 21253 - DNA, 20 bp, Artificial Sequence
  chemically synthesized
atgcatagggtaccaccaca

SEQ ID NO: 21254 - DNA, 20 bp, Artificial Sequence
  chemically synthesized
tgtggtggtaccctatgcat

SEQ ID NO: 21255 - DNA, 20 bp, Artificial Sequence
  chemically synthesized
ccccacagccctcatgcata

SEQ ID NO: 21256 - DNA, 20 bp, Artificial Sequence
  chemically synthesized
gtggtggtaccctatgcatg

SEQ ID NO: 21257 - DNA, 20 bp, Artificial Sequence
  chemically synthesized
cccccacagccctcatgcat

SEQ ID NO: 21258 - DNA, 20 bp, Artificial Sequence
  chemically synthesized
tggtggtaccctatgcatga

SEQ ID NO: 21259 - DNA, 20 bp, Artificial Sequence
  chemically synthesized
acccccacagccctcatgca

SEQ ID NO: 21260 - DNA, 20 bp, Artificial Sequence
  chemically synthesized
taccctatgcatgagggctg

SEQ ID NO: 21261 - DNA, 20 bp, Artificial Sequence
  chemically synthesized
accctatgcatgagggctgt

SEQ ID NO: 21262 - DNA, 20 bp, Artificial Sequence
  chemically synthesized
ccctatgcatgagggctgtg

SEQ ID NO: 21263 - DNA, 20 bp, Artificial Sequence
  chemically synthesized
cctatgcatgagggctgtgg

SEQ ID NO: 21264 - DNA, 20 bp, Artificial Sequence
  chemically synthesized
tgcatgagggctgtgggggt

SEQ ID NO: 21265 - DNA, 20 bp, Artificial Sequence
  chemically synthesized
cccaccctctctcaccccca

SEQ ID NO: 21266 - DNA, 20 bp, Artificial Sequence
  chemically synthesized
catgagggctgtgggggtga

SEQ ID NO: 21267 - DNA, 20 bp, Artificial Sequence
  chemically synthesized
tgagggctgtgggggtgaga

SEQ ID NO: 21268 - DNA, 20 bp, Artificial Sequence
  chemically synthesized
gagggctgtgggggtgagag

SEQ ID NO: 21269 - DNA, 20 bp, Artificial Sequence
  chemically synthesized
agggctgtgggggtgagaga

SEQ ID NO: 21270 - DNA, 20 bp, Artificial Sequence
  chemically synthesized
gctgtgggggtgagagaggg

SEQ ID NO: 21271 - DNA, 20 bp, Artificial Sequence
  chemically synthesized
ctgtgggggtgagagagggt

SEQ ID NO: 21272 - DNA, 20 bp, Artificial Sequence
  chemically synthesized
tgtgggggtgagagagggtg

SEQ ID NO: 21273 - DNA, 20 bp, Artificial Sequence
  chemically synthesized
ggggtgagagagggtgggga

SEQ ID NO: 21274 - DNA, 20 bp, Artificial Sequence
  chemically synthesized
gggtgagagagggtggggac

SEQ ID NO: 21275 - DNA, 20 bp, Artificial Sequence
  chemically synthesized
agagggtggggacaggataa

SEQ ID NO: 21276 - DNA, 20 bp, Artificial Sequence
  chemically synthesized
tggggacaggataaaagaaa

SEQ ID NO: 21277 - DNA, 20 bp, Artificial Sequence
  chemically synthesized
aaaagaaatggctgactctc

SEQ ID NO: 21278 - DNA, 20 bp, Artificial Sequence
  chemically synthesized
aaagaaatggctgactctcc

SEQ ID NO: 21279 - DNA, 20 bp, Artificial Sequence
  chemically synthesized
caaagaggatcctggagagt

SEQ ID NO: 21280 - DNA, 20 bp, Artificial Sequence
  chemically synthesized
acagcaaagaggatcctgga

SEQ ID NO: 21281 - DNA, 20 bp, Artificial Sequence
  chemically synthesized
gcacagcaaagaggatcctg

SEQ ID NO: 21282 - DNA, 20 bp, Artificial Sequence
  chemically synthesized
ctgcacagcaaagaggatcc

SEQ ID NO: 21283 - DNA, 20 bp, Artificial Sequence
  chemically synthesized
gcttttcctgcacagcaaag

SEQ ID NO: 21284 - DNA, 20 bp, Artificial Sequence
  chemically synthesized
tgcttttcctgcacagcaaa

SEQ ID NO: 21285 - DNA, 20 bp, Artificial Sequence
  chemically synthesized
ccaggatcctctttgctgtg

SEQ ID NO: 21286 - DNA, 20 bp, Artificial Sequence
  chemically synthesized
tctgcttttcctgcacagca

SEQ ID NO: 21287 - DNA, 20 bp, Artificial Sequence
  chemically synthesized
caggatcctctttgctgtgc

SEQ ID NO: 21288 - DNA, 20 bp, Artificial Sequence
  chemically synthesized
cactgtctgcttttcctgca

SEQ ID NO: 21289 - DNA, 20 bp, Artificial Sequence
  chemically synthesized
tcctctttgctgtgcaggaa

SEQ ID NO: 21290 - DNA, 20 bp, Artificial Sequence
  chemically synthesized
tctttgctgtgcaggaaaag

SEQ ID NO: 21291 - DNA, 20 bp, Artificial Sequence
  chemically synthesized
tgctgtgcaggaaaagcaga

SEQ ID NO: 21292 - DNA, 20 bp, Artificial Sequence
  chemically synthesized
tgtgcaggaaaagcagacag

SEQ ID NO: 21293 - DNA, 20 bp, Artificial Sequence
  chemically synthesized
gcaggaaaagcagacagtgg

SEQ ID NO: 21294 - DNA, 20 bp, Artificial Sequence
  chemically synthesized
gaaaagcagacagtggcggt

SEQ ID NO: 21295 - DNA, 20 bp, Artificial Sequence
  chemically synthesized
aaaagcagacagtggcggtt

SEQ ID NO: 21296 - DNA, 20 bp, Artificial Sequence
  chemically synthesized
aaagcagacagtggcggttg

SEQ ID NO: 21297 - DNA, 20 bp, Artificial Sequence
  chemically synthesized
aagcagacagtggcggttgg

SEQ ID NO: 21298 - DNA, 20 bp, Artificial Sequence
  chemically synthesized
agcagacagtggcggttggg

SEQ ID NO: 21299 - DNA, 20 bp, Artificial Sequence
  chemically synthesized
agacagtggcggttgggggg

SEQ ID NO: 21300 - DNA, 20 bp, Artificial Sequence
  chemically synthesized
agtggcggttggggggcggc

SEQ ID NO: 21301 - DNA, 20 bp, Artificial Sequence
  chemically synthesized
ggcggttggggggcggcgag

SEQ ID NO: 21302 - DNA, 20 bp, Artificial Sequence
  chemically synthesized
gcggttggggggcggcgagc

SEQ ID NO: 21303 - DNA, 20 bp, Artificial Sequence
  chemically synthesized
gttggggggcggcgagcagg

SEQ ID NO: 21304 - DNA, 20 bp, Artificial Sequence
  chemically synthesized
ttggggggcggcgagcaggc

SEQ ID NO: 21305 - DNA, 20 bp, Artificial Sequence
  chemically synthesized
gagcaggcaggacttcaaca

SEQ ID NO: 21306 - DNA, 20 bp, Artificial Sequence
  chemically synthesized
agcaggcaggacttcaacac

SEQ ID NO: 21307 - DNA, 20 bp, Artificial Sequence
  chemically synthesized
gcaggcaggacttcaacaca

SEQ ID NO: 21308 - DNA, 20 bp, Artificial Sequence
  chemically synthesized
ttagtgggatccctgtgttg

SEQ ID NO: 21309 - DNA, 20 bp, Artificial Sequence
  chemically synthesized
caacacagggatcccactaa

SEQ ID NO: 21310 - DNA, 20 bp, Artificial Sequence
  chemically synthesized
gagcctcaggaaccattagt

SEQ ID NO: 21311 - DNA, 20 bp, Artificial Sequence
  chemically synthesized
agagcctcaggaaccattag

SEQ ID NO: 21312 - DNA, 20 bp, Artificial Sequence
  chemically synthesized
accagagcctcaggaaccat

SEQ ID NO: 21313 - DNA, 20 bp, Artificial Sequence
  chemically synthesized
ggatcccactaatggttcct

SEQ ID NO: 21314 - DNA, 20 bp, Artificial Sequence
  chemically synthesized
gatcccactaatggttcctg

SEQ ID NO: 21315 - DNA, 20 bp, Artificial Sequence
  chemically synthesized
actaatggttcctgaggctc

SEQ ID NO: 21316 - DNA, 20 bp, Artificial Sequence
  chemically synthesized
ttaggcacaaccagagcctc

SEQ ID NO: 21317 - DNA, 20 bp, Artificial Sequence
  chemically synthesized
attaggcacaaccagagcct

SEQ ID NO: 21318 - DNA, 20 bp, Artificial Sequence
  chemically synthesized
aagatgattaggcacaacca

SEQ ID NO: 21319 - DNA, 20 bp, Artificial Sequence
  chemically synthesized
agaagatgattaggcacaac

SEQ ID NO: 21320 - DNA, 20 bp, Artificial Sequence
  chemically synthesized
agaaggttgagaagatgatt

SEQ ID NO: 21321 - DNA, 20 bp, Artificial Sequence
  chemically synthesized
tagaaggttgagaagatgat

SEQ ID NO: 21322 - DNA, 20 bp, Artificial Sequence
  chemically synthesized
tttgaagctagaaggttgag

SEQ ID NO: 21323 - DNA, 20 bp, Artificial Sequence
  chemically synthesized
taatcatcttctcaaccttc

SEQ ID NO: 21324 - DNA, 20 bp, Artificial Sequence
  chemically synthesized
gcttttgaagctagaaggtt

SEQ ID NO: 21325 - DNA, 20 bp, Artificial Sequence
  chemically synthesized
aatgagcttttgaagctaga

SEQ ID NO: 21326 - DNA, 20 bp, Artificial Sequence
  chemically synthesized
gaatgagcttttgaagctag

SEQ ID NO: 21327 - DNA, 20 bp, Artificial Sequence
  chemically synthesized
tctcaaccttctagcttcaa

SEQ ID NO: 21328 - DNA, 20 bp, Artificial Sequence
  chemically synthesized
aaagaatgagcttttgaagc

SEQ ID NO: 21329 - DNA, 20 bp, Artificial Sequence
  chemically synthesized
aggaaaagaatgagcttttg

SEQ ID NO: 21330 - DNA, 20 bp, Artificial Sequence
  chemically synthesized
tacatagaaaggaaaagaat

SEQ ID NO: 21331 - DNA, 20 bp, Artificial Sequence
  chemically synthesized
gtggcatacatagaaaggaa

SEQ ID NO: 21332 - DNA, 20 bp, Artificial Sequence
  chemically synthesized
ctactgtggcatacatagaa

SEQ ID NO: 21333 - DNA, 20 bp, Artificial Sequence
  chemically synthesized
gctactgtggcatacataga

SEQ ID NO: 21334 - DNA, 20 bp, Artificial Sequence
  chemically synthesized
gttagctactgtggcataca

SEQ ID NO: 21335 - DNA, 20 bp, Artificial Sequence
  chemically synthesized
tttcctttctatgtatgcca

SEQ ID NO: 21336 - DNA, 20 bp, Artificial Sequence
  chemically synthesized
cctttctatgtatgccacag

SEQ ID NO: 21337 - DNA, 20 bp, Artificial Sequence
  chemically synthesized
atagcaagagttagctactg

SEQ ID NO: 21338 - DNA, 20 bp, Artificial Sequence
  chemically synthesized
taggaaggaatagcaagagt

SEQ ID NO: 21339 - DNA, 20 bp, Artificial Sequence
  chemically synthesized
tacataggaaggaatagcaa

SEQ ID NO: 21340 - DNA, 20 bp, Artificial Sequence
  chemically synthesized
cttacataggaaggaatagc

SEQ ID NO: 21341 - DNA, 20 bp, Artificial Sequence
  chemically synthesized
ctgtcttacataggaaggaa

SEQ ID NO: 21342 - DNA, 20 bp, Artificial Sequence
  chemically synthesized
aaaatctgtcttacatagga

SEQ ID NO: 21343 - DNA, 20 bp, Artificial Sequence
  chemically synthesized
cttgctattccttcctatgt

SEQ ID NO: 21344 - DNA, 20 bp, Artificial Sequence
  chemically synthesized
aaaaatctgtcttacatagg

SEQ ID NO: 21345 - DNA, 20 bp, Artificial Sequence
  chemically synthesized
aaaaaaaatctgtcttacat

SEQ ID NO: 21346 - DNA, 20 bp, Artificial Sequence
  chemically synthesized
ctattccttcctatgtaaga

SEQ ID NO: 21347 - DNA, 20 bp, Artificial Sequence
  chemically synthesized
caaaaaaaatctgtcttaca

SEQ ID NO: 21348 - DNA, 20 bp, Artificial Sequence
  chemically synthesized
cagattttttttgtctttta

SEQ ID NO: 21349 - DNA, 20 bp, Artificial Sequence
  chemically synthesized
gattttttttgtcttttaca

SEQ ID NO: 21350 - DNA, 20 bp, Artificial Sequence
  chemically synthesized
aagagtctatcactctgtaa

SEQ ID NO: 21351 - DNA, 20 bp, Artificial Sequence
  chemically synthesized
ttttgtcttttacagagtga

SEQ ID NO: 21352 - DNA, 20 bp, Artificial Sequence
  chemically synthesized
tttacagagtgatagactct

SEQ ID NO: 21353 - DNA, 20 bp, Artificial Sequence
  chemically synthesized
tacagagtgatagactctta

SEQ ID NO: 21354 - DNA, 20 bp, Artificial Sequence
  chemically synthesized
gagtgatagactcttagagc

SEQ ID NO: 21355 - DNA, 20 bp, Artificial Sequence
  chemically synthesized
aagcaaccttctggctctaa

SEQ ID NO: 21356 - DNA, 20 bp, Artificial Sequence
  chemically synthesized
taaagcaaccttctggctct

SEQ ID NO: 21357 - DNA, 20 bp, Artificial Sequence
  chemically synthesized
tgatagactcttagagccag

SEQ ID NO: 21358 - DNA, 20 bp, Artificial Sequence
  chemically synthesized
gatagactcttagagccaga

SEQ ID NO: 21359 - DNA, 20 bp, Artificial Sequence
  chemically synthesized
atgattttaaagcaaccttc

SEQ ID NO: 21360 - DNA, 20 bp, Artificial Sequence
  chemically synthesized
tcaactgcaaaatgatttta

SEQ ID NO: 21361 - DNA, 20 bp, Artificial Sequence
  chemically synthesized
gttgctttaaaatcattttg

SEQ ID NO: 21362 - DNA, 20 bp, Artificial Sequence
  chemically synthesized
tttaaaatcattttgcagtt

SEQ ID NO: 21363 - DNA, 20 bp, Artificial Sequence
  chemically synthesized
attttgcagttgagacaact

SEQ ID NO: 21364 - DNA, 20 bp, Artificial Sequence
  chemically synthesized
gcagttgagacaactgagac

SEQ ID NO: 21365 - DNA, 20 bp, Artificial Sequence
  chemically synthesized
agttgagacaactgagacca

SEQ ID NO: 21366 - DNA, 20 bp, Artificial Sequence
  chemically synthesized
agtctccatatctctggtct

SEQ ID NO: 21367 - DNA, 20 bp, Artificial Sequence
  chemically synthesized
gacaactgagaccagagata

SEQ ID NO: 21368 - DNA, 20 bp, Artificial Sequence
  chemically synthesized
agagtgagtctccatatctc

SEQ ID NO: 21369 - DNA, 20 bp, Artificial Sequence
  chemically synthesized
caactgagaccagagatatg

SEQ ID NO: 21370 - DNA, 20 bp, Artificial Sequence
  chemically synthesized
agagatatggagactcactc

SEQ ID NO: 21371 - DNA, 20 bp, Artificial Sequence
  chemically synthesized
gagatatggagactcactct

SEQ ID NO: 21372 - DNA, 20 bp, Artificial Sequence
  chemically synthesized
cctgccataacacccagagt

SEQ ID NO: 21373 - DNA, 20 bp, Artificial Sequence
  chemically synthesized
atatcctgccataacaccca

SEQ ID NO: 21374 - DNA, 20 bp, Artificial Sequence
  chemically synthesized
gagactcactctgggtgtta

SEQ ID NO: 21375 - DNA, 20 bp, Artificial Sequence
  chemically synthesized
agatatcctgccataacacc

SEQ ID NO: 21376 - DNA, 20 bp, Artificial Sequence
  chemically synthesized
actcactctgggtgttatgg

SEQ ID NO: 21377 - DNA, 20 bp, Artificial Sequence
  chemically synthesized
ctcactctgggtgttatggc

SEQ ID NO: 21378 - DNA, 20 bp, Artificial Sequence
  chemically synthesized
gggtgttatggcaggatatc

SEQ ID NO: 21379 - DNA, 20 bp, Artificial Sequence
  chemically synthesized
ggtgttatggcaggatatct

SEQ ID NO: 21380 - DNA, 20 bp, Artificial Sequence
  chemically synthesized
ccatgagaaatcagaaaacc

SEQ ID NO: 21381 - DNA, 20 bp, Artificial Sequence
  chemically synthesized
tatgtacctccatgagaaat

SEQ ID NO: 21382 - DNA, 20 bp, Artificial Sequence
  chemically synthesized
ctaggttttctgatttctca

SEQ ID NO: 21383 - DNA, 20 bp, Artificial Sequence
  chemically synthesized
aggttttctgatttctcatg

SEQ ID NO: 21384 - DNA, 20 bp, Artificial Sequence
  chemically synthesized
ggttttctgatttctcatgg

SEQ ID NO: 21385 - DNA, 20 bp, Artificial Sequence
  chemically synthesized
cttacaatatgtacctccat

SEQ ID NO: 21386 - DNA, 20 bp, Artificial Sequence
  chemically synthesized
ctcatggaggtacatattgt

SEQ ID NO: 21387 - DNA, 20 bp, Artificial Sequence
  chemically synthesized
tcatggaggtacatattgta

SEQ ID NO: 21388 - DNA, 20 bp, Artificial Sequence
  chemically synthesized
catggaggtacatattgtaa

SEQ ID NO: 21389 - DNA, 20 bp, Artificial Sequence
  chemically synthesized
atggaggtacatattgtaag

SEQ ID NO: 21390 - DNA, 20 bp, Artificial Sequence
  chemically synthesized
tggaggtacatattgtaagg

SEQ ID NO: 21391 - DNA, 20 bp, Artificial Sequence
  chemically synthesized
gtacatattgtaagggggaa

SEQ ID NO: 21392 - DNA, 20 bp, Artificial Sequence
  chemically synthesized
catattgtaagggggaaaag

SEQ ID NO: 21393 - DNA, 20 bp, Artificial Sequence
  chemically synthesized
atattgtaagggggaaaagt

SEQ ID NO: 21394 - DNA, 20 bp, Artificial Sequence
  chemically synthesized
ttgtaagggggaaaagtggg

SEQ ID NO: 21395 - DNA, 20 bp, Artificial Sequence
  chemically synthesized
taagggggaaaagtgggtgg

SEQ ID NO: 21396 - DNA, 20 bp, Artificial Sequence
  chemically synthesized
gggggaaaagtgggtggcag

SEQ ID NO: 21397 - DNA, 20 bp, Artificial Sequence
  chemically synthesized
ggggaaaagtgggtggcaga

SEQ ID NO: 21398 - DNA, 20 bp, Artificial Sequence
  chemically synthesized
cctgttctgtaaagtcagta

SEQ ID NO: 21399 - DNA, 20 bp, Artificial Sequence
  chemically synthesized
tcctgttctgtaaagtcagt

SEQ ID NO: 21400 - DNA, 20 bp, Artificial Sequence
  chemically synthesized
aggtgtccttactgacttta

SEQ ID NO: 21401 - DNA, 20 bp, Artificial Sequence
  chemically synthesized
gttttcctgttctgtaaagt

SEQ ID NO: 21402 - DNA, 20 bp, Artificial Sequence
  chemically synthesized
tccttactgactttacagaa

SEQ ID NO: 21403 - DNA, 20 bp, Artificial Sequence
  chemically synthesized
aatggttttcctgttctgta

SEQ ID NO: 21404 - DNA, 20 bp, Artificial Sequence
  chemically synthesized
ccttactgactttacagaac

SEQ ID NO: 21405 - DNA, 20 bp, Artificial Sequence
  chemically synthesized
cattagcatggaatgcagaa

SEQ ID NO: 21406 - DNA, 20 bp, Artificial Sequence
  chemically synthesized
gttgtcattagcatggaatg

SEQ ID NO: 21407 - DNA, 20 bp, Artificial Sequence
  chemically synthesized
tcctactgttgtcattagca

SEQ ID NO: 21408 - DNA, 20 bp, Artificial Sequence
  chemically synthesized
gcattccatgctaatgacaa

SEQ ID NO: 21409 - DNA, 20 bp, Artificial Sequence
  chemically synthesized
ttttatcctactgttgtcat

SEQ ID NO: 21410 - DNA, 20 bp, Artificial Sequence
  chemically synthesized
ttccatgctaatgacaacag

SEQ ID NO: 21411 - DNA, 20 bp, Artificial Sequence
  chemically synthesized
tccatgctaatgacaacagt

SEQ ID NO: 21412 - DNA, 20 bp, Artificial Sequence
  chemically synthesized
atgacaacagtaggataaaa

SEQ ID NO: 21413 - DNA, 20 bp, Artificial Sequence
  chemically synthesized
acaacagtaggataaaacag

SEQ ID NO: 21414 - DNA, 20 bp, Artificial Sequence
  chemically synthesized
gataaaacagaagcaccaaa

SEQ ID NO: 21415 - DNA, 20 bp, Artificial Sequence
  chemically synthesized
aaacagaagcaccaaaaagt

SEQ ID NO: 21416 - DNA, 20 bp, Artificial Sequence
  chemically synthesized
ttctccactaaccaactttt

SEQ ID NO: 21417 - DNA, 20 bp, Artificial Sequence
  chemically synthesized
agaagcaccaaaaagttggt

SEQ ID NO: 21418 - DNA, 20 bp, Artificial Sequence
  chemically synthesized
agcaccaaaaagttggttag

SEQ ID NO: 21419 - DNA, 20 bp, Artificial Sequence
  chemically synthesized
caccaaaaagttggttagtg

SEQ ID NO: 21420 - DNA, 20 bp, Artificial Sequence
  chemically synthesized
ttggttagtggagaaaaaaa

SEQ ID NO: 21421 - DNA, 20 bp, Artificial Sequence
  chemically synthesized
tggagaaaaaaaaagtctca

SEQ ID NO: 21422 - DNA, 20 bp, Artificial Sequence
  chemically synthesized
tggggttatatgggcaccat

SEQ ID NO: 21423 - DNA, 20 bp, Artificial Sequence
  chemically synthesized
ggatgaacttggggttatat

SEQ ID NO: 21424 - DNA, 20 bp, Artificial Sequence
  chemically synthesized
aggatgaacttggggttata

SEQ ID NO: 21425 - DNA, 20 bp, Artificial Sequence
  chemically synthesized
catggtgcccatataacccc

SEQ ID NO: 21426 - DNA, 20 bp, Artificial Sequence
  chemically synthesized
tgacctataggatgaacttg

SEQ ID NO: 21427 - DNA, 20 bp, Artificial Sequence
  chemically synthesized
ttgacctataggatgaactt

SEQ ID NO: 21428 - DNA, 20 bp, Artificial Sequence
  chemically synthesized
attgacctataggatgaact

SEQ ID NO: 21429 - DNA, 20 bp, Artificial Sequence
  chemically synthesized
ataaccccaagttcatccta

SEQ ID NO: 21430 - DNA, 20 bp, Artificial Sequence
  chemically synthesized
taaccccaagttcatcctat

SEQ ID NO: 21431 - DNA, 20 bp, Artificial Sequence
  chemically synthesized
gaatatacagattgacctat

SEQ ID NO: 21432 - DNA, 20 bp, Artificial Sequence
  chemically synthesized
agaatatacagattgaccta

SEQ ID NO: 21433 - DNA, 20 bp, Artificial Sequence
  chemically synthesized
atacatcaacatagaatata

SEQ ID NO: 21434 - DNA, 20 bp, Artificial Sequence
  chemically synthesized
gaattatttatacatcaaca

SEQ ID NO: 21435 - DNA, 20 bp, Artificial Sequence
  chemically synthesized
tttctgtgctaattagatca

SEQ ID NO: 21436 - DNA, 20 bp, Artificial Sequence
  chemically synthesized
aaataattctgtgatctaat

SEQ ID NO: 21437 - DNA, 20 bp, Artificial Sequence
  chemically synthesized
attctgtgatctaattagca

SEQ ID NO: 21438 - DNA, 20 bp, Artificial Sequence
  chemically synthesized
ctttctgtttctgtgctaat

SEQ ID NO: 21439 - DNA, 20 bp, Artificial Sequence
  chemically synthesized
tgatctaattagcacagaaa

SEQ ID NO: 21440 - DNA, 20 bp, Artificial Sequence
  chemically synthesized
ctaattagcacagaaacaga

SEQ ID NO: 21441 - DNA, 20 bp, Artificial Sequence
  chemically synthesized
aattagcacagaaacagaaa

SEQ ID NO: 21442 - DNA, 20 bp, Artificial Sequence
  chemically synthesized
attagcacagaaacagaaag

SEQ ID NO: 21443 - DNA, 20 bp, Artificial Sequence
  chemically synthesized
gcacagaaacagaaagaggt

SEQ ID NO: 21444 - DNA, 20 bp, Artificial Sequence
  chemically synthesized
aaacagaaagaggtgagtaa

SEQ ID NO: 21445 - DNA, 20 bp, Artificial Sequence
  chemically synthesized
cagaaagaggtgagtaatgg

SEQ ID NO: 21446 - DNA, 20 bp, Artificial Sequence
  chemically synthesized
aaagaggtgagtaatggtgg

SEQ ID NO: 21447 - DNA, 20 bp, Artificial Sequence
  chemically synthesized
aaaaatcagcaaacatacag

SEQ ID NO: 21448 - DNA, 20 bp, Artificial Sequence
  chemically synthesized
aagaaaaatcagcaaacata

SEQ ID NO: 21449 - DNA, 20 bp, Artificial Sequence
  chemically synthesized
catgcctgggcaagaaaaat

SEQ ID NO: 21450 - DNA, 20 bp, Artificial Sequence
  chemically synthesized
gtttgctgatttttcttgcc

SEQ ID NO: 21451 - DNA, 20 bp, Artificial Sequence
  chemically synthesized
tttgctgatttttcttgccc

SEQ ID NO: 21452 - DNA, 20 bp, Artificial Sequence
  chemically synthesized
gtagagtggcatgcctgggc

SEQ ID NO: 21453 - DNA, 20 bp, Artificial Sequence
  chemically synthesized
gcctgtagagtggcatgcct

SEQ ID NO: 21454 - DNA, 20 bp, Artificial Sequence
  chemically synthesized
tgcctgtagagtggcatgcc

SEQ ID NO: 21455 - DNA, 20 bp, Artificial Sequence
  chemically synthesized
tgcccaggcatgccactcta

SEQ ID NO: 21456 - DNA, 20 bp, Artificial Sequence
  chemically synthesized
gcccaggcatgccactctac

SEQ ID NO: 21457 - DNA, 20 bp, Artificial Sequence
  chemically synthesized
agtgtaagttgcctgtagag

SEQ ID NO: 21458 - DNA, 20 bp, Artificial Sequence
  chemically synthesized
ataagtgtaagttgcctgta

SEQ ID NO: 21459 - DNA, 20 bp, Artificial Sequence
  chemically synthesized
ccataagtgtaagttgcctg

SEQ ID NO: 21460 - DNA, 20 bp, Artificial Sequence
  chemically synthesized
ctacaggcaacttacactta

SEQ ID NO: 21461 - DNA, 20 bp, Artificial Sequence
  chemically synthesized
ggtccctcagccataagtgt

SEQ ID NO: 21462 - DNA, 20 bp, Artificial Sequence
  chemically synthesized
ggcaacttacacttatggct

SEQ ID NO: 21463 - DNA, 20 bp, Artificial Sequence
  chemically synthesized
gcaacttacacttatggctg

SEQ ID NO: 21464 - DNA, 20 bp, Artificial Sequence
  chemically synthesized
ttgggaggtccctcagccat

SEQ ID NO: 21465 - DNA, 20 bp, Artificial Sequence
  chemically synthesized
caacttacacttatggctga

SEQ ID NO: 21466 - DNA, 20 bp, Artificial Sequence
  chemically synthesized
gatttgcttgggaggtccct

SEQ ID NO: 21467 - DNA, 20 bp, Artificial Sequence
  chemically synthesized
ttatggctgagggacctccc

SEQ ID NO: 21468 - DNA, 20 bp, Artificial Sequence
  chemically synthesized
agtgcaaagatttgcttggg

SEQ ID NO: 21469 - DNA, 20 bp, Artificial Sequence
  chemically synthesized
aagtgcaaagatttgcttgg

SEQ ID NO: 21470 - DNA, 20 bp, Artificial Sequence
  chemically synthesized
tgaagtgcaaagatttgctt

SEQ ID NO: 21471 - DNA, 20 bp, Artificial Sequence
  chemically synthesized
ttgaagtgcaaagatttgct

SEQ ID NO: 21472 - DNA, 20 bp, Artificial Sequence
  chemically synthesized
attgactttcttgaagtgca

SEQ ID NO: 21473 - DNA, 20 bp, Artificial Sequence
  chemically synthesized
caagcaaatctttgcacttc

SEQ ID NO: 21474 - DNA, 20 bp, Artificial Sequence
  chemically synthesized
caaatctttgcacttcaaga

SEQ ID NO: 21475 - DNA, 20 bp, Artificial Sequence
  chemically synthesized
aaagtgcattgactttcttg

SEQ ID NO: 21476 - DNA, 20 bp, Artificial Sequence
  chemically synthesized
aaagtcaatgcactttgatg

SEQ ID NO: 21477 - DNA, 20 bp, Artificial Sequence
  chemically synthesized
ctgcacagacaactacatca

SEQ ID NO: 21478 - DNA, 20 bp, Artificial Sequence
  chemically synthesized
ctttgatgtagttgtctgtg

SEQ ID NO: 21479 - DNA, 20 bp, Artificial Sequence
  chemically synthesized
gatgtagttgtctgtgcagt

SEQ ID NO: 21480 - DNA, 20 bp, Artificial Sequence
  chemically synthesized
atgtagttgtctgtgcagta

SEQ ID NO: 21481 - DNA, 20 bp, Artificial Sequence
  chemically synthesized
tggaattaacccttactgca

SEQ ID NO: 21482 - DNA, 20 bp, Artificial Sequence
  chemically synthesized
tgtagttgtctgtgcagtaa

SEQ ID NO: 21483 - DNA, 20 bp, Artificial Sequence
  chemically synthesized
tgtgcagtaagggttaattc

SEQ ID NO: 21484 - DNA, 20 bp, Artificial Sequence
  chemically synthesized
tgcagtaagggttaattcca

SEQ ID NO: 21485 - DNA, 20 bp, Artificial Sequence
  chemically synthesized
cagtaagggttaattccaga

SEQ ID NO: 21486 - DNA, 20 bp, Artificial Sequence
  chemically synthesized
agtaagggttaattccagag

SEQ ID NO: 21487 - DNA, 20 bp, Artificial Sequence
  chemically synthesized
agggttaattccagagaggc

SEQ ID NO: 21488 - DNA, 20 bp, Artificial Sequence
  chemically synthesized
cgtgccaactccagcctctc

SEQ ID NO: 21489 - DNA, 20 bp, Artificial Sequence
  chemically synthesized
ggttaattccagagaggctg

SEQ ID NO: 21490 - DNA, 20 bp, Artificial Sequence
  chemically synthesized
aattccagagaggctggagt

SEQ ID NO: 21491 - DNA, 20 bp, Artificial Sequence
  chemically synthesized
aagtcatctcgtgccaactc

SEQ ID NO: 21492 - DNA, 20 bp, Artificial Sequence
  chemically synthesized
agagaggctggagttggcac

SEQ ID NO: 21493 - DNA, 20 bp, Artificial Sequence
  chemically synthesized
cactgtgtagatattttagc

SEQ ID NO: 21494 - DNA, 20 bp, Artificial Sequence
  chemically synthesized
tctgcactgtgtagatattt

SEQ ID NO: 21495 - DNA, 20 bp, Artificial Sequence
  chemically synthesized
gacttgctaaaatatctaca

SEQ ID NO: 21496 - DNA, 20 bp, Artificial Sequence
  chemically synthesized
gctaaaatatctacacagtg

SEQ ID NO: 21497 - DNA, 20 bp, Artificial Sequence
  chemically synthesized
gaccagggctctgcactgtg

SEQ ID NO: 21498 - DNA, 20 bp, Artificial Sequence
  chemically synthesized
taaaatatctacacagtgca

SEQ ID NO: 21499 - DNA, 20 bp, Artificial Sequence
  chemically synthesized
atctacacagtgcagagccc

SEQ ID NO: 21500 - DNA, 20 bp, Artificial Sequence
  chemically synthesized
acagtgcagagccctggtca

SEQ ID NO: 21501 - DNA, 20 bp, Artificial Sequence
  chemically synthesized
aaaagcaagtgctttgacca

SEQ ID NO: 21502 - DNA, 20 bp, Artificial Sequence
  chemically synthesized
gaaaagcaagtgctttgacc

SEQ ID NO: 21503 - DNA, 20 bp, Artificial Sequence
  chemically synthesized
tgaaaagcaagtgctttgac

SEQ ID NO: 21504 - DNA, 20 bp, Artificial Sequence
  chemically synthesized
agtaagtcactttgaaaagc

SEQ ID NO: 21505 - DNA, 20 bp, Artificial Sequence
  chemically synthesized
gtcaaagcacttgcttttca

SEQ ID NO: 21506 - DNA, 20 bp, Artificial Sequence
  chemically synthesized
acacagtaagtcactttgaa

SEQ ID NO: 21507 - DNA, 20 bp, Artificial Sequence
  chemically synthesized
tggctacacttcaacacagt

SEQ ID NO: 21508 - DNA, 20 bp, Artificial Sequence
  chemically synthesized
caaagtgacttactgtgttg

SEQ ID NO: 21509 - DNA, 20 bp, Artificial Sequence
  chemically synthesized
cccatggctacacttcaaca

SEQ ID NO: 21510 - DNA, 20 bp, Artificial Sequence
  chemically synthesized
tgacttactgtgttgaagtg

SEQ ID NO: 21511 - DNA, 20 bp, Artificial Sequence
  chemically synthesized
actgtgttgaagtgtagcca

SEQ ID NO: 21512 - DNA, 20 bp, Artificial Sequence
  chemically synthesized
ctgtgttgaagtgtagccat

SEQ ID NO: 21513 - DNA, 20 bp, Artificial Sequence
  chemically synthesized
tgaagtgtagccatgggttg

SEQ ID NO: 21514 - DNA, 20 bp, Artificial Sequence
  chemically synthesized
tggtgataacctgcaaccca

SEQ ID NO: 21515 - DNA, 20 bp, Artificial Sequence
  chemically synthesized
gaagtgtagccatgggttgc

SEQ ID NO: 21516 - DNA, 20 bp, Artificial Sequence
  chemically synthesized
ttactgttagcaataaacaa

SEQ ID NO: 21517 - DNA, 20 bp, Artificial Sequence
  chemically synthesized
tcaccattgtttattgctaa

SEQ ID NO: 21518 - DNA, 20 bp, Artificial Sequence
  chemically synthesized
aaaatggtcaatgttactgt

SEQ ID NO: 21519 - DNA, 20 bp, Artificial Sequence
  chemically synthesized
tgactgtgcccgggtaaaaa

SEQ ID NO: 21520 - DNA, 20 bp, Artificial Sequence
  chemically synthesized
taacattgaccatttttacc

SEQ ID NO: 21521 - DNA, 20 bp, Artificial Sequence
  chemically synthesized
aacattgaccatttttaccc

SEQ ID NO: 21522 - DNA, 20 bp, Artificial Sequence
  chemically synthesized
tgaccatttttacccgggca

SEQ ID NO: 21523 - DNA, 20 bp, Artificial Sequence
  chemically synthesized
ccgttggtctgactgtgccc

SEQ ID NO: 21524 - DNA, 20 bp, Artificial Sequence
  chemically synthesized
tccgttggtctgactgtgcc

SEQ ID NO: 21525 - DNA, 20 bp, Artificial Sequence
  chemically synthesized
catttttacccgggcacagt

SEQ ID NO: 21526 - DNA, 20 bp, Artificial Sequence
  chemically synthesized
cccgggcacagtcagaccaa

SEQ ID NO: 21527 - DNA, 20 bp, Artificial Sequence
  chemically synthesized
gggcacagtcagaccaacgg

SEQ ID NO: 21528 - DNA, 20 bp, Artificial Sequence
  chemically synthesized
tcaaactcagtggcttccgt

SEQ ID NO: 21529 - DNA, 20 bp, Artificial Sequence
  chemically synthesized
tcagaccaacggaagccact

SEQ ID NO: 21530 - DNA, 20 bp, Artificial Sequence
  chemically synthesized
gtaaccagcctcaaactcag

SEQ ID NO: 21531 - DNA, 20 bp, Artificial Sequence
  chemically synthesized
caacggaagccactgagttt

SEQ ID NO: 21532 - DNA, 20 bp, Artificial Sequence
  chemically synthesized
aacggaagccactgagtttg

SEQ ID NO: 21533 - DNA, 20 bp, Artificial Sequence
  chemically synthesized
tatgtaaccagcctcaaact

SEQ ID NO: 21534 - DNA, 20 bp, Artificial Sequence
  chemically synthesized
gaagccactgagtttgaggc

SEQ ID NO: 21535 - DNA, 20 bp, Artificial Sequence
  chemically synthesized
tgagtttgaggctggttaca

SEQ ID NO: 21536 - DNA, 20 bp, Artificial Sequence
  chemically synthesized
gagtttgaggctggttacat

SEQ ID NO: 21537 - DNA, 20 bp, Artificial Sequence
  chemically synthesized
gcatactgttcctatgtaac

SEQ ID NO: 21538 - DNA, 20 bp, Artificial Sequence
  chemically synthesized
tgaggctggttacataggaa

SEQ ID NO: 21539 - DNA, 20 bp, Artificial Sequence
  chemically synthesized
ttacataggaacagtatgcc

SEQ ID NO: 21540 - DNA, 20 bp, Artificial Sequence
  chemically synthesized
tacataggaacagtatgcct

SEQ ID NO: 21541 - DNA, 20 bp, Artificial Sequence
  chemically synthesized
ttatatcccgtgggtaacct

SEQ ID NO: 21542 - DNA, 20 bp, Artificial Sequence
  chemically synthesized
cttatatcccgtgggtaacc

SEQ ID NO: 21543 - DNA, 20 bp, Artificial Sequence
  chemically synthesized
cagtatgcctaggttaccca

SEQ ID NO: 21544 - DNA, 20 bp, Artificial Sequence
  chemically synthesized
agtatgcctaggttacccac

SEQ ID NO: 21545 - DNA, 20 bp, Artificial Sequence
  chemically synthesized
cagggtttcttatatcccgt

SEQ ID NO: 21546 - DNA, 20 bp, Artificial Sequence
  chemically synthesized
ccagggtttcttatatcccg

SEQ ID NO: 21547 - DNA, 20 bp, Artificial Sequence
  chemically synthesized
ctaggttacccacgggatat

SEQ ID NO: 21548 - DNA, 20 bp, Artificial Sequence
  chemically synthesized
ccacgggatataagaaaccc

SEQ ID NO: 21549 - DNA, 20 bp, Artificial Sequence
  chemically synthesized
acaaattggagtttcagcca

SEQ ID NO: 21550 - DNA, 20 bp, Artificial Sequence
  chemically synthesized
cacaaattggagtttcagcc

SEQ ID NO: 21551 - DNA, 20 bp, Artificial Sequence
  chemically synthesized
gcacaaattggagtttcagc

SEQ ID NO: 21552 - DNA, 20 bp, Artificial Sequence
  chemically synthesized
gggagcacaaattggagttt

SEQ ID NO: 21553 - DNA, 20 bp, Artificial Sequence
  chemically synthesized
aaaccagggagcacaaattg

SEQ ID NO: 21554 - DNA, 20 bp, Artificial Sequence
  chemically synthesized
ggaaaccagggagcacaaat

SEQ ID NO: 21555 - DNA, 20 bp, Artificial Sequence
  chemically synthesized
aaactccaatttgtgctccc

SEQ ID NO: 21556 - DNA, 20 bp, Artificial Sequence
  chemically synthesized
agaacaccttggaaaccagg

SEQ ID NO: 21557 - DNA, 20 bp, Artificial Sequence
  chemically synthesized
acagaacaccttggaaacca

SEQ ID NO: 21558 - DNA, 20 bp, Artificial Sequence
  chemically synthesized
atttgtgctccctggtttcc

SEQ ID NO: 21559 - DNA, 20 bp, Artificial Sequence
  chemically synthesized
cacagaacaccttggaaacc

SEQ ID NO: 21560 - DNA, 20 bp, Artificial Sequence
  chemically synthesized
tttgtgctccctggtttcca

SEQ ID NO: 21561 - DNA, 20 bp, Artificial Sequence
  chemically synthesized
gcacagaacaccttggaaac

SEQ ID NO: 21562 - DNA, 20 bp, Artificial Sequence
  chemically synthesized
gatgtgagcacagaacacct

SEQ ID NO: 21563 - DNA, 20 bp, Artificial Sequence
  chemically synthesized
aagagctactgatgtgagca

SEQ ID NO: 21564 - DNA, 20 bp, Artificial Sequence
  chemically synthesized
aaggtgttctgtgctcacat

SEQ ID NO: 21565 - DNA, 20 bp, Artificial Sequence
  chemically synthesized
gtgttctgtgctcacatcag

SEQ ID NO: 21566 - DNA, 20 bp, Artificial Sequence
  chemically synthesized
ggaacaagagctactgatgt

SEQ ID NO: 21567 - DNA, 20 bp, Artificial Sequence
  chemically synthesized
acatcagtagctcttgttcc

SEQ ID NO: 21568 - DNA, 20 bp, Artificial Sequence
  chemically synthesized
cattttctctcttggaacaa

SEQ ID NO: 21569 - DNA, 20 bp, Artificial Sequence
  chemically synthesized
atcagtagctcttgttccaa

SEQ ID NO: 21570 - DNA, 20 bp, Artificial Sequence
  chemically synthesized
tgcattttctctcttggaac

SEQ ID NO: 21571 - DNA, 20 bp, Artificial Sequence
  chemically synthesized
cagtagctcttgttccaaga

SEQ ID NO: 21572 - DNA, 20 bp, Artificial Sequence
  chemically synthesized
ccacgatgcattttctctct

SEQ ID NO: 21573 - DNA, 20 bp, Artificial Sequence
  chemically synthesized
ccaagagagaaaatgcatcg

SEQ ID NO: 21574 - DNA, 20 bp, Artificial Sequence
  chemically synthesized
agagaaaatgcatcgtggtg

SEQ ID NO: 21575 - DNA, 20 bp, Artificial Sequence
  chemically synthesized
gcatcgtggtgtggctcttg

SEQ ID NO: 21576 - DNA, 20 bp, Artificial Sequence
  chemically synthesized
cgtggtgtggctcttgcaga

SEQ ID NO: 21577 - DNA, 20 bp, Artificial Sequence
  chemically synthesized
taattgccctctgtctgcaa

SEQ ID NO: 21578 - DNA, 20 bp, Artificial Sequence
  chemically synthesized
tggtgtggctcttgcagaca

SEQ ID NO: 21579 - DNA, 20 bp, Artificial Sequence
  chemically synthesized
tataattgccctctgtctgc

SEQ ID NO: 21580 - DNA, 20 bp, Artificial Sequence
  chemically synthesized
ggtgtggctcttgcagacag

SEQ ID NO: 21581 - DNA, 20 bp, Artificial Sequence
  chemically synthesized
gtgtggctcttgcagacaga

SEQ ID NO: 21582 - DNA, 20 bp, Artificial Sequence
  chemically synthesized
ttgcagacagagggcaatta

SEQ ID NO: 21583 - DNA, 20 bp, Artificial Sequence
  chemically synthesized
ggtccagagaggacaggtgc

SEQ ID NO: 21584 - DNA, 20 bp, Artificial Sequence
  chemically synthesized
gcatagggtccagagaggac

SEQ ID NO: 21585 - DNA, 20 bp, Artificial Sequence
  chemically synthesized
tagcttgcacctgtcctctc

SEQ ID NO: 21586 - DNA, 20 bp, Artificial Sequence
  chemically synthesized
agcatagggtccagagagga

SEQ ID NO: 21587 - DNA, 20 bp, Artificial Sequence
  chemically synthesized
tcacagcatagggtccagag

SEQ ID NO: 21588 - DNA, 20 bp, Artificial Sequence
  chemically synthesized
ctcacagcatagggtccaga

SEQ ID NO: 21589 - DNA, 20 bp, Artificial Sequence
  chemically synthesized
gcctcacagcatagggtcca

SEQ ID NO: 21590 - DNA, 20 bp, Artificial Sequence
  chemically synthesized
ctgcctcacagcatagggtc

SEQ ID NO: 21591 - DNA, 20 bp, Artificial Sequence
  chemically synthesized
acagcctgcctcacagcata

SEQ ID NO: 21592 - DNA, 20 bp, Artificial Sequence
  chemically synthesized
ctctctggaccctatgctgt

SEQ ID NO: 21593 - DNA, 20 bp, Artificial Sequence
  chemically synthesized
cacagcctgcctcacagcat

SEQ ID NO: 21594 - DNA, 20 bp, Artificial Sequence
  chemically synthesized
tctctggaccctatgctgtg

SEQ ID NO: 21595 - DNA, 20 bp, Artificial Sequence
  chemically synthesized
ccacagcctgcctcacagca

SEQ ID NO: 21596 - DNA, 20 bp, Artificial Sequence
  chemically synthesized
ctggaccctatgctgtgagg

SEQ ID NO: 21597 - DNA, 20 bp, Artificial Sequence
  chemically synthesized
tggaccctatgctgtgaggc

SEQ ID NO: 21598 - DNA, 20 bp, Artificial Sequence
  chemically synthesized
cacagccacagcctgcctca

SEQ ID NO: 21599 - DNA, 20 bp, Artificial Sequence
  chemically synthesized
ctatgctgtgaggcaggctg

SEQ ID NO: 21600 - DNA, 20 bp, Artificial Sequence
  chemically synthesized
aagaataagtgtcacagcca

SEQ ID NO: 21601 - DNA, 20 bp, Artificial Sequence
  chemically synthesized
taaaacaagaataagtgtca

SEQ ID NO: 21602 - DNA, 20 bp, Artificial Sequence
  chemically synthesized
cacaacattaaaacaagaat

SEQ ID NO: 21603 - DNA, 20 bp, Artificial Sequence
  chemically synthesized
tatacccacaacattaaaac

SEQ ID NO: 21604 - DNA, 20 bp, Artificial Sequence
  chemically synthesized
ttattcttgttttaatgttg

SEQ ID NO: 21605 - DNA, 20 bp, Artificial Sequence
  chemically synthesized
tattcttgttttaatgttgt

SEQ ID NO: 21606 - DNA, 20 bp, Artificial Sequence
  chemically synthesized
ctagagttccttgcagaaaa

SEQ ID NO: 21607 - DNA, 20 bp, Artificial Sequence
  chemically synthesized
atattgcatcctttttctgc

SEQ ID NO: 21608 - DNA, 20 bp, Artificial Sequence
  chemically synthesized
tctagagttccttgcagaaa

SEQ ID NO: 21609 - DNA, 20 bp, Artificial Sequence
  chemically synthesized
tattgcatcctttttctgca

SEQ ID NO: 21610 - DNA, 20 bp, Artificial Sequence
  chemically synthesized
tacgaatctagagttccttg

SEQ ID NO: 21611 - DNA, 20 bp, Artificial Sequence
  chemically synthesized
cctttttctgcaaggaactc

SEQ ID NO: 21612 - DNA, 20 bp, Artificial Sequence
  chemically synthesized
tgacagtgcttacgaatcta

SEQ ID NO: 21613 - DNA, 20 bp, Artificial Sequence
  chemically synthesized
gcaaggaactctagattcgt

SEQ ID NO: 21614 - DNA, 20 bp, Artificial Sequence
  chemically synthesized
aatgacagtgcttacgaatc

SEQ ID NO: 21615 - DNA, 20 bp, Artificial Sequence
  chemically synthesized
gattcgtaagcactgtcatt

SEQ ID NO: 21616 - DNA, 20 bp, Artificial Sequence
  chemically synthesized
gactcacaggaaccaaatga

SEQ ID NO: 21617 - DNA, 20 bp, Artificial Sequence
  chemically synthesized
cactgtcatttggttcctgt

SEQ ID NO: 21618 - DNA, 20 bp, Artificial Sequence
  chemically synthesized
aattgctaaagaggactcac

SEQ ID NO: 21619 - DNA, 20 bp, Artificial Sequence
  chemically synthesized
caattgctaaagaggactca

SEQ ID NO: 21620 - DNA, 20 bp, Artificial Sequence
  chemically synthesized
tggttcctgtgagtcctctt

SEQ ID NO: 21621 - DNA, 20 bp, Artificial Sequence
  chemically synthesized
acagggttcaattgctaaag

SEQ ID NO: 21622 - DNA, 20 bp, Artificial Sequence
  chemically synthesized
aacagggttcaattgctaaa

SEQ ID NO: 21623 - DNA, 20 bp, Artificial Sequence
  chemically synthesized
taaacagggttcaattgcta

SEQ ID NO: 21624 - DNA, 20 bp, Artificial Sequence
  chemically synthesized
ctgacagtggaagttaaaca

SEQ ID NO: 21625 - DNA, 20 bp, Artificial Sequence
  chemically synthesized
cctgacagtggaagttaaac

SEQ ID NO: 21626 - DNA, 20 bp, Artificial Sequence
  chemically synthesized
ccctgacagtggaagttaaa

SEQ ID NO: 21627 - DNA, 20 bp, Artificial Sequence
  chemically synthesized
ccctgtttaacttccactgt

SEQ ID NO: 21628 - DNA, 20 bp, Artificial Sequence
  chemically synthesized
actcactgccctgacagtgg

SEQ ID NO: 21629 - DNA, 20 bp, Artificial Sequence
  chemically synthesized
cctgtttaacttccactgtc

SEQ ID NO: 21630 - DNA, 20 bp, Artificial Sequence
  chemically synthesized
ctgtttaacttccactgtca

SEQ ID NO: 21631 - DNA, 20 bp, Artificial Sequence
  chemically synthesized
gacactcactgccctgacag

SEQ ID NO: 21632 - DNA, 20 bp, Artificial Sequence
  chemically synthesized
tttaacttccactgtcaggg

SEQ ID NO: 21633 - DNA, 20 bp, Artificial Sequence
  chemically synthesized
tctgacactcactgccctga

SEQ ID NO: 21634 - DNA, 20 bp, Artificial Sequence
  chemically synthesized
acttccactgtcagggcagt

SEQ ID NO: 21635 - DNA, 20 bp, Artificial Sequence
  chemically synthesized
actgtcagggcagtgagtgt

SEQ ID NO: 21636 - DNA, 20 bp, Artificial Sequence
  chemically synthesized
gtcagggcagtgagtgtcag

SEQ ID NO: 21637 - DNA, 20 bp, Artificial Sequence
  chemically synthesized
gggcagtgagtgtcagaagc

SEQ ID NO: 21638 - DNA, 20 bp, Artificial Sequence
  chemically synthesized
gtgtcagaagcaagattgtt

SEQ ID NO: 21639 - DNA, 20 bp, Artificial Sequence
  chemically synthesized
tttagctaagaatgagttgg

SEQ ID NO: 21640 - DNA, 20 bp, Artificial Sequence
  chemically synthesized
ttttagctaagaatgagttg

SEQ ID NO: 21641 - DNA, 20 bp, Artificial Sequence
  chemically synthesized
acttttagctaagaatgagt

SEQ ID NO: 21642 - DNA, 20 bp, Artificial Sequence
  chemically synthesized
gaacacctccaactcattct

SEQ ID NO: 21643 - DNA, 20 bp, Artificial Sequence
  chemically synthesized
tcatacttttagctaagaat

SEQ ID NO: 21644 - DNA, 20 bp, Artificial Sequence
  chemically synthesized
tccaactcattcttagctaa

SEQ ID NO: 21645 - DNA, 20 bp, Artificial Sequence
  chemically synthesized
cctcagtcatacttttagct

SEQ ID NO: 21646 - DNA, 20 bp, Artificial Sequence
  chemically synthesized
taatgcctcagtcatacttt

SEQ ID NO: 21647 - DNA, 20 bp, Artificial Sequence
  chemically synthesized
tcttagctaaaagtatgact

SEQ ID NO: 21648 - DNA, 20 bp, Artificial Sequence
  chemically synthesized
cttagctaaaagtatgactg

SEQ ID NO: 21649 - DNA, 20 bp, Artificial Sequence
  chemically synthesized
tttctttctaaataatgcct

SEQ ID NO: 21650 - DNA, 20 bp, Artificial Sequence
  chemically synthesized
agtatgactgaggcattatt

SEQ ID NO: 21651 - DNA, 20 bp, Artificial Sequence
  chemically synthesized
tgactgaggcattatttaga

SEQ ID NO: 21652 - DNA, 20 bp, Artificial Sequence
  chemically synthesized
gcattatttagaaagaaaaa

SEQ ID NO: 21653 - DNA, 20 bp, Artificial Sequence
  chemically synthesized
ttatttagaaagaaaaaaag

SEQ ID NO: 21654 - DNA, 20 bp, Artificial Sequence
  chemically synthesized
aaaaaagaagattctgataa

SEQ ID NO: 21655 - DNA, 20 bp, Artificial Sequence
  chemically synthesized
aaaaagaagattctgataaa

SEQ ID NO: 21656 - DNA, 20 bp, Artificial Sequence
  chemically synthesized
aaaagaagattctgataaaa

SEQ ID NO: 21657 - DNA, 20 bp, Artificial Sequence
  chemically synthesized
ttctttttcatcccttttat

SEQ ID NO: 21658 - DNA, 20 bp, Artificial Sequence
  chemically synthesized
ttctgataaaagggatgaaa

SEQ ID NO: 21659 - DNA, 20 bp, Artificial Sequence
  chemically synthesized
gggatgaaaaagaacctttg

SEQ ID NO: 21660 - DNA, 20 bp, Artificial Sequence
  chemically synthesized
agcttgttgagcaacttcaa

SEQ ID NO: 21661 - DNA, 20 bp, Artificial Sequence
  chemically synthesized
tagcttgttgagcaacttca

SEQ ID NO: 21662 - DNA, 20 bp, Artificial Sequence
  chemically synthesized
aacctttgaagttgctcaac

SEQ ID NO: 21663 - DNA, 20 bp, Artificial Sequence
  chemically synthesized
tcaaccaagcgtagcttgtt

SEQ ID NO: 21664 - DNA, 20 bp, Artificial Sequence
  chemically synthesized
gttgctcaacaagctacgct

SEQ ID NO: 21665 - DNA, 20 bp, Artificial Sequence
  chemically synthesized
tgttacttttcaaccaagcg

SEQ ID NO: 21666 - DNA, 20 bp, Artificial Sequence
  chemically synthesized
acaagctacgcttggttgaa

SEQ ID NO: 21667 - DNA, 20 bp, Artificial Sequence
  chemically synthesized
gcctgtgttacttttcaacc

SEQ ID NO: 21668 - DNA, 20 bp, Artificial Sequence
  chemically synthesized
cgcttggttgaaaagtaaca

SEQ ID NO: 21669 - DNA, 20 bp, Artificial Sequence
  chemically synthesized
gcttggttgaaaagtaacac

SEQ ID NO: 21670 - DNA, 20 bp, Artificial Sequence
  chemically synthesized
agtaacacaggctttgaaat

SEQ ID NO: 21671 - DNA, 20 bp, Artificial Sequence
  chemically synthesized
accatcagtaaccaatttca

SEQ ID NO: 21672 - DNA, 20 bp, Artificial Sequence
  chemically synthesized
gctttgaaattggttactga

SEQ ID NO: 21673 - DNA, 20 bp, Artificial Sequence
  chemically synthesized
ccactagaaagttacaccat

SEQ ID NO: 21674 - DNA, 20 bp, Artificial Sequence
  chemically synthesized
ttactgatggtgtaactttc

SEQ ID NO: 21675 - DNA, 20 bp, Artificial Sequence
  chemically synthesized
ctgatggtgtaactttctag

SEQ ID NO: 21676 - DNA, 20 bp, Artificial Sequence
  chemically synthesized
cacttccagattccactaga

SEQ ID NO: 21677 - DNA, 20 bp, Artificial Sequence
  chemically synthesized
ctctcacttccagattccac

SEQ ID NO: 21678 - DNA, 20 bp, Artificial Sequence
  chemically synthesized
tgtaactttctagtggaatc

SEQ ID NO: 21679 - DNA, 20 bp, Artificial Sequence
  chemically synthesized
aactttctagtggaatctgg

SEQ ID NO: 21680 - DNA, 20 bp, Artificial Sequence
  chemically synthesized
ttctagtggaatctggaagt

SEQ ID NO: 21681 - DNA, 20 bp, Artificial Sequence
  chemically synthesized
ctagtggaatctggaagtga

SEQ ID NO: 21682 - DNA, 20 bp, Artificial Sequence
  chemically synthesized
ggttcaagttctctcacttc

SEQ ID NO: 21683 - DNA, 20 bp, Artificial Sequence
  chemically synthesized
aagtgagagaacttgaacct

SEQ ID NO: 21684 - DNA, 20 bp, Artificial Sequence
  chemically synthesized
agtgagagaacttgaaccta

SEQ ID NO: 21685 - DNA, 20 bp, Artificial Sequence
  chemically synthesized
tttgttagctccttaggttc

SEQ ID NO: 21686 - DNA, 20 bp, Artificial Sequence
  chemically synthesized
tgagagaacttgaacctaag

SEQ ID NO: 21687 - DNA, 20 bp, Artificial Sequence
  chemically synthesized
atccattttgttagctcctt

SEQ ID NO: 21688 - DNA, 20 bp, Artificial Sequence
  chemically synthesized
aatccattttgttagctcct

SEQ ID NO: 21689 - DNA, 20 bp, Artificial Sequence
  chemically synthesized
aacctaaggagctaacaaaa

SEQ ID NO: 21690 - DNA, 20 bp, Artificial Sequence
  chemically synthesized
tgcctcctaatccattttgt

SEQ ID NO: 21691 - DNA, 20 bp, Artificial Sequence
  chemically synthesized
aaggagctaacaaaatggat

SEQ ID NO: 21692 - DNA, 20 bp, Artificial Sequence
  chemically synthesized
aggagctaacaaaatggatt

SEQ ID NO: 21693 - DNA, 20 bp, Artificial Sequence
  chemically synthesized
gagctaacaaaatggattag

SEQ ID NO: 21694 - DNA, 20 bp, Artificial Sequence
  chemically synthesized
agctaacaaaatggattagg

SEQ ID NO: 21695 - DNA, 20 bp, Artificial Sequence
  chemically synthesized
aggaggcaattgcaaactga

SEQ ID NO: 21696 - DNA, 20 bp, Artificial Sequence
  chemically synthesized
ggcaattgcaaactgatggc

SEQ ID NO: 21697 - DNA, 20 bp, Artificial Sequence
  chemically synthesized
gcaattgcaaactgatggca

SEQ ID NO: 21698 - DNA, 20 bp, Artificial Sequence
  chemically synthesized
ttttttagcagccttgccat

SEQ ID NO: 21699 - DNA, 20 bp, Artificial Sequence
  chemically synthesized
gcttttggatttttttttag

SEQ ID NO: 21700 - DNA, 20 bp, Artificial Sequence
  chemically synthesized
ttagcttttggatttttttt

SEQ ID NO: 21701 - DNA, 20 bp, Artificial Sequence
  chemically synthesized
gctgctaaaaaaaaatccaa

SEQ ID NO: 21702 - DNA, 20 bp, Artificial Sequence
  chemically synthesized
ctgaacttaacattagcttt

SEQ ID NO: 21703 - DNA, 20 bp, Artificial Sequence
  chemically synthesized
aaaatccaaaagctaatgtt

SEQ ID NO: 21704 - DNA, 20 bp, Artificial Sequence
  chemically synthesized
agaaattctgaacttaacat

SEQ ID NO: 21705 - DNA, 20 bp, Artificial Sequence
  chemically synthesized
ccaaaagctaatgttaagtt

SEQ ID NO: 21706 - DNA, 20 bp, Artificial Sequence
  chemically synthesized
agttcagaatttctttccac

SEQ ID NO: 21707 - DNA, 20 bp, Artificial Sequence
  chemically synthesized
gttcagaatttctttccact

SEQ ID NO: 21708 - DNA, 20 bp, Artificial Sequence
  chemically synthesized
agagggtgaagcccagtgga

SEQ ID NO: 21709 - DNA, 20 bp, Artificial Sequence
  chemically synthesized
ccagagagggtgaagcccag

SEQ ID NO: 21710 - DNA, 20 bp, Artificial Sequence
  chemically synthesized
aggccagagagggtgaagcc

SEQ ID NO: 21711 - DNA, 20 bp, Artificial Sequence
  chemically synthesized
cctgcaggccagagagggtg

SEQ ID NO: 21712 - DNA, 20 bp, Artificial Sequence
  chemically synthesized
ccactgggcttcaccctctc

SEQ ID NO: 21713 - DNA, 20 bp, Artificial Sequence
  chemically synthesized
ctccacctgcaggccagaga

SEQ ID NO: 21714 - DNA, 20 bp, Artificial Sequence
  chemically synthesized
actccacctgcaggccagag

SEQ ID NO: 21715 - DNA, 20 bp, Artificial Sequence
  chemically synthesized
gactccacctgcaggccaga

SEQ ID NO: 21716 - DNA, 20 bp, Artificial Sequence
  chemically synthesized
gcttcaccctctctggcctg

SEQ ID NO: 21717 - DNA, 20 bp, Artificial Sequence
  chemically synthesized
gggactccacctgcaggcca

SEQ ID NO: 21718 - DNA, 20 bp, Artificial Sequence
  chemically synthesized
cttcaccctctctggcctgc

SEQ ID NO: 21719 - DNA, 20 bp, Artificial Sequence
  chemically synthesized
ttgggactccacctgcaggc

SEQ ID NO: 21720 - DNA, 20 bp, Artificial Sequence
  chemically synthesized
caccctctctggcctgcagg

SEQ ID NO: 21721 - DNA, 20 bp, Artificial Sequence
  chemically synthesized
ccctctctggcctgcaggtg

SEQ ID NO: 21722 - DNA, 20 bp, Artificial Sequence
  chemically synthesized
ttggttgggactccacctgc

SEQ ID NO: 21723 - DNA, 20 bp, Artificial Sequence
  chemically synthesized
tttggttgggactccacctg

SEQ ID NO: 21724 - DNA, 20 bp, Artificial Sequence
  chemically synthesized
caggtggagtcccaaccaaa

SEQ ID NO: 21725 - DNA, 20 bp, Artificial Sequence
  chemically synthesized
gttgcttcagctttttggtt

SEQ ID NO: 21726 - DNA, 20 bp, Artificial Sequence
  chemically synthesized
agttgcttcagctttttggt

SEQ ID NO: 21727 - DNA, 20 bp, Artificial Sequence
  chemically synthesized
tgatagttgcttcagctttt

SEQ ID NO: 21728 - DNA, 20 bp, Artificial Sequence
  chemically synthesized
gagtcccaaccaaaaagctg

SEQ ID NO: 21729 - DNA, 20 bp, Artificial Sequence
  chemically synthesized
ctcaaaaatgatagttgctt

SEQ ID NO: 21730 - DNA, 20 bp, Artificial Sequence
  chemically synthesized
agcccatttctcaaaaatga

SEQ ID NO: 21731 - DNA, 20 bp, Artificial Sequence
  chemically synthesized
ctgaagcaactatcattttt

SEQ ID NO: 21732 - DNA, 20 bp, Artificial Sequence
  chemically synthesized
caactatcatttttgagaaa

SEQ ID NO: 21733 - DNA, 20 bp, Artificial Sequence
  chemically synthesized
aactatcatttttgagaaat

SEQ ID NO: 21734 - DNA, 20 bp, Artificial Sequence
  chemically synthesized
gagaaatgggctacacctgt

SEQ ID NO: 21735 - DNA, 20 bp, Artificial Sequence
  chemically synthesized
tgtaactggtctcacaggtg

SEQ ID NO: 21736 - DNA, 20 bp, Artificial Sequence
  chemically synthesized
atgggctacacctgtgagac

SEQ ID NO: 21737 - DNA, 20 bp, Artificial Sequence
  chemically synthesized
ttaattgtaactggtctcac

SEQ ID NO: 21738 - DNA, 20 bp, Artificial Sequence
  chemically synthesized
tttaattgtaactggtctca

SEQ ID NO: 21739 - DNA, 20 bp, Artificial Sequence
  chemically synthesized
attatctttttaattgtaac

SEQ ID NO: 21740 - DNA, 20 bp, Artificial Sequence
  chemically synthesized
tgagaccagttacaattaaa

SEQ ID NO: 21741 - DNA, 20 bp, Artificial Sequence
  chemically synthesized
tacaattaaaaagataattc

SEQ ID NO: 21742 - DNA, 20 bp, Artificial Sequence
  chemically synthesized
aattaaaaagataattcaag

SEQ ID NO: 21743 - DNA, 20 bp, Artificial Sequence
  chemically synthesized
attaaaaagataattcaagt

SEQ ID NO: 21744 - DNA, 20 bp, Artificial Sequence
  chemically synthesized
ttaaaaagataattcaagtg

SEQ ID NO: 21745 - DNA, 20 bp, Artificial Sequence
  chemically synthesized
taattcaagtggggcactta

SEQ ID NO: 21746 - DNA, 20 bp, Artificial Sequence
  chemically synthesized
aattcaagtggggcacttac

SEQ ID NO: 21747 - DNA, 20 bp, Artificial Sequence
  chemically synthesized
gtgacatagggaatacctgt

SEQ ID NO: 21748 - DNA, 20 bp, Artificial Sequence
  chemically synthesized
aagaaacctgtagtgacata

SEQ ID NO: 21749 - DNA, 20 bp, Artificial Sequence
  chemically synthesized
aaagaaacctgtagtgacat

SEQ ID NO: 21750 - DNA, 20 bp, Artificial Sequence
  chemically synthesized
aaaagaaacctgtagtgaca

SEQ ID NO: 21751 - DNA, 20 bp, Artificial Sequence
  chemically synthesized
aggtattccctatgtcacta

SEQ ID NO: 21752 - DNA, 20 bp, Artificial Sequence
  chemically synthesized
ggtattccctatgtcactac

SEQ ID NO: 21753 - DNA, 20 bp, Artificial Sequence
  chemically synthesized
ggcatcaaaaaagaaacctg

SEQ ID NO: 21754 - DNA, 20 bp, Artificial Sequence
  chemically synthesized
tactaggtctggcatcaaaa

SEQ ID NO: 21755 - DNA, 20 bp, Artificial Sequence
  chemically synthesized
acaggtttcttttttgatgc

SEQ ID NO: 21756 - DNA, 20 bp, Artificial Sequence
  chemically synthesized
ttcttttttgatgccagacc

SEQ ID NO: 21757 - DNA, 20 bp, Artificial Sequence
  chemically synthesized
ttttttgatgccagacctag

SEQ ID NO: 21758 - DNA, 20 bp, Artificial Sequence
  chemically synthesized
agttcagggactactaggtc

SEQ ID NO: 21759 - DNA, 20 bp, Artificial Sequence
  chemically synthesized
gccccagttcagggactact

SEQ ID NO: 21760 - DNA, 20 bp, Artificial Sequence
  chemically synthesized
agccccagttcagggactac

SEQ ID NO: 21761 - DNA, 20 bp, Artificial Sequence
  chemically synthesized
agacctagtagtccctgaac

SEQ ID NO: 21762 - DNA, 20 bp, Artificial Sequence
  chemically synthesized
gacctagtagtccctgaact

SEQ ID NO: 21763 - DNA, 20 bp, Artificial Sequence
  chemically synthesized
acctagtagtccctgaactg

SEQ ID NO: 21764 - DNA, 20 bp, Artificial Sequence
  chemically synthesized
ttaattgtagccccagttca

SEQ ID NO: 21765 - DNA, 20 bp, Artificial Sequence
  chemically synthesized
cttaattgtagccccagttc

SEQ ID NO: 21766 - DNA, 20 bp, Artificial Sequence
  chemically synthesized
tcttaattgtagccccagtt

SEQ ID NO: 21767 - DNA, 20 bp, Artificial Sequence
  chemically synthesized
gaaactcttaattgtagccc

SEQ ID NO: 21768 - DNA, 20 bp, Artificial Sequence
  chemically synthesized
cctgaactggggctacaatt

SEQ ID NO: 21769 - DNA, 20 bp, Artificial Sequence
  chemically synthesized
tgaactggggctacaattaa

SEQ ID NO: 21770 - DNA, 20 bp, Artificial Sequence
  chemically synthesized
gcctttgaaactcttaattg

SEQ ID NO: 21771 - DNA, 20 bp, Artificial Sequence
  chemically synthesized
ggctacaattaagagtttca

SEQ ID NO: 21772 - DNA, 20 bp, Artificial Sequence
  chemically synthesized
gctacaattaagagtttcaa

SEQ ID NO: 21773 - DNA, 20 bp, Artificial Sequence
  chemically synthesized
caattaagagtttcaaaggc

SEQ ID NO: 21774 - DNA, 20 bp, Artificial Sequence
  chemically synthesized
atcttattttggaatattac

SEQ ID NO: 21775 - DNA, 20 bp, Artificial Sequence
  chemically synthesized
ggctggtaatattccaaaat

SEQ ID NO: 21776 - DNA, 20 bp, Artificial Sequence
  chemically synthesized
atagccatagtatcttattt

SEQ ID NO: 21777 - DNA, 20 bp, Artificial Sequence
  chemically synthesized
tattccaaaataagatacta

SEQ ID NO: 21778 - DNA, 20 bp, Artificial Sequence
  chemically synthesized
aaataagatactatggctat

SEQ ID NO: 21779 - DNA, 20 bp, Artificial Sequence
  chemically synthesized
taagtaccaactaatagcca

SEQ ID NO: 21780 - DNA, 20 bp, Artificial Sequence
  chemically synthesized
aagatactatggctattagt

SEQ ID NO: 21781 - DNA, 20 bp, Artificial Sequence
  chemically synthesized
tgtgcttaagtaccaactaa

SEQ ID NO: 21782 - DNA, 20 bp, Artificial Sequence
  chemically synthesized
atggctattagttggtactt

SEQ ID NO: 21783 - DNA, 20 bp, Artificial Sequence
  chemically synthesized
attagttggtacttaagcac

SEQ ID NO: 21784 - DNA, 20 bp, Artificial Sequence
  chemically synthesized
cttgtggaatgcttgtgctt

SEQ ID NO: 21785 - DNA, 20 bp, Artificial Sequence
  chemically synthesized
cttaagcacaagcattccac

SEQ ID NO: 21786 - DNA, 20 bp, Artificial Sequence
  chemically synthesized
ttaagcacaagcattccaca

SEQ ID NO: 21787 - DNA, 20 bp, Artificial Sequence
  chemically synthesized
atccattccattgatccttg

SEQ ID NO: 21788 - DNA, 20 bp, Artificial Sequence
  chemically synthesized
aagcattccacaaggatcaa

SEQ ID NO: 21789 - DNA, 20 bp, Artificial Sequence
  chemically synthesized
ttccacaaggatcaatggaa

SEQ ID NO: 21790 - DNA, 20 bp, Artificial Sequence
  chemically synthesized
ttaggcaaggcacaaggaag

SEQ ID NO: 21791 - DNA, 20 bp, Artificial Sequence
  chemically synthesized
aattaggcaaggcacaagga

SEQ ID NO: 21792 - DNA, 20 bp, Artificial Sequence
  chemically synthesized
caattaggcaaggcacaagg

SEQ ID NO: 21793 - DNA, 20 bp, Artificial Sequence
  chemically synthesized
cttcaattaggcaaggcaca

SEQ ID NO: 21794 - DNA, 20 bp, Artificial Sequence
  chemically synthesized
gcttcaattaggcaaggcac

SEQ ID NO: 21795 - DNA, 20 bp, Artificial Sequence
  chemically synthesized
gtgatagcttcaattaggca

SEQ ID NO: 21796 - DNA, 20 bp, Artificial Sequence
  chemically synthesized
tgtgatagcttcaattaggc

SEQ ID NO: 21797 - DNA, 20 bp, Artificial Sequence
  chemically synthesized
ccttgtgccttgcctaattg

SEQ ID NO: 21798 - DNA, 20 bp, Artificial Sequence
  chemically synthesized
gttgtgtgatagcttcaatt

SEQ ID NO: 21799 - DNA, 20 bp, Artificial Sequence
  chemically synthesized
ggttgtgtgatagcttcaat

SEQ ID NO: 21800 - DNA, 20 bp, Artificial Sequence
  chemically synthesized
cctatgatggggttgtgtga

SEQ ID NO: 21801 - DNA, 20 bp, Artificial Sequence
  chemically synthesized
gctatcacacaaccccatca

SEQ ID NO: 21802 - DNA, 20 bp, Artificial Sequence
  chemically synthesized
ctatcacacaaccccatcat

SEQ ID NO: 21803 - DNA, 20 bp, Artificial Sequence
  chemically synthesized
gatattttcaacctatgatg

SEQ ID NO: 21804 - DNA, 20 bp, Artificial Sequence
  chemically synthesized
agatattttcaacctatgat

SEQ ID NO: 21805 - DNA, 20 bp, Artificial Sequence
  chemically synthesized
aagatattttcaacctatga

SEQ ID NO: 21806 - DNA, 20 bp, Artificial Sequence
  chemically synthesized
tcataggttgaaaatatctt

SEQ ID NO: 21807 - DNA, 20 bp, Artificial Sequence
  chemically synthesized
attaaatgcatttgtgactt

SEQ ID NO: 21808 - DNA, 20 bp, Artificial Sequence
  chemically synthesized
gctgtgagtttcagttagtt

SEQ ID NO: 21809 - DNA, 20 bp, Artificial Sequence
  chemically synthesized
agctgtgagtttcagttagt

SEQ ID NO: 21810 - DNA, 20 bp, Artificial Sequence
  chemically synthesized
gctaagctgtgagtttcagt

SEQ ID NO: 21811 - DNA, 20 bp, Artificial Sequence
  chemically synthesized
acctaactaactgaaactca

SEQ ID NO: 21812 - DNA, 20 bp, Artificial Sequence
  chemically synthesized
ctaggctaagctgtgagttt

SEQ ID NO: 21813 - DNA, 20 bp, Artificial Sequence
  chemically synthesized
actaactgaaactcacagct

SEQ ID NO: 21814 - DNA, 20 bp, Artificial Sequence
  chemically synthesized
ggtaggctaggctaagctgt

SEQ ID NO: 21815 - DNA, 20 bp, Artificial Sequence
  chemically synthesized
ctgaaactcacagcttagcc

SEQ ID NO: 21816 - DNA, 20 bp, Artificial Sequence
  chemically synthesized
cattgaaggtaggctaggct

SEQ ID NO: 21817 - DNA, 20 bp, Artificial Sequence
  chemically synthesized
gagcacattgaaggtaggct

SEQ ID NO: 21818 - DNA, 20 bp, Artificial Sequence
  chemically synthesized
ggagcacattgaaggtaggc

SEQ ID NO: 21819 - DNA, 20 bp, Artificial Sequence
  chemically synthesized
gttgggagcacattgaaggt

SEQ ID NO: 21820 - DNA, 20 bp, Artificial Sequence
  chemically synthesized
tgttgggagcacattgaagg

SEQ ID NO: 21821 - DNA, 20 bp, Artificial Sequence
  chemically synthesized
aagtgttgggagcacattga

SEQ ID NO: 21822 - DNA, 20 bp, Artificial Sequence
  chemically synthesized
taagtgttgggagcacattg

SEQ ID NO: 21823 - DNA, 20 bp, Artificial Sequence
  chemically synthesized
taggccgatgtaagtgttgg

SEQ ID NO: 21824 - DNA, 20 bp, Artificial Sequence
  chemically synthesized
tgtaggccgatgtaagtgtt

SEQ ID NO: 21825 - DNA, 20 bp, Artificial Sequence
  chemically synthesized
ctgtaggccgatgtaagtgt

SEQ ID NO: 21826 - DNA, 20 bp, Artificial Sequence
  chemically synthesized
tgtgctcccaacacttacat

SEQ ID NO: 21827 - DNA, 20 bp, Artificial Sequence
  chemically synthesized
gcccaactgtaggccgatgt

SEQ ID NO: 21828 - DNA, 20 bp, Artificial Sequence
  chemically synthesized
ccaacacttacatcggccta

SEQ ID NO: 21829 - DNA, 20 bp, Artificial Sequence
  chemically synthesized
cacttacatcggcctacagt

SEQ ID NO: 21830 - DNA, 20 bp, Artificial Sequence
  chemically synthesized
acttacatcggcctacagtt

SEQ ID NO: 21831 - DNA, 20 bp, Artificial Sequence
  chemically synthesized
agacagttttgcccaactgt

SEQ ID NO: 21832 - DNA, 20 bp, Artificial Sequence
  chemically synthesized
tagacagttttgcccaactg

SEQ ID NO: 21833 - DNA, 20 bp, Artificial Sequence
  chemically synthesized
tacagttgggcaaaactgtc

SEQ ID NO: 21834 - DNA, 20 bp, Artificial Sequence
  chemically synthesized
ctgtgtaaggtgttgctaga

SEQ ID NO: 21835 - DNA, 20 bp, Artificial Sequence
  chemically synthesized
tttactgtgtaaggtgttgc

SEQ ID NO: 21836 - DNA, 20 bp, Artificial Sequence
  chemically synthesized
ctgtctagcaacaccttaca

SEQ ID NO: 21837 - DNA, 20 bp, Artificial Sequence
  chemically synthesized
aactgacactttactgtgta

SEQ ID NO: 21838 - DNA, 20 bp, Artificial Sequence
  chemically synthesized
caactgacactttactgtgt

SEQ ID NO: 21839 - DNA, 20 bp, Artificial Sequence
  chemically synthesized
tagcaacaccttacacagta

SEQ ID NO: 21840 - DNA, 20 bp, Artificial Sequence
  chemically synthesized
caccttacacagtaaagtgt

SEQ ID NO: 21841 - DNA, 20 bp, Artificial Sequence
  chemically synthesized
acagtaaagtgtcagttgtt

SEQ ID NO: 21842 - DNA, 20 bp, Artificial Sequence
  chemically synthesized
cagtcagccacaagatcatg

SEQ ID NO: 21843 - DNA, 20 bp, Artificial Sequence
  chemically synthesized
ccagtcagccacaagatcat

SEQ ID NO: 21844 - DNA, 20 bp, Artificial Sequence
  chemically synthesized
tgtttagcctcatgatcttg

SEQ ID NO: 21845 - DNA, 20 bp, Artificial Sequence
  chemically synthesized
ctcagctcccagtcagccac

SEQ ID NO: 21846 - DNA, 20 bp, Artificial Sequence
  chemically synthesized
ctcatgatcttgtggctgac

SEQ ID NO: 21847 - DNA, 20 bp, Artificial Sequence
  chemically synthesized
tcatgatcttgtggctgact

SEQ ID NO: 21848 - DNA, 20 bp, Artificial Sequence
  chemically synthesized
atgatcttgtggctgactgg

SEQ ID NO: 21849 - DNA, 20 bp, Artificial Sequence
  chemically synthesized
actgaacctcagctcccagt

SEQ ID NO: 21850 - DNA, 20 bp, Artificial Sequence
  chemically synthesized
cttgtggctgactgggagct

SEQ ID NO: 21851 - DNA, 20 bp, Artificial Sequence
  chemically synthesized
ttgtggctgactgggagctg

SEQ ID NO: 21852 - DNA, 20 bp, Artificial Sequence
  chemically synthesized
cagcactgaacctcagctcc

SEQ ID NO: 21853 - DNA, 20 bp, Artificial Sequence
  chemically synthesized
gctgactgggagctgaggtt

SEQ ID NO: 21854 - DNA, 20 bp, Artificial Sequence
  chemically synthesized
tgggcagcagcactgaacct

SEQ ID NO: 21855 - DNA, 20 bp, Artificial Sequence
  chemically synthesized
tgaggttcagtgctgctgcc

SEQ ID NO: 21856 - DNA, 20 bp, Artificial Sequence
  chemically synthesized
tctctccccttgctgggcag

SEQ ID NO: 21857 - DNA, 20 bp, Artificial Sequence
  chemically synthesized
gttcagtgctgctgcccagc

SEQ ID NO: 21858 - DNA, 20 bp, Artificial Sequence
  chemically synthesized
ttcagtgctgctgcccagca

SEQ ID NO: 21859 - DNA, 20 bp, Artificial Sequence
  chemically synthesized
tactctctccccttgctggg

SEQ ID NO: 21860 - DNA, 20 bp, Artificial Sequence
  chemically synthesized
tcagtgctgctgcccagcaa

SEQ ID NO: 21861 - DNA, 20 bp, Artificial Sequence
  chemically synthesized
cagtgctgctgcccagcaag

SEQ ID NO: 21862 - DNA, 20 bp, Artificial Sequence
  chemically synthesized
tgatactctctccccttgct

SEQ ID NO: 21863 - DNA, 20 bp, Artificial Sequence
  chemically synthesized
gtgctgctgcccagcaaggg

SEQ ID NO: 21864 - DNA, 20 bp, Artificial Sequence
  chemically synthesized
atgatactctctccccttgc

SEQ ID NO: 21865 - DNA, 20 bp, Artificial Sequence
  chemically synthesized
gctgctgcccagcaagggga

SEQ ID NO: 21866 - DNA, 20 bp, Artificial Sequence
  chemically synthesized
tgctgcccagcaaggggaga

SEQ ID NO: 21867 - DNA, 20 bp, Artificial Sequence
  chemically synthesized
tttccaaggctagtaatatg

SEQ ID NO: 21868 - DNA, 20 bp, Artificial Sequence
  chemically synthesized
agtatcataccgcatattac

SEQ ID NO: 21869 - DNA, 20 bp, Artificial Sequence
  chemically synthesized
ataccgcatattactagcct

SEQ ID NO: 21870 - DNA, 20 bp, Artificial Sequence
  chemically synthesized
attttgatcttttccaaggc

SEQ ID NO: 21871 - DNA, 20 bp, Artificial Sequence
  chemically synthesized
gcatattactagccttggaa

SEQ ID NO: 21872 - DNA, 20 bp, Artificial Sequence
  chemically synthesized
ttgaattttgatcttttcca

SEQ ID NO: 21873 - DNA, 20 bp, Artificial Sequence
  chemically synthesized
tttgaattttgatcttttcc

SEQ ID NO: 21874 - DNA, 20 bp, Artificial Sequence
  chemically synthesized
aaaagatcaaaattcaaatc

SEQ ID NO: 21875 - DNA, 20 bp, Artificial Sequence
  chemically synthesized
agatcaaaattcaaatctag

SEQ ID NO: 21876 - DNA, 20 bp, Artificial Sequence
  chemically synthesized
tcaaaattcaaatctagaag

SEQ ID NO: 21877 - DNA, 20 bp, Artificial Sequence
  chemically synthesized
aaaattcaaatctagaagta

SEQ ID NO: 21878 - DNA, 20 bp, Artificial Sequence
  chemically synthesized
ttcaatagaaactctacttc

SEQ ID NO: 21879 - DNA, 20 bp, Artificial Sequence
  chemically synthesized
gcaaagtgatatgcattcaa

SEQ ID NO: 21880 - DNA, 20 bp, Artificial Sequence
  chemically synthesized
tttgatttcacagtgatgca

SEQ ID NO: 21881 - DNA, 20 bp, Artificial Sequence
  chemically synthesized
ttaacaattttttgatttca

SEQ ID NO: 21882 - DNA, 20 bp, Artificial Sequence
  chemically synthesized
tgtgaaatcaaaaaattgtt

SEQ ID NO: 21883 - DNA, 20 bp, Artificial Sequence
  chemically synthesized
ttgttaagttgaaacttcac

SEQ ID NO: 21884 - DNA, 20 bp, Artificial Sequence
  chemically synthesized
taagttgaaacttcacaagt

SEQ ID NO: 21885 - DNA, 20 bp, Artificial Sequence
  chemically synthesized
cagacagtccccaacttgtg

SEQ ID NO: 21886 - DNA, 20 bp, Artificial Sequence
  chemically synthesized
aagttgaaacttcacaagtt

SEQ ID NO: 21887 - DNA, 20 bp, Artificial Sequence
  chemically synthesized
agttgaaacttcacaagttg

SEQ ID NO: 21888 - DNA, 20 bp, Artificial Sequence
  chemically synthesized
cacacaccacacaatgcaga

SEQ ID NO: 21889 - DNA, 20 bp, Artificial Sequence
  chemically synthesized
tggggactgtctgcattgtg

SEQ ID NO: 21890 - DNA, 20 bp, Artificial Sequence
  chemically synthesized
cacacacacaccacacaatg

SEQ ID NO: 21891 - DNA, 20 bp, Artificial Sequence
  chemically synthesized
cattgtgtggtgtgtgtgtg

SEQ ID NO: 21892 - DNA, 20 bp, Artificial Sequence
  chemically synthesized
gtgtggtgtgtgtgtgtagc

SEQ ID NO: 21893 - DNA, 20 bp, Artificial Sequence
  chemically synthesized
tgtggtgtgtgtgtgtagct

SEQ ID NO: 21894 - DNA, 20 bp, Artificial Sequence
  chemically synthesized
gtggtgtgtgtgtgtagctg

SEQ ID NO: 21895 - DNA, 20 bp, Artificial Sequence
  chemically synthesized
gtgtgtgtgtgtagctgggg

SEQ ID NO: 21896 - DNA, 20 bp, Artificial Sequence
  chemically synthesized
gtgtgtgtgtagctggggaa

SEQ ID NO: 21897 - DNA, 20 bp, Artificial Sequence
  chemically synthesized
tgtgtgtgtagctggggaag

SEQ ID NO: 21898 - DNA, 20 bp, Artificial Sequence
  chemically synthesized
tttaagccaaacctcttccc

SEQ ID NO: 21899 - DNA, 20 bp, Artificial Sequence
  chemically synthesized
gtgtagctggggaagaggtt

SEQ ID NO: 21900 - DNA, 20 bp, Artificial Sequence
  chemically synthesized
ttccttttatcattaatttt

SEQ ID NO: 21901 - DNA, 20 bp, Artificial Sequence
  chemically synthesized
tggcttaaaattaatgataa

SEQ ID NO: 21902 - DNA, 20 bp, Artificial Sequence
  chemically synthesized
ggcttaaaattaatgataaa

SEQ ID NO: 21903 - DNA, 20 bp, Artificial Sequence
  chemically synthesized
aaattaatgataaaaggaaa

SEQ ID NO: 21904 - DNA, 20 bp, Artificial Sequence
  chemically synthesized
aattaatgataaaaggaaaa

SEQ ID NO: 21905 - DNA, 20 bp, Artificial Sequence
  chemically synthesized
aatgataaaaggaaaaaggt

SEQ ID NO: 21906 - DNA, 20 bp, Artificial Sequence
  chemically synthesized
gaaaaaggtgagattgttgc

SEQ ID NO: 21907 - DNA, 20 bp, Artificial Sequence
  chemically synthesized
aaaaaggtgagattgttgca

SEQ ID NO: 21908 - DNA, 20 bp, Artificial Sequence
  chemically synthesized
aaaaggtgagattgttgcaa

SEQ ID NO: 21909 - DNA, 20 bp, Artificial Sequence
  chemically synthesized
aaaggtgagattgttgcaag

SEQ ID NO: 21910 - DNA, 20 bp, Artificial Sequence
  chemically synthesized
ggtgagattgttgcaagggg

SEQ ID NO: 21911 - DNA, 20 bp, Artificial Sequence
  chemically synthesized
gtgagattgttgcaagggga

SEQ ID NO: 21912 - DNA, 20 bp, Artificial Sequence
  chemically synthesized
caaggggaaggaaaccacca

SEQ ID NO: 21913 - DNA, 20 bp, Artificial Sequence
  chemically synthesized
aaataaaaaagtatctttgg

SEQ ID NO: 21914 - DNA, 20 bp, Artificial Sequence
  chemically synthesized
aagaaataaaaaagtatctt

SEQ ID NO: 21915 - DNA, 20 bp, Artificial Sequence
  chemically synthesized
aaaagaaaaaagaaataaaa

SEQ ID NO: 21916 - DNA, 20 bp, Artificial Sequence
  chemically synthesized
aaaaaaaaaaaaaaagaaaa

SEQ ID NO: 21917 - DNA, 20 bp, Artificial Sequence
  chemically synthesized
aaaaaaaaaaaaaaaaaaaa

SEQ ID NO: 21918 - DNA, 20 bp, Artificial Sequence
  chemically synthesized
tttttttttttttttttttt

SEQ ID NO: 21919 - DNA, 20 bp, Artificial Sequence
  chemically synthesized
ttttttttttttttgagacc

SEQ ID NO: 21920 - DNA, 20 bp, Artificial Sequence
  chemically synthesized
ctgggtgacagagcaagact

SEQ ID NO: 21921 - DNA, 20 bp, Artificial Sequence
  chemically synthesized
tccagcctgggtgacagagc

SEQ ID NO: 21922 - DNA, 20 bp, Artificial Sequence
  chemically synthesized
ccgagtcttgctctgtcacc

SEQ ID NO: 21923 - DNA, 20 bp, Artificial Sequence
  chemically synthesized
gtcctccagcctgggtgaca

SEQ ID NO: 21924 - DNA, 20 bp, Artificial Sequence
  chemically synthesized
cgagtcttgctctgtcaccc

SEQ ID NO: 21925 - DNA, 20 bp, Artificial Sequence
  chemically synthesized
ctgtcctccagcctgggtga

SEQ ID NO: 21926 - DNA, 20 bp, Artificial Sequence
  chemically synthesized
tcttgctctgtcacccaggc

SEQ ID NO: 21927 - DNA, 20 bp, Artificial Sequence
  chemically synthesized
ttgctctgtcacccaggctg

SEQ ID NO: 21928 - DNA, 20 bp, Artificial Sequence
  chemically synthesized
tgctctgtcacccaggctgg

SEQ ID NO: 21929 - DNA, 20 bp, Artificial Sequence
  chemically synthesized
gcgccactgtcctccagcct

SEQ ID NO: 21930 - DNA, 20 bp, Artificial Sequence
  chemically synthesized
cgcgccactgtcctccagcc

SEQ ID NO: 21931 - DNA, 20 bp, Artificial Sequence
  chemically synthesized
ctgtcacccaggctggagga

SEQ ID NO: 21932 - DNA, 20 bp, Artificial Sequence
  chemically synthesized
gagatcgcgccactgtcctc

SEQ ID NO: 21933 - DNA, 20 bp, Artificial Sequence
  chemically synthesized
tcacccaggctggaggacag

SEQ ID NO: 21934 - DNA, 20 bp, Artificial Sequence
  chemically synthesized
ggaggacagtggcgcgatct

SEQ ID NO: 21935 - DNA, 20 bp, Artificial Sequence
  chemically synthesized
ggcggagcttgcagcgagcc

SEQ ID NO: 21936 - DNA, 20 bp, Artificial Sequence
  chemically synthesized
gcgcgatctcggctcgctgc

SEQ ID NO: 21937 - DNA, 20 bp, Artificial Sequence
  chemically synthesized
tgggaggcggagcttgcagc

SEQ ID NO: 21938 - DNA, 20 bp, Artificial Sequence
  chemically synthesized
aacctgggaggcggagcttg

SEQ ID NO: 21939 - DNA, 20 bp, Artificial Sequence
  chemically synthesized
tcgctgcaagctccgcctcc

SEQ ID NO: 21940 - DNA, 20 bp, Artificial Sequence
  chemically synthesized
tggcgtgaacctgggaggcg

SEQ ID NO: 21941 - DNA, 20 bp, Artificial Sequence
  chemically synthesized
cgctgcaagctccgcctccc

SEQ ID NO: 21942 - DNA, 20 bp, Artificial Sequence
  chemically synthesized
aatggcgtgaacctgggagg

SEQ ID NO: 21943 - DNA, 20 bp, Artificial Sequence
  chemically synthesized
gagaatggcgtgaacctggg

SEQ ID NO: 21944 - DNA, 20 bp, Artificial Sequence
  chemically synthesized
ggagaatggcgtgaacctgg

SEQ ID NO: 21945 - DNA, 20 bp, Artificial Sequence
  chemically synthesized
caggagaatggcgtgaacct

SEQ ID NO: 21946 - DNA, 20 bp, Artificial Sequence
  chemically synthesized
gcaggagaatggcgtgaacc

SEQ ID NO: 21947 - DNA, 20 bp, Artificial Sequence
  chemically synthesized
gggagtctgaggcaggagaa

SEQ ID NO: 21948 - DNA, 20 bp, Artificial Sequence
  chemically synthesized
ttcacgccattctcctgcct

SEQ ID NO: 21949 - DNA, 20 bp, Artificial Sequence
  chemically synthesized
tactcgggagtctgaggcag

SEQ ID NO: 21950 - DNA, 20 bp, Artificial Sequence
  chemically synthesized
gctactcgggagtctgaggc

SEQ ID NO: 21951 - DNA, 20 bp, Artificial Sequence
  chemically synthesized
agctactcgggagtctgagg

SEQ ID NO: 21952 - DNA, 20 bp, Artificial Sequence
  chemically synthesized
cccagctactcgggagtctg

SEQ ID NO: 21953 - DNA, 20 bp, Artificial Sequence
  chemically synthesized
tcccagctactcgggagtct

SEQ ID NO: 21954 - DNA, 20 bp, Artificial Sequence
  chemically synthesized
ttctcctgcctcagactccc

SEQ ID NO: 21955 - DNA, 20 bp, Artificial Sequence
  chemically synthesized
tcctgcctcagactcccgag

SEQ ID NO: 21956 - DNA, 20 bp, Artificial Sequence
  chemically synthesized
ctgtagtcccagctactcgg

SEQ ID NO: 21957 - DNA, 20 bp, Artificial Sequence
  chemically synthesized
gcctcagactcccgagtagc

SEQ ID NO: 21958 - DNA, 20 bp, Artificial Sequence
  chemically synthesized
gactgtagtcccagctactc

SEQ ID NO: 21959 - DNA, 20 bp, Artificial Sequence
  chemically synthesized
cctcagactcccgagtagct

SEQ ID NO: 21960 - DNA, 20 bp, Artificial Sequence
  chemically synthesized
cgactgtagtcccagctact

SEQ ID NO: 21961 - DNA, 20 bp, Artificial Sequence
  chemically synthesized
ctcccgagtagctgggacta

SEQ ID NO: 21962 - DNA, 20 bp, Artificial Sequence
  chemically synthesized
atggcgagcgactgtagtcc

SEQ ID NO: 21963 - DNA, 20 bp, Artificial Sequence
  chemically synthesized
ggcgtgatggcgagcgactg

SEQ ID NO: 21964 - DNA, 20 bp, Artificial Sequence
  chemically synthesized
aattagccaggcgtgatggc

SEQ ID NO: 21965 - DNA, 20 bp, Artificial Sequence
  chemically synthesized
cagtcgctcgccatcacgcc

SEQ ID NO: 21966 - DNA, 20 bp, Artificial Sequence
  chemically synthesized
aaaaaattagccaggcgtga

SEQ ID NO: 21967 - DNA, 20 bp, Artificial Sequence
  chemically synthesized
aaaaatacaaaaaattagcc

SEQ ID NO: 21968 - DNA, 20 bp, Artificial Sequence
  chemically synthesized
taaaaatacaaaaaattagc

SEQ ID NO: 21969 - DNA, 20 bp, Artificial Sequence
  chemically synthesized
ctactaaaaatacaaaaaat

SEQ ID NO: 21970 - DNA, 20 bp, Artificial Sequence
  chemically synthesized
tggctaattttttgtatttt

SEQ ID NO: 21971 - DNA, 20 bp, Artificial Sequence
  chemically synthesized
ctaattttttgtatttttag

SEQ ID NO: 21972 - DNA, 20 bp, Artificial Sequence
  chemically synthesized
aattttttgtatttttagta

SEQ ID NO: 21973 - DNA, 20 bp, Artificial Sequence
  chemically synthesized
ttttgtatttttagtagaga

SEQ ID NO: 21974 - DNA, 20 bp, Artificial Sequence
  chemically synthesized
tttgtatttttagtagagat

SEQ ID NO: 21975 - DNA, 20 bp, Artificial Sequence
  chemically synthesized
ttgtatttttagtagagatg

SEQ ID NO: 21976 - DNA, 20 bp, Artificial Sequence
  chemically synthesized
gagatggggtttcaccgtgt

SEQ ID NO: 21977 - DNA, 20 bp, Artificial Sequence
  chemically synthesized
tggggtttcaccgtgttagc

SEQ ID NO: 21978 - DNA, 20 bp, Artificial Sequence
  chemically synthesized
cgaggccatcctggctaaca

SEQ ID NO: 21979 - DNA, 20 bp, Artificial Sequence
  chemically synthesized
ggggtttcaccgtgttagcc

SEQ ID NO: 21980 - DNA, 20 bp, Artificial Sequence
  chemically synthesized
tttcaccgtgttagccagga

SEQ ID NO: 21981 - DNA, 20 bp, Artificial Sequence
  chemically synthesized
tcaggagttcgaggccatcc

SEQ ID NO: 21982 - DNA, 20 bp, Artificial Sequence
  chemically synthesized
atcacgaggtcaggagttcg

SEQ ID NO: 21983 - DNA, 20 bp, Artificial Sequence
  chemically synthesized
gatcacgaggtcaggagttc

SEQ ID NO: 21984 - DNA, 20 bp, Artificial Sequence
  chemically synthesized
caggcagatcacgaggtcag

SEQ ID NO: 21985 - DNA, 20 bp, Artificial Sequence
  chemically synthesized
ggcaggcagatcacgaggtc

SEQ ID NO: 21986 - DNA, 20 bp, Artificial Sequence
  chemically synthesized
aggcaggcagatcacgaggt

SEQ ID NO: 21987 - DNA, 20 bp, Artificial Sequence
  chemically synthesized
gccgaggcaggcagatcacg

SEQ ID NO: 21988 - DNA, 20 bp, Artificial Sequence
  chemically synthesized
ggccgaggcaggcagatcac

SEQ ID NO: 21989 - DNA, 20 bp, Artificial Sequence
  chemically synthesized
acctcgtgatctgcctgcct

SEQ ID NO: 21990 - DNA, 20 bp, Artificial Sequence
  chemically synthesized
cttcgggaggccgaggcagg

SEQ ID NO: 21991 - DNA, 20 bp, Artificial Sequence
  chemically synthesized
gcacttcgggaggccgaggc

SEQ ID NO: 21992 - DNA, 20 bp, Artificial Sequence
  chemically synthesized
agcacttcgggaggccgagg

SEQ ID NO: 21993 - DNA, 20 bp, Artificial Sequence
  chemically synthesized
cccagcacttcgggaggccg

SEQ ID NO: 21994 - DNA, 20 bp, Artificial Sequence
  chemically synthesized
tcccagcacttcgggaggcc

SEQ ID NO: 21995 - DNA, 20 bp, Artificial Sequence
  chemically synthesized
ctgcctgcctcggcctcccg

SEQ ID NO: 21996 - DNA, 20 bp, Artificial Sequence
  chemically synthesized
tgtaatcccagcacttcggg

SEQ ID NO: 21997 - DNA, 20 bp, Artificial Sequence
  chemically synthesized
ctgtaatcccagcacttcgg

SEQ ID NO: 21998 - DNA, 20 bp, Artificial Sequence
  chemically synthesized
gcctcggcctcccgaagtgc

SEQ ID NO: 21999 - DNA, 20 bp, Artificial Sequence
  chemically synthesized
gcctgtaatcccagcacttc

SEQ ID NO: 22000 - DNA, 20 bp, Artificial Sequence
  chemically synthesized
cctcggcctcccgaagtgct

SEQ ID NO: 22001 - DNA, 20 bp, Artificial Sequence
  chemically synthesized
cgcctgtaatcccagcactt

SEQ ID NO: 22002 - DNA, 20 bp, Artificial Sequence
  chemically synthesized
ctcccgaagtgctgggatta

SEQ ID NO: 22003 - DNA, 20 bp, Artificial Sequence
  chemically synthesized
tcccgaagtgctgggattac

SEQ ID NO: 22004 - DNA, 20 bp, Artificial Sequence
  chemically synthesized
gtggctcacgcctgtaatcc

SEQ ID NO: 22005 - DNA, 20 bp, Artificial Sequence
  chemically synthesized
agtgctgggattacaggcgt

SEQ ID NO: 22006 - DNA, 20 bp, Artificial Sequence
  chemically synthesized
gattacaggcgtgagccacc

SEQ ID NO: 22007 - DNA, 20 bp, Artificial Sequence
  chemically synthesized
caggcgtgagccaccgagcc

SEQ ID NO: 22008 - DNA, 20 bp, Artificial Sequence
  chemically synthesized
aaagtatcggctgggctcgg

SEQ ID NO: 22009 - DNA, 20 bp, Artificial Sequence
  chemically synthesized
aaaaaagtatcggctgggct

SEQ ID NO: 22010 - DNA, 20 bp, Artificial Sequence
  chemically synthesized
aaaaaaaaaaagtatcggct

SEQ ID NO: 22011 - DNA, 20 bp, Artificial Sequence
  chemically synthesized
aaaaaaaaaaaagtatcggc

SEQ ID NO: 22012 - DNA, 20 bp, Artificial Sequence
  chemically synthesized
ttaaaaaaaaaaaaaagtat

SEQ ID NO: 22013 - DNA, 20 bp, Artificial Sequence
  chemically synthesized
ttccctttaaaaaaaaaaaa

SEQ ID NO: 22014 - DNA, 20 bp, Artificial Sequence
  chemically synthesized
gatactttttttttttttta

SEQ ID NO: 22015 - DNA, 20 bp, Artificial Sequence
  chemically synthesized
atacttttttttttttttaa

SEQ ID NO: 22016 - DNA, 20 bp, Artificial Sequence
  chemically synthesized
tacttttttttttttttaaa

SEQ ID NO: 22017 - DNA, 20 bp, Artificial Sequence
  chemically synthesized
gtaggcagcaacattatatt

SEQ ID NO: 22018 - DNA, 20 bp, Artificial Sequence
  chemically synthesized
cgtaggcagcaacattatat

SEQ ID NO: 22019 - DNA, 20 bp, Artificial Sequence
  chemically synthesized
taatataatgttgctgccta

SEQ ID NO: 22020 - DNA, 20 bp, Artificial Sequence
  chemically synthesized
atataatgttgctgcctacg

SEQ ID NO: 22021 - DNA, 20 bp, Artificial Sequence
  chemically synthesized
attttaaacctctccgtagg

SEQ ID NO: 22022 - DNA, 20 bp, Artificial Sequence
  chemically synthesized
ataatgttgctgcctacgga

SEQ ID NO: 22023 - DNA, 20 bp, Artificial Sequence
  chemically synthesized
taatgttgctgcctacggag

SEQ ID NO: 22024 - DNA, 20 bp, Artificial Sequence
  chemically synthesized
cttattttaaacctctccgt

SEQ ID NO: 22025 - DNA, 20 bp, Artificial Sequence
  chemically synthesized
tcttattttaaacctctccg

SEQ ID NO: 22026 - DNA, 20 bp, Artificial Sequence
  chemically synthesized
cctacggagaggtttaaaat

SEQ ID NO: 22027 - DNA, 20 bp, Artificial Sequence
  chemically synthesized
tacggagaggtttaaaataa

SEQ ID NO: 22028 - DNA, 20 bp, Artificial Sequence
  chemically synthesized
aagagaataatatgctccct

SEQ ID NO: 22029 - DNA, 20 bp, Artificial Sequence
  chemically synthesized
catctgagtctaagccaagg

SEQ ID NO: 22030 - DNA, 20 bp, Artificial Sequence
  chemically synthesized
aataatatgctcccttggct

SEQ ID NO: 22031 - DNA, 20 bp, Artificial Sequence
  chemically synthesized
ggcatctgagtctaagccaa

SEQ ID NO: 22032 - DNA, 20 bp, Artificial Sequence
  chemically synthesized
aggcatctgagtctaagcca

SEQ ID NO: 22033 - DNA, 20 bp, Artificial Sequence
  chemically synthesized
gaggcatctgagtctaagcc

SEQ ID NO: 22034 - DNA, 20 bp, Artificial Sequence
  chemically synthesized
atgctcccttggcttagact

SEQ ID NO: 22035 - DNA, 20 bp, Artificial Sequence
  chemically synthesized
cccaagaggcatctgagtct

SEQ ID NO: 22036 - DNA, 20 bp, Artificial Sequence
  chemically synthesized
ccccaccccaagaggcatct

SEQ ID NO: 22037 - DNA, 20 bp, Artificial Sequence
  chemically synthesized
gcttagactcagatgcctct

SEQ ID NO: 22038 - DNA, 20 bp, Artificial Sequence
  chemically synthesized
cttagactcagatgcctctt

SEQ ID NO: 22039 - DNA, 20 bp, Artificial Sequence
  chemically synthesized
ttagactcagatgcctcttg

SEQ ID NO: 22040 - DNA, 20 bp, Artificial Sequence
  chemically synthesized
gactcagatgcctcttgggg

SEQ ID NO: 22041 - DNA, 20 bp, Artificial Sequence
  chemically synthesized
gcagagtcccccaccccaag

SEQ ID NO: 22042 - DNA, 20 bp, Artificial Sequence
  chemically synthesized
actcagatgcctcttggggt

SEQ ID NO: 22043 - DNA, 20 bp, Artificial Sequence
  chemically synthesized
agcagagtcccccaccccaa

SEQ ID NO: 22044 - DNA, 20 bp, Artificial Sequence
  chemically synthesized
ctcagatgcctcttggggtg

SEQ ID NO: 22045 - DNA, 20 bp, Artificial Sequence
  chemically synthesized
tcagatgcctcttggggtgg

SEQ ID NO: 22046 - DNA, 20 bp, Artificial Sequence
  chemically synthesized
ttagcagagtcccccacccc

SEQ ID NO: 22047 - DNA, 20 bp, Artificial Sequence
  chemically synthesized
aggaggaggaggttttagca

SEQ ID NO: 22048 - DNA, 20 bp, Artificial Sequence
  chemically synthesized
caaggaggaggaggttttag

SEQ ID NO: 22049 - DNA, 20 bp, Artificial Sequence
  chemically synthesized
tttcaaggaggaggaggttt

SEQ ID NO: 22050 - DNA, 20 bp, Artificial Sequence
  chemically synthesized
tggctctttcaaggaggagg

SEQ ID NO: 22051 - DNA, 20 bp, Artificial Sequence
  chemically synthesized
ttggctctttcaaggaggag

SEQ ID NO: 22052 - DNA, 20 bp, Artificial Sequence
  chemically synthesized
tcttggctctttcaaggagg

SEQ ID NO: 22053 - DNA, 20 bp, Artificial Sequence
  chemically synthesized
atcttggctctttcaaggag

SEQ ID NO: 22054 - DNA, 20 bp, Artificial Sequence
  chemically synthesized
taaaacctcctcctccttga

SEQ ID NO: 22055 - DNA, 20 bp, Artificial Sequence
  chemically synthesized
acatcttggctctttcaagg

SEQ ID NO: 22056 - DNA, 20 bp, Artificial Sequence
  chemically synthesized
aaacctcctcctccttgaaa

SEQ ID NO: 22057 - DNA, 20 bp, Artificial Sequence
  chemically synthesized
cacatcttggctctttcaag

SEQ ID NO: 22058 - DNA, 20 bp, Artificial Sequence
  chemically synthesized
ctcacatcttggctctttca

SEQ ID NO: 22059 - DNA, 20 bp, Artificial Sequence
  chemically synthesized
actcacatcttggctctttc

SEQ ID NO: 22060 - DNA, 20 bp, Artificial Sequence
  chemically synthesized
tcctcctccttgaaagagcc

SEQ ID NO: 22061 - DNA, 20 bp, Artificial Sequence
  chemically synthesized
ccttgaaagagccaagatgt

SEQ ID NO: 22062 - DNA, 20 bp, Artificial Sequence
  chemically synthesized
tgactctcccactcacatct

SEQ ID NO: 22063 - DNA, 20 bp, Artificial Sequence
  chemically synthesized
tgaaagagccaagatgtgag

SEQ ID NO: 22064 - DNA, 20 bp, Artificial Sequence
  chemically synthesized
gaaagagccaagatgtgagt

SEQ ID NO: 22065 - DNA, 20 bp, Artificial Sequence
  chemically synthesized
aagagccaagatgtgagtgg

SEQ ID NO: 22066 - DNA, 20 bp, Artificial Sequence
  chemically synthesized
gagccaagatgtgagtggga

SEQ ID NO: 22067 - DNA, 20 bp, Artificial Sequence
  chemically synthesized
caagatgtgagtgggagagt

SEQ ID NO: 22068 - DNA, 20 bp, Artificial Sequence
  chemically synthesized
atccagtgtgttggataggt

SEQ ID NO: 22069 - DNA, 20 bp, Artificial Sequence
  chemically synthesized
cgtcatccagtgtgttggat

SEQ ID NO: 22070 - DNA, 20 bp, Artificial Sequence
  chemically synthesized
tcgtcatccagtgtgttgga

SEQ ID NO: 22071 - DNA, 20 bp, Artificial Sequence
  chemically synthesized
agccaacctatccaacacac

SEQ ID NO: 22072 - DNA, 20 bp, Artificial Sequence
  chemically synthesized
catctcgtcatccagtgtgt

SEQ ID NO: 22073 - DNA, 20 bp, Artificial Sequence
  chemically synthesized
tatccaacacactggatgac

SEQ ID NO: 22074 - DNA, 20 bp, Artificial Sequence
  chemically synthesized
agaacgcccatctcgtcatc

SEQ ID NO: 22075 - DNA, 20 bp, Artificial Sequence
  chemically synthesized
caacacactggatgacgaga

SEQ ID NO: 22076 - DNA, 20 bp, Artificial Sequence
  chemically synthesized
aacacactggatgacgagat

SEQ ID NO: 22077 - DNA, 20 bp, Artificial Sequence
  chemically synthesized
catggtgttgtagtcgcagt

SEQ ID NO: 22078 - DNA, 20 bp, Artificial Sequence
  chemically synthesized
gctccatggtgttgtagtcg

SEQ ID NO: 22079 - DNA, 20 bp, Artificial Sequence
  chemically synthesized
aatattgctccatggtgttg

SEQ ID NO: 22080 - DNA, 20 bp, Artificial Sequence
  chemically synthesized
taactgcgactacaacacca

SEQ ID NO: 22081 - DNA, 20 bp, Artificial Sequence
  chemically synthesized
actgcgactacaacaccatg

SEQ ID NO: 22082 - DNA, 20 bp, Artificial Sequence
  chemically synthesized
gccacattaatattgctcca

SEQ ID NO: 22083 - DNA, 20 bp, Artificial Sequence
  chemically synthesized
accatggagcaatattaatg

SEQ ID NO: 22084 - DNA, 20 bp, Artificial Sequence
  chemically synthesized
agcaatattaatgtggcttt

SEQ ID NO: 22085 - DNA, 20 bp, Artificial Sequence
  chemically synthesized
atattaatgtggcttttggt

SEQ ID NO: 22086 - DNA, 20 bp, Artificial Sequence
  chemically synthesized
cattaacgaatactaaccaa

SEQ ID NO: 22087 - DNA, 20 bp, Artificial Sequence
  chemically synthesized
tagtattcgttaatgtcttt

SEQ ID NO: 22088 - DNA, 20 bp, Artificial Sequence
  chemically synthesized
tcctgtgaaagaagaaccaa

SEQ ID NO: 22089 - DNA, 20 bp, Artificial Sequence
  chemically synthesized
gtcttttggttcttctttca

SEQ ID NO: 22090 - DNA, 20 bp, Artificial Sequence
  chemically synthesized
tcttttggttcttctttcac

SEQ ID NO: 22091 - DNA, 20 bp, Artificial Sequence
  chemically synthesized
acagatatgtcctgtgaaag

SEQ ID NO: 22092 - DNA, 20 bp, Artificial Sequence
  chemically synthesized
ataacagatatgtcctgtga

SEQ ID NO: 22093 - DNA, 20 bp, Artificial Sequence
  chemically synthesized
ctgacacagctgattaataa

SEQ ID NO: 22094 - DNA, 20 bp, Artificial Sequence
  chemically synthesized
aggacatatctgttattaat

SEQ ID NO: 22095 - DNA, 20 bp, Artificial Sequence
  chemically synthesized
ctgttattaatcagctgtgt

SEQ ID NO: 22096 - DNA, 20 bp, Artificial Sequence
  chemically synthesized
tgttattaatcagctgtgtc

SEQ ID NO: 22097 - DNA, 20 bp, Artificial Sequence
  chemically synthesized
cctcaggttatttcctgaca

SEQ ID NO: 22098 - DNA, 20 bp, Artificial Sequence
  chemically synthesized
gctgtgtcaggaaataacct

SEQ ID NO: 22099 - DNA, 20 bp, Artificial Sequence
  chemically synthesized
ctgtgtcaggaaataacctg

SEQ ID NO: 22100 - DNA, 20 bp, Artificial Sequence
  chemically synthesized
tgtgtcaggaaataacctga

SEQ ID NO: 22101 - DNA, 20 bp, Artificial Sequence
  chemically synthesized
gactgggtaaatattccctc

SEQ ID NO: 22102 - DNA, 20 bp, Artificial Sequence
  chemically synthesized
tgactgggtaaatattccct

SEQ ID NO: 22103 - DNA, 20 bp, Artificial Sequence
  chemically synthesized
aacctgagggaatatttacc

SEQ ID NO: 22104 - DNA, 20 bp, Artificial Sequence
  chemically synthesized
attgttcttcagatttgact

SEQ ID NO: 22105 - DNA, 20 bp, Artificial Sequence
  chemically synthesized
cattgttcttcagatttgac

SEQ ID NO: 22106 - DNA, 20 bp, Artificial Sequence
  chemically synthesized
tatttacccagtcaaatctg

SEQ ID NO: 22107 - DNA, 20 bp, Artificial Sequence
  chemically synthesized
tgttataaatcattgttctt

SEQ ID NO: 22108 - DNA, 20 bp, Artificial Sequence
  chemically synthesized
atggccacacagtgtttatt

SEQ ID NO: 22109 - DNA, 20 bp, Artificial Sequence
  chemically synthesized
caatctcaataaacactgtg

SEQ ID NO: 22110 - DNA, 20 bp, Artificial Sequence
  chemically synthesized
catcacaattgatggccaca

SEQ ID NO: 22111 - DNA, 20 bp, Artificial Sequence
  chemically synthesized
accttcatcatcacaattga

SEQ ID NO: 22112 - DNA, 20 bp, Artificial Sequence
  chemically synthesized
ggccatcaattgtgatgatg

SEQ ID NO: 22113 - DNA, 20 bp, Artificial Sequence
  chemically synthesized
gccatcaattgtgatgatga

SEQ ID NO: 22114 - DNA, 20 bp, Artificial Sequence
  chemically synthesized
gtgatgatgaaggtttaaca

SEQ ID NO: 22115 - DNA, 20 bp, Artificial Sequence
  chemically synthesized
tgatgatgaaggtttaacaa

SEQ ID NO: 22116 - DNA, 20 bp, Artificial Sequence
  chemically synthesized
tgaaggtttaacaaaggtat

SEQ ID NO: 22117 - DNA, 20 bp, Artificial Sequence
  chemically synthesized
gaaggtttaacaaaggtatt

SEQ ID NO: 22118 - DNA, 20 bp, Artificial Sequence
  chemically synthesized
caaaggtattgggcatgtga

SEQ ID NO: 22119 - DNA, 20 bp, Artificial Sequence
  chemically synthesized
aggtattgggcatgtgatag

SEQ ID NO: 22120 - DNA, 20 bp, Artificial Sequence
  chemically synthesized
ggtattgggcatgtgataga

SEQ ID NO: 22121 - DNA, 20 bp, Artificial Sequence
  chemically synthesized
agatgaaacatacagcacgt

SEQ ID NO: 22122 - DNA, 20 bp, Artificial Sequence
  chemically synthesized
gttatgacagatgaaacata

SEQ ID NO: 22123 - DNA, 20 bp, Artificial Sequence
  chemically synthesized
ttaaacacataatgttatga

SEQ ID NO: 22124 - DNA, 20 bp, Artificial Sequence
  chemically synthesized
acattatgtgtttaaaaaaa

SEQ ID NO: 22125 - DNA, 20 bp, Artificial Sequence
  chemically synthesized
acacggagtaatggggcaaa

SEQ ID NO: 22126 - DNA, 20 bp, Artificial Sequence
  chemically synthesized
gctttccacacggagtaatg

SEQ ID NO: 22127 - DNA, 20 bp, Artificial Sequence
  chemically synthesized
ggctttccacacggagtaat

SEQ ID NO: 22128 - DNA, 20 bp, Artificial Sequence
  chemically synthesized
tggctttccacacggagtaa

SEQ ID NO: 22129 - DNA, 20 bp, Artificial Sequence
  chemically synthesized
atttgccccattactccgtg

SEQ ID NO: 22130 - DNA, 20 bp, Artificial Sequence
  chemically synthesized
cactaatggctttccacacg

SEQ ID NO: 22131 - DNA, 20 bp, Artificial Sequence
  chemically synthesized
gccccattactccgtgtgga

SEQ ID NO: 22132 - DNA, 20 bp, Artificial Sequence
  chemically synthesized
cccactaatggctttccaca

SEQ ID NO: 22133 - DNA, 20 bp, Artificial Sequence
  chemically synthesized
tactccgtgtggaaagccat

SEQ ID NO: 22134 - DNA, 20 bp, Artificial Sequence
  chemically synthesized
tccgtgtggaaagccattag

SEQ ID NO: 22135 - DNA, 20 bp, Artificial Sequence
  chemically synthesized
ccgtgtggaaagccattagt

SEQ ID NO: 22136 - DNA, 20 bp, Artificial Sequence
  chemically synthesized
attgtccctccacccactaa

SEQ ID NO: 22137 - DNA, 20 bp, Artificial Sequence
  chemically synthesized
tgtggaaagccattagtggg

SEQ ID NO: 22138 - DNA, 20 bp, Artificial Sequence
  chemically synthesized
tggaaagccattagtgggtg

SEQ ID NO: 22139 - DNA, 20 bp, Artificial Sequence
  chemically synthesized
ggaaagccattagtgggtgg

SEQ ID NO: 22140 - DNA, 20 bp, Artificial Sequence
  chemically synthesized
gaaagccattagtgggtgga

SEQ ID NO: 22141 - DNA, 20 bp, Artificial Sequence
  chemically synthesized
ttagtgggtggagggacaat

SEQ ID NO: 22142 - DNA, 20 bp, Artificial Sequence
  chemically synthesized
tagtgggtggagggacaatt

SEQ ID NO: 22143 - DNA, 20 bp, Artificial Sequence
  chemically synthesized
gggtggagggacaattggga

SEQ ID NO: 22144 - DNA, 20 bp, Artificial Sequence
  chemically synthesized
acaattgggacagcttgaat

SEQ ID NO: 22145 - DNA, 20 bp, Artificial Sequence
  chemically synthesized
taaatatctgtcactgattc

SEQ ID NO: 22146 - DNA, 20 bp, Artificial Sequence
  chemically synthesized
gggacagcttgaatcagtga

SEQ ID NO: 22147 - DNA, 20 bp, Artificial Sequence
  chemically synthesized
tgaatcagtgacagatattt

SEQ ID NO: 22148 - DNA, 20 bp, Artificial Sequence
  chemically synthesized
acagatatttaagttgaatt

SEQ ID NO: 22149 - DNA, 20 bp, Artificial Sequence
  chemically synthesized
gatatttaagttgaatttgg

SEQ ID NO: 22150 - DNA, 20 bp, Artificial Sequence
  chemically synthesized
atatttaagttgaatttggt

SEQ ID NO: 22151 - DNA, 20 bp, Artificial Sequence
  chemically synthesized
cttttcagtctcaggaaagt

SEQ ID NO: 22152 - DNA, 20 bp, Artificial Sequence
  chemically synthesized
tttggtgggcctactttcct

SEQ ID NO: 22153 - DNA, 20 bp, Artificial Sequence
  chemically synthesized
gcttttcagtctcaggaaag

SEQ ID NO: 22154 - DNA, 20 bp, Artificial Sequence
  chemically synthesized
ctagcttttcagtctcagga

SEQ ID NO: 22155 - DNA, 20 bp, Artificial Sequence
  chemically synthesized
atttctagcttttcagtctc

SEQ ID NO: 22156 - DNA, 20 bp, Artificial Sequence
  chemically synthesized
aatttctagcttttcagtct

SEQ ID NO: 22157 - DNA, 20 bp, Artificial Sequence
  chemically synthesized
cctactttcctgagactgaa

SEQ ID NO: 22158 - DNA, 20 bp, Artificial Sequence
  chemically synthesized
ctttcctgagactgaaaagc

SEQ ID NO: 22159 - DNA, 20 bp, Artificial Sequence
  chemically synthesized
atatccaatttctagctttt

SEQ ID NO: 22160 - DNA, 20 bp, Artificial Sequence
  chemically synthesized
gagactgaaaagctagaaat

SEQ ID NO: 22161 - DNA, 20 bp, Artificial Sequence
  chemically synthesized
agccatccatatccaatttc

SEQ ID NO: 22162 - DNA, 20 bp, Artificial Sequence
  chemically synthesized
gaaaagctagaaattggata

SEQ ID NO: 22163 - DNA, 20 bp, Artificial Sequence
  chemically synthesized
agctagaaattggatatgga

SEQ ID NO: 22164 - DNA, 20 bp, Artificial Sequence
  chemically synthesized
aaattggatatggatggcta

SEQ ID NO: 22165 - DNA, 20 bp, Artificial Sequence
  chemically synthesized
gtatgtcacagaaatttctg

SEQ ID NO: 22166 - DNA, 20 bp, Artificial Sequence
  chemically synthesized
actttggtttgggtatgtca

SEQ ID NO: 22167 - DNA, 20 bp, Artificial Sequence
  chemically synthesized
tctgtgacatacccaaacca

SEQ ID NO: 22168 - DNA, 20 bp, Artificial Sequence
  chemically synthesized
tcctaaaaggactttggttt

SEQ ID NO: 22169 - DNA, 20 bp, Artificial Sequence
  chemically synthesized
ctcctaaaaggactttggtt

SEQ ID NO: 22170 - DNA, 20 bp, Artificial Sequence
  chemically synthesized
agtcactcctaaaaggactt

SEQ ID NO: 22171 - DNA, 20 bp, Artificial Sequence
  chemically synthesized
tacccaaaccaaagtccttt

SEQ ID NO: 22172 - DNA, 20 bp, Artificial Sequence
  chemically synthesized
acccaaaccaaagtcctttt

SEQ ID NO: 22173 - DNA, 20 bp, Artificial Sequence
  chemically synthesized
ccaaaccaaagtccttttag

SEQ ID NO: 22174 - DNA, 20 bp, Artificial Sequence
  chemically synthesized
gaatagtagtcactcctaaa

SEQ ID NO: 22175 - DNA, 20 bp, Artificial Sequence
  chemically synthesized
tgaatagtagtcactcctaa

SEQ ID NO: 22176 - DNA, 20 bp, Artificial Sequence
  chemically synthesized
ggctaaaatcatatgaatag

SEQ ID NO: 22177 - DNA, 20 bp, Artificial Sequence
  chemically synthesized
ctaggctaaaatcatatgaa

SEQ ID NO: 22178 - DNA, 20 bp, Artificial Sequence
  chemically synthesized
gactactattcatatgattt

SEQ ID NO: 22179 - DNA, 20 bp, Artificial Sequence
  chemically synthesized
ctattcatatgattttagcc

SEQ ID NO: 22180 - DNA, 20 bp, Artificial Sequence
  chemically synthesized
tgagacacaaaaatgtgact

SEQ ID NO: 22181 - DNA, 20 bp, Artificial Sequence
  chemically synthesized
atgagacacaaaaatgtgac

SEQ ID NO: 22182 - DNA, 20 bp, Artificial Sequence
  chemically synthesized
ctttaatgggaaatacacat

SEQ ID NO: 22183 - DNA, 20 bp, Artificial Sequence
  chemically synthesized
ctcatgtgtatttcccatta

SEQ ID NO: 22184 - DNA, 20 bp, Artificial Sequence
  chemically synthesized
tgagaaatagcagctttaat

SEQ ID NO: 22185 - DNA, 20 bp, Artificial Sequence
  chemically synthesized
ttgagaaatagcagctttaa

SEQ ID NO: 22186 - DNA, 20 bp, Artificial Sequence
  chemically synthesized
atgttgccattgagaaatag

SEQ ID NO: 22187 - DNA, 20 bp, Artificial Sequence
  chemically synthesized
gacatgttgccattgagaaa

SEQ ID NO: 22188 - DNA, 20 bp, Artificial Sequence
  chemically synthesized
ttaaagctgctatttctcaa

SEQ ID NO: 22189 - DNA, 20 bp, Artificial Sequence
  chemically synthesized
ccaccagacatgttgccatt

SEQ ID NO: 22190 - DNA, 20 bp, Artificial Sequence
  chemically synthesized
tttctcaatggcaacatgtc

SEQ ID NO: 22191 - DNA, 20 bp, Artificial Sequence
  chemically synthesized
ctcaatggcaacatgtctgg

SEQ ID NO: 22192 - DNA, 20 bp, Artificial Sequence
  chemically synthesized
tcaatggcaacatgtctggt

SEQ ID NO: 22193 - DNA, 20 bp, Artificial Sequence
  chemically synthesized
ggcaacatgtctggtgggcc

SEQ ID NO: 22194 - DNA, 20 bp, Artificial Sequence
  chemically synthesized
attcatgccccttggcccac

SEQ ID NO: 22195 - DNA, 20 bp, Artificial Sequence
  chemically synthesized
gcaacatgtctggtgggcca

SEQ ID NO: 22196 - DNA, 20 bp, Artificial Sequence
  chemically synthesized
caacatgtctggtgggccaa

SEQ ID NO: 22197 - DNA, 20 bp, Artificial Sequence
  chemically synthesized
aacatgtctggtgggccaag

SEQ ID NO: 22198 - DNA, 20 bp, Artificial Sequence
  chemically synthesized
tcaagtggattcatgcccct

SEQ ID NO: 22199 - DNA, 20 bp, Artificial Sequence
  chemically synthesized
gaagtttcttttatttcaag

SEQ ID NO: 22200 - DNA, 20 bp, Artificial Sequence
  chemically synthesized
catgaatccacttgaaataa

SEQ ID NO: 22201 - DNA, 20 bp, Artificial Sequence
  chemically synthesized
atagaagtttcttttatttc

SEQ ID NO: 22202 - DNA, 20 bp, Artificial Sequence
  chemically synthesized
gaaataaaagaaacttctat

SEQ ID NO: 22203 - DNA, 20 bp, Artificial Sequence
  chemically synthesized
aaataaaagaaacttctatt

SEQ ID NO: 22204 - DNA, 20 bp, Artificial Sequence
  chemically synthesized
ataaaagaaacttctattag

SEQ ID NO: 22205 - DNA, 20 bp, Artificial Sequence
  chemically synthesized
gttcctaattctcctaatag

SEQ ID NO: 22206 - DNA, 20 bp, Artificial Sequence
  chemically synthesized
ccagttcctaattctcctaa

SEQ ID NO: 22207 - DNA, 20 bp, Artificial Sequence
  chemically synthesized
gaaacttctattaggagaat

SEQ ID NO: 22208 - DNA, 20 bp, Artificial Sequence
  chemically synthesized
aaacttctattaggagaatt

SEQ ID NO: 22209 - DNA, 20 bp, Artificial Sequence
  chemically synthesized
ctattaggagaattaggaac

SEQ ID NO: 22210 - DNA, 20 bp, Artificial Sequence
  chemically synthesized
tattaggagaattaggaact

SEQ ID NO: 22211 - DNA, 20 bp, Artificial Sequence
  chemically synthesized
aggagaattaggaactgggc

SEQ ID NO: 22212 - DNA, 20 bp, Artificial Sequence
  chemically synthesized
gagaattaggaactgggcta

SEQ ID NO: 22213 - DNA, 20 bp, Artificial Sequence
  chemically synthesized
ctggccaggtatctctagcc

SEQ ID NO: 22214 - DNA, 20 bp, Artificial Sequence
  chemically synthesized
tctacctggccaggtatctc

SEQ ID NO: 22215 - DNA, 20 bp, Artificial Sequence
  chemically synthesized
ggaactgggctagagatacc

SEQ ID NO: 22216 - DNA, 20 bp, Artificial Sequence
  chemically synthesized
ctgggctagagatacctggc

SEQ ID NO: 22217 - DNA, 20 bp, Artificial Sequence
  chemically synthesized
tgggctagagatacctggcc

SEQ ID NO: 22218 - DNA, 20 bp, Artificial Sequence
  chemically synthesized
gctagagatacctggccagg

SEQ ID NO: 22219 - DNA, 20 bp, Artificial Sequence
  chemically synthesized
aaagcaaattctacctggcc

SEQ ID NO: 22220 - DNA, 20 bp, Artificial Sequence
  chemically synthesized
caaagcaaattctacctggc

SEQ ID NO: 22221 - DNA, 20 bp, Artificial Sequence
  chemically synthesized
cattcaaagcaaattctacc

SEQ ID NO: 22222 - DNA, 20 bp, Artificial Sequence
  chemically synthesized
aggtagaatttgctttgaat

SEQ ID NO: 22223 - DNA, 20 bp, Artificial Sequence
  chemically synthesized
agtttatcatttctcattca

SEQ ID NO: 22224 - DNA, 20 bp, Artificial Sequence
  chemically synthesized
atgagaaatgataaactgac

SEQ ID NO: 22225 - DNA, 20 bp, Artificial Sequence
  chemically synthesized
gaaatgataaactgacgaga

SEQ ID NO: 22226 - DNA, 20 bp, Artificial Sequence
  chemically synthesized
cactaggaagtctttctcgt

SEQ ID NO: 22227 - DNA, 20 bp, Artificial Sequence
  chemically synthesized
aactgacgagaaagacttcc

SEQ ID NO: 22228 - DNA, 20 bp, Artificial Sequence
  chemically synthesized
agtgcgcttcttgcactagg

SEQ ID NO: 22229 - DNA, 20 bp, Artificial Sequence
  chemically synthesized
cgagaaagacttcctagtgc

SEQ ID NO: 22230 - DNA, 20 bp, Artificial Sequence
  chemically synthesized
tgaagtgcgcttcttgcact

SEQ ID NO: 22231 - DNA, 20 bp, Artificial Sequence
  chemically synthesized
gaaagacttcctagtgcaag

SEQ ID NO: 22232 - DNA, 20 bp, Artificial Sequence
  chemically synthesized
ttgaagtgcgcttcttgcac

SEQ ID NO: 22233 - DNA, 20 bp, Artificial Sequence
  chemically synthesized
tagtgcaagaagcgcacttc

SEQ ID NO: 22234 - DNA, 20 bp, Artificial Sequence
  chemically synthesized
agtgcaagaagcgcacttca

SEQ ID NO: 22235 - DNA, 20 bp, Artificial Sequence
  chemically synthesized
gtgcaagaagcgcacttcaa

SEQ ID NO: 22236 - DNA, 20 bp, Artificial Sequence
  chemically synthesized
cctggaattggatgcccttg

SEQ ID NO: 22237 - DNA, 20 bp, Artificial Sequence
  chemically synthesized
acttcaagggcatccaattc

SEQ ID NO: 22238 - DNA, 20 bp, Artificial Sequence
  chemically synthesized
cttcaagggcatccaattcc

SEQ ID NO: 22239 - DNA, 20 bp, Artificial Sequence
  chemically synthesized
tcaagggcatccaattccag

SEQ ID NO: 22240 - DNA, 20 bp, Artificial Sequence
  chemically synthesized
cctatccttcctcctggaat

SEQ ID NO: 22241 - DNA, 20 bp, Artificial Sequence
  chemically synthesized
caagggcatccaattccagg

SEQ ID NO: 22242 - DNA, 20 bp, Artificial Sequence
  chemically synthesized
gggcatccaattccaggagg

SEQ ID NO: 22243 - DNA, 20 bp, Artificial Sequence
  chemically synthesized
ggcatccaattccaggagga

SEQ ID NO: 22244 - DNA, 20 bp, Artificial Sequence
  chemically synthesized
gccatccctatccttcctcc

SEQ ID NO: 22245 - DNA, 20 bp, Artificial Sequence
  chemically synthesized
tccaattccaggaggaagga

SEQ ID NO: 22246 - DNA, 20 bp, Artificial Sequence
  chemically synthesized
ccaattccaggaggaaggat

SEQ ID NO: 22247 - DNA, 20 bp, Artificial Sequence
  chemically synthesized
caattccaggaggaaggata

SEQ ID NO: 22248 - DNA, 20 bp, Artificial Sequence
  chemically synthesized
tccaggaggaaggataggga

SEQ ID NO: 22249 - DNA, 20 bp, Artificial Sequence
  chemically synthesized
ggaggaaggatagggatggc

SEQ ID NO: 22250 - DNA, 20 bp, Artificial Sequence
  chemically synthesized
gatagggatggcaagctgcc

SEQ ID NO: 22251 - DNA, 20 bp, Artificial Sequence
  chemically synthesized
atagggatggcaagctgcca

SEQ ID NO: 22252 - DNA, 20 bp, Artificial Sequence
  chemically synthesized
tctccagctatcaaccttgg

SEQ ID NO: 22253 - DNA, 20 bp, Artificial Sequence
  chemically synthesized
tggcaagctgccaaggttga

SEQ ID NO: 22254 - DNA, 20 bp, Artificial Sequence
  chemically synthesized
cattctccagctatcaacct

SEQ ID NO: 22255 - DNA, 20 bp, Artificial Sequence
  chemically synthesized
aagctgccaaggttgatagc

SEQ ID NO: 22256 - DNA, 20 bp, Artificial Sequence
  chemically synthesized
gctgccaaggttgatagctg

SEQ ID NO: 22257 - DNA, 20 bp, Artificial Sequence
  chemically synthesized
caaggttgatagctggagaa

SEQ ID NO: 22258 - DNA, 20 bp, Artificial Sequence
  chemically synthesized
taattattggttccattctc

SEQ ID NO: 22259 - DNA, 20 bp, Artificial Sequence
  chemically synthesized
ttccgttttctagtaattat

SEQ ID NO: 22260 - DNA, 20 bp, Artificial Sequence
  chemically synthesized
agaatggaaccaataattac

SEQ ID NO: 22261 - DNA, 20 bp, Artificial Sequence
  chemically synthesized
aaccaataattactagaaaa

SEQ ID NO: 22262 - DNA, 20 bp, Artificial Sequence
  chemically synthesized
acctcgtaggttccgttttc

SEQ ID NO: 22263 - DNA, 20 bp, Artificial Sequence
  chemically synthesized
tactagaaaacggaacctac

SEQ ID NO: 22264 - DNA, 20 bp, Artificial Sequence
  chemically synthesized
actagaaaacggaacctacg

SEQ ID NO: 22265 - DNA, 20 bp, Artificial Sequence
  chemically synthesized
gagattaaagaacacctcgt

SEQ ID NO: 22266 - DNA, 20 bp, Artificial Sequence
  chemically synthesized
agagattaaagaacacctcg

SEQ ID NO: 22267 - DNA, 20 bp, Artificial Sequence
  chemically synthesized
gtcagatgctaaagagatta

SEQ ID NO: 22268 - DNA, 20 bp, Artificial Sequence
  chemically synthesized
gaggtgttctttaatctctt

SEQ ID NO: 22269 - DNA, 20 bp, Artificial Sequence
  chemically synthesized
tctctcagtcagatgctaaa

SEQ ID NO: 22270 - DNA, 20 bp, Artificial Sequence
  chemically synthesized
tttctctcagtcagatgcta

SEQ ID NO: 22271 - DNA, 20 bp, Artificial Sequence
  chemically synthesized
aatctctttagcatctgact

SEQ ID NO: 22272 - DNA, 20 bp, Artificial Sequence
  chemically synthesized
tctctttagcatctgactga

SEQ ID NO: 22273 - DNA, 20 bp, Artificial Sequence
  chemically synthesized
aagaatggttttctctcagt

SEQ ID NO: 22274 - DNA, 20 bp, Artificial Sequence
  chemically synthesized
gggaaagaatggttttctct

SEQ ID NO: 22275 - DNA, 20 bp, Artificial Sequence
  chemically synthesized
gttacccactagggaaagaa

SEQ ID NO: 22276 - DNA, 20 bp, Artificial Sequence
  chemically synthesized
agagaaaaccattctttccc

SEQ ID NO: 22277 - DNA, 20 bp, Artificial Sequence
  chemically synthesized
gaaaaccattctttccctag

SEQ ID NO: 22278 - DNA, 20 bp, Artificial Sequence
  chemically synthesized
tagctgttacccactaggga

SEQ ID NO: 22279 - DNA, 20 bp, Artificial Sequence
  chemically synthesized
aaaaccattctttccctagt

SEQ ID NO: 22280 - DNA, 20 bp, Artificial Sequence
  chemically synthesized
tgtttagctgttacccacta

SEQ ID NO: 22281 - DNA, 20 bp, Artificial Sequence
  chemically synthesized
ttgtttagctgttacccact

SEQ ID NO: 22282 - DNA, 20 bp, Artificial Sequence
  chemically synthesized
cttgtttagctgttacccac

SEQ ID NO: 22283 - DNA, 20 bp, Artificial Sequence
  chemically synthesized
attctttccctagtgggtaa

SEQ ID NO: 22284 - DNA, 20 bp, Artificial Sequence
  chemically synthesized
ctagtgggtaacagctaaac

SEQ ID NO: 22285 - DNA, 20 bp, Artificial Sequence
  chemically synthesized
ggaaatactgtaatcttgtt

SEQ ID NO: 22286 - DNA, 20 bp, Artificial Sequence
  chemically synthesized
gtaacagctaaacaagatta

SEQ ID NO: 22287 - DNA, 20 bp, Artificial Sequence
  chemically synthesized
caagattacagtatttcccc

SEQ ID NO: 22288 - DNA, 20 bp, Artificial Sequence
  chemically synthesized
aagattacagtatttcccct

SEQ ID NO: 22289 - DNA, 20 bp, Artificial Sequence
  chemically synthesized
gattacagtatttcccctgg

SEQ ID NO: 22290 - DNA, 20 bp, Artificial Sequence
  chemically synthesized
atgacccatctatctcccag

SEQ ID NO: 22291 - DNA, 20 bp, Artificial Sequence
  chemically synthesized
acagtatttcccctgggaga

SEQ ID NO: 22292 - DNA, 20 bp, Artificial Sequence
  chemically synthesized
catgacccatctatctccca

SEQ ID NO: 22293 - DNA, 20 bp, Artificial Sequence
  chemically synthesized
acatgacccatctatctccc

SEQ ID NO: 22294 - DNA, 20 bp, Artificial Sequence
  chemically synthesized
aacatgacccatctatctcc

SEQ ID NO: 22295 - DNA, 20 bp, Artificial Sequence
  chemically synthesized
tatttcccctgggagataga

SEQ ID NO: 22296 - DNA, 20 bp, Artificial Sequence
  chemically synthesized
atttcccctgggagatagat

SEQ ID NO: 22297 - DNA, 20 bp, Artificial Sequence
  chemically synthesized
agatagatgggtcatgttat

SEQ ID NO: 22298 - DNA, 20 bp, Artificial Sequence
  chemically synthesized
tcatgttatgagacctctct

SEQ ID NO: 22299 - DNA, 20 bp, Artificial Sequence
  chemically synthesized
catgttatgagacctctctt

SEQ ID NO: 22300 - DNA, 20 bp, Artificial Sequence
  chemically synthesized
cagatattagtgcccaagag

SEQ ID NO: 22301 - DNA, 20 bp, Artificial Sequence
  chemically synthesized
acagatattagtgcccaaga

SEQ ID NO: 22302 - DNA, 20 bp, Artificial Sequence
  chemically synthesized
tgacagatattagtgcccaa

SEQ ID NO: 22303 - DNA, 20 bp, Artificial Sequence
  chemically synthesized
tttgacagatattagtgccc

SEQ ID NO: 22304 - DNA, 20 bp, Artificial Sequence
  chemically synthesized
ttatatggtttgacagatat

SEQ ID NO: 22305 - DNA, 20 bp, Artificial Sequence
  chemically synthesized
tctcagtttatatggtttga

SEQ ID NO: 22306 - DNA, 20 bp, Artificial Sequence
  chemically synthesized
actaattttctcagtttata

SEQ ID NO: 22307 - DNA, 20 bp, Artificial Sequence
  chemically synthesized
tctgtcaaaccatataaact

SEQ ID NO: 22308 - DNA, 20 bp, Artificial Sequence
  chemically synthesized
accatataaactgagaaaat

SEQ ID NO: 22309 - DNA, 20 bp, Artificial Sequence
  chemically synthesized
catggccaaactaattttct

SEQ ID NO: 22310 - DNA, 20 bp, Artificial Sequence
  chemically synthesized
ataaactgagaaaattagtt

SEQ ID NO: 22311 - DNA, 20 bp, Artificial Sequence
  chemically synthesized
attagtttggccatgtcctc

SEQ ID NO: 22312 - DNA, 20 bp, Artificial Sequence
  chemically synthesized
tttaagacgtcttgaggaca

SEQ ID NO: 22313 - DNA, 20 bp, Artificial Sequence
  chemically synthesized
tctgagtttaagacgtcttg

SEQ ID NO: 22314 - DNA, 20 bp, Artificial Sequence
  chemically synthesized
ttctgagtttaagacgtctt

SEQ ID NO: 22315 - DNA, 20 bp, Artificial Sequence
  chemically synthesized
tcctcaagacgtcttaaact

SEQ ID NO: 22316 - DNA, 20 bp, Artificial Sequence
  chemically synthesized
tctctgttagttctgagttt

SEQ ID NO: 22317 - DNA, 20 bp, Artificial Sequence
  chemically synthesized
gccatgtctctgttagttct

SEQ ID NO: 22318 - DNA, 20 bp, Artificial Sequence
  chemically synthesized
cgtcttaaactcagaactaa

SEQ ID NO: 22319 - DNA, 20 bp, Artificial Sequence
  chemically synthesized
tcttaaactcagaactaaca

SEQ ID NO: 22320 - DNA, 20 bp, Artificial Sequence
  chemically synthesized
gttagaggccatgtctctgt

SEQ ID NO: 22321 - DNA, 20 bp, Artificial Sequence
  chemically synthesized
actcagaactaacagagaca

SEQ ID NO: 22322 - DNA, 20 bp, Artificial Sequence
  chemically synthesized
ttatttttcacataggttag

SEQ ID NO: 22323 - DNA, 20 bp, Artificial Sequence
  chemically synthesized
attatttttcacataggtta

SEQ ID NO: 22324 - DNA, 20 bp, Artificial Sequence
  chemically synthesized
gtattatttttcacataggt

SEQ ID NO: 22325 - DNA, 20 bp, Artificial Sequence
  chemically synthesized
ccatgtattatttttcacat

SEQ ID NO: 22326 - DNA, 20 bp, Artificial Sequence
  chemically synthesized
accatgtattatttttcaca

SEQ ID NO: 22327 - DNA, 20 bp, Artificial Sequence
  chemically synthesized
cctatgtgaaaaataataca

SEQ ID NO: 22328 - DNA, 20 bp, Artificial Sequence
  chemically synthesized
gaaaaataatacatggtata

SEQ ID NO: 22329 - DNA, 20 bp, Artificial Sequence
  chemically synthesized
taatacatggtatatagaaa

SEQ ID NO: 22330 - DNA, 20 bp, Artificial Sequence
  chemically synthesized
tacatggtatatagaaaaag

SEQ ID NO: 22331 - DNA, 20 bp, Artificial Sequence
  chemically synthesized
atagaaaaagtagatttttg

SEQ ID NO: 22332 - DNA, 20 bp, Artificial Sequence
  chemically synthesized
tagaaaaagtagatttttgt

SEQ ID NO: 22333 - DNA, 20 bp, Artificial Sequence
  chemically synthesized
aaaagtagatttttgtagga

SEQ ID NO: 22334 - DNA, 20 bp, Artificial Sequence
  chemically synthesized
agtagatttttgtaggacag

SEQ ID NO: 22335 - DNA, 20 bp, Artificial Sequence
  chemically synthesized
cagtggcaaaataattacac

SEQ ID NO: 22336 - DNA, 20 bp, Artificial Sequence
  chemically synthesized
aataattacactggcctctc

SEQ ID NO: 22337 - DNA, 20 bp, Artificial Sequence
  chemically synthesized
gcaagggggtctcgagaggc

SEQ ID NO: 22338 - DNA, 20 bp, Artificial Sequence
  chemically synthesized
cacagcaagggggtctcgag

SEQ ID NO: 22339 - DNA, 20 bp, Artificial Sequence
  chemically synthesized
ccacagcaagggggtctcga

SEQ ID NO: 22340 - DNA, 20 bp, Artificial Sequence
  chemically synthesized
ctccacagcaagggggtctc

SEQ ID NO: 22341 - DNA, 20 bp, Artificial Sequence
  chemically synthesized
aggctgcctccacagcaagg

SEQ ID NO: 22342 - DNA, 20 bp, Artificial Sequence
  chemically synthesized
ctctcgagacccccttgctg

SEQ ID NO: 22343 - DNA, 20 bp, Artificial Sequence
  chemically synthesized
caggctgcctccacagcaag

SEQ ID NO: 22344 - DNA, 20 bp, Artificial Sequence
  chemically synthesized
acaggctgcctccacagcaa

SEQ ID NO: 22345 - DNA, 20 bp, Artificial Sequence
  chemically synthesized
ctcgagacccccttgctgtg

SEQ ID NO: 22346 - DNA, 20 bp, Artificial Sequence
  chemically synthesized
cacaggctgcctccacagca

SEQ ID NO: 22347 - DNA, 20 bp, Artificial Sequence
  chemically synthesized
tcgagacccccttgctgtgg

SEQ ID NO: 22348 - DNA, 20 bp, Artificial Sequence
  chemically synthesized
ccacaggctgcctccacagc

SEQ ID NO: 22349 - DNA, 20 bp, Artificial Sequence
  chemically synthesized
agacccccttgctgtggagg

SEQ ID NO: 22350 - DNA, 20 bp, Artificial Sequence
  chemically synthesized
acagccacaggctgcctcca

SEQ ID NO: 22351 - DNA, 20 bp, Artificial Sequence
  chemically synthesized
cttgctgtggaggcagcctg

SEQ ID NO: 22352 - DNA, 20 bp, Artificial Sequence
  chemically synthesized
gtggaggcagcctgtggctg

SEQ ID NO: 22353 - DNA, 20 bp, Artificial Sequence
  chemically synthesized
ggatatggatccacagccac

SEQ ID NO: 22354 - DNA, 20 bp, Artificial Sequence
  chemically synthesized
aggatatggatccacagcca

SEQ ID NO: 22355 - DNA, 20 bp, Artificial Sequence
  chemically synthesized
actgtcaggatatggatcca

SEQ ID NO: 22356 - DNA, 20 bp, Artificial Sequence
  chemically synthesized
agagcattactgtcaggata

SEQ ID NO: 22357 - DNA, 20 bp, Artificial Sequence
  chemically synthesized
gctgtggatccatatcctga

SEQ ID NO: 22358 - DNA, 20 bp, Artificial Sequence
  chemically synthesized
attacaagagcattactgtc

SEQ ID NO: 22359 - DNA, 20 bp, Artificial Sequence
  chemically synthesized
cattacaagagcattactgt

SEQ ID NO: 22360 - DNA, 20 bp, Artificial Sequence
  chemically synthesized
cagaaaaggctacattacaa

SEQ ID NO: 22361 - DNA, 20 bp, Artificial Sequence
  chemically synthesized
acagtaatgctcttgtaatg

SEQ ID NO: 22362 - DNA, 20 bp, Artificial Sequence
  chemically synthesized
gccagaaaaggctacattac

SEQ ID NO: 22363 - DNA, 20 bp, Artificial Sequence
  chemically synthesized
tcttgtaatgtagccttttc

SEQ ID NO: 22364 - DNA, 20 bp, Artificial Sequence
  chemically synthesized
ccgcgctctattgccagaaa

SEQ ID NO: 22365 - DNA, 20 bp, Artificial Sequence
  chemically synthesized
tccgcgctctattgccagaa

SEQ ID NO: 22366 - DNA, 20 bp, Artificial Sequence
  chemically synthesized
aatgtagccttttctggcaa

SEQ ID NO: 22367 - DNA, 20 bp, Artificial Sequence
  chemically synthesized
tgtagccttttctggcaata

SEQ ID NO: 22368 - DNA, 20 bp, Artificial Sequence
  chemically synthesized
acaaatccgcgctctattgc

SEQ ID NO: 22369 - DNA, 20 bp, Artificial Sequence
  chemically synthesized
ccttttctggcaatagagcg

SEQ ID NO: 22370 - DNA, 20 bp, Artificial Sequence
  chemically synthesized
gcaatagagcgcggatttgt

SEQ ID NO: 22371 - DNA, 20 bp, Artificial Sequence
  chemically synthesized
tctcaggacccacaataaca

SEQ ID NO: 22372 - DNA, 20 bp, Artificial Sequence
  chemically synthesized
atttgtaagccatgttattg

SEQ ID NO: 22373 - DNA, 20 bp, Artificial Sequence
  chemically synthesized
tttgtaagccatgttattgt

SEQ ID NO: 22374 - DNA, 20 bp, Artificial Sequence
  chemically synthesized
gccatgttattgtgggtcct

SEQ ID NO: 22375 - DNA, 20 bp, Artificial Sequence
  chemically synthesized
catgttattgtgggtcctga

SEQ ID NO: 22376 - DNA, 20 bp, Artificial Sequence
  chemically synthesized
agttgctaaagaagactctc

SEQ ID NO: 22377 - DNA, 20 bp, Artificial Sequence
  chemically synthesized
cagttgctaaagaagactct

SEQ ID NO: 22378 - DNA, 20 bp, Artificial Sequence
  chemically synthesized
tgggtcctgagagtcttctt

SEQ ID NO: 22379 - DNA, 20 bp, Artificial Sequence
  chemically synthesized
ataggcttcagttgctaaag

SEQ ID NO: 22380 - DNA, 20 bp, Artificial Sequence
  chemically synthesized
tagataggcttcagttgcta

SEQ ID NO: 22381 - DNA, 20 bp, Artificial Sequence
  chemically synthesized
agagtcttctttagcaactg

SEQ ID NO: 22382 - DNA, 20 bp, Artificial Sequence
  chemically synthesized
gggtgacattagataggctt

SEQ ID NO: 22383 - DNA, 20 bp, Artificial Sequence
  chemically synthesized
cgctaagggtgacattagat

SEQ ID NO: 22384 - DNA, 20 bp, Artificial Sequence
  chemically synthesized
gcgctaagggtgacattaga

SEQ ID NO: 22385 - DNA, 20 bp, Artificial Sequence
  chemically synthesized
tggtgcgctaagggtgacat

SEQ ID NO: 22386 - DNA, 20 bp, Artificial Sequence
  chemically synthesized
agcctatctaatgtcaccct

SEQ ID NO: 22387 - DNA, 20 bp, Artificial Sequence
  chemically synthesized
accttttgatggtgcgctaa

SEQ ID NO: 22388 - DNA, 20 bp, Artificial Sequence
  chemically synthesized
caccttttgatggtgcgcta

SEQ ID NO: 22389 - DNA, 20 bp, Artificial Sequence
  chemically synthesized
tcaccttttgatggtgcgct

SEQ ID NO: 22390 - DNA, 20 bp, Artificial Sequence
  chemically synthesized
cacccttagcgcaccatcaa

SEQ ID NO: 22391 - DNA, 20 bp, Artificial Sequence
  chemically synthesized
acccttagcgcaccatcaaa

SEQ ID NO: 22392 - DNA, 20 bp, Artificial Sequence
  chemically synthesized
aaatgcacctcaccttttga

SEQ ID NO: 22393 - DNA, 20 bp, Artificial Sequence
  chemically synthesized
ttagcgcaccatcaaaaggt

SEQ ID NO: 22394 - DNA, 20 bp, Artificial Sequence
  chemically synthesized
tagcgcaccatcaaaaggtg

SEQ ID NO: 22395 - DNA, 20 bp, Artificial Sequence
  chemically synthesized
caaaaggtgaggtgcattta

SEQ ID NO: 22396 - DNA, 20 bp, Artificial Sequence
  chemically synthesized
aaaggtgaggtgcatttaca

SEQ ID NO: 22397 - DNA, 20 bp, Artificial Sequence
  chemically synthesized
ggtgaggtgcatttacagag

SEQ ID NO: 22398 - DNA, 20 bp, Artificial Sequence
  chemically synthesized
gtgaggtgcatttacagaga

SEQ ID NO: 22399 - DNA, 20 bp, Artificial Sequence
  chemically synthesized
aggtgcatttacagagaagg

SEQ ID NO: 22400 - DNA, 20 bp, Artificial Sequence
  chemically synthesized
aaggcggtgcatttttcacc

SEQ ID NO: 22401 - DNA, 20 bp, Artificial Sequence
  chemically synthesized
cgccctcaccatgacaaacc

SEQ ID NO: 22402 - DNA, 20 bp, Artificial Sequence
  chemically synthesized
tcgccctcaccatgacaaac

SEQ ID NO: 22403 - DNA, 20 bp, Artificial Sequence
  chemically synthesized
atttttcacctggtttgtca

SEQ ID NO: 22404 - DNA, 20 bp, Artificial Sequence
  chemically synthesized
ttcacctggtttgtcatggt

SEQ ID NO: 22405 - DNA, 20 bp, Artificial Sequence
  chemically synthesized
tcacctggtttgtcatggtg

SEQ ID NO: 22406 - DNA, 20 bp, Artificial Sequence
  chemically synthesized
cacctggtttgtcatggtga

SEQ ID NO: 22407 - DNA, 20 bp, Artificial Sequence
  chemically synthesized
tggtttgtcatggtgagggc

SEQ ID NO: 22408 - DNA, 20 bp, Artificial Sequence
  chemically synthesized
tgtcatggtgagggcgagtc

SEQ ID NO: 22409 - DNA, 20 bp, Artificial Sequence
  chemically synthesized
gtgtgaatagtcacagtttc

SEQ ID NO: 22410 - DNA, 20 bp, Artificial Sequence
  chemically synthesized
tggagttgtgtgaatagtca

SEQ ID NO: 22411 - DNA, 20 bp, Artificial Sequence
  chemically synthesized
acaggctggagttgtgtgaa

SEQ ID NO: 22412 - DNA, 20 bp, Artificial Sequence
  chemically synthesized
tgtgactattcacacaactc

SEQ ID NO: 22413 - DNA, 20 bp, Artificial Sequence
  chemically synthesized
tagagatttggtacaggctg

SEQ ID NO: 22414 - DNA, 20 bp, Artificial Sequence
  chemically synthesized
tatagagatttggtacaggc

SEQ ID NO: 22415 - DNA, 20 bp, Artificial Sequence
  chemically synthesized
acattatagagatttggtac

SEQ ID NO: 22416 - DNA, 20 bp, Artificial Sequence
  chemically synthesized
cacattatagagatttggta

SEQ ID NO: 22417 - DNA, 20 bp, Artificial Sequence
  chemically synthesized
aagcacacattatagagatt

SEQ ID NO: 22418 - DNA, 20 bp, Artificial Sequence
  chemically synthesized
caactaaagcacacattata

SEQ ID NO: 22419 - DNA, 20 bp, Artificial Sequence
  chemically synthesized
agcaactaaagcacacatta

SEQ ID NO: 22420 - DNA, 20 bp, Artificial Sequence
  chemically synthesized
aatctctataatgtgtgctt

SEQ ID NO: 22421 - DNA, 20 bp, Artificial Sequence
  chemically synthesized
ttgcctctattcagcaacta

SEQ ID NO: 22422 - DNA, 20 bp, Artificial Sequence
  chemically synthesized
tgtgtgctttagttgctgaa

SEQ ID NO: 22423 - DNA, 20 bp, Artificial Sequence
  chemically synthesized
tgtgctttagttgctgaata

SEQ ID NO: 22424 - DNA, 20 bp, Artificial Sequence
  chemically synthesized
gtgctttagttgctgaatag

SEQ ID NO: 22425 - DNA, 20 bp, Artificial Sequence
  chemically synthesized
gagaacattttgcctctatt

SEQ ID NO: 22426 - DNA, 20 bp, Artificial Sequence
  chemically synthesized
tctgcaaacagtaagaaata

SEQ ID NO: 22427 - DNA, 20 bp, Artificial Sequence
  chemically synthesized
attctgcaaacagtaagaaa

SEQ ID NO: 22428 - DNA, 20 bp, Artificial Sequence
  chemically synthesized
acaaatattctgcaaacagt

SEQ ID NO: 22429 - DNA, 20 bp, Artificial Sequence
  chemically synthesized
tctctatttcttactgtttg

SEQ ID NO: 22430 - DNA, 20 bp, Artificial Sequence
  chemically synthesized
tgtgacaaatattctgcaaa

SEQ ID NO: 22431 - DNA, 20 bp, Artificial Sequence
  chemically synthesized
ctaaatatactgcagttgat

SEQ ID NO: 22432 - DNA, 20 bp, Artificial Sequence
  chemically synthesized
tttgtcacacttatcaactg

SEQ ID NO: 22433 - DNA, 20 bp, Artificial Sequence
  chemically synthesized
ccatagggctaaatatactg

SEQ ID NO: 22434 - DNA, 20 bp, Artificial Sequence
  chemically synthesized
cttatcaactgcagtatatt

SEQ ID NO: 22435 - DNA, 20 bp, Artificial Sequence
  chemically synthesized
ctgcagtatatttagcccta

SEQ ID NO: 22436 - DNA, 20 bp, Artificial Sequence
  chemically synthesized
gtatatttagccctatggtt

SEQ ID NO: 22437 - DNA, 20 bp, Artificial Sequence
  chemically synthesized
tggagagagcccaaaccata

SEQ ID NO: 22438 - DNA, 20 bp, Artificial Sequence
  chemically synthesized
tatatttagccctatggttt

SEQ ID NO: 22439 - DNA, 20 bp, Artificial Sequence
  chemically synthesized
ttggagagagcccaaaccat

SEQ ID NO: 22440 - DNA, 20 bp, Artificial Sequence
  chemically synthesized
gttggagagagcccaaacca

SEQ ID NO: 22441 - DNA, 20 bp, Artificial Sequence
  chemically synthesized
aatgtgtggtgggttggaga

SEQ ID NO: 22442 - DNA, 20 bp, Artificial Sequence
  chemically synthesized
ataatgtgtggtgggttgga

SEQ ID NO: 22443 - DNA, 20 bp, Artificial Sequence
  chemically synthesized
taataatgtgtggtgggttg

SEQ ID NO: 22444 - DNA, 20 bp, Artificial Sequence
  chemically synthesized
attaataatgtgtggtgggt

SEQ ID NO: 22445 - DNA, 20 bp, Artificial Sequence
  chemically synthesized
gtttattaataatgtgtggt

SEQ ID NO: 22446 - DNA, 20 bp, Artificial Sequence
  chemically synthesized
agtttattaataatgtgtgg

SEQ ID NO: 22447 - DNA, 20 bp, Artificial Sequence
  chemically synthesized
tttagtttattaataatgtg

SEQ ID NO: 22448 - DNA, 20 bp, Artificial Sequence
  chemically synthesized
cttaacaaagcaagtgtatt

SEQ ID NO: 22449 - DNA, 20 bp, Artificial Sequence
  chemically synthesized
aaaaacgcacttaacaaagc

SEQ ID NO: 22450 - DNA, 20 bp, Artificial Sequence
  chemically synthesized
ctaaatacacttgctttgtt

SEQ ID NO: 22451 - DNA, 20 bp, Artificial Sequence
  chemically synthesized
aaataaaaacgcacttaaca

SEQ ID NO: 22452 - DNA, 20 bp, Artificial Sequence
  chemically synthesized
gtttttatttctgctcttac

SEQ ID NO: 22453 - DNA, 20 bp, Artificial Sequence
  chemically synthesized
aaaaagccaacttgtaagag

SEQ ID NO: 22454 - DNA, 20 bp, Artificial Sequence
  chemically synthesized
attaaaaagccaacttgtaa

SEQ ID NO: 22455 - DNA, 20 bp, Artificial Sequence
  chemically synthesized
ttatttctgctcttacaagt

SEQ ID NO: 22456 - DNA, 20 bp, Artificial Sequence
  chemically synthesized
aaattaaaaagccaacttgt

SEQ ID NO: 22457 - DNA, 20 bp, Artificial Sequence
  chemically synthesized
gtgaggcttctaaaattaaa

SEQ ID NO: 22458 - DNA, 20 bp, Artificial Sequence
  chemically synthesized
acaagttggctttttaattt

SEQ ID NO: 22459 - DNA, 20 bp, Artificial Sequence
  chemically synthesized
agttggctttttaattttag

SEQ ID NO: 22460 - DNA, 20 bp, Artificial Sequence
  chemically synthesized
gatgacattctacaggtgtg

SEQ ID NO: 22461 - DNA, 20 bp, Artificial Sequence
  chemically synthesized
ttttagaagcctcacacctg

SEQ ID NO: 22462 - DNA, 20 bp, Artificial Sequence
  chemically synthesized
tgatgacattctacaggtgt

SEQ ID NO: 22463 - DNA, 20 bp, Artificial Sequence
  chemically synthesized
tagttctgatgacattctac

SEQ ID NO: 22464 - DNA, 20 bp, Artificial Sequence
  chemically synthesized
gtagttctgatgacattcta

SEQ ID NO: 22465 - DNA, 20 bp, Artificial Sequence
  chemically synthesized
tcacacctgtagaatgtcat

SEQ ID NO: 22466 - DNA, 20 bp, Artificial Sequence
  chemically synthesized
agaatgtcatcagaactaca

SEQ ID NO: 22467 - DNA, 20 bp, Artificial Sequence
  chemically synthesized
gaatgtcatcagaactacaa

SEQ ID NO: 22468 - DNA, 20 bp, Artificial Sequence
  chemically synthesized
aatgtcatcagaactacaaa

SEQ ID NO: 22469 - DNA, 20 bp, Artificial Sequence
  chemically synthesized
tgtcatcagaactacaaagg

SEQ ID NO: 22470 - DNA, 20 bp, Artificial Sequence
  chemically synthesized
gcattttctttctccctttg

SEQ ID NO: 22471 - DNA, 20 bp, Artificial Sequence
  chemically synthesized
atcagaactacaaagggaga

SEQ ID NO: 22472 - DNA, 20 bp, Artificial Sequence
  chemically synthesized
agttatgaagaaggtaattt

SEQ ID NO: 22473 - DNA, 20 bp, Artificial Sequence
  chemically synthesized
tccattgaaagttatgaaga

SEQ ID NO: 22474 - DNA, 20 bp, Artificial Sequence
  chemically synthesized
ctccattgaaagttatgaag

SEQ ID NO: 22475 - DNA, 20 bp, Artificial Sequence
  chemically synthesized
atactccattgaaagttatg

SEQ ID NO: 22476 - DNA, 20 bp, Artificial Sequence
  chemically synthesized
accttcttcataactttcaa

SEQ ID NO: 22477 - DNA, 20 bp, Artificial Sequence
  chemically synthesized
cttcttcataactttcaatg

SEQ ID NO: 22478 - DNA, 20 bp, Artificial Sequence
  chemically synthesized
tatagctgatactccattga

SEQ ID NO: 22479 - DNA, 20 bp, Artificial Sequence
  chemically synthesized
cataactttcaatggagtat

SEQ ID NO: 22480 - DNA, 20 bp, Artificial Sequence
  chemically synthesized
ggagtatcagctatatgaaa

SEQ ID NO: 22481 - DNA, 20 bp, Artificial Sequence
  chemically synthesized
gatttataaactgtttcata

SEQ ID NO: 22482 - DNA, 20 bp, Artificial Sequence
  chemically synthesized
gtttataaatccttcttacc

SEQ ID NO: 22483 - DNA, 20 bp, Artificial Sequence
  chemically synthesized
aagataaaatcttggtaaga

SEQ ID NO: 22484 - DNA, 20 bp, Artificial Sequence
  chemically synthesized
aaagataaaatcttggtaag

SEQ ID NO: 22485 - DNA, 20 bp, Artificial Sequence
  chemically synthesized
aacaaagataaaatcttggt

SEQ ID NO: 22486 - DNA, 20 bp, Artificial Sequence
  chemically synthesized
caggaacaaagataaaatct

SEQ ID NO: 22487 - DNA, 20 bp, Artificial Sequence
  chemically synthesized
ttggtagaaaagcaggaaca

SEQ ID NO: 22488 - DNA, 20 bp, Artificial Sequence
  chemically synthesized
atgaaacttggtagaaaagc

SEQ ID NO: 22489 - DNA, 20 bp, Artificial Sequence
  chemically synthesized
aatgaaacttggtagaaaag

SEQ ID NO: 22490 - DNA, 20 bp, Artificial Sequence
  chemically synthesized
tttgttcctgcttttctacc

SEQ ID NO: 22491 - DNA, 20 bp, Artificial Sequence
  chemically synthesized
gaaaatgaaacttggtagaa

SEQ ID NO: 22492 - DNA, 20 bp, Artificial Sequence
  chemically synthesized
gaaatgaaaatgaaacttgg

SEQ ID NO: 22493 - DNA, 20 bp, Artificial Sequence
  chemically synthesized
ttggaaatgaaaatgaaact

SEQ ID NO: 22494 - DNA, 20 bp, Artificial Sequence
  chemically synthesized
attttcatttccaatgtgtt

SEQ ID NO: 22495 - DNA, 20 bp, Artificial Sequence
  chemically synthesized
cttactgcctctcaacacat

SEQ ID NO: 22496 - DNA, 20 bp, Artificial Sequence
  chemically synthesized
tttcatttccaatgtgttga

SEQ ID NO: 22497 - DNA, 20 bp, Artificial Sequence
  chemically synthesized
ttcatttccaatgtgttgag

SEQ ID NO: 22498 - DNA, 20 bp, Artificial Sequence
  chemically synthesized
atttccaatgtgttgagagg

SEQ ID NO: 22499 - DNA, 20 bp, Artificial Sequence
  chemically synthesized
ccaatgtgttgagaggcagt

SEQ ID NO: 22500 - DNA, 20 bp, Artificial Sequence
  chemically synthesized
caatgtgttgagaggcagta

SEQ ID NO: 22501 - DNA, 20 bp, Artificial Sequence
  chemically synthesized
atgtgttgagaggcagtaag

SEQ ID NO: 22502 - DNA, 20 bp, Artificial Sequence
  chemically synthesized
tccccagtttgtaatcagtt

SEQ ID NO: 22503 - DNA, 20 bp, Artificial Sequence
  chemically synthesized
taatgtccccagtttgtaat

SEQ ID NO: 22504 - DNA, 20 bp, Artificial Sequence
  chemically synthesized
acacttaactgattacaaac

SEQ ID NO: 22505 - DNA, 20 bp, Artificial Sequence
  chemically synthesized
cacttaactgattacaaact

SEQ ID NO: 22506 - DNA, 20 bp, Artificial Sequence
  chemically synthesized
acttaactgattacaaactg

SEQ ID NO: 22507 - DNA, 20 bp, Artificial Sequence
  chemically synthesized
ccgttggcctataatgtccc

SEQ ID NO: 22508 - DNA, 20 bp, Artificial Sequence
  chemically synthesized
attacaaactggggacatta

SEQ ID NO: 22509 - DNA, 20 bp, Artificial Sequence
  chemically synthesized
ttacaaactggggacattat

SEQ ID NO: 22510 - DNA, 20 bp, Artificial Sequence
  chemically synthesized
ctggggacattataggccaa

SEQ ID NO: 22511 - DNA, 20 bp, Artificial Sequence
  chemically synthesized
taagtggagagcatcaccgt

SEQ ID NO: 22512 - DNA, 20 bp, Artificial Sequence
  chemically synthesized
gaattcactatttaagtgga

SEQ ID NO: 22513 - DNA, 20 bp, Artificial Sequence
  chemically synthesized
gagaattcactatttaagtg

SEQ ID NO: 22514 - DNA, 20 bp, Artificial Sequence
  chemically synthesized
ggtgatgctctccacttaaa

SEQ ID NO: 22515 - DNA, 20 bp, Artificial Sequence
  chemically synthesized
tagagaattcactatttaag

SEQ ID NO: 22516 - DNA, 20 bp, Artificial Sequence
  chemically synthesized
ctatagagaattcactattt

SEQ ID NO: 22517 - DNA, 20 bp, Artificial Sequence
  chemically synthesized
cttaaatagtgaattctcta

SEQ ID NO: 22518 - DNA, 20 bp, Artificial Sequence
  chemically synthesized
aaatagtgaattctctatag

SEQ ID NO: 22519 - DNA, 20 bp, Artificial Sequence
  chemically synthesized
acccaattgtatccactata

SEQ ID NO: 22520 - DNA, 20 bp, Artificial Sequence
  chemically synthesized
taacccaattgtatccacta

SEQ ID NO: 22521 - DNA, 20 bp, Artificial Sequence
  chemically synthesized
ttctctatagtggatacaat

SEQ ID NO: 22522 - DNA, 20 bp, Artificial Sequence
  chemically synthesized
tctctatagtggatacaatt

SEQ ID NO: 22523 - DNA, 20 bp, Artificial Sequence
  chemically synthesized
gtggatacaattgggttatt

SEQ ID NO: 22524 - DNA, 20 bp, Artificial Sequence
  chemically synthesized
caatgtttccgtattgcaga

SEQ ID NO: 22525 - DNA, 20 bp, Artificial Sequence
  chemically synthesized
ttatttggctttctgcaata

SEQ ID NO: 22526 - DNA, 20 bp, Artificial Sequence
  chemically synthesized
ctatcaatgtttccgtattg

SEQ ID NO: 22527 - DNA, 20 bp, Artificial Sequence
  chemically synthesized
ctgcaatacggaaacattga

SEQ ID NO: 22528 - DNA, 20 bp, Artificial Sequence
  chemically synthesized
tgcaatacggaaacattgat

SEQ ID NO: 22529 - DNA, 20 bp, Artificial Sequence
  chemically synthesized
gcaatacggaaacattgata

SEQ ID NO: 22530 - DNA, 20 bp, Artificial Sequence
  chemically synthesized
atacggaaacattgataggg

SEQ ID NO: 22531 - DNA, 20 bp, Artificial Sequence
  chemically synthesized
tagggaagtgaaaaaaaaat

SEQ ID NO: 22532 - DNA, 20 bp, Artificial Sequence
  chemically synthesized
agtgaaaaaaaaataagatc

SEQ ID NO: 22533 - DNA, 20 bp, Artificial Sequence
  chemically synthesized
aaataagatcaagtgcttaa

SEQ ID NO: 22534 - DNA, 20 bp, Artificial Sequence
  chemically synthesized
ataagatcaagtgcttaata

SEQ ID NO: 22535 - DNA, 20 bp, Artificial Sequence
  chemically synthesized
taagatcaagtgcttaatag

SEQ ID NO: 22536 - DNA, 20 bp, Artificial Sequence
  chemically synthesized
tatgcacttccacctctatt

SEQ ID NO: 22537 - DNA, 20 bp, Artificial Sequence
  chemically synthesized
gatcaagtgcttaatagagg

SEQ ID NO: 22538 - DNA, 20 bp, Artificial Sequence
  chemically synthesized
caagtgcttaatagaggtgg

SEQ ID NO: 22539 - DNA, 20 bp, Artificial Sequence
  chemically synthesized
aggtggaagtgcatatttcc

SEQ ID NO: 22540 - DNA, 20 bp, Artificial Sequence
  chemically synthesized
ggtggaagtgcatatttcca

SEQ ID NO: 22541 - DNA, 20 bp, Artificial Sequence
  chemically synthesized
agtttgaattacagatgcct

SEQ ID NO: 22542 - DNA, 20 bp, Artificial Sequence
  chemically synthesized
ccagtgaagagtttgaatta

SEQ ID NO: 22543 - DNA, 20 bp, Artificial Sequence
  chemically synthesized
ctgtaattcaaactcttcac

SEQ ID NO: 22544 - DNA, 20 bp, Artificial Sequence
  chemically synthesized
gatttcctggtgccagtgaa

SEQ ID NO: 22545 - DNA, 20 bp, Artificial Sequence
  chemically synthesized
gtgatttcctggtgccagtg

SEQ ID NO: 22546 - DNA, 20 bp, Artificial Sequence
  chemically synthesized
ttcaaactcttcactggcac

SEQ ID NO: 22547 - DNA, 20 bp, Artificial Sequence
  chemically synthesized
tcaaactcttcactggcacc

SEQ ID NO: 22548 - DNA, 20 bp, Artificial Sequence
  chemically synthesized
tctcagtgatttcctggtgc

SEQ ID NO: 22549 - DNA, 20 bp, Artificial Sequence
  chemically synthesized
atgttatctcagtgatttcc

SEQ ID NO: 22550 - DNA, 20 bp, Artificial Sequence
  chemically synthesized
actggcaccaggaaatcact

SEQ ID NO: 22551 - DNA, 20 bp, Artificial Sequence
  chemically synthesized
gaaaattaatgatgttatct

SEQ ID NO: 22552 - DNA, 20 bp, Artificial Sequence
  chemically synthesized
aacatcattaattttcctta

SEQ ID NO: 22553 - DNA, 20 bp, Artificial Sequence
  chemically synthesized
tcattaattttccttaaagt

SEQ ID NO: 22554 - DNA, 20 bp, Artificial Sequence
  chemically synthesized
ttctaccaactctaacttta

SEQ ID NO: 22555 - DNA, 20 bp, Artificial Sequence
  chemically synthesized
attaattttccttaaagtta

SEQ ID NO: 22556 - DNA, 20 bp, Artificial Sequence
  chemically synthesized
cttctaccaactctaacttt

SEQ ID NO: 22557 - DNA, 20 bp, Artificial Sequence
  chemically synthesized
attttccttaaagttagagt

SEQ ID NO: 22558 - DNA, 20 bp, Artificial Sequence
  chemically synthesized
ttccttaaagttagagttgg

SEQ ID NO: 22559 - DNA, 20 bp, Artificial Sequence
  chemically synthesized
cttaaagttagagttggtag

SEQ ID NO: 22560 - DNA, 20 bp, Artificial Sequence
  chemically synthesized
aaagttagagttggtagaag

SEQ ID NO: 22561 - DNA, 20 bp, Artificial Sequence
  chemically synthesized
gagttggtagaagtggcctt

SEQ ID NO: 22562 - DNA, 20 bp, Artificial Sequence
  chemically synthesized
ttggtagaagtggcctttgg

SEQ ID NO: 22563 - DNA, 20 bp, Artificial Sequence
  chemically synthesized
tggtagaagtggcctttggt

SEQ ID NO: 22564 - DNA, 20 bp, Artificial Sequence
  chemically synthesized
ggtagaagtggcctttggta

SEQ ID NO: 22565 - DNA, 20 bp, Artificial Sequence
  chemically synthesized
tggctagctttccctaccaa

SEQ ID NO: 22566 - DNA, 20 bp, Artificial Sequence
  chemically synthesized
ctggctagctttccctacca

SEQ ID NO: 22567 - DNA, 20 bp, Artificial Sequence
  chemically synthesized
gaagtggcctttggtaggga

SEQ ID NO: 22568 - DNA, 20 bp, Artificial Sequence
  chemically synthesized
tggcctttggtagggaaagc

SEQ ID NO: 22569 - DNA, 20 bp, Artificial Sequence
  chemically synthesized
ctttggtagggaaagctagc

SEQ ID NO: 22570 - DNA, 20 bp, Artificial Sequence
  chemically synthesized
tttggtagggaaagctagcc

SEQ ID NO: 22571 - DNA, 20 bp, Artificial Sequence
  chemically synthesized
ttggtagggaaagctagcca

SEQ ID NO: 22572 - DNA, 20 bp, Artificial Sequence
  chemically synthesized
caaataaaacttgccctggc

SEQ ID NO: 22573 - DNA, 20 bp, Artificial Sequence
  chemically synthesized
tagggaaagctagccagggc

SEQ ID NO: 22574 - DNA, 20 bp, Artificial Sequence
  chemically synthesized
caggcaaataaaacttgccc

SEQ ID NO: 22575 - DNA, 20 bp, Artificial Sequence
  chemically synthesized
agttttatttgcctgtaccg

SEQ ID NO: 22576 - DNA, 20 bp, Artificial Sequence
  chemically synthesized
agagctattgtctgcggtac

SEQ ID NO: 22577 - DNA, 20 bp, Artificial Sequence
  chemically synthesized
aagagctattgtctgcggta

SEQ ID NO: 22578 - DNA, 20 bp, Artificial Sequence
  chemically synthesized
tttgcctgtaccgcagacaa

SEQ ID NO: 22579 - DNA, 20 bp, Artificial Sequence
  chemically synthesized
tgataaagagctattgtctg

SEQ ID NO: 22580 - DNA, 20 bp, Artificial Sequence
  chemically synthesized
cagacaatagctctttatca

SEQ ID NO: 22581 - DNA, 20 bp, Artificial Sequence
  chemically synthesized
gcctgcaaagccatgataaa

SEQ ID NO: 22582 - DNA, 20 bp, Artificial Sequence
  chemically synthesized
aagcctgcaaagccatgata

SEQ ID NO: 22583 - DNA, 20 bp, Artificial Sequence
  chemically synthesized
agctctttatcatggctttg

SEQ ID NO: 22584 - DNA, 20 bp, Artificial Sequence
  chemically synthesized
gctctttatcatggctttgc

SEQ ID NO: 22585 - DNA, 20 bp, Artificial Sequence
  chemically synthesized
ttgtcatttctaagcctgca

SEQ ID NO: 22586 - DNA, 20 bp, Artificial Sequence
  chemically synthesized
ttatcatggctttgcaggct

SEQ ID NO: 22587 - DNA, 20 bp, Artificial Sequence
  chemically synthesized
tccaggcttttgtcatttct

SEQ ID NO: 22588 - DNA, 20 bp, Artificial Sequence
  chemically synthesized
tgcaggcttagaaatgacaa

SEQ ID NO: 22589 - DNA, 20 bp, Artificial Sequence
  chemically synthesized
gcttagaaatgacaaaagcc

SEQ ID NO: 22590 - DNA, 20 bp, Artificial Sequence
  chemically synthesized
tagaaatgacaaaagcctgg

SEQ ID NO: 22591 - DNA, 20 bp, Artificial Sequence
  chemically synthesized
tttgcttagatttagcttcc

SEQ ID NO: 22592 - DNA, 20 bp, Artificial Sequence
  chemically synthesized
atttgcttagatttagcttc

SEQ ID NO: 22593 - DNA, 20 bp, Artificial Sequence
  chemically synthesized
aaagcctggaagctaaatct

SEQ ID NO: 22594 - DNA, 20 bp, Artificial Sequence
  chemically synthesized
attttatatttgcttagatt

SEQ ID NO: 22595 - DNA, 20 bp, Artificial Sequence
  chemically synthesized
ctcctaattttatatttgct

SEQ ID NO: 22596 - DNA, 20 bp, Artificial Sequence
  chemically synthesized
aatctaagcaaatataaaat

SEQ ID NO: 22597 - DNA, 20 bp, Artificial Sequence
  chemically synthesized
atctaagcaaatataaaatt

SEQ ID NO: 22598 - DNA, 20 bp, Artificial Sequence
  chemically synthesized
ctaagcaaatataaaattag

SEQ ID NO: 22599 - DNA, 20 bp, Artificial Sequence
  chemically synthesized
ttactttcaatatatgattt

SEQ ID NO: 22600 - DNA, 20 bp, Artificial Sequence
  chemically synthesized
attcttaaatcatatattga

SEQ ID NO: 22601 - DNA, 20 bp, Artificial Sequence
  chemically synthesized
ttaaatcatatattgaaagt

SEQ ID NO: 22602 - DNA, 20 bp, Artificial Sequence
  chemically synthesized
ccttttattgaacatatgtg

SEQ ID NO: 22603 - DNA, 20 bp, Artificial Sequence
  chemically synthesized
accacacatatgttcaataa

SEQ ID NO: 22604 - DNA, 20 bp, Artificial Sequence
  chemically synthesized
ccacacatatgttcaataaa

SEQ ID NO: 22605 - DNA, 20 bp, Artificial Sequence
  chemically synthesized
acatatgttcaataaaagga

SEQ ID NO: 22606 - DNA, 20 bp, Artificial Sequence
  chemically synthesized
catatgttcaataaaaggat

SEQ ID NO: 22607 - DNA, 20 bp, Artificial Sequence
  chemically synthesized
atatgttcaataaaaggatg

SEQ ID NO: 22608 - DNA, 20 bp, Artificial Sequence
  chemically synthesized
tagtaaaactatagaatgaa

SEQ ID NO: 22609 - DNA, 20 bp, Artificial Sequence
  chemically synthesized
ggggtgaactcttcattcta

SEQ ID NO: 22610 - DNA, 20 bp, Artificial Sequence
  chemically synthesized
tatagtaaaactatagaatg

SEQ ID NO: 22611 - DNA, 20 bp, Artificial Sequence
  chemically synthesized
tgccatatatagtaaaacta

SEQ ID NO: 22612 - DNA, 20 bp, Artificial Sequence
  chemically synthesized
ttctatagttttactatata

SEQ ID NO: 22613 - DNA, 20 bp, Artificial Sequence
  chemically synthesized
tgctaggagggtgccatata

SEQ ID NO: 22614 - DNA, 20 bp, Artificial Sequence
  chemically synthesized
tactatatatggcaccctcc

SEQ ID NO: 22615 - DNA, 20 bp, Artificial Sequence
  chemically synthesized
aattctcattaatgctagga

SEQ ID NO: 22616 - DNA, 20 bp, Artificial Sequence
  chemically synthesized
gaattctcattaatgctagg

SEQ ID NO: 22617 - DNA, 20 bp, Artificial Sequence
  chemically synthesized
tgaattctcattaatgctag

SEQ ID NO: 22618 - DNA, 20 bp, Artificial Sequence
  chemically synthesized
attgaattctcattaatgct

SEQ ID NO: 22619 - DNA, 20 bp, Artificial Sequence
  chemically synthesized
tattgaattctcattaatgc

SEQ ID NO: 22620 - DNA, 20 bp, Artificial Sequence
  chemically synthesized
ggcaccctcctagcattaat

SEQ ID NO: 22621 - DNA, 20 bp, Artificial Sequence
  chemically synthesized
tgagaattcaatacttaatt

SEQ ID NO: 22622 - DNA, 20 bp, Artificial Sequence
  chemically synthesized
aaggtgtatgtatctaaatt

SEQ ID NO: 22623 - DNA, 20 bp, Artificial Sequence
  chemically synthesized
agatacatacaccttaattt

SEQ ID NO: 22624 - DNA, 20 bp, Artificial Sequence
  chemically synthesized
attcaagtatgccaaaatta

SEQ ID NO: 22625 - DNA, 20 bp, Artificial Sequence
  chemically synthesized
gattcaagtatgccaaaatt

SEQ ID NO: 22626 - DNA, 20 bp, Artificial Sequence
  chemically synthesized
ctaatatgtgaaaaagattc

SEQ ID NO: 22627 - DNA, 20 bp, Artificial Sequence
  chemically synthesized
ggcttttctaatatgtgaaa

SEQ ID NO: 22628 - DNA, 20 bp, Artificial Sequence
  chemically synthesized
cttgaatctttttcacatat

SEQ ID NO: 22629 - DNA, 20 bp, Artificial Sequence
  chemically synthesized
atctttttcacatattagaa

SEQ ID NO: 22630 - DNA, 20 bp, Artificial Sequence
  chemically synthesized
catattagaaaagccatgct

SEQ ID NO: 22631 - DNA, 20 bp, Artificial Sequence
  chemically synthesized
ctgcatttcctttctgagca

SEQ ID NO: 22632 - DNA, 20 bp, Artificial Sequence
  chemically synthesized
ttagaaaagccatgctcaga

SEQ ID NO: 22633 - DNA, 20 bp, Artificial Sequence
  chemically synthesized
tagaaaagccatgctcagaa

SEQ ID NO: 22634 - DNA, 20 bp, Artificial Sequence
  chemically synthesized
attctctgcatttcctttct

SEQ ID NO: 22635 - DNA, 20 bp, Artificial Sequence
  chemically synthesized
ccatgctcagaaaggaaatg

SEQ ID NO: 22636 - DNA, 20 bp, Artificial Sequence
  chemically synthesized
atgctcagaaaggaaatgca

SEQ ID NO: 22637 - DNA, 20 bp, Artificial Sequence
  chemically synthesized
agaatttcaaattgatttaa

SEQ ID NO: 22638 - DNA, 20 bp, Artificial Sequence
  chemically synthesized
gatttaaaagtgaaaattta

SEQ ID NO: 22639 - DNA, 20 bp, Artificial Sequence
  chemically synthesized
taaagaaattattctacatt

SEQ ID NO: 22640 - DNA, 20 bp, Artificial Sequence
  chemically synthesized
aagaaattattctacattcg

SEQ ID NO: 22641 - DNA, 20 bp, Artificial Sequence
  chemically synthesized
ataaaggtaagctccgaatg

SEQ ID NO: 22642 - DNA, 20 bp, Artificial Sequence
  chemically synthesized
gataaccttgtaataaaggt

SEQ ID NO: 22643 - DNA, 20 bp, Artificial Sequence
  chemically synthesized
tcggagcttacctttattac

SEQ ID NO: 22644 - DNA, 20 bp, Artificial Sequence
  chemically synthesized
aggtgataaccttgtaataa

SEQ ID NO: 22645 - DNA, 20 bp, Artificial Sequence
  chemically synthesized
cggagcttacctttattaca

SEQ ID NO: 22646 - DNA, 20 bp, Artificial Sequence
  chemically synthesized
gaggtgataaccttgtaata

SEQ ID NO: 22647 - DNA, 20 bp, Artificial Sequence
  chemically synthesized
tacaaggttatcacctcaaa

SEQ ID NO: 22648 - DNA, 20 bp, Artificial Sequence
  chemically synthesized
tacaaaattttgtccatttg

SEQ ID NO: 22649 - DNA, 20 bp, Artificial Sequence
  chemically synthesized
atacaaaattttgtccattt

SEQ ID NO: 22650 - DNA, 20 bp, Artificial Sequence
  chemically synthesized
aataaactttgggaaaatgg

SEQ ID NO: 22651 - DNA, 20 bp, Artificial Sequence
  chemically synthesized
caataaactttgggaaaatg

SEQ ID NO: 22652 - DNA, 20 bp, Artificial Sequence
  chemically synthesized
ccaataaactttgggaaaat

SEQ ID NO: 22653 - DNA, 20 bp, Artificial Sequence
  chemically synthesized
tccaataaactttgggaaaa

SEQ ID NO: 22654 - DNA, 20 bp, Artificial Sequence
  chemically synthesized
gaaattcccccattttccca

SEQ ID NO: 22655 - DNA, 20 bp, Artificial Sequence
  chemically synthesized
tataatttccaataaacttt

SEQ ID NO: 22656 - DNA, 20 bp, Artificial Sequence
  chemically synthesized
ttataatttccaataaactt

SEQ ID NO: 22657 - DNA, 20 bp, Artificial Sequence
  chemically synthesized
cccattttcccaaagtttat

SEQ ID NO: 22658 - DNA, 20 bp, Artificial Sequence
  chemically synthesized
caaagtttattggaaattat

SEQ ID NO: 22659 - DNA, 20 bp, Artificial Sequence
  chemically synthesized
gaaattataagttgaaatga

SEQ ID NO: 22660 - DNA, 20 bp, Artificial Sequence
  chemically synthesized
caataaaacacatatgtgaa

SEQ ID NO: 22661 - DNA, 20 bp, Artificial Sequence
  chemically synthesized
atgtgaatggaatttttttt

SEQ ID NO: 22662 - DNA, 20 bp, Artificial Sequence
  chemically synthesized
tgaatggaattttttttgag

SEQ ID NO: 22663 - DNA, 20 bp, Artificial Sequence
  chemically synthesized
gaatggaattttttttgagc

SEQ ID NO: 22664 - DNA, 20 bp, Artificial Sequence
  chemically synthesized
aatcgaataatgcctaaatc

SEQ ID NO: 22665 - DNA, 20 bp, Artificial Sequence
  chemically synthesized
atcgaataatgcctaaatcc

SEQ ID NO: 22666 - DNA, 20 bp, Artificial Sequence
  chemically synthesized
tcgaataatgcctaaatcca

SEQ ID NO: 22667 - DNA, 20 bp, Artificial Sequence
  chemically synthesized
tccattttcaccctggattt

SEQ ID NO: 22668 - DNA, 20 bp, Artificial Sequence
  chemically synthesized
gtccattttcaccctggatt

SEQ ID NO: 22669 - DNA, 20 bp, Artificial Sequence
  chemically synthesized
tataatgtccattttcaccc

SEQ ID NO: 22670 - DNA, 20 bp, Artificial Sequence
  chemically synthesized
gcctaaatccagggtgaaaa

SEQ ID NO: 22671 - DNA, 20 bp, Artificial Sequence
  chemically synthesized
cagggtgaaaatggacatta

SEQ ID NO: 22672 - DNA, 20 bp, Artificial Sequence
  chemically synthesized
gtgaaaatggacattataga

SEQ ID NO: 22673 - DNA, 20 bp, Artificial Sequence
  chemically synthesized
tgaaaatggacattatagaa

SEQ ID NO: 22674 - DNA, 20 bp, Artificial Sequence
  chemically synthesized
atggacattatagaaaggaa

SEQ ID NO: 22675 - DNA, 20 bp, Artificial Sequence
  chemically synthesized
tagaaaggaacagtcattat

SEQ ID NO: 22676 - DNA, 20 bp, Artificial Sequence
  chemically synthesized
agaaaggaacagtcattata

SEQ ID NO: 22677 - DNA, 20 bp, Artificial Sequence
  chemically synthesized
cattataaggtttttccatc

SEQ ID NO: 22678 - DNA, 20 bp, Artificial Sequence
  chemically synthesized
aaacccagaaatagaccaga

SEQ ID NO: 22679 - DNA, 20 bp, Artificial Sequence
  chemically synthesized
aaagaaacccagaaatagac

SEQ ID NO: 22680 - DNA, 20 bp, Artificial Sequence
  chemically synthesized
ttttccatctggtctatttc

SEQ ID NO: 22681 - DNA, 20 bp, Artificial Sequence
  chemically synthesized
tttccatctggtctatttct

SEQ ID NO: 22682 - DNA, 20 bp, Artificial Sequence
  chemically synthesized
aaaaaaaagaaacccagaaa

SEQ ID NO: 22683 - DNA, 20 bp, Artificial Sequence
  chemically synthesized
aaaaaaaaaaaaaagaaacc

SEQ ID NO: 22684 - DNA, 20 bp, Artificial Sequence
  chemically synthesized
tactatggaaaaaaaaaaaa

SEQ ID NO: 22685 - DNA, 20 bp, Artificial Sequence
  chemically synthesized
ttcttttttttttttttcca

SEQ ID NO: 22686 - DNA, 20 bp, Artificial Sequence
  chemically synthesized
atttgttccagtttatacta

SEQ ID NO: 22687 - DNA, 20 bp, Artificial Sequence
  chemically synthesized
tttttttccatagtataaac

SEQ ID NO: 22688 - DNA, 20 bp, Artificial Sequence
  chemically synthesized
atagtataaactggaacaaa

SEQ ID NO: 22689 - DNA, 20 bp, Artificial Sequence
  chemically synthesized
cagaagctaaccatttgttc

SEQ ID NO: 22690 - DNA, 20 bp, Artificial Sequence
  chemically synthesized
tataaactggaacaaatggt

SEQ ID NO: 22691 - DNA, 20 bp, Artificial Sequence
  chemically synthesized
gtgagatcctaaaagttcag

SEQ ID NO: 22692 - DNA, 20 bp, Artificial Sequence
  chemically synthesized
atggttagcttctgaacttt

SEQ ID NO: 22693 - DNA, 20 bp, Artificial Sequence
  chemically synthesized
tggttagcttctgaactttt

SEQ ID NO: 22694 - DNA, 20 bp, Artificial Sequence
  chemically synthesized
cctgtgagatcctaaaagtt

SEQ ID NO: 22695 - DNA, 20 bp, Artificial Sequence
  chemically synthesized
atattcctgtgagatcctaa

SEQ ID NO: 22696 - DNA, 20 bp, Artificial Sequence
  chemically synthesized
tctgaacttttaggatctca

SEQ ID NO: 22697 - DNA, 20 bp, Artificial Sequence
  chemically synthesized
ctgaacttttaggatctcac

SEQ ID NO: 22698 - DNA, 20 bp, Artificial Sequence
  chemically synthesized
gtgctagagaatattcctgt

SEQ ID NO: 22699 - DNA, 20 bp, Artificial Sequence
  chemically synthesized
gatctcacaggaatattctc

SEQ ID NO: 22700 - DNA, 20 bp, Artificial Sequence
  chemically synthesized
ctggttatcatgaagtgcta

SEQ ID NO: 22701 - DNA, 20 bp, Artificial Sequence
  chemically synthesized
cactggttatcatgaagtgc

SEQ ID NO: 22702 - DNA, 20 bp, Artificial Sequence
  chemically synthesized
attaggcactggttatcatg

SEQ ID NO: 22703 - DNA, 20 bp, Artificial Sequence
  chemically synthesized
ctctagcacttcatgataac

SEQ ID NO: 22704 - DNA, 20 bp, Artificial Sequence
  chemically synthesized
ataaaggagtaattaggcac

SEQ ID NO: 22705 - DNA, 20 bp, Artificial Sequence
  chemically synthesized
cctttaataaaggagtaatt

SEQ ID NO: 22706 - DNA, 20 bp, Artificial Sequence
  chemically synthesized
tcctttaataaaggagtaat

SEQ ID NO: 22707 - DNA, 20 bp, Artificial Sequence
  chemically synthesized
actgctttcctttaataaag

SEQ ID NO: 22708 - DNA, 20 bp, Artificial Sequence
  chemically synthesized
gcctaattactcctttatta

SEQ ID NO: 22709 - DNA, 20 bp, Artificial Sequence
  chemically synthesized
cctaattactcctttattaa

SEQ ID NO: 22710 - DNA, 20 bp, Artificial Sequence
  chemically synthesized
ctactgctttcctttaataa

SEQ ID NO: 22711 - DNA, 20 bp, Artificial Sequence
  chemically synthesized
gctactgctttcctttaata

SEQ ID NO: 22712 - DNA, 20 bp, Artificial Sequence
  chemically synthesized
attactcctttattaaagga

SEQ ID NO: 22713 - DNA, 20 bp, Artificial Sequence
  chemically synthesized
actcctttattaaaggaaag

SEQ ID NO: 22714 - DNA, 20 bp, Artificial Sequence
  chemically synthesized
cctttattaaaggaaagcag

SEQ ID NO: 22715 - DNA, 20 bp, Artificial Sequence
  chemically synthesized
ttaaaggaaagcagtagctc

SEQ ID NO: 22716 - DNA, 20 bp, Artificial Sequence
  chemically synthesized
taaaggaaagcagtagctct

SEQ ID NO: 22717 - DNA, 20 bp, Artificial Sequence
  chemically synthesized
ggaaagcagtagctctggga

SEQ ID NO: 22718 - DNA, 20 bp, Artificial Sequence
  chemically synthesized
gaaagcagtagctctgggat

SEQ ID NO: 22719 - DNA, 20 bp, Artificial Sequence
  chemically synthesized
aaagcagtagctctgggatg

SEQ ID NO: 22720 - DNA, 20 bp, Artificial Sequence
  chemically synthesized
cctgcccctgccccatccca

SEQ ID NO: 22721 - DNA, 20 bp, Artificial Sequence
  chemically synthesized
cccctgcccctgccccatcc

SEQ ID NO: 22722 - DNA, 20 bp, Artificial Sequence
  chemically synthesized
gcagtagctctgggatgggg

SEQ ID NO: 22723 - DNA, 20 bp, Artificial Sequence
  chemically synthesized
cagtagctctgggatggggc

SEQ ID NO: 22724 - DNA, 20 bp, Artificial Sequence
  chemically synthesized
agtagctctgggatggggca

SEQ ID NO: 22725 - DNA, 20 bp, Artificial Sequence
  chemically synthesized
gtagctctgggatggggcag

SEQ ID NO: 22726 - DNA, 20 bp, Artificial Sequence
  chemically synthesized
gctctgggatggggcagggg

SEQ ID NO: 22727 - DNA, 20 bp, Artificial Sequence
  chemically synthesized
ctctgggatggggcaggggc

SEQ ID NO: 22728 - DNA, 20 bp, Artificial Sequence
  chemically synthesized
tctgggatggggcaggggca

SEQ ID NO: 22729 - DNA, 20 bp, Artificial Sequence
  chemically synthesized
ctgggatggggcaggggcag

SEQ ID NO: 22730 - DNA, 20 bp, Artificial Sequence
  chemically synthesized
ggatggggcaggggcagggg

SEQ ID NO: 22731 - DNA, 20 bp, Artificial Sequence
  chemically synthesized
gatggggcaggggcaggggc

SEQ ID NO: 22732 - DNA, 20 bp, Artificial Sequence
  chemically synthesized
atggggcaggggcaggggca

SEQ ID NO: 22733 - DNA, 20 bp, Artificial Sequence
  chemically synthesized
tggggcaggggcaggggcag

SEQ ID NO: 22734 - DNA, 20 bp, Artificial Sequence
  chemically synthesized
ggcaggggcaggggcagggg

SEQ ID NO: 22735 - DNA, 20 bp, Artificial Sequence
  chemically synthesized
gcaggggcaggggcaggggc

SEQ ID NO: 22736 - DNA, 20 bp, Artificial Sequence
  chemically synthesized
ggcaggggcaggggcaggtg

SEQ ID NO: 22737 - DNA, 20 bp, Artificial Sequence
  chemically synthesized
ggcaggggcaggtgaagaaa

SEQ ID NO: 22738 - DNA, 20 bp, Artificial Sequence
  chemically synthesized
caggggcaggtgaagaaaaa

SEQ ID NO: 22739 - DNA, 20 bp, Artificial Sequence
  chemically synthesized
aggggcaggtgaagaaaaag

SEQ ID NO: 22740 - DNA, 20 bp, Artificial Sequence
  chemically synthesized
gcaggtgaagaaaaagaggc

SEQ ID NO: 22741 - DNA, 20 bp, Artificial Sequence
  chemically synthesized
gtcagggggctgaatagaga

SEQ ID NO: 22742 - DNA, 20 bp, Artificial Sequence
  chemically synthesized
gcaagaaaactttctctatt

SEQ ID NO: 22743 - DNA, 20 bp, Artificial Sequence
  chemically synthesized
tcgagtcagggggctgaata

SEQ ID NO: 22744 - DNA, 20 bp, Artificial Sequence
  chemically synthesized
gatcgagtcagggggctgaa

SEQ ID NO: 22745 - DNA, 20 bp, Artificial Sequence
  chemically synthesized
tgggatgggatcgagtcagg

SEQ ID NO: 22746 - DNA, 20 bp, Artificial Sequence
  chemically synthesized
ttgggatgggatcgagtcag

SEQ ID NO: 22747 - DNA, 20 bp, Artificial Sequence
  chemically synthesized
tttgggatgggatcgagtca

SEQ ID NO: 22748 - DNA, 20 bp, Artificial Sequence
  chemically synthesized
gtttgggatgggatcgagtc

SEQ ID NO: 22749 - DNA, 20 bp, Artificial Sequence
  chemically synthesized
agtttgggatgggatcgagt

SEQ ID NO: 22750 - DNA, 20 bp, Artificial Sequence
  chemically synthesized
aagtagtttgggatgggatc

SEQ ID NO: 22751 - DNA, 20 bp, Artificial Sequence
  chemically synthesized
gggaaaaagtagtttgggat

SEQ ID NO: 22752 - DNA, 20 bp, Artificial Sequence
  chemically synthesized
tgggaaaaagtagtttggga

SEQ ID NO: 22753 - DNA, 20 bp, Artificial Sequence
  chemically synthesized
tagctgggaaaaagtagttt

SEQ ID NO: 22754 - DNA, 20 bp, Artificial Sequence
  chemically synthesized
atagctgggaaaaagtagtt

SEQ ID NO: 22755 - DNA, 20 bp, Artificial Sequence
  chemically synthesized
acgtcatagctgggaaaaag

SEQ ID NO: 22756 - DNA, 20 bp, Artificial Sequence
  chemically synthesized
catcccaaactactttttcc

SEQ ID NO: 22757 - DNA, 20 bp, Artificial Sequence
  chemically synthesized
aatacgtcatagctgggaaa

SEQ ID NO: 22758 - DNA, 20 bp, Artificial Sequence
  chemically synthesized
cctgttaatacgtcatagct

SEQ ID NO: 22759 - DNA, 20 bp, Artificial Sequence
  chemically synthesized
acctgttaatacgtcatagc

SEQ ID NO: 22760 - DNA, 20 bp, Artificial Sequence
  chemically synthesized
taggacctgttaatacgtca

SEQ ID NO: 22761 - DNA, 20 bp, Artificial Sequence
  chemically synthesized
tcccagctatgacgtattaa

SEQ ID NO: 22762 - DNA, 20 bp, Artificial Sequence
  chemically synthesized
cccagctatgacgtattaac

SEQ ID NO: 22763 - DNA, 20 bp, Artificial Sequence
  chemically synthesized
atgacgtattaacaggtcct

SEQ ID NO: 22764 - DNA, 20 bp, Artificial Sequence
  chemically synthesized
tgacgtattaacaggtccta

SEQ ID NO: 22765 - DNA, 20 bp, Artificial Sequence
  chemically synthesized
tccaggtcgagggtttcctt

SEQ ID NO: 22766 - DNA, 20 bp, Artificial Sequence
  chemically synthesized
ttccaggtcgagggtttcct

SEQ ID NO: 22767 - DNA, 20 bp, Artificial Sequence
  chemically synthesized
tcctaaggaaaccctcgacc

SEQ ID NO: 22768 - DNA, 20 bp, Artificial Sequence
  chemically synthesized
taaagggctttccaggtcga

SEQ ID NO: 22769 - DNA, 20 bp, Artificial Sequence
  chemically synthesized
ttaaagggctttccaggtcg

SEQ ID NO: 22770 - DNA, 20 bp, Artificial Sequence
  chemically synthesized
tttaaagggctttccaggtc

SEQ ID NO: 22771 - DNA, 20 bp, Artificial Sequence
  chemically synthesized
aaggaaaccctcgacctgga

SEQ ID NO: 22772 - DNA, 20 bp, Artificial Sequence
  chemically synthesized
tggtgtttaaagggctttcc

SEQ ID NO: 22773 - DNA, 20 bp, Artificial Sequence
  chemically synthesized
ctggtgtttaaagggctttc

SEQ ID NO: 22774 - DNA, 20 bp, Artificial Sequence
  chemically synthesized
aagtttaactggtgtttaaa

SEQ ID NO: 22775 - DNA, 20 bp, Artificial Sequence
  chemically synthesized
caagtttaactggtgtttaa

SEQ ID NO: 22776 - DNA, 20 bp, Artificial Sequence
  chemically synthesized
ctggaaagccctttaaacac

SEQ ID NO: 22777 - DNA, 20 bp, Artificial Sequence
  chemically synthesized
ccaagtttaactggtgttta

SEQ ID NO: 22778 - DNA, 20 bp, Artificial Sequence
  chemically synthesized
atatagttgccaagtttaac

SEQ ID NO: 22779 - DNA, 20 bp, Artificial Sequence
  chemically synthesized
ctttaaacaccagttaaact

SEQ ID NO: 22780 - DNA, 20 bp, Artificial Sequence
  chemically synthesized
ttttcagctatatagttgcc

SEQ ID NO: 22781 - DNA, 20 bp, Artificial Sequence
  chemically synthesized
agttaaacttggcaactata

SEQ ID NO: 22782 - DNA, 20 bp, Artificial Sequence
  chemically synthesized
gttatcatttttcagctata

SEQ ID NO: 22783 - DNA, 20 bp, Artificial Sequence
  chemically synthesized
agcccgaagttatcattttt

SEQ ID NO: 22784 - DNA, 20 bp, Artificial Sequence
  chemically synthesized
tagctgaaaaatgataactt

SEQ ID NO: 22785 - DNA, 20 bp, Artificial Sequence
  chemically synthesized
agctgaaaaatgataacttc

SEQ ID NO: 22786 - DNA, 20 bp, Artificial Sequence
  chemically synthesized
ttccatttccttatagcccg

SEQ ID NO: 22787 - DNA, 20 bp, Artificial Sequence
  chemically synthesized
aaatgataacttcgggctat

SEQ ID NO: 22788 - DNA, 20 bp, Artificial Sequence
  chemically synthesized
aatgataacttcgggctata

SEQ ID NO: 22789 - DNA, 20 bp, Artificial Sequence
  chemically synthesized
ccaaggcttccatttcctta

SEQ ID NO: 22790 - DNA, 20 bp, Artificial Sequence
  chemically synthesized
aacttcgggctataaggaaa

SEQ ID NO: 22791 - DNA, 20 bp, Artificial Sequence
  chemically synthesized
ttcgggctataaggaaatgg

SEQ ID NO: 22792 - DNA, 20 bp, Artificial Sequence
  chemically synthesized
ctataaggaaatggaagcct

SEQ ID NO: 22793 - DNA, 20 bp, Artificial Sequence
  chemically synthesized
gcatgaatgaaagtaaacca

SEQ ID NO: 22794 - DNA, 20 bp, Artificial Sequence
  chemically synthesized
tgcatgaatgaaagtaaacc

SEQ ID NO: 22795 - DNA, 20 bp, Artificial Sequence
  chemically synthesized
tgagatgaatgcatgaatga

SEQ ID NO: 22796 - DNA, 20 bp, Artificial Sequence
  chemically synthesized
atggttcaatatgttttcat

SEQ ID NO: 22797 - DNA, 20 bp, Artificial Sequence
  chemically synthesized
acaaaacctggcacacagca

SEQ ID NO: 22798 - DNA, 20 bp, Artificial Sequence
  chemically synthesized
tattgaaccatgctgtgtgc

SEQ ID NO: 22799 - DNA, 20 bp, Artificial Sequence
  chemically synthesized
attgaaccatgctgtgtgcc

SEQ ID NO: 22800 - DNA, 20 bp, Artificial Sequence
  chemically synthesized
ttagtacaaaacctggcaca

SEQ ID NO: 22801 - DNA, 20 bp, Artificial Sequence
  chemically synthesized
ccaatgcttagtacaaaacc

SEQ ID NO: 22802 - DNA, 20 bp, Artificial Sequence
  chemically synthesized
tgtgtgccaggttttgtact

SEQ ID NO: 22803 - DNA, 20 bp, Artificial Sequence
  chemically synthesized
ccaggttttgtactaagcat

SEQ ID NO: 22804 - DNA, 20 bp, Artificial Sequence
  chemically synthesized
caggttttgtactaagcatt

SEQ ID NO: 22805 - DNA, 20 bp, Artificial Sequence
  chemically synthesized
aggttttgtactaagcattg

SEQ ID NO: 22806 - DNA, 20 bp, Artificial Sequence
  chemically synthesized
atcttggtatccccaatgct

SEQ ID NO: 22807 - DNA, 20 bp, Artificial Sequence
  chemically synthesized
tactaagcattggggatacc

SEQ ID NO: 22808 - DNA, 20 bp, Artificial Sequence
  chemically synthesized
gcattggggataccaagatg

SEQ ID NO: 22809 - DNA, 20 bp, Artificial Sequence
  chemically synthesized
cattggggataccaagatga

SEQ ID NO: 22810 - DNA, 20 bp, Artificial Sequence
  chemically synthesized
attggggataccaagatgaa

SEQ ID NO: 22811 - DNA, 20 bp, Artificial Sequence
  chemically synthesized
taggccttttcccttcatct

SEQ ID NO: 22812 - DNA, 20 bp, Artificial Sequence
  chemically synthesized
ggataccaagatgaagggaa

SEQ ID NO: 22813 - DNA, 20 bp, Artificial Sequence
  chemically synthesized
gataccaagatgaagggaaa

SEQ ID NO: 22814 - DNA, 20 bp, Artificial Sequence
  chemically synthesized
caagatgaagggaaaaggcc

SEQ ID NO: 22815 - DNA, 20 bp, Artificial Sequence
  chemically synthesized
attatttggaaagagagact

SEQ ID NO: 22816 - DNA, 20 bp, Artificial Sequence
  chemically synthesized
aattatttggaaagagagac

SEQ ID NO: 22817 - DNA, 20 bp, Artificial Sequence
  chemically synthesized
agtggaattatttggaaaga

SEQ ID NO: 22818 - DNA, 20 bp, Artificial Sequence
  chemically synthesized
gaagtggaattatttggaaa

SEQ ID NO: 22819 - DNA, 20 bp, Artificial Sequence
  chemically synthesized
tagaagtggaattatttgga

SEQ ID NO: 22820 - DNA, 20 bp, Artificial Sequence
  chemically synthesized
gccttagaagtggaattatt

SEQ ID NO: 22821 - DNA, 20 bp, Artificial Sequence
  chemically synthesized
ttccaaataattccacttct

SEQ ID NO: 22822 - DNA, 20 bp, Artificial Sequence
  chemically synthesized
tccaaataattccacttcta

SEQ ID NO: 22823 - DNA, 20 bp, Artificial Sequence
  chemically synthesized
gagaagaaatgccttagaag

SEQ ID NO: 22824 - DNA, 20 bp, Artificial Sequence
  chemically synthesized
atagagaagaaatgccttag

SEQ ID NO: 22825 - DNA, 20 bp, Artificial Sequence
  chemically synthesized
gagatagagaagaaatgcct

SEQ ID NO: 22826 - DNA, 20 bp, Artificial Sequence
  chemically synthesized
gttcttacacagagatagag

SEQ ID NO: 22827 - DNA, 20 bp, Artificial Sequence
  chemically synthesized
atggttcttacacagagata

SEQ ID NO: 22828 - DNA, 20 bp, Artificial Sequence
  chemically synthesized
atatggttcttacacagaga

SEQ ID NO: 22829 - DNA, 20 bp, Artificial Sequence
  chemically synthesized
tttcttctctatctctgtgt

SEQ ID NO: 22830 - DNA, 20 bp, Artificial Sequence
  chemically synthesized
tggcatatggttcttacaca

SEQ ID NO: 22831 - DNA, 20 bp, Artificial Sequence
  chemically synthesized
cttggcatatggttcttaca

SEQ ID NO: 22832 - DNA, 20 bp, Artificial Sequence
  chemically synthesized
ctgtgtaagaaccatatgcc

SEQ ID NO: 22833 - DNA, 20 bp, Artificial Sequence
  chemically synthesized
tcaaggagtcacttggcata

SEQ ID NO: 22834 - DNA, 20 bp, Artificial Sequence
  chemically synthesized
aagatagtcaaggagtcact

SEQ ID NO: 22835 - DNA, 20 bp, Artificial Sequence
  chemically synthesized
ctagcaataagatagtcaag

SEQ ID NO: 22836 - DNA, 20 bp, Artificial Sequence
  chemically synthesized
ggctagcaataagatagtca

SEQ ID NO: 22837 - DNA, 20 bp, Artificial Sequence
  chemically synthesized
aggctagcaataagatagtc

SEQ ID NO: 22838 - DNA, 20 bp, Artificial Sequence
  chemically synthesized
tgcagaggctagcaataaga

SEQ ID NO: 22839 - DNA, 20 bp, Artificial Sequence
  chemically synthesized
ctccttgactatcttattgc

SEQ ID NO: 22840 - DNA, 20 bp, Artificial Sequence
  chemically synthesized
gatctgcagaggctagcaat

SEQ ID NO: 22841 - DNA, 20 bp, Artificial Sequence
  chemically synthesized
tatcttattgctagcctctg

SEQ ID NO: 22842 - DNA, 20 bp, Artificial Sequence
  chemically synthesized
accagaggatctgcagaggc

SEQ ID NO: 22843 - DNA, 20 bp, Artificial Sequence
  chemically synthesized
ttcaaccagaggatctgcag

SEQ ID NO: 22844 - DNA, 20 bp, Artificial Sequence
  chemically synthesized
gttcaaccagaggatctgca

SEQ ID NO: 22845 - DNA, 20 bp, Artificial Sequence
  chemically synthesized
gggttcaaccagaggatctg

SEQ ID NO: 22846 - DNA, 20 bp, Artificial Sequence
  chemically synthesized
gctagcctctgcagatcctc

SEQ ID NO: 22847 - DNA, 20 bp, Artificial Sequence
  chemically synthesized
aaataaaggggttcaaccag

SEQ ID NO: 22848 - DNA, 20 bp, Artificial Sequence
  chemically synthesized
gaaataaaggggttcaacca

SEQ ID NO: 22849 - DNA, 20 bp, Artificial Sequence
  chemically synthesized
cagaaataaaggggttcaac

SEQ ID NO: 22850 - DNA, 20 bp, Artificial Sequence
  chemically synthesized
ccaggtcttcagaaataaag

SEQ ID NO: 22851 - DNA, 20 bp, Artificial Sequence
  chemically synthesized
gccaggtcttcagaaataaa

SEQ ID NO: 22852 - DNA, 20 bp, Artificial Sequence
  chemically synthesized
tgccaggtcttcagaaataa

SEQ ID NO: 22853 - DNA, 20 bp, Artificial Sequence
  chemically synthesized
ctgccaggtcttcagaaata

SEQ ID NO: 22854 - DNA, 20 bp, Artificial Sequence
  chemically synthesized
gttgaacccctttatttctg

SEQ ID NO: 22855 - DNA, 20 bp, Artificial Sequence
  chemically synthesized
cccctttatttctgaagacc

SEQ ID NO: 22856 - DNA, 20 bp, Artificial Sequence
  chemically synthesized
aaccctggctgccaggtctt

SEQ ID NO: 22857 - DNA, 20 bp, Artificial Sequence
  chemically synthesized
ctttatttctgaagacctgg

SEQ ID NO: 22858 - DNA, 20 bp, Artificial Sequence
  chemically synthesized
atttctgaagacctggcagc

SEQ ID NO: 22859 - DNA, 20 bp, Artificial Sequence
  chemically synthesized
tttctgaagacctggcagcc

SEQ ID NO: 22860 - DNA, 20 bp, Artificial Sequence
  chemically synthesized
gaccgtgaaccctggctgcc

SEQ ID NO: 22861 - DNA, 20 bp, Artificial Sequence
  chemically synthesized
ttctgaagacctggcagcca

SEQ ID NO: 22862 - DNA, 20 bp, Artificial Sequence
  chemically synthesized
ggaccgtgaaccctggctgc

SEQ ID NO: 22863 - DNA, 20 bp, Artificial Sequence
  chemically synthesized
gacctggcagccagggttca

SEQ ID NO: 22864 - DNA, 20 bp, Artificial Sequence
  chemically synthesized
aagagaaggaccgtgaaccc

SEQ ID NO: 22865 - DNA, 20 bp, Artificial Sequence
  chemically synthesized
cgagaactgggcaaaagaga

SEQ ID NO: 22866 - DNA, 20 bp, Artificial Sequence
  chemically synthesized
gcgagaactgggcaaaagag

SEQ ID NO: 22867 - DNA, 20 bp, Artificial Sequence
  chemically synthesized
cacggtccttctcttttgcc

SEQ ID NO: 22868 - DNA, 20 bp, Artificial Sequence
  chemically synthesized
ggagcgagaactgggcaaaa

SEQ ID NO: 22869 - DNA, 20 bp, Artificial Sequence
  chemically synthesized
ttggagcgagaactgggcaa

SEQ ID NO: 22870 - DNA, 20 bp, Artificial Sequence
  chemically synthesized
gcagaattggagcgagaact

SEQ ID NO: 22871 - DNA, 20 bp, Artificial Sequence
  chemically synthesized
tgcagaattggagcgagaac

SEQ ID NO: 22872 - DNA, 20 bp, Artificial Sequence
  chemically synthesized
aaatcatgcagaattggagc

SEQ ID NO: 22873 - DNA, 20 bp, Artificial Sequence
  chemically synthesized
gttgaaatcatgcagaattg

SEQ ID NO: 22874 - DNA, 20 bp, Artificial Sequence
  chemically synthesized
atgttgaaatcatgcagaat

SEQ ID NO: 22875 - DNA, 20 bp, Artificial Sequence
  chemically synthesized
atgccaatgttgaaatcatg

SEQ ID NO: 22876 - DNA, 20 bp, Artificial Sequence
  chemically synthesized
attctgcatgatttcaacat

SEQ ID NO: 22877 - DNA, 20 bp, Artificial Sequence
  chemically synthesized
gcatgatttcaacattggca

SEQ ID NO: 22878 - DNA, 20 bp, Artificial Sequence
  chemically synthesized
catgatttcaacattggcat

SEQ ID NO: 22879 - DNA, 20 bp, Artificial Sequence
  chemically synthesized
atgatttcaacattggcatg

SEQ ID NO: 22880 - DNA, 20 bp, Artificial Sequence
  chemically synthesized
tgatttcaacattggcatgg

SEQ ID NO: 22881 - DNA, 20 bp, Artificial Sequence
  chemically synthesized
gagaggctagaatgatgcat

SEQ ID NO: 22882 - DNA, 20 bp, Artificial Sequence
  chemically synthesized
gggggactcatgcatcattc

SEQ ID NO: 22883 - DNA, 20 bp, Artificial Sequence
  chemically synthesized
catgcatcattctagcctct

SEQ ID NO: 22884 - DNA, 20 bp, Artificial Sequence
  chemically synthesized
aagttaaggaactgagaggc

SEQ ID NO: 22885 - DNA, 20 bp, Artificial Sequence
  chemically synthesized
tagcaagttaaggaactgag

SEQ ID NO: 22886 - DNA, 20 bp, Artificial Sequence
  chemically synthesized
atagcaagttaaggaactga

SEQ ID NO: 22887 - DNA, 20 bp, Artificial Sequence
  chemically synthesized
aaatagcaagttaaggaact

SEQ ID NO: 22888 - DNA, 20 bp, Artificial Sequence
  chemically synthesized
ggaggtgaaatagcaagtta

SEQ ID NO: 22889 - DNA, 20 bp, Artificial Sequence
  chemically synthesized
tggaggtgaaatagcaagtt

SEQ ID NO: 22890 - DNA, 20 bp, Artificial Sequence
  chemically synthesized
ttccatggaggtgaaatagc

SEQ ID NO: 22891 - DNA, 20 bp, Artificial Sequence
  chemically synthesized
gaatttccatggaggtgaaa

SEQ ID NO: 22892 - DNA, 20 bp, Artificial Sequence
  chemically synthesized
aacttgctatttcacctcca

SEQ ID NO: 22893 - DNA, 20 bp, Artificial Sequence
  chemically synthesized
gtggatgtgaatttccatgg

SEQ ID NO: 22894 - DNA, 20 bp, Artificial Sequence
  chemically synthesized
agtggatgtgaatttccatg

SEQ ID NO: 22895 - DNA, 20 bp, Artificial Sequence
  chemically synthesized
agagtggatgtgaatttcca

SEQ ID NO: 22896 - DNA, 20 bp, Artificial Sequence
  chemically synthesized
agtaggtggcagaggtagag

SEQ ID NO: 22897 - DNA, 20 bp, Artificial Sequence
  chemically synthesized
ttgagtaggtggcagaggta

SEQ ID NO: 22898 - DNA, 20 bp, Artificial Sequence
  chemically synthesized
atttgagtaggtggcagagg

SEQ ID NO: 22899 - DNA, 20 bp, Artificial Sequence
  chemically synthesized
gccatttgagtaggtggcag

SEQ ID NO: 22900 - DNA, 20 bp, Artificial Sequence
  chemically synthesized
agccatttgagtaggtggca

SEQ ID NO: 22901 - DNA, 20 bp, Artificial Sequence
  chemically synthesized
atagccatttgagtaggtgg

SEQ ID NO: 22902 - DNA, 20 bp, Artificial Sequence
  chemically synthesized
gatatagccatttgagtagg

SEQ ID NO: 22903 - DNA, 20 bp, Artificial Sequence
  chemically synthesized
acctctgccacctactcaaa

SEQ ID NO: 22904 - DNA, 20 bp, Artificial Sequence
  chemically synthesized
taggatatagccatttgagt

SEQ ID NO: 22905 - DNA, 20 bp, Artificial Sequence
  chemically synthesized
ctaggatatagccatttgag

SEQ ID NO: 22906 - DNA, 20 bp, Artificial Sequence
  chemically synthesized
gatctaggatatagccattt

SEQ ID NO: 22907 - DNA, 20 bp, Artificial Sequence
  chemically synthesized
ctactcaaatggctatatcc

SEQ ID NO: 22908 - DNA, 20 bp, Artificial Sequence
  chemically synthesized
aggtgattagatctaggata

SEQ ID NO: 22909 - DNA, 20 bp, Artificial Sequence
  chemically synthesized
agtttcaggtgattagatct

SEQ ID NO: 22910 - DNA, 20 bp, Artificial Sequence
  chemically synthesized
cagtttcaggtgattagatc

SEQ ID NO: 22911 - DNA, 20 bp, Artificial Sequence
  chemically synthesized
gtggaacagtttcaggtgat

SEQ ID NO: 22912 - DNA, 20 bp, Artificial Sequence
  chemically synthesized
tttgaaggtggaacagtttc

SEQ ID NO: 22913 - DNA, 20 bp, Artificial Sequence
  chemically synthesized
ttttgaaggtggaacagttt

SEQ ID NO: 22914 - DNA, 20 bp, Artificial Sequence
  chemically synthesized
acattattttgaaggtggaa

SEQ ID NO: 22915 - DNA, 20 bp, Artificial Sequence
  chemically synthesized
gatgaacattattttgaagg

SEQ ID NO: 22916 - DNA, 20 bp, Artificial Sequence
  chemically synthesized
atagatgaacattattttga

SEQ ID NO: 22917 - DNA, 20 bp, Artificial Sequence
  chemically synthesized
catagatgaacattattttg

SEQ ID NO: 22918 - DNA, 20 bp, Artificial Sequence
  chemically synthesized
gttgtggtcagagagaatca

SEQ ID NO: 22919 - DNA, 20 bp, Artificial Sequence
  chemically synthesized
gtcaagaagttgtggtcaga

SEQ ID NO: 22920 - DNA, 20 bp, Artificial Sequence
  chemically synthesized
aggtcaagaagttgtggtca

SEQ ID NO: 22921 - DNA, 20 bp, Artificial Sequence
  chemically synthesized
gaaggtcaagaagttgtggt

SEQ ID NO: 22922 - DNA, 20 bp, Artificial Sequence
  chemically synthesized
aactgaaggtcaagaagttg

SEQ ID NO: 22923 - DNA, 20 bp, Artificial Sequence
  chemically synthesized
taaaggaactgaaggtcaag

SEQ ID NO: 22924 - DNA, 20 bp, Artificial Sequence
  chemically synthesized
gaccacaacttcttgacctt

SEQ ID NO: 22925 - DNA, 20 bp, Artificial Sequence
  chemically synthesized
tagtaaaggaactgaaggtc

SEQ ID NO: 22926 - DNA, 20 bp, Artificial Sequence
  chemically synthesized
agaagtagtaaaggaactga

SEQ ID NO: 22927 - DNA, 20 bp, Artificial Sequence
  chemically synthesized
aagaagtagtaaaggaactg

SEQ ID NO: 22928 - DNA, 20 bp, Artificial Sequence
  chemically synthesized
ggtaggggaagaagtagtaa

SEQ ID NO: 22929 - DNA, 20 bp, Artificial Sequence
  chemically synthesized
aggtaggggaagaagtagta

SEQ ID NO: 22930 - DNA, 20 bp, Artificial Sequence
  chemically synthesized
cagggaggtaggggaagaag

SEQ ID NO: 22931 - DNA, 20 bp, Artificial Sequence
  chemically synthesized
cttcagggaggtaggggaag

SEQ ID NO: 22932 - DNA, 20 bp, Artificial Sequence
  chemically synthesized
actcttcagggaggtagggg

SEQ ID NO: 22933 - DNA, 20 bp, Artificial Sequence
  chemically synthesized
ctaactcttcagggaggtag

SEQ ID NO: 22934 - DNA, 20 bp, Artificial Sequence
  chemically synthesized
gctaactcttcagggaggta

SEQ ID NO: 22935 - DNA, 20 bp, Artificial Sequence
  chemically synthesized
tgctaactcttcagggaggt

SEQ ID NO: 22936 - DNA, 20 bp, Artificial Sequence
  chemically synthesized
atgctaactcttcagggagg

SEQ ID NO: 22937 - DNA, 20 bp, Artificial Sequence
  chemically synthesized
cttcttcccctacctccctg

SEQ ID NO: 22938 - DNA, 20 bp, Artificial Sequence
  chemically synthesized
tcttcccctacctccctgaa

SEQ ID NO: 22939 - DNA, 20 bp, Artificial Sequence
  chemically synthesized
aaaatgctaactcttcaggg

SEQ ID NO: 22940 - DNA, 20 bp, Artificial Sequence
  chemically synthesized
gaaaatgctaactcttcagg

SEQ ID NO: 22941 - DNA, 20 bp, Artificial Sequence
  chemically synthesized
atgaaaatgctaactcttca

SEQ ID NO: 22942 - DNA, 20 bp, Artificial Sequence
  chemically synthesized
cccctacctccctgaagagt

SEQ ID NO: 22943 - DNA, 20 bp, Artificial Sequence
  chemically synthesized
gatgaaaatgctaactcttc

SEQ ID NO: 22944 - DNA, 20 bp, Artificial Sequence
  chemically synthesized
ggatgaaaatgctaactctt

SEQ ID NO: 22945 - DNA, 20 bp, Artificial Sequence
  chemically synthesized
actggtaattaggaggtaga

SEQ ID NO: 22946 - DNA, 20 bp, Artificial Sequence
  chemically synthesized
aactggtaattaggaggtag

SEQ ID NO: 22947 - DNA, 20 bp, Artificial Sequence
  chemically synthesized
aaactggtaattaggaggta

SEQ ID NO: 22948 - DNA, 20 bp, Artificial Sequence
  chemically synthesized
ggaaactggtaattaggagg

SEQ ID NO: 22949 - DNA, 20 bp, Artificial Sequence
  chemically synthesized
tatggaaactggtaattagg

SEQ ID NO: 22950 - DNA, 20 bp, Artificial Sequence
  chemically synthesized
atatggaaactggtaattag

SEQ ID NO: 22951 - DNA, 20 bp, Artificial Sequence
  chemically synthesized
tccctctacctcctaattac

SEQ ID NO: 22952 - DNA, 20 bp, Artificial Sequence
  chemically synthesized
gcatatggaaactggtaatt

SEQ ID NO: 22953 - DNA, 20 bp, Artificial Sequence
  chemically synthesized
cgcatatggaaactggtaat

SEQ ID NO: 22954 - DNA, 20 bp, Artificial Sequence
  chemically synthesized
ctgtgaacgcatatggaaac

SEQ ID NO: 22955 - DNA, 20 bp, Artificial Sequence
  chemically synthesized
ggagaagctgtgaacgcata

SEQ ID NO: 22956 - DNA, 20 bp, Artificial Sequence
  chemically synthesized
ccagtttccatatgcgttca

SEQ ID NO: 22957 - DNA, 20 bp, Artificial Sequence
  chemically synthesized
aagtccctgttgggtaggag

SEQ ID NO: 22958 - DNA, 20 bp, Artificial Sequence
  chemically synthesized
gacaagtccctgttgggtag

SEQ ID NO: 22959 - DNA, 20 bp, Artificial Sequence
  chemically synthesized
tcacagcttctcctacccaa

SEQ ID NO: 22960 - DNA, 20 bp, Artificial Sequence
  chemically synthesized
cacagcttctcctacccaac

SEQ ID NO: 22961 - DNA, 20 bp, Artificial Sequence
  chemically synthesized
ctgacaagtccctgttgggt

SEQ ID NO: 22962 - DNA, 20 bp, Artificial Sequence
  chemically synthesized
acagcttctcctacccaaca

SEQ ID NO: 22963 - DNA, 20 bp, Artificial Sequence
  chemically synthesized
actgacaagtccctgttggg

SEQ ID NO: 22964 - DNA, 20 bp, Artificial Sequence
  chemically synthesized
gatactgacaagtccctgtt

SEQ ID NO: 22965 - DNA, 20 bp, Artificial Sequence
  chemically synthesized
tgatactgacaagtccctgt

SEQ ID NO: 22966 - DNA, 20 bp, Artificial Sequence
  chemically synthesized
cctacccaacagggacttgt

SEQ ID NO: 22967 - DNA, 20 bp, Artificial Sequence
  chemically synthesized
ttgattaaaatgatactgac

SEQ ID NO: 22968 - DNA, 20 bp, Artificial Sequence
  chemically synthesized
agaagtgaggatttgggcaa

SEQ ID NO: 22969 - DNA, 20 bp, Artificial Sequence
  chemically synthesized
ggcaagagaagtgaggattt

SEQ ID NO: 22970 - DNA, 20 bp, Artificial Sequence
  chemically synthesized
gggcaagagaagtgaggatt

SEQ ID NO: 22971 - DNA, 20 bp, Artificial Sequence
  chemically synthesized
acagctgggcaagagaagtg

SEQ ID NO: 22972 - DNA, 20 bp, Artificial Sequence
  chemically synthesized
aacagctgggcaagagaagt

SEQ ID NO: 22973 - DNA, 20 bp, Artificial Sequence
  chemically synthesized
agggaacagctgggcaagag

SEQ ID NO: 22974 - DNA, 20 bp, Artificial Sequence
  chemically synthesized
aaatcctcacttctcttgcc

SEQ ID NO: 22975 - DNA, 20 bp, Artificial Sequence
  chemically synthesized
gggagggaacagctgggcaa

SEQ ID NO: 22976 - DNA, 20 bp, Artificial Sequence
  chemically synthesized
tagggagggaacagctgggc

SEQ ID NO: 22977 - DNA, 20 bp, Artificial Sequence
  chemically synthesized
ggggtagggagggaacagct

SEQ ID NO: 22978 - DNA, 20 bp, Artificial Sequence
  chemically synthesized
tggggtagggagggaacagc

SEQ ID NO: 22979 - DNA, 20 bp, Artificial Sequence
  chemically synthesized
gtcctggggtagggagggaa

SEQ ID NO: 22980 - DNA, 20 bp, Artificial Sequence
  chemically synthesized
cttctgtcctggggtaggga

SEQ ID NO: 22981 - DNA, 20 bp, Artificial Sequence
  chemically synthesized
gcttctgtcctggggtaggg

SEQ ID NO: 22982 - DNA, 20 bp, Artificial Sequence
  chemically synthesized
cagctgttccctccctaccc

SEQ ID NO: 22983 - DNA, 20 bp, Artificial Sequence
  chemically synthesized
tgcttctgtcctggggtagg

SEQ ID NO: 22984 - DNA, 20 bp, Artificial Sequence
  chemically synthesized
agctgttccctccctacccc

SEQ ID NO: 22985 - DNA, 20 bp, Artificial Sequence
  chemically synthesized
gatgcttctgtcctggggta

SEQ ID NO: 22986 - DNA, 20 bp, Artificial Sequence
  chemically synthesized
agatgcttctgtcctggggt

SEQ ID NO: 22987 - DNA, 20 bp, Artificial Sequence
  chemically synthesized
cagatgcttctgtcctgggg

SEQ ID NO: 22988 - DNA, 20 bp, Artificial Sequence
  chemically synthesized
gttccctccctaccccagga

SEQ ID NO: 22989 - DNA, 20 bp, Artificial Sequence
  chemically synthesized
agccagatgcttctgtcctg

SEQ ID NO: 22990 - DNA, 20 bp, Artificial Sequence
  chemically synthesized
ccctccctaccccaggacag

SEQ ID NO: 22991 - DNA, 20 bp, Artificial Sequence
  chemically synthesized
gagccagatgcttctgtcct

SEQ ID NO: 22992 - DNA, 20 bp, Artificial Sequence
  chemically synthesized
ggagccagatgcttctgtcc

SEQ ID NO: 22993 - DNA, 20 bp, Artificial Sequence
  chemically synthesized
taccccaggacagaagcatc

SEQ ID NO: 22994 - DNA, 20 bp, Artificial Sequence
  chemically synthesized
gacagaagcatctggctccc

SEQ ID NO: 22995 - DNA, 20 bp, Artificial Sequence
  chemically synthesized
cacgcttagcacttgggagc

SEQ ID NO: 22996 - DNA, 20 bp, Artificial Sequence
  chemically synthesized
caggcacgcttagcacttgg

SEQ ID NO: 22997 - DNA, 20 bp, Artificial Sequence
  chemically synthesized
gcatctggctcccaagtgct

SEQ ID NO: 22998 - DNA, 20 bp, Artificial Sequence
  chemically synthesized
cccaggcacgcttagcactt

SEQ ID NO: 22999 - DNA, 20 bp, Artificial Sequence
  chemically synthesized
ccccaggcacgcttagcact

SEQ ID NO: 23000 - DNA, 20 bp, Artificial Sequence
  chemically synthesized
ggtatttccccaggcacgct

SEQ ID NO: 23001 - DNA, 20 bp, Artificial Sequence
  chemically synthesized
tcccaagtgctaagcgtgcc

SEQ ID NO: 23002 - DNA, 20 bp, Artificial Sequence
  chemically synthesized
cccaagtgctaagcgtgcct

SEQ ID NO: 23003 - DNA, 20 bp, Artificial Sequence
  chemically synthesized
ccaagtgctaagcgtgcctg

SEQ ID NO: 23004 - DNA, 20 bp, Artificial Sequence
  chemically synthesized
caggggtgtggtatttcccc

SEQ ID NO: 23005 - DNA, 20 bp, Artificial Sequence
  chemically synthesized
gcaggggtgtggtatttccc

SEQ ID NO: 23006 - DNA, 20 bp, Artificial Sequence
  chemically synthesized
agctccaatctgcaggggtg

SEQ ID NO: 23007 - DNA, 20 bp, Artificial Sequence
  chemically synthesized
ggggaaataccacacccctg

SEQ ID NO: 23008 - DNA, 20 bp, Artificial Sequence
  chemically synthesized
acggtagctccaatctgcag

SEQ ID NO: 23009 - DNA, 20 bp, Artificial Sequence
  chemically synthesized
aataccacacccctgcagat

SEQ ID NO: 23010 - DNA, 20 bp, Artificial Sequence
  chemically synthesized
cacggtagctccaatctgca

SEQ ID NO: 23011 - DNA, 20 bp, Artificial Sequence
  chemically synthesized
tcacggtagctccaatctgc

SEQ ID NO: 23012 - DNA, 20 bp, Artificial Sequence
  chemically synthesized
taccacacccctgcagattg

SEQ ID NO: 23013 - DNA, 20 bp, Artificial Sequence
  chemically synthesized
ttcacggtagctccaatctg

SEQ ID NO: 23014 - DNA, 20 bp, Artificial Sequence
  chemically synthesized
ggcggctgagtgtttcacgg

SEQ ID NO: 23015 - DNA, 20 bp, Artificial Sequence
  chemically synthesized
agaggcggctgagtgtttca

SEQ ID NO: 23016 - DNA, 20 bp, Artificial Sequence
  chemically synthesized
tggagctaccgtgaaacact

SEQ ID NO: 23017 - DNA, 20 bp, Artificial Sequence
  chemically synthesized
gtgtgaacccagaggcggct

SEQ ID NO: 23018 - DNA, 20 bp, Artificial Sequence
  chemically synthesized
gtgaaacactcagccgcctc

SEQ ID NO: 23019 - DNA, 20 bp, Artificial Sequence
  chemically synthesized
tgaaacactcagccgcctct

SEQ ID NO: 23020 - DNA, 20 bp, Artificial Sequence
  chemically synthesized
cagctgtgtgaacccagagg

SEQ ID NO: 23021 - DNA, 20 bp, Artificial Sequence
  chemically synthesized
aaccagctgtgtgaacccag

SEQ ID NO: 23022 - DNA, 20 bp, Artificial Sequence
  chemically synthesized
aaaccagctgtgtgaaccca

SEQ ID NO: 23023 - DNA, 20 bp, Artificial Sequence
  chemically synthesized
gaaaaccagctgtgtgaacc

SEQ ID NO: 23024 - DNA, 20 bp, Artificial Sequence
  chemically synthesized
cagccgcctctgggttcaca

SEQ ID NO: 23025 - DNA, 20 bp, Artificial Sequence
  chemically synthesized
cgcctctgggttcacacagc

SEQ ID NO: 23026 - DNA, 20 bp, Artificial Sequence
  chemically synthesized
gagagggcggagttgaaaac

SEQ ID NO: 23027 - DNA, 20 bp, Artificial Sequence
  chemically synthesized
ggagaataagagagagggcg

SEQ ID NO: 23028 - DNA, 20 bp, Artificial Sequence
  chemically synthesized
gtggagaataagagagaggg

SEQ ID NO: 23029 - DNA, 20 bp, Artificial Sequence
  chemically synthesized
tttgtggagaataagagaga

SEQ ID NO: 23030 - DNA, 20 bp, Artificial Sequence
  chemically synthesized
ctttgtggagaataagagag

SEQ ID NO: 23031 - DNA, 20 bp, Artificial Sequence
  chemically synthesized
tctttgtggagaataagaga

SEQ ID NO: 23032 - DNA, 20 bp, Artificial Sequence
  chemically synthesized
tatctttgtggagaataaga

SEQ ID NO: 23033 - DNA, 20 bp, Artificial Sequence
  chemically synthesized
cttatctttgtggagaataa

SEQ ID NO: 23034 - DNA, 20 bp, Artificial Sequence
  chemically synthesized
ggcttatctttgtggagaat

SEQ ID NO: 23035 - DNA, 20 bp, Artificial Sequence
  chemically synthesized
cctctctcttattctccaca

SEQ ID NO: 23036 - DNA, 20 bp, Artificial Sequence
  chemically synthesized
aagttgggcttatctttgtg

SEQ ID NO: 23037 - DNA, 20 bp, Artificial Sequence
  chemically synthesized
ctcttattctccacaaagat

SEQ ID NO: 23038 - DNA, 20 bp, Artificial Sequence
  chemically synthesized
tgaagttgggcttatctttg

SEQ ID NO: 23039 - DNA, 20 bp, Artificial Sequence
  chemically synthesized
cagcaggagatgatgaagtt

SEQ ID NO: 23040 - DNA, 20 bp, Artificial Sequence
  chemically synthesized
acagcaggagatgatgaagt

SEQ ID NO: 23041 - DNA, 20 bp, Artificial Sequence
  chemically synthesized
gttaacagcaggagatgatg

SEQ ID NO: 23042 - DNA, 20 bp, Artificial Sequence
  chemically synthesized
tgcaacgcagttaacagcag

SEQ ID NO: 23043 - DNA, 20 bp, Artificial Sequence
  chemically synthesized
cctgcaacgcagttaacagc

SEQ ID NO: 23044 - DNA, 20 bp, Artificial Sequence
  chemically synthesized
ccctgcaacgcagttaacag

SEQ ID NO: 23045 - DNA, 20 bp, Artificial Sequence
  chemically synthesized
agtccctgcaacgcagttaa

SEQ ID NO: 23046 - DNA, 20 bp, Artificial Sequence
  chemically synthesized
tcctgctgttaactgcgttg

SEQ ID NO: 23047 - DNA, 20 bp, Artificial Sequence
  chemically synthesized
cctgctgttaactgcgttgc

SEQ ID NO: 23048 - DNA, 20 bp, Artificial Sequence
  chemically synthesized
ctgctgttaactgcgttgca

SEQ ID NO: 23049 - DNA, 20 bp, Artificial Sequence
  chemically synthesized
agtggagagtccctgcaacg

SEQ ID NO: 23050 - DNA, 20 bp, Artificial Sequence
  chemically synthesized
cattttttgtatggagtgga

SEQ ID NO: 23051 - DNA, 20 bp, Artificial Sequence
  chemically synthesized
tccattttttgtatggagtg

SEQ ID NO: 23052 - DNA, 20 bp, Artificial Sequence
  chemically synthesized
cttccattttttgtatggag

SEQ ID NO: 23053 - DNA, 20 bp, Artificial Sequence
  chemically synthesized
aggcttccattttttgtatg

SEQ ID NO: 23054 - DNA, 20 bp, Artificial Sequence
  chemically synthesized
aaaggcttccattttttgta

SEQ ID NO: 23055 - DNA, 20 bp, Artificial Sequence
  chemically synthesized
tctccactccatacaaaaaa

SEQ ID NO: 23056 - DNA, 20 bp, Artificial Sequence
  chemically synthesized
ccactccatacaaaaaatgg

SEQ ID NO: 23057 - DNA, 20 bp, Artificial Sequence
  chemically synthesized
acaaaaaatggaagccttta

SEQ ID NO: 23058 - DNA, 20 bp, Artificial Sequence
  chemically synthesized
aaaatggaagcctttatagt

SEQ ID NO: 23059 - DNA, 20 bp, Artificial Sequence
  chemically synthesized
tgaaggatgtcttactataa

SEQ ID NO: 23060 - DNA, 20 bp, Artificial Sequence
  chemically synthesized
gtgaaggatgtcttactata

SEQ ID NO: 23061 - DNA, 20 bp, Artificial Sequence
  chemically synthesized
accaggtagcagcaaggtga

SEQ ID NO: 23062 - DNA, 20 bp, Artificial Sequence
  chemically synthesized
aaccaggtagcagcaaggtg

SEQ ID NO: 23063 - DNA, 20 bp, Artificial Sequence
  chemically synthesized
taagaaaccaggtagcagca

SEQ ID NO: 23064 - DNA, 20 bp, Artificial Sequence
  chemically synthesized
ctaagaaaccaggtagcagc

SEQ ID NO: 23065 - DNA, 20 bp, Artificial Sequence
  chemically synthesized
tccttcaccttgctgctacc

SEQ ID NO: 23066 - DNA, 20 bp, Artificial Sequence
  chemically synthesized
gtaactaagaaaccaggtag

SEQ ID NO: 23067 - DNA, 20 bp, Artificial Sequence
  chemically synthesized
caggtaactaagaaaccagg

SEQ ID NO: 23068 - DNA, 20 bp, Artificial Sequence
  chemically synthesized
cttgctgctacctggtttct

SEQ ID NO: 23069 - DNA, 20 bp, Artificial Sequence
  chemically synthesized
gtccaggtaactaagaaacc

SEQ ID NO: 23070 - DNA, 20 bp, Artificial Sequence
  chemically synthesized
ggtccaggtaactaagaaac

SEQ ID NO: 23071 - DNA, 20 bp, Artificial Sequence
  chemically synthesized
tacctggtttcttagttacc

SEQ ID NO: 23072 - DNA, 20 bp, Artificial Sequence
  chemically synthesized
ctgggcaggtccaggtaact

SEQ ID NO: 23073 - DNA, 20 bp, Artificial Sequence
  chemically synthesized
ggaaggatctgggcaggtcc

SEQ ID NO: 23074 - DNA, 20 bp, Artificial Sequence
  chemically synthesized
gggaaggatctgggcaggtc

SEQ ID NO: 23075 - DNA, 20 bp, Artificial Sequence
  chemically synthesized
cttagttacctggacctgcc

SEQ ID NO: 23076 - DNA, 20 bp, Artificial Sequence
  chemically synthesized
gtagagggaaggatctgggc

SEQ ID NO: 23077 - DNA, 20 bp, Artificial Sequence
  chemically synthesized
ggtagagggaaggatctggg

SEQ ID NO: 23078 - DNA, 20 bp, Artificial Sequence
  chemically synthesized
tggggtagagggaaggatct

SEQ ID NO: 23079 - DNA, 20 bp, Artificial Sequence
  chemically synthesized
gtggggtagagggaaggatc

SEQ ID NO: 23080 - DNA, 20 bp, Artificial Sequence
  chemically synthesized
taatgggtggggtagaggga

SEQ ID NO: 23081 - DNA, 20 bp, Artificial Sequence
  chemically synthesized
gtaatgggtggggtagaggg

SEQ ID NO: 23082 - DNA, 20 bp, Artificial Sequence
  chemically synthesized
actgtaatgggtggggtaga

SEQ ID NO: 23083 - DNA, 20 bp, Artificial Sequence
  chemically synthesized
cactgtaatgggtggggtag

SEQ ID NO: 23084 - DNA, 20 bp, Artificial Sequence
  chemically synthesized
ccactgtaatgggtggggta

SEQ ID NO: 23085 - DNA, 20 bp, Artificial Sequence
  chemically synthesized
ttccactgtaatgggtgggg

SEQ ID NO: 23086 - DNA, 20 bp, Artificial Sequence
  chemically synthesized
ctcttccactgtaatgggtg

SEQ ID NO: 23087 - DNA, 20 bp, Artificial Sequence
  chemically synthesized
tctcttccactgtaatgggt

SEQ ID NO: 23088 - DNA, 20 bp, Artificial Sequence
  chemically synthesized
tccctctaccccacccatta

SEQ ID NO: 23089 - DNA, 20 bp, Artificial Sequence
  chemically synthesized
ctctcttccactgtaatggg

SEQ ID NO: 23090 - DNA, 20 bp, Artificial Sequence
  chemically synthesized
ctctaccccacccattacag

SEQ ID NO: 23091 - DNA, 20 bp, Artificial Sequence
  chemically synthesized
tacctctcttccactgtaat

SEQ ID NO: 23092 - DNA, 20 bp, Artificial Sequence
  chemically synthesized
atacctctcttccactgtaa

SEQ ID NO: 23093 - DNA, 20 bp, Artificial Sequence
  chemically synthesized
taccccacccattacagtgg

SEQ ID NO: 23094 - DNA, 20 bp, Artificial Sequence
  chemically synthesized
ccccacccattacagtggaa

SEQ ID NO: 23095 - DNA, 20 bp, Artificial Sequence
  chemically synthesized
ccacccattacagtggaaga

SEQ ID NO: 23096 - DNA, 20 bp, Artificial Sequence
  chemically synthesized
cacccattacagtggaagag

SEQ ID NO: 23097 - DNA, 20 bp, Artificial Sequence
  chemically synthesized
ccagagcccaagggagggaa

SEQ ID NO: 23098 - DNA, 20 bp, Artificial Sequence
  chemically synthesized
atccagagcccaagggaggg

SEQ ID NO: 23099 - DNA, 20 bp, Artificial Sequence
  chemically synthesized
gaggtatctcttccctccct

SEQ ID NO: 23100 - DNA, 20 bp, Artificial Sequence
  chemically synthesized
aggtatctcttccctccctt

SEQ ID NO: 23101 - DNA, 20 bp, Artificial Sequence
  chemically synthesized
gtaatccagagcccaaggga

SEQ ID NO: 23102 - DNA, 20 bp, Artificial Sequence
  chemically synthesized
ggtaatccagagcccaaggg

SEQ ID NO: 23103 - DNA, 20 bp, Artificial Sequence
  chemically synthesized
aggtaatccagagcccaagg

SEQ ID NO: 23104 - DNA, 20 bp, Artificial Sequence
  chemically synthesized
gcaggtaatccagagcccaa

SEQ ID NO: 23105 - DNA, 20 bp, Artificial Sequence
  chemically synthesized
ctcttccctcccttgggctc

SEQ ID NO: 23106 - DNA, 20 bp, Artificial Sequence
  chemically synthesized
ggcaggtaatccagagccca

SEQ ID NO: 23107 - DNA, 20 bp, Artificial Sequence
  chemically synthesized
gggcaggtaatccagagccc

SEQ ID NO: 23108 - DNA, 20 bp, Artificial Sequence
  chemically synthesized
gaatacgggcaggtaatcca

SEQ ID NO: 23109 - DNA, 20 bp, Artificial Sequence
  chemically synthesized
gagaatacgggcaggtaatc

SEQ ID NO: 23110 - DNA, 20 bp, Artificial Sequence
  chemically synthesized
tgttctcagagaatacgggc

SEQ ID NO: 23111 - DNA, 20 bp, Artificial Sequence
  chemically synthesized
gtgttctcagagaatacggg

SEQ ID NO: 23112 - DNA, 20 bp, Artificial Sequence
  chemically synthesized
tgggtgttctcagagaatac

SEQ ID NO: 23113 - DNA, 20 bp, Artificial Sequence
  chemically synthesized
atgggtgttctcagagaata

SEQ ID NO: 23114 - DNA, 20 bp, Artificial Sequence
  chemically synthesized
attacctgcccgtattctct

SEQ ID NO: 23115 - DNA, 20 bp, Artificial Sequence
  chemically synthesized
ataaataatgggtgttctca

SEQ ID NO: 23116 - DNA, 20 bp, Artificial Sequence
  chemically synthesized
tgataaataatgggtgttct

SEQ ID NO: 23117 - DNA, 20 bp, Artificial Sequence
  chemically synthesized
aagaggagatgataaataat

SEQ ID NO: 23118 - DNA, 20 bp, Artificial Sequence
  chemically synthesized
caagaggagatgataaataa

SEQ ID NO: 23119 - DNA, 20 bp, Artificial Sequence
  chemically synthesized
cattatttatcatctcctct

SEQ ID NO: 23120 - DNA, 20 bp, Artificial Sequence
  chemically synthesized
attatttatcatctcctctt

SEQ ID NO: 23121 - DNA, 20 bp, Artificial Sequence
  chemically synthesized
tacaattattggcccaagag

SEQ ID NO: 23122 - DNA, 20 bp, Artificial Sequence
  chemically synthesized
attacaattattggcccaag

SEQ ID NO: 23123 - DNA, 20 bp, Artificial Sequence
  chemically synthesized
gattacaattattggcccaa

SEQ ID NO: 23124 - DNA, 20 bp, Artificial Sequence
  chemically synthesized
gagattacaattattggccc

SEQ ID NO: 23125 - DNA, 20 bp, Artificial Sequence
  chemically synthesized
cagggtgagattacaattat

SEQ ID NO: 23126 - DNA, 20 bp, Artificial Sequence
  chemically synthesized
tgagtatgagaagacagggt

SEQ ID NO: 23127 - DNA, 20 bp, Artificial Sequence
  chemically synthesized
tatatgagtatgagaagaca

SEQ ID NO: 23128 - DNA, 20 bp, Artificial Sequence
  chemically synthesized
ttatatgagtatgagaagac

SEQ ID NO: 23129 - DNA, 20 bp, Artificial Sequence
  chemically synthesized
tttatatgagtatgagaaga

SEQ ID NO: 23130 - DNA, 20 bp, Artificial Sequence
  chemically synthesized
tgtatttatatgagtatgag

SEQ ID NO: 23131 - DNA, 20 bp, Artificial Sequence
  chemically synthesized
gaatgtatttatatgagtat

SEQ ID NO: 23132 - DNA, 20 bp, Artificial Sequence
  chemically synthesized
tcgtgggaatgtatttatat

SEQ ID NO: 23133 - DNA, 20 bp, Artificial Sequence
  chemically synthesized
gccaaacatatagtattcgt

SEQ ID NO: 23134 - DNA, 20 bp, Artificial Sequence
  chemically synthesized
ggccaaacatatagtattcg

SEQ ID NO: 23135 - DNA, 20 bp, Artificial Sequence
  chemically synthesized
tcccacgaatactatatgtt

SEQ ID NO: 23136 - DNA, 20 bp, Artificial Sequence
  chemically synthesized
tcaaatgcaggccaaacata

SEQ ID NO: 23137 - DNA, 20 bp, Artificial Sequence
  chemically synthesized
gatttttttcaatcaaatgc

SEQ ID NO: 23138 - DNA, 20 bp, Artificial Sequence
  chemically synthesized
ggatttttttcaatcaaatg

SEQ ID NO: 23139 - DNA, 20 bp, Artificial Sequence
  chemically synthesized
tgattgaaaaaaatccacgt

SEQ ID NO: 23140 - DNA, 20 bp, Artificial Sequence
  chemically synthesized
actgcttgggtcaacttacg

SEQ ID NO: 23141 - DNA, 20 bp, Artificial Sequence
  chemically synthesized
aaatccacgtaagttgaccc

SEQ ID NO: 23142 - DNA, 20 bp, Artificial Sequence
  chemically synthesized
tccacgtaagttgacccaag

SEQ ID NO: 23143 - DNA, 20 bp, Artificial Sequence
  chemically synthesized
aacatgggtttgaactgctt

SEQ ID NO: 23144 - DNA, 20 bp, Artificial Sequence
  chemically synthesized
caacatgggtttgaactgct

SEQ ID NO: 23145 - DNA, 20 bp, Artificial Sequence
  chemically synthesized
cattgatccttgaacaacat

SEQ ID NO: 23146 - DNA, 20 bp, Artificial Sequence
  chemically synthesized
acattgatccttgaacaaca

SEQ ID NO: 23147 - DNA, 20 bp, Artificial Sequence
  chemically synthesized
agttcaaacccatgttgttc

SEQ ID NO: 23148 - DNA, 20 bp, Artificial Sequence
  chemically synthesized
gttcaaacccatgttgttca

SEQ ID NO: 23149 - DNA, 20 bp, Artificial Sequence
  chemically synthesized
gtggcacaatatgtgtatat

SEQ ID NO: 23150 - DNA, 20 bp, Artificial Sequence
  chemically synthesized
ttgactgaaatgtcattatg

SEQ ID NO: 23151 - DNA, 20 bp, Artificial Sequence
  chemically synthesized
tgtgccacataatgacattt

SEQ ID NO: 23152 - DNA, 20 bp, Artificial Sequence
  chemically synthesized
aatgacatttcagtcaacaa

SEQ ID NO: 23153 - DNA, 20 bp, Artificial Sequence
  chemically synthesized
tgggctcgctgtcatatagg

SEQ ID NO: 23154 - DNA, 20 bp, Artificial Sequence
  chemically synthesized
acaatggactgcctatatga

SEQ ID NO: 23155 - DNA, 20 bp, Artificial Sequence
  chemically synthesized
tcatgggctcgctgtcatat

SEQ ID NO: 23156 - DNA, 20 bp, Artificial Sequence
  chemically synthesized
ctcatgggctcgctgtcata

SEQ ID NO: 23157 - DNA, 20 bp, Artificial Sequence
  chemically synthesized
tggactgcctatatgacagc

SEQ ID NO: 23158 - DNA, 20 bp, Artificial Sequence
  chemically synthesized
ctatatgacagcgagcccat

SEQ ID NO: 23159 - DNA, 20 bp, Artificial Sequence
  chemically synthesized
atataatagtgtaatctcat

SEQ ID NO: 23160 - DNA, 20 bp, Artificial Sequence
  chemically synthesized
tatataatagtgtaatctca

SEQ ID NO: 23161 - DNA, 20 bp, Artificial Sequence
  chemically synthesized
gatacagtaaaaatatataa

SEQ ID NO: 23162 - DNA, 20 bp, Artificial Sequence
  chemically synthesized
tatttaaacatagaaagata

SEQ ID NO: 23163 - DNA, 20 bp, Artificial Sequence
  chemically synthesized
gaaacgtatttaaacataga

SEQ ID NO: 23164 - DNA, 20 bp, Artificial Sequence
  chemically synthesized
tatcgaaacgtatttaaaca

SEQ ID NO: 23165 - DNA, 20 bp, Artificial Sequence
  chemically synthesized
ggcagttggaacacaatagt

SEQ ID NO: 23166 - DNA, 20 bp, Artificial Sequence
  chemically synthesized
tgtaggcagttggaacacaa

SEQ ID NO: 23167 - DNA, 20 bp, Artificial Sequence
  chemically synthesized
ttctgaatactgtaggcagt

SEQ ID NO: 23168 - DNA, 20 bp, Artificial Sequence
  chemically synthesized
tattgtgttccaactgccta

SEQ ID NO: 23169 - DNA, 20 bp, Artificial Sequence
  chemically synthesized
actgttctgaatactgtagg

SEQ ID NO: 23170 - DNA, 20 bp, Artificial Sequence
  chemically synthesized
gtgactgttctgaatactgt

SEQ ID NO: 23171 - DNA, 20 bp, Artificial Sequence
  chemically synthesized
ttccaactgcctacagtatt

SEQ ID NO: 23172 - DNA, 20 bp, Artificial Sequence
  chemically synthesized
cgtgactgttctgaatactg

SEQ ID NO: 23173 - DNA, 20 bp, Artificial Sequence
  chemically synthesized
actgcctacagtattcagaa

SEQ ID NO: 23174 - DNA, 20 bp, Artificial Sequence
  chemically synthesized
cagaacagtcacgtgctgta

SEQ ID NO: 23175 - DNA, 20 bp, Artificial Sequence
  chemically synthesized
agaacagtcacgtgctgtac

SEQ ID NO: 23176 - DNA, 20 bp, Artificial Sequence
  chemically synthesized
tcctaggctatacacctgta

SEQ ID NO: 23177 - DNA, 20 bp, Artificial Sequence
  chemically synthesized
tcacgtgctgtacaggtgta

SEQ ID NO: 23178 - DNA, 20 bp, Artificial Sequence
  chemically synthesized
tgctgtacaggtgtatagcc

SEQ ID NO: 23179 - DNA, 20 bp, Artificial Sequence
  chemically synthesized
gctgtacaggtgtatagcct

SEQ ID NO: 23180 - DNA, 20 bp, Artificial Sequence
  chemically synthesized
tgtacaggtgtatagcctag

SEQ ID NO: 23181 - DNA, 20 bp, Artificial Sequence
  chemically synthesized
tgggatagcctattgctcct

SEQ ID NO: 23182 - DNA, 20 bp, Artificial Sequence
  chemically synthesized
ggtgtatagcctaggagcaa

SEQ ID NO: 23183 - DNA, 20 bp, Artificial Sequence
  chemically synthesized
atgggatagcctattgctcc

SEQ ID NO: 23184 - DNA, 20 bp, Artificial Sequence
  chemically synthesized
gtgtatagcctaggagcaat

SEQ ID NO: 23185 - DNA, 20 bp, Artificial Sequence
  chemically synthesized
gagcaataggctatcccata

SEQ ID NO: 23186 - DNA, 20 bp, Artificial Sequence
  chemically synthesized
cacacctaggctgtatggga

SEQ ID NO: 23187 - DNA, 20 bp, Artificial Sequence
  chemically synthesized
agtacacacctaggctgtat

SEQ ID NO: 23188 - DNA, 20 bp, Artificial Sequence
  chemically synthesized
ataggctatcccatacagcc

SEQ ID NO: 23189 - DNA, 20 bp, Artificial Sequence
  chemically synthesized
tagtacacacctaggctgta

SEQ ID NO: 23190 - DNA, 20 bp, Artificial Sequence
  chemically synthesized
taggctatcccatacagcct

SEQ ID NO: 23191 - DNA, 20 bp, Artificial Sequence
  chemically synthesized
gtatagcctagtacacacct

SEQ ID NO: 23192 - DNA, 20 bp, Artificial Sequence
  chemically synthesized
ggtatagcctagtacacacc

SEQ ID NO: 23193 - DNA, 20 bp, Artificial Sequence
  chemically synthesized
catacagcctaggtgtgtac

SEQ ID NO: 23194 - DNA, 20 bp, Artificial Sequence
  chemically synthesized
atacagcctaggtgtgtact

SEQ ID NO: 23195 - DNA, 20 bp, Artificial Sequence
  chemically synthesized
caaacttagatggtatagcc

SEQ ID NO: 23196 - DNA, 20 bp, Artificial Sequence
  chemically synthesized
ctacacaaacttagatggta

SEQ ID NO: 23197 - DNA, 20 bp, Artificial Sequence
  chemically synthesized
tgtactaggctataccatct

SEQ ID NO: 23198 - DNA, 20 bp, Artificial Sequence
  chemically synthesized
gagtactacacaaacttaga

SEQ ID NO: 23199 - DNA, 20 bp, Artificial Sequence
  chemically synthesized
aggagagtactacacaaact

SEQ ID NO: 23200 - DNA, 20 bp, Artificial Sequence
  chemically synthesized
ctataccatctaagtttgtg

SEQ ID NO: 23201 - DNA, 20 bp, Artificial Sequence
  chemically synthesized
gttgttatgtcaatatagga

SEQ ID NO: 23202 - DNA, 20 bp, Artificial Sequence
  chemically synthesized
ttgttgttatgtcaatatag

SEQ ID NO: 23203 - DNA, 20 bp, Artificial Sequence
  chemically synthesized
ctttgttgttatgtcaatat

SEQ ID NO: 23204 - DNA, 20 bp, Artificial Sequence
  chemically synthesized
actttgttgttatgtcaata

SEQ ID NO: 23205 - DNA, 20 bp, Artificial Sequence
  chemically synthesized
cctatattgacataacaaca

SEQ ID NO: 23206 - DNA, 20 bp, Artificial Sequence
  chemically synthesized
gttctaagaaatgtgttgtt

SEQ ID NO: 23207 - DNA, 20 bp, Artificial Sequence
  chemically synthesized
tgttctaagaaatgtgttgt

SEQ ID NO: 23208 - DNA, 20 bp, Artificial Sequence
  chemically synthesized
ttgcctaacaacacatttct

SEQ ID NO: 23209 - DNA, 20 bp, Artificial Sequence
  chemically synthesized
taacaatggggatatgttct

SEQ ID NO: 23210 - DNA, 20 bp, Artificial Sequence
  chemically synthesized
tagaacatatccccattgtt

SEQ ID NO: 23211 - DNA, 20 bp, Artificial Sequence
  chemically synthesized
tcacgtgttgcttaacaatg

SEQ ID NO: 23212 - DNA, 20 bp, Artificial Sequence
  chemically synthesized
gtcacgtgttgcttaacaat

SEQ ID NO: 23213 - DNA, 20 bp, Artificial Sequence
  chemically synthesized
agtcacgtgttgcttaacaa

SEQ ID NO: 23214 - DNA, 20 bp, Artificial Sequence
  chemically synthesized
agttaatggaaatgtatgta

SEQ ID NO: 23215 - DNA, 20 bp, Artificial Sequence
  chemically synthesized
ggagggggctgaggagttaa

SEQ ID NO: 23216 - DNA, 20 bp, Artificial Sequence
  chemically synthesized
atacatttccattaactcct

SEQ ID NO: 23217 - DNA, 20 bp, Artificial Sequence
  chemically synthesized
gctagttggagggggctgag

SEQ ID NO: 23218 - DNA, 20 bp, Artificial Sequence
  chemically synthesized
tagctagttggagggggctg

SEQ ID NO: 23219 - DNA, 20 bp, Artificial Sequence
  chemically synthesized
gtagctagttggagggggct

SEQ ID NO: 23220 - DNA, 20 bp, Artificial Sequence
  chemically synthesized
gggtggtagctagttggagg

SEQ ID NO: 23221 - DNA, 20 bp, Artificial Sequence
  chemically synthesized
actcctcagccccctccaac

SEQ ID NO: 23222 - DNA, 20 bp, Artificial Sequence
  chemically synthesized
ggggtggtagctagttggag

SEQ ID NO: 23223 - DNA, 20 bp, Artificial Sequence
  chemically synthesized
tggggtggtagctagttgga

SEQ ID NO: 23224 - DNA, 20 bp, Artificial Sequence
  chemically synthesized
gtggggtggtagctagttgg

SEQ ID NO: 23225 - DNA, 20 bp, Artificial Sequence
  chemically synthesized
agtggggtggtagctagttg

SEQ ID NO: 23226 - DNA, 20 bp, Artificial Sequence
  chemically synthesized
agagtggggtggtagctagt

SEQ ID NO: 23227 - DNA, 20 bp, Artificial Sequence
  chemically synthesized
gagaagagtggggtggtagc

SEQ ID NO: 23228 - DNA, 20 bp, Artificial Sequence
  chemically synthesized
aggggagaagagtggggtgg

SEQ ID NO: 23229 - DNA, 20 bp, Artificial Sequence
  chemically synthesized
tgaaggggagaagagtgggg

SEQ ID NO: 23230 - DNA, 20 bp, Artificial Sequence
  chemically synthesized
ttatgaaggggagaagagtg

SEQ ID NO: 23231 - DNA, 20 bp, Artificial Sequence
  chemically synthesized
cttatgaaggggagaagagt

SEQ ID NO: 23232 - DNA, 20 bp, Artificial Sequence
  chemically synthesized
acttatgaaggggagaagag

SEQ ID NO: 23233 - DNA, 20 bp, Artificial Sequence
  chemically synthesized
tttacttatgaaggggagaa

SEQ ID NO: 23234 - DNA, 20 bp, Artificial Sequence
  chemically synthesized
aatttacttatgaaggggag

SEQ ID NO: 23235 - DNA, 20 bp, Artificial Sequence
  chemically synthesized
agaaatttacttatgaaggg

SEQ ID NO: 23236 - DNA, 20 bp, Artificial Sequence
  chemically synthesized
cccactcttctccccttcat

SEQ ID NO: 23237 - DNA, 20 bp, Artificial Sequence
  chemically synthesized
ggagaaatttacttatgaag

SEQ ID NO: 23238 - DNA, 20 bp, Artificial Sequence
  chemically synthesized
tggagaaatttacttatgaa

SEQ ID NO: 23239 - DNA, 20 bp, Artificial Sequence
  chemically synthesized
ttggagaaatttacttatga

SEQ ID NO: 23240 - DNA, 20 bp, Artificial Sequence
  chemically synthesized
cttggagaaatttacttatg

SEQ ID NO: 23241 - DNA, 20 bp, Artificial Sequence
  chemically synthesized
cttcataagtaaatttctcc

SEQ ID NO: 23242 - DNA, 20 bp, Artificial Sequence
  chemically synthesized
gaaggtatgaatgattcttg

SEQ ID NO: 23243 - DNA, 20 bp, Artificial Sequence
  chemically synthesized
gagaaggtatgaatgattct

SEQ ID NO: 23244 - DNA, 20 bp, Artificial Sequence
  chemically synthesized
caaaagtggagaattagaga

SEQ ID NO: 23245 - DNA, 20 bp, Artificial Sequence
  chemically synthesized
ccaaaagtggagaattagag

SEQ ID NO: 23246 - DNA, 20 bp, Artificial Sequence
  chemically synthesized
gaaccaaaagtggagaatta

SEQ ID NO: 23247 - DNA, 20 bp, Artificial Sequence
  chemically synthesized
gtgaaccaaaagtggagaat

SEQ ID NO: 23248 - DNA, 20 bp, Artificial Sequence
  chemically synthesized
cttctctaattctccacttt

SEQ ID NO: 23249 - DNA, 20 bp, Artificial Sequence
  chemically synthesized
tcaaaagtgaaccaaaagtg

SEQ ID NO: 23250 - DNA, 20 bp, Artificial Sequence
  chemically synthesized
gttcaaaagtgaaccaaaag

SEQ ID NO: 23251 - DNA, 20 bp, Artificial Sequence
  chemically synthesized
tgagttcaaaagtgaaccaa

SEQ ID NO: 23252 - DNA, 20 bp, Artificial Sequence
  chemically synthesized
aagtggtgtggtgagttcaa

SEQ ID NO: 23253 - DNA, 20 bp, Artificial Sequence
  chemically synthesized
cacagtggaagtggtgtggt

SEQ ID NO: 23254 - DNA, 20 bp, Artificial Sequence
  chemically synthesized
gaggcacagtggaagtggtg

SEQ ID NO: 23255 - DNA, 20 bp, Artificial Sequence
  chemically synthesized
ttttagaggcacagtggaag

SEQ ID NO: 23256 - DNA, 20 bp, Artificial Sequence
  chemically synthesized
agattttagaggcacagtgg

SEQ ID NO: 23257 - DNA, 20 bp, Artificial Sequence
  chemically synthesized
gtgagattttagaggcacag

SEQ ID NO: 23258 - DNA, 20 bp, Artificial Sequence
  chemically synthesized
ttggtgagattttagaggca

SEQ ID NO: 23259 - DNA, 20 bp, Artificial Sequence
  chemically synthesized
taactttggtgagattttag

SEQ ID NO: 23260 - DNA, 20 bp, Artificial Sequence
  chemically synthesized
gtaactttggtgagatttta

SEQ ID NO: 23261 - DNA, 20 bp, Artificial Sequence
  chemically synthesized
tagtaactttggtgagattt

SEQ ID NO: 23262 - DNA, 20 bp, Artificial Sequence
  chemically synthesized
gtgcctctaaaatctcacca

SEQ ID NO: 23263 - DNA, 20 bp, Artificial Sequence
  chemically synthesized
aggtccctagtaactttggt

SEQ ID NO: 23264 - DNA, 20 bp, Artificial Sequence
  chemically synthesized
taaaatctcaccaaagttac

SEQ ID NO: 23265 - DNA, 20 bp, Artificial Sequence
  chemically synthesized
aggaaggtccctagtaactt

SEQ ID NO: 23266 - DNA, 20 bp, Artificial Sequence
  chemically synthesized
aaaatctcaccaaagttact

SEQ ID NO: 23267 - DNA, 20 bp, Artificial Sequence
  chemically synthesized
aaatctcaccaaagttacta

SEQ ID NO: 23268 - DNA, 20 bp, Artificial Sequence
  chemically synthesized
cttagcaacaggaaggtccc

SEQ ID NO: 23269 - DNA, 20 bp, Artificial Sequence
  chemically synthesized
cattggacttagcaacagga

SEQ ID NO: 23270 - DNA, 20 bp, Artificial Sequence
  chemically synthesized
ccattggacttagcaacagg

SEQ ID NO: 23271 - DNA, 20 bp, Artificial Sequence
  chemically synthesized
ctagggaccttcctgttgct

SEQ ID NO: 23272 - DNA, 20 bp, Artificial Sequence
  chemically synthesized
tgcccattggacttagcaac

SEQ ID NO: 23273 - DNA, 20 bp, Artificial Sequence
  chemically synthesized
atgcccattggacttagcaa

SEQ ID NO: 23274 - DNA, 20 bp, Artificial Sequence
  chemically synthesized
cttcctgttgctaagtccaa

SEQ ID NO: 23275 - DNA, 20 bp, Artificial Sequence
  chemically synthesized
cggaaaatgcccattggact

SEQ ID NO: 23276 - DNA, 20 bp, Artificial Sequence
  chemically synthesized
ttcctgttgctaagtccaat

SEQ ID NO: 23277 - DNA, 20 bp, Artificial Sequence
  chemically synthesized
aagttgcggaaaatgcccat

SEQ ID NO: 23278 - DNA, 20 bp, Artificial Sequence
  chemically synthesized
gggatgtcagcataaagttg

SEQ ID NO: 23279 - DNA, 20 bp, Artificial Sequence
  chemically synthesized
gttgctgggatgtcagcata

SEQ ID NO: 23280 - DNA, 20 bp, Artificial Sequence
  chemically synthesized
gcaactttatgctgacatcc

SEQ ID NO: 23281 - DNA, 20 bp, Artificial Sequence
  chemically synthesized
gtcagatgttgctgggatgt

SEQ ID NO: 23282 - DNA, 20 bp, Artificial Sequence
  chemically synthesized
taccagggtcagatgttgct

SEQ ID NO: 23283 - DNA, 20 bp, Artificial Sequence
  chemically synthesized
ttaccagggtcagatgttgc

SEQ ID NO: 23284 - DNA, 20 bp, Artificial Sequence
  chemically synthesized
atcccagcaacatctgaccc

SEQ ID NO: 23285 - DNA, 20 bp, Artificial Sequence
  chemically synthesized
aaagaacccgttaccagggt

SEQ ID NO: 23286 - DNA, 20 bp, Artificial Sequence
  chemically synthesized
gcaacatctgaccctggtaa

SEQ ID NO: 23287 - DNA, 20 bp, Artificial Sequence
  chemically synthesized
caacatctgaccctggtaac

SEQ ID NO: 23288 - DNA, 20 bp, Artificial Sequence
  chemically synthesized
aaagaaagaacccgttacca

SEQ ID NO: 23289 - DNA, 20 bp, Artificial Sequence
  chemically synthesized
gaaagaaagaacccgttacc

SEQ ID NO: 23290 - DNA, 20 bp, Artificial Sequence
  chemically synthesized
agaaagaaagaacccgttac

SEQ ID NO: 23291 - DNA, 20 bp, Artificial Sequence
  chemically synthesized
atgctccatgggaagaaaga

SEQ ID NO: 23292 - DNA, 20 bp, Artificial Sequence
  chemically synthesized
ccacatgctccatgggaaga

SEQ ID NO: 23293 - DNA, 20 bp, Artificial Sequence
  chemically synthesized
gggttctttctttcttccca

SEQ ID NO: 23294 - DNA, 20 bp, Artificial Sequence
  chemically synthesized
gttctttctttcttcccatg

SEQ ID NO: 23295 - DNA, 20 bp, Artificial Sequence
  chemically synthesized
gatgccacatgctccatggg

SEQ ID NO: 23296 - DNA, 20 bp, Artificial Sequence
  chemically synthesized
tatgatgccacatgctccat

SEQ ID NO: 23297 - DNA, 20 bp, Artificial Sequence
  chemically synthesized
ttatgatgccacatgctcca

SEQ ID NO: 23298 - DNA, 20 bp, Artificial Sequence
  chemically synthesized
ctttcttcccatggagcatg

SEQ ID NO: 23299 - DNA, 20 bp, Artificial Sequence
  chemically synthesized
catgtggcatcataacctct

SEQ ID NO: 23300 - DNA, 20 bp, Artificial Sequence
  chemically synthesized
gaaagaaggaaaattccaag

SEQ ID NO: 23301 - DNA, 20 bp, Artificial Sequence
  chemically synthesized
ggaaagaaggaaaattccaa

SEQ ID NO: 23302 - DNA, 20 bp, Artificial Sequence
  chemically synthesized
gaggaaagaaggaaaattcc

SEQ ID NO: 23303 - DNA, 20 bp, Artificial Sequence
  chemically synthesized
ggaatggccaggaggaaaga

SEQ ID NO: 23304 - DNA, 20 bp, Artificial Sequence
  chemically synthesized
aggaatggccaggaggaaag

SEQ ID NO: 23305 - DNA, 20 bp, Artificial Sequence
  chemically synthesized
gaattttccttctttcctcc

SEQ ID NO: 23306 - DNA, 20 bp, Artificial Sequence
  chemically synthesized
caaaggaatggccaggagga

SEQ ID NO: 23307 - DNA, 20 bp, Artificial Sequence
  chemically synthesized
actgcaaaggaatggccagg

SEQ ID NO: 23308 - DNA, 20 bp, Artificial Sequence
  chemically synthesized
gactgcaaaggaatggccag

SEQ ID NO: 23309 - DNA, 20 bp, Artificial Sequence
  chemically synthesized
gggactgcaaaggaatggcc

SEQ ID NO: 23310 - DNA, 20 bp, Artificial Sequence
  chemically synthesized
agggactgcaaaggaatggc

SEQ ID NO: 23311 - DNA, 20 bp, Artificial Sequence
  chemically synthesized
cagaagggactgcaaaggaa

SEQ ID NO: 23312 - DNA, 20 bp, Artificial Sequence
  chemically synthesized
tcctcctggccattcctttg

SEQ ID NO: 23313 - DNA, 20 bp, Artificial Sequence
  chemically synthesized
acctacagaagggactgcaa

SEQ ID NO: 23314 - DNA, 20 bp, Artificial Sequence
  chemically synthesized
aacctacagaagggactgca

SEQ ID NO: 23315 - DNA, 20 bp, Artificial Sequence
  chemically synthesized
ttcctttgcagtcccttctg

SEQ ID NO: 23316 - DNA, 20 bp, Artificial Sequence
  chemically synthesized
tcctttgcagtcccttctgt

SEQ ID NO: 23317 - DNA, 20 bp, Artificial Sequence
  chemically synthesized
aggataagcaacctacagaa

SEQ ID NO: 23318 - DNA, 20 bp, Artificial Sequence
  chemically synthesized
caggataagcaacctacaga

SEQ ID NO: 23319 - DNA, 20 bp, Artificial Sequence
  chemically synthesized
acaggataagcaacctacag

SEQ ID NO: 23320 - DNA, 20 bp, Artificial Sequence
  chemically synthesized
gacacaggataagcaaccta

SEQ ID NO: 23321 - DNA, 20 bp, Artificial Sequence
  chemically synthesized
agttatttaggacacaggat

SEQ ID NO: 23322 - DNA, 20 bp, Artificial Sequence
  chemically synthesized
agggaagttatttaggacac

SEQ ID NO: 23323 - DNA, 20 bp, Artificial Sequence
  chemically synthesized
aagggaagttatttaggaca

SEQ ID NO: 23324 - DNA, 20 bp, Artificial Sequence
  chemically synthesized
cgtgagaagggaagttattt

SEQ ID NO: 23325 - DNA, 20 bp, Artificial Sequence
  chemically synthesized
gcgtgagaagggaagttatt

SEQ ID NO: 23326 - DNA, 20 bp, Artificial Sequence
  chemically synthesized
aaagtgtagcgtgagaaggg

SEQ ID NO: 23327 - DNA, 20 bp, Artificial Sequence
  chemically synthesized
aggaaagtgtagcgtgagaa

SEQ ID NO: 23328 - DNA, 20 bp, Artificial Sequence
  chemically synthesized
caggaaagtgtagcgtgaga

SEQ ID NO: 23329 - DNA, 20 bp, Artificial Sequence
  chemically synthesized
ccaggaaagtgtagcgtgag

SEQ ID NO: 23330 - DNA, 20 bp, Artificial Sequence
  chemically synthesized
gctccaggaaagtgtagcgt

SEQ ID NO: 23331 - DNA, 20 bp, Artificial Sequence
  chemically synthesized
tggatagctccaggaaagtg

SEQ ID NO: 23332 - DNA, 20 bp, Artificial Sequence
  chemically synthesized
cttctcacgctacactttcc

SEQ ID NO: 23333 - DNA, 20 bp, Artificial Sequence
  chemically synthesized
tctcacgctacactttcctg

SEQ ID NO: 23334 - DNA, 20 bp, Artificial Sequence
  chemically synthesized
aggattggatagctccagga

SEQ ID NO: 23335 - DNA, 20 bp, Artificial Sequence
  chemically synthesized
ggagaggattggatagctcc

SEQ ID NO: 23336 - DNA, 20 bp, Artificial Sequence
  chemically synthesized
gggagaggattggatagctc

SEQ ID NO: 23337 - DNA, 20 bp, Artificial Sequence
  chemically synthesized
taacgggggagaggattgga

SEQ ID NO: 23338 - DNA, 20 bp, Artificial Sequence
  chemically synthesized
cttgtaacgggggagaggat

SEQ ID NO: 23339 - DNA, 20 bp, Artificial Sequence
  chemically synthesized
tgctgcttgtaacgggggag

SEQ ID NO: 23340 - DNA, 20 bp, Artificial Sequence
  chemically synthesized
gtgctgcttgtaacggggga

SEQ ID NO: 23341 - DNA, 20 bp, Artificial Sequence
  chemically synthesized
aggtgctgcttgtaacgggg

SEQ ID NO: 23342 - DNA, 20 bp, Artificial Sequence
  chemically synthesized
ccaatcctctcccccgttac

SEQ ID NO: 23343 - DNA, 20 bp, Artificial Sequence
  chemically synthesized
gtaggtgctgcttgtaacgg

SEQ ID NO: 23344 - DNA, 20 bp, Artificial Sequence
  chemically synthesized
tgtaggtgctgcttgtaacg

SEQ ID NO: 23345 - DNA, 20 bp, Artificial Sequence
  chemically synthesized
ctgtaggtgctgcttgtaac

SEQ ID NO: 23346 - DNA, 20 bp, Artificial Sequence
  chemically synthesized
atcctctcccccgttacaag

SEQ ID NO: 23347 - DNA, 20 bp, Artificial Sequence
  chemically synthesized
cctgtaggtgctgcttgtaa

SEQ ID NO: 23348 - DNA, 20 bp, Artificial Sequence
  chemically synthesized
cccgttacaagcagcaccta

SEQ ID NO: 23349 - DNA, 20 bp, Artificial Sequence
  chemically synthesized
ccgttacaagcagcacctac

SEQ ID NO: 23350 - DNA, 20 bp, Artificial Sequence
  chemically synthesized
tttagggatcatgagcctgt

SEQ ID NO: 23351 - DNA, 20 bp, Artificial Sequence
  chemically synthesized
gtttagggatcatgagcctg

SEQ ID NO: 23352 - DNA, 20 bp, Artificial Sequence
  chemically synthesized
aaacaacgtttagggatcat

SEQ ID NO: 23353 - DNA, 20 bp, Artificial Sequence
  chemically synthesized
aaatatacaaacaacgttta

SEQ ID NO: 23354 - DNA, 20 bp, Artificial Sequence
  chemically synthesized
gaaatatacaaacaacgttt

SEQ ID NO: 23355 - DNA, 20 bp, Artificial Sequence
  chemically synthesized
agaaatatacaaacaacgtt

SEQ ID NO: 23356 - DNA, 20 bp, Artificial Sequence
  chemically synthesized
gttgtttgtatatttctcct

SEQ ID NO: 23357 - DNA, 20 bp, Artificial Sequence
  chemically synthesized
cacggagctgtggtgctcag

SEQ ID NO: 23358 - DNA, 20 bp, Artificial Sequence
  chemically synthesized
gacacggagctgtggtgctc

SEQ ID NO: 23359 - DNA, 20 bp, Artificial Sequence
  chemically synthesized
tatatttctcctgagcacca

SEQ ID NO: 23360 - DNA, 20 bp, Artificial Sequence
  chemically synthesized
agacacggagctgtggtgct

SEQ ID NO: 23361 - DNA, 20 bp, Artificial Sequence
  chemically synthesized
taaggttagacacggagctg

SEQ ID NO: 23362 - DNA, 20 bp, Artificial Sequence
  chemically synthesized
gtctggtaaggttagacacg

SEQ ID NO: 23363 - DNA, 20 bp, Artificial Sequence
  chemically synthesized
ttgtctggtaaggttagaca

SEQ ID NO: 23364 - DNA, 20 bp, Artificial Sequence
  chemically synthesized
agctccgtgtctaaccttac

SEQ ID NO: 23365 - DNA, 20 bp, Artificial Sequence
  chemically synthesized
tgggacttgtctggtaaggt

SEQ ID NO: 23366 - DNA, 20 bp, Artificial Sequence
  chemically synthesized
aatgtgggacttgtctggta

SEQ ID NO: 23367 - DNA, 20 bp, Artificial Sequence
  chemically synthesized
cgtgtctaaccttaccagac

SEQ ID NO: 23368 - DNA, 20 bp, Artificial Sequence
  chemically synthesized
gaatgtgggacttgtctggt

SEQ ID NO: 23369 - DNA, 20 bp, Artificial Sequence
  chemically synthesized
aggtgaatgtgggacttgtc

SEQ ID NO: 23370 - DNA, 20 bp, Artificial Sequence
  chemically synthesized
ttggaatatcaggtgaatgt

SEQ ID NO: 23371 - DNA, 20 bp, Artificial Sequence
  chemically synthesized
cttggaatatcaggtgaatg

SEQ ID NO: 23372 - DNA, 20 bp, Artificial Sequence
  chemically synthesized
ggtgcttggcttggaatatc

SEQ ID NO: 23373 - DNA, 20 bp, Artificial Sequence
  chemically synthesized
ccacattcacctgatattcc

SEQ ID NO: 23374 - DNA, 20 bp, Artificial Sequence
  chemically synthesized
aggtgcttggcttggaatat

SEQ ID NO: 23375 - DNA, 20 bp, Artificial Sequence
  chemically synthesized
ttcacctgatattccaagcc

SEQ ID NO: 23376 - DNA, 20 bp, Artificial Sequence
  chemically synthesized
agacacttaggtgcttggct

SEQ ID NO: 23377 - DNA, 20 bp, Artificial Sequence
  chemically synthesized
atattccaagccaagcacct

SEQ ID NO: 23378 - DNA, 20 bp, Artificial Sequence
  chemically synthesized
aaggaagacacttaggtgct

SEQ ID NO: 23379 - DNA, 20 bp, Artificial Sequence
  chemically synthesized
gggagtcaaggaagacactt

SEQ ID NO: 23380 - DNA, 20 bp, Artificial Sequence
  chemically synthesized
agggagtcaaggaagacact

SEQ ID NO: 23381 - DNA, 20 bp, Artificial Sequence
  chemically synthesized
tgggtgaaagggagtcaagg

SEQ ID NO: 23382 - DNA, 20 bp, Artificial Sequence
  chemically synthesized
tggtgggtgaaagggagtca

SEQ ID NO: 23383 - DNA, 20 bp, Artificial Sequence
  chemically synthesized
gtggtgggtgaaagggagtc

SEQ ID NO: 23384 - DNA, 20 bp, Artificial Sequence
  chemically synthesized
ttgatgtggtgggtgaaagg

SEQ ID NO: 23385 - DNA, 20 bp, Artificial Sequence
  chemically synthesized
gcttgatgtggtgggtgaaa

SEQ ID NO: 23386 - DNA, 20 bp, Artificial Sequence
  chemically synthesized
agcttgatgtggtgggtgaa

SEQ ID NO: 23387 - DNA, 20 bp, Artificial Sequence
  chemically synthesized
aagcttgatgtggtgggtga

SEQ ID NO: 23388 - DNA, 20 bp, Artificial Sequence
  chemically synthesized
ttggacaagcttgatgtggt

SEQ ID NO: 23389 - DNA, 20 bp, Artificial Sequence
  chemically synthesized
tccctttcacccaccacatc

SEQ ID NO: 23390 - DNA, 20 bp, Artificial Sequence
  chemically synthesized
gttggacaagcttgatgtgg

SEQ ID NO: 23391 - DNA, 20 bp, Artificial Sequence
  chemically synthesized
caggttggacaagcttgatg

SEQ ID NO: 23392 - DNA, 20 bp, Artificial Sequence
  chemically synthesized
tcctgggccacaggttggac

SEQ ID NO: 23393 - DNA, 20 bp, Artificial Sequence
  chemically synthesized
catcaagcttgtccaacctg

SEQ ID NO: 23394 - DNA, 20 bp, Artificial Sequence
  chemically synthesized
agccatcctgggccacaggt

SEQ ID NO: 23395 - DNA, 20 bp, Artificial Sequence
  chemically synthesized
agcttgtccaacctgtggcc

SEQ ID NO: 23396 - DNA, 20 bp, Artificial Sequence
  chemically synthesized
gcttgtccaacctgtggccc

SEQ ID NO: 23397 - DNA, 20 bp, Artificial Sequence
  chemically synthesized
tcaaagccatcctgggccac

SEQ ID NO: 23398 - DNA, 20 bp, Artificial Sequence
  chemically synthesized
ttcaaagccatcctgggcca

SEQ ID NO: 23399 - DNA, 20 bp, Artificial Sequence
  chemically synthesized
gtccaacctgtggcccagga

SEQ ID NO: 23400 - DNA, 20 bp, Artificial Sequence
  chemically synthesized
gcctcattcaaagccatcct

SEQ ID NO: 23401 - DNA, 20 bp, Artificial Sequence
  chemically synthesized
ggcctcattcaaagccatcc

SEQ ID NO: 23402 - DNA, 20 bp, Artificial Sequence
  chemically synthesized
ggcccaggatggctttgaat

SEQ ID NO: 23403 - DNA, 20 bp, Artificial Sequence
  chemically synthesized
gcccaggatggctttgaatg

SEQ ID NO: 23404 - DNA, 20 bp, Artificial Sequence
  chemically synthesized
attcatttgggcctcattca

SEQ ID NO: 23405 - DNA, 20 bp, Artificial Sequence
  chemically synthesized
gaaagtttacgaattcattt

SEQ ID NO: 23406 - DNA, 20 bp, Artificial Sequence
  chemically synthesized
ggaaagtttacgaattcatt

SEQ ID NO: 23407 - DNA, 20 bp, Artificial Sequence
  chemically synthesized
aaaaaaaaaatgttttagga

SEQ ID NO: 23408 - DNA, 20 bp, Artificial Sequence
  chemically synthesized
aaaaaaaaaaaaaatgtttt

SEQ ID NO: 23409 - DNA, 20 bp, Artificial Sequence
  chemically synthesized
aaaaaaaaaaaaaaatgttt

SEQ ID NO: 23410 - DNA, 20 bp, Artificial Sequence
  chemically synthesized
tttttttttttttttttttt

SEQ ID NO: 23411 - DNA, 20 bp, Artificial Sequence
  chemically synthesized
tttttttttttttagctcat

SEQ ID NO: 23412 - DNA, 20 bp, Artificial Sequence
  chemically synthesized
taacgctaacggtagctgat

SEQ ID NO: 23413 - DNA, 20 bp, Artificial Sequence
  chemically synthesized
tttagctcatcagctaccgt

SEQ ID NO: 23414 - DNA, 20 bp, Artificial Sequence
  chemically synthesized
aaatacactaacgctaacgg

SEQ ID NO: 23415 - DNA, 20 bp, Artificial Sequence
  chemically synthesized
tcatcagctaccgttagcgt

SEQ ID NO: 23416 - DNA, 20 bp, Artificial Sequence
  chemically synthesized
ataaaatacactaacgctaa

SEQ ID NO: 23417 - DNA, 20 bp, Artificial Sequence
  chemically synthesized
tagcgttagtgtattttatg

SEQ ID NO: 23418 - DNA, 20 bp, Artificial Sequence
  chemically synthesized
agcgttagtgtattttatgt

SEQ ID NO: 23419 - DNA, 20 bp, Artificial Sequence
  chemically synthesized
gcgttagtgtattttatgtg

SEQ ID NO: 23420 - DNA, 20 bp, Artificial Sequence
  chemically synthesized
gtgtattttatgtggggtcc

SEQ ID NO: 23421 - DNA, 20 bp, Artificial Sequence
  chemically synthesized
cagtggaagaagaattgtct

SEQ ID NO: 23422 - DNA, 20 bp, Artificial Sequence
  chemically synthesized
tctccgggccacagtggaag

SEQ ID NO: 23423 - DNA, 20 bp, Artificial Sequence
  chemically synthesized
agacaattcttcttccactg

SEQ ID NO: 23424 - DNA, 20 bp, Artificial Sequence
  chemically synthesized
gcttctccgggccacagtgg

SEQ ID NO: 23425 - DNA, 20 bp, Artificial Sequence
  chemically synthesized
ttggcttctccgggccacag

SEQ ID NO: 23426 - DNA, 20 bp, Artificial Sequence
  chemically synthesized
attcttcttccactgtggcc

SEQ ID NO: 23427 - DNA, 20 bp, Artificial Sequence
  chemically synthesized
tcttcttccactgtggcccg

SEQ ID NO: 23428 - DNA, 20 bp, Artificial Sequence
  chemically synthesized
cttttggcttctccgggcca

SEQ ID NO: 23429 - DNA, 20 bp, Artificial Sequence
  chemically synthesized
tcttccactgtggcccggag

SEQ ID NO: 23430 - DNA, 20 bp, Artificial Sequence
  chemically synthesized
tccaatcttttggcttctcc

SEQ ID NO: 23431 - DNA, 20 bp, Artificial Sequence
  chemically synthesized
gtccaatcttttggcttctc

SEQ ID NO: 23432 - DNA, 20 bp, Artificial Sequence
  chemically synthesized
ctgtggcccggagaagccaa

SEQ ID NO: 23433 - DNA, 20 bp, Artificial Sequence
  chemically synthesized
gcccggagaagccaaaagat

SEQ ID NO: 23434 - DNA, 20 bp, Artificial Sequence
  chemically synthesized
tgcagggatgtccaatcttt

SEQ ID NO: 23435 - DNA, 20 bp, Artificial Sequence
  chemically synthesized
gattcatttgatgtggtgca

SEQ ID NO: 23436 - DNA, 20 bp, Artificial Sequence
  chemically synthesized
tgattcatttgatgtggtgc

SEQ ID NO: 23437 - DNA, 20 bp, Artificial Sequence
  chemically synthesized
gtgattcatttgatgtggtg

SEQ ID NO: 23438 - DNA, 20 bp, Artificial Sequence
  chemically synthesized
cctcagtgattcatttgatg

SEQ ID NO: 23439 - DNA, 20 bp, Artificial Sequence
  chemically synthesized
accacatcaaatgaatcact

SEQ ID NO: 23440 - DNA, 20 bp, Artificial Sequence
  chemically synthesized
ccacatcaaatgaatcactg

SEQ ID NO: 23441 - DNA, 20 bp, Artificial Sequence
  chemically synthesized
gaagtggatttgacaggcct

SEQ ID NO: 23442 - DNA, 20 bp, Artificial Sequence
  chemically synthesized
atttaggaagtggatttgac

SEQ ID NO: 23443 - DNA, 20 bp, Artificial Sequence
  chemically synthesized
tatttaggaagtggatttga

SEQ ID NO: 23444 - DNA, 20 bp, Artificial Sequence
  chemically synthesized
atttagaaatatttaggaag

SEQ ID NO: 23445 - DNA, 20 bp, Artificial Sequence
  chemically synthesized
agaatttagaaatatttagg

SEQ ID NO: 23446 - DNA, 20 bp, Artificial Sequence
  chemically synthesized
gagagaatttagaaatattt

SEQ ID NO: 23447 - DNA, 20 bp, Artificial Sequence
  chemically synthesized
ggagagaatttagaaatatt

SEQ ID NO: 23448 - DNA, 20 bp, Artificial Sequence
  chemically synthesized
ggagataagtggagagaatt

SEQ ID NO: 23449 - DNA, 20 bp, Artificial Sequence
  chemically synthesized
tagtaagggagataagtgga

SEQ ID NO: 23450 - DNA, 20 bp, Artificial Sequence
  chemically synthesized
agtagtaagggagataagtg

SEQ ID NO: 23451 - DNA, 20 bp, Artificial Sequence
  chemically synthesized
agagtagtaagggagataag

SEQ ID NO: 23452 - DNA, 20 bp, Artificial Sequence
  chemically synthesized
agcagagtagtaagggagat

SEQ ID NO: 23453 - DNA, 20 bp, Artificial Sequence
  chemically synthesized
gaattagcagagtagtaagg

SEQ ID NO: 23454 - DNA, 20 bp, Artificial Sequence
  chemically synthesized
ttgaattagcagagtagtaa

SEQ ID NO: 23455 - DNA, 20 bp, Artificial Sequence
  chemically synthesized
cttgaattagcagagtagta

SEQ ID NO: 23456 - DNA, 20 bp, Artificial Sequence
  chemically synthesized
gcttgaattagcagagtagt

SEQ ID NO: 23457 - DNA, 20 bp, Artificial Sequence
  chemically synthesized
ggtggcttgaattagcagag

SEQ ID NO: 23458 - DNA, 20 bp, Artificial Sequence
  chemically synthesized
tgtggtggcttgaattagca

SEQ ID NO: 23459 - DNA, 20 bp, Artificial Sequence
  chemically synthesized
ccttactactctgctaattc

SEQ ID NO: 23460 - DNA, 20 bp, Artificial Sequence
  chemically synthesized
aatgtggtggcttgaattag

SEQ ID NO: 23461 - DNA, 20 bp, Artificial Sequence
  chemically synthesized
agcaatgtggtggcttgaat

SEQ ID NO: 23462 - DNA, 20 bp, Artificial Sequence
  chemically synthesized
aatctaaaccagcaatgtgg

SEQ ID NO: 23463 - DNA, 20 bp, Artificial Sequence
  chemically synthesized
aattcaagccaccacattgc

SEQ ID NO: 23464 - DNA, 20 bp, Artificial Sequence
  chemically synthesized
agtaatctaaaccagcaatg

SEQ ID NO: 23465 - DNA, 20 bp, Artificial Sequence
  chemically synthesized
aagccaccacattgctggtt

SEQ ID NO: 23466 - DNA, 20 bp, Artificial Sequence
  chemically synthesized
cctgttgcagtaatctaaac

SEQ ID NO: 23467 - DNA, 20 bp, Artificial Sequence
  chemically synthesized
gctggtttagattactgcaa

SEQ ID NO: 23468 - DNA, 20 bp, Artificial Sequence
  chemically synthesized
ctggtttagattactgcaac

SEQ ID NO: 23469 - DNA, 20 bp, Artificial Sequence
  chemically synthesized
gacaggagaaaaacctgttg

SEQ ID NO: 23470 - DNA, 20 bp, Artificial Sequence
  chemically synthesized
gtgcgatgtgggagtgacag

SEQ ID NO: 23471 - DNA, 20 bp, Artificial Sequence
  chemically synthesized
tggtgcgatgtgggagtgac

SEQ ID NO: 23472 - DNA, 20 bp, Artificial Sequence
  chemically synthesized
ttggtgcgatgtgggagtga

SEQ ID NO: 23473 - DNA, 20 bp, Artificial Sequence
  chemically synthesized
tatggattggtgcgatgtgg

SEQ ID NO: 23474 - DNA, 20 bp, Artificial Sequence
  chemically synthesized
agtatggattggtgcgatgt

SEQ ID NO: 23475 - DNA, 20 bp, Artificial Sequence
  chemically synthesized
gagtatggattggtgcgatg

SEQ ID NO: 23476 - DNA, 20 bp, Artificial Sequence
  chemically synthesized
ctgtggaacagagtatggat

SEQ ID NO: 23477 - DNA, 20 bp, Artificial Sequence
  chemically synthesized
tcttgctgtggaacagagta

SEQ ID NO: 23478 - DNA, 20 bp, Artificial Sequence
  chemically synthesized
ccaatccatactctgttcca

SEQ ID NO: 23479 - DNA, 20 bp, Artificial Sequence
  chemically synthesized
atgattcttgctgtggaaca

SEQ ID NO: 23480 - DNA, 20 bp, Artificial Sequence
  chemically synthesized
agatgattcttgctgtggaa

SEQ ID NO: 23481 - DNA, 20 bp, Artificial Sequence
  chemically synthesized
tccatactctgttccacagc

SEQ ID NO: 23482 - DNA, 20 bp, Artificial Sequence
  chemically synthesized
tagaaagatgattcttgctg

SEQ ID NO: 23483 - DNA, 20 bp, Artificial Sequence
  chemically synthesized
acagcaagaatcatctttct

SEQ ID NO: 23484 - DNA, 20 bp, Artificial Sequence
  chemically synthesized
taatcagattgtcgcttaga

SEQ ID NO: 23485 - DNA, 20 bp, Artificial Sequence
  chemically synthesized
gacataatcagattgtcgct

SEQ ID NO: 23486 - DNA, 20 bp, Artificial Sequence
  chemically synthesized
tggcctgggggtgacataat

SEQ ID NO: 23487 - DNA, 20 bp, Artificial Sequence
  chemically synthesized
caatctgattatgtcacccc

SEQ ID NO: 23488 - DNA, 20 bp, Artificial Sequence
  chemically synthesized
aatctgattatgtcaccccc

SEQ ID NO: 23489 - DNA, 20 bp, Artificial Sequence
  chemically synthesized
ggtcaggggatttggcctgg

SEQ ID NO: 23490 - DNA, 20 bp, Artificial Sequence
  chemically synthesized
aggtcaggggatttggcctg

SEQ ID NO: 23491 - DNA, 20 bp, Artificial Sequence
  chemically synthesized
gaggtcaggggatttggcct

SEQ ID NO: 23492 - DNA, 20 bp, Artificial Sequence
  chemically synthesized
agaggtcaggggatttggcc

SEQ ID NO: 23493 - DNA, 20 bp, Artificial Sequence
  chemically synthesized
aatttagaggtcaggggatt

SEQ ID NO: 23494 - DNA, 20 bp, Artificial Sequence
  chemically synthesized
ttaaggaatttagaggtcag

SEQ ID NO: 23495 - DNA, 20 bp, Artificial Sequence
  chemically synthesized
gttaaggaatttagaggtca

SEQ ID NO: 23496 - DNA, 20 bp, Artificial Sequence
  chemically synthesized
agttaaggaatttagaggtc

SEQ ID NO: 23497 - DNA, 20 bp, Artificial Sequence
  chemically synthesized
aagttaaggaatttagaggt

SEQ ID NO: 23498 - DNA, 20 bp, Artificial Sequence
  chemically synthesized
acccaagttaaggaatttag

SEQ ID NO: 23499 - DNA, 20 bp, Artificial Sequence
  chemically synthesized
aacccaagttaaggaattta

SEQ ID NO: 23500 - DNA, 20 bp, Artificial Sequence
  chemically synthesized
aaaacccaagttaaggaatt

SEQ ID NO: 23501 - DNA, 20 bp, Artificial Sequence
  chemically synthesized
gacctctaaattccttaact

SEQ ID NO: 23502 - DNA, 20 bp, Artificial Sequence
  chemically synthesized
acctctaaattccttaactt

SEQ ID NO: 23503 - DNA, 20 bp, Artificial Sequence
  chemically synthesized
ggtttttaaaacccaagtta

SEQ ID NO: 23504 - DNA, 20 bp, Artificial Sequence
  chemically synthesized
aggtttttaaaacccaagtt

SEQ ID NO: 23505 - DNA, 20 bp, Artificial Sequence
  chemically synthesized
gtgcaaggtttttaaaaccc

SEQ ID NO: 23506 - DNA, 20 bp, Artificial Sequence
  chemically synthesized
agcaggaagcagattgtgca

SEQ ID NO: 23507 - DNA, 20 bp, Artificial Sequence
  chemically synthesized
aagcaggaagcagattgtgc

SEQ ID NO: 23508 - DNA, 20 bp, Artificial Sequence
  chemically synthesized
ctggagagagaagcaggaag

SEQ ID NO: 23509 - DNA, 20 bp, Artificial Sequence
  chemically synthesized
aggctggagagagaagcagg

SEQ ID NO: 23510 - DNA, 20 bp, Artificial Sequence
  chemically synthesized
aataggctggagagagaagc

SEQ ID NO: 23511 - DNA, 20 bp, Artificial Sequence
  chemically synthesized
taataggctggagagagaag

SEQ ID NO: 23512 - DNA, 20 bp, Artificial Sequence
  chemically synthesized
ctgcttcctgcttctctctc

SEQ ID NO: 23513 - DNA, 20 bp, Artificial Sequence
  chemically synthesized
aaataataggctggagagag

SEQ ID NO: 23514 - DNA, 20 bp, Artificial Sequence
  chemically synthesized
gtgaaataataggctggaga

SEQ ID NO: 23515 - DNA, 20 bp, Artificial Sequence
  chemically synthesized
ttgtgaaataataggctgga

SEQ ID NO: 23516 - DNA, 20 bp, Artificial Sequence
  chemically synthesized
tattgtgaaataataggctg

SEQ ID NO: 23517 - DNA, 20 bp, Artificial Sequence
  chemically synthesized
tctattgtgaaataataggc

SEQ ID NO: 23518 - DNA, 20 bp, Artificial Sequence
  chemically synthesized
aagatctattgtgaaataat

SEQ ID NO: 23519 - DNA, 20 bp, Artificial Sequence
  chemically synthesized
aaagatctattgtgaaataa

SEQ ID NO: 23520 - DNA, 20 bp, Artificial Sequence
  chemically synthesized
tccagcctattatttcacaa

SEQ ID NO: 23521 - DNA, 20 bp, Artificial Sequence
  chemically synthesized
ttcacaatagatctttcccc

SEQ ID NO: 23522 - DNA, 20 bp, Artificial Sequence
  chemically synthesized
aagcacagaattccagggga

SEQ ID NO: 23523 - DNA, 20 bp, Artificial Sequence
  chemically synthesized
gctaaagcacagaattccag

SEQ ID NO: 23524 - DNA, 20 bp, Artificial Sequence
  chemically synthesized
ggctaaagcacagaattcca

SEQ ID NO: 23525 - DNA, 20 bp, Artificial Sequence
  chemically synthesized
tggctaaagcacagaattcc

SEQ ID NO: 23526 - DNA, 20 bp, Artificial Sequence
  chemically synthesized
atggctaaagcacagaattc

SEQ ID NO: 23527 - DNA, 20 bp, Artificial Sequence
  chemically synthesized
tcccctggaattctgtgctt

SEQ ID NO: 23528 - DNA, 20 bp, Artificial Sequence
  chemically synthesized
atgtcagtatggctaaagca

SEQ ID NO: 23529 - DNA, 20 bp, Artificial Sequence
  chemically synthesized
aaaatatgtcagtatggcta

SEQ ID NO: 23530 - DNA, 20 bp, Artificial Sequence
  chemically synthesized
gaactgaaaatatgtcagta

SEQ ID NO: 23531 - DNA, 20 bp, Artificial Sequence
  chemically synthesized
ttcaggaactgaaaatatgt

SEQ ID NO: 23532 - DNA, 20 bp, Artificial Sequence
  chemically synthesized
tagccatactgacatatttt

SEQ ID NO: 23533 - DNA, 20 bp, Artificial Sequence
  chemically synthesized
agagaaagcatgacacattc

SEQ ID NO: 23534 - DNA, 20 bp, Artificial Sequence
  chemically synthesized
cagagaaagcatgacacatt

SEQ ID NO: 23535 - DNA, 20 bp, Artificial Sequence
  chemically synthesized
tgaatgtgtcatgctttctc

SEQ ID NO: 23536 - DNA, 20 bp, Artificial Sequence
  chemically synthesized
gaatgtgtcatgctttctct

SEQ ID NO: 23537 - DNA, 20 bp, Artificial Sequence
  chemically synthesized
tgtgctgaagggcccagaga

SEQ ID NO: 23538 - DNA, 20 bp, Artificial Sequence
  chemically synthesized
agcatgtgctgaagggccca

SEQ ID NO: 23539 - DNA, 20 bp, Artificial Sequence
  chemically synthesized
catgctttctctgggccctt

SEQ ID NO: 23540 - DNA, 20 bp, Artificial Sequence
  chemically synthesized
agagcatgtgctgaagggcc

SEQ ID NO: 23541 - DNA, 20 bp, Artificial Sequence
  chemically synthesized
aaagaagagcatgtgctgaa

SEQ ID NO: 23542 - DNA, 20 bp, Artificial Sequence
  chemically synthesized
gaaagaagagcatgtgctga

SEQ ID NO: 23543 - DNA, 20 bp, Artificial Sequence
  chemically synthesized
agaaagaagagcatgtgctg

SEQ ID NO: 23544 - DNA, 20 bp, Artificial Sequence
  chemically synthesized
agcgttctagtcagaaagaa

SEQ ID NO: 23545 - DNA, 20 bp, Artificial Sequence
  chemically synthesized
agagcgttctagtcagaaag

SEQ ID NO: 23546 - DNA, 20 bp, Artificial Sequence
  chemically synthesized
cacatgctcttctttctgac

SEQ ID NO: 23547 - DNA, 20 bp, Artificial Sequence
  chemically synthesized
ggaagagcgttctagtcaga

SEQ ID NO: 23548 - DNA, 20 bp, Artificial Sequence
  chemically synthesized
tctaggaagagcgttctagt

SEQ ID NO: 23549 - DNA, 20 bp, Artificial Sequence
  chemically synthesized
tctctctaggaagagcgttc

SEQ ID NO: 23550 - DNA, 20 bp, Artificial Sequence
  chemically synthesized
tctgactagaacgctcttcc

SEQ ID NO: 23551 - DNA, 20 bp, Artificial Sequence
  chemically synthesized
tgactagaacgctcttccta

SEQ ID NO: 23552 - DNA, 20 bp, Artificial Sequence
  chemically synthesized
agcagctctctctctaggaa

SEQ ID NO: 23553 - DNA, 20 bp, Artificial Sequence
  chemically synthesized
actagaacgctcttcctaga

SEQ ID NO: 23554 - DNA, 20 bp, Artificial Sequence
  chemically synthesized
taagcagctctctctctagg

SEQ ID NO: 23555 - DNA, 20 bp, Artificial Sequence
  chemically synthesized
tagaacgctcttcctagaga

SEQ ID NO: 23556 - DNA, 20 bp, Artificial Sequence
  chemically synthesized
gaacgctcttcctagagaga

SEQ ID NO: 23557 - DNA, 20 bp, Artificial Sequence
  chemically synthesized
gagtaagcagctctctctct

SEQ ID NO: 23558 - DNA, 20 bp, Artificial Sequence
  chemically synthesized
agagtaagcagctctctctc

SEQ ID NO: 23559 - DNA, 20 bp, Artificial Sequence
  chemically synthesized
ggtaactctagaagagtaag

SEQ ID NO: 23560 - DNA, 20 bp, Artificial Sequence
  chemically synthesized
gagagagctgcttactcttc

SEQ ID NO: 23561 - DNA, 20 bp, Artificial Sequence
  chemically synthesized
ctaggtaactctagaagagt

SEQ ID NO: 23562 - DNA, 20 bp, Artificial Sequence
  chemically synthesized
gagagctgcttactcttcta

SEQ ID NO: 23563 - DNA, 20 bp, Artificial Sequence
  chemically synthesized
taagctaggtaactctagaa

SEQ ID NO: 23564 - DNA, 20 bp, Artificial Sequence
  chemically synthesized
tctaagctaggtaactctag

SEQ ID NO: 23565 - DNA, 20 bp, Artificial Sequence
  chemically synthesized
atgtctaagctaggtaactc

SEQ ID NO: 23566 - DNA, 20 bp, Artificial Sequence
  chemically synthesized
cttactcttctagagttacc

SEQ ID NO: 23567 - DNA, 20 bp, Artificial Sequence
  chemically synthesized
tcttctagagttacctagct

SEQ ID NO: 23568 - DNA, 20 bp, Artificial Sequence
  chemically synthesized
gaagaggtgatgtctaagct

SEQ ID NO: 23569 - DNA, 20 bp, Artificial Sequence
  chemically synthesized
tgaagaggtgatgtctaagc

SEQ ID NO: 23570 - DNA, 20 bp, Artificial Sequence
  chemically synthesized
tgtttgaagaggtgatgtct

SEQ ID NO: 23571 - DNA, 20 bp, Artificial Sequence
  chemically synthesized
caaagaatgtttgtttgaag

SEQ ID NO: 23572 - DNA, 20 bp, Artificial Sequence
  chemically synthesized
tcaaagaatgtttgtttgaa

SEQ ID NO: 23573 - DNA, 20 bp, Artificial Sequence
  chemically synthesized
attcaaagaatgtttgtttg

SEQ ID NO: 23574 - DNA, 20 bp, Artificial Sequence
  chemically synthesized
actgtgtggaatgagattca

SEQ ID NO: 23575 - DNA, 20 bp, Artificial Sequence
  chemically synthesized
aacagctaactgtgtggaat

SEQ ID NO: 23576 - DNA, 20 bp, Artificial Sequence
  chemically synthesized
tctttgaatctcattccaca

SEQ ID NO: 23577 - DNA, 20 bp, Artificial Sequence
  chemically synthesized
tgaatctcattccacacagt

SEQ ID NO: 23578 - DNA, 20 bp, Artificial Sequence
  chemically synthesized
tatgtgaacagctaactgtg

SEQ ID NO: 23579 - DNA, 20 bp, Artificial Sequence
  chemically synthesized
cacacagttagctgttcaca

SEQ ID NO: 23580 - DNA, 20 bp, Artificial Sequence
  chemically synthesized
acaatggggtactatgtgaa

SEQ ID NO: 23581 - DNA, 20 bp, Artificial Sequence
  chemically synthesized
tgtgcaacagtgggacaatg

SEQ ID NO: 23582 - DNA, 20 bp, Artificial Sequence
  chemically synthesized
ttgtgcaacagtgggacaat

SEQ ID NO: 23583 - DNA, 20 bp, Artificial Sequence
  chemically synthesized
gttgtgcaacagtgggacaa

SEQ ID NO: 23584 - DNA, 20 bp, Artificial Sequence
  chemically synthesized
atatttagttgtgcaacagt

SEQ ID NO: 23585 - DNA, 20 bp, Artificial Sequence
  chemically synthesized
tatatttagttgtgcaacag

SEQ ID NO: 23586 - DNA, 20 bp, Artificial Sequence
  chemically synthesized
tcatatatttagttgtgcaa

SEQ ID NO: 23587 - DNA, 20 bp, Artificial Sequence
  chemically synthesized
ccatttcaatgtcatatatt

SEQ ID NO: 23588 - DNA, 20 bp, Artificial Sequence
  chemically synthesized
ctaaatatatgacattgaaa

SEQ ID NO: 23589 - DNA, 20 bp, Artificial Sequence
  chemically synthesized
atatgacattgaaatggtct

SEQ ID NO: 23590 - DNA, 20 bp, Artificial Sequence
  chemically synthesized
cattgaaatggtcttggaaa

SEQ ID NO: 23591 - DNA, 20 bp, Artificial Sequence
  chemically synthesized
ttgaaatggtcttggaaata

SEQ ID NO: 23592 - DNA, 20 bp, Artificial Sequence
  chemically synthesized
gtgatcttgtctctatttcc

SEQ ID NO: 23593 - DNA, 20 bp, Artificial Sequence
  chemically synthesized
atggtcttggaaatagagac

SEQ ID NO: 23594 - DNA, 20 bp, Artificial Sequence
  chemically synthesized
tacagttggttaaaaaaata

SEQ ID NO: 23595 - DNA, 20 bp, Artificial Sequence
  chemically synthesized
tttatttttttaaccaactg

SEQ ID NO: 23596 - DNA, 20 bp, Artificial Sequence
  chemically synthesized
gtattaagaatgtctacagt

SEQ ID NO: 23597 - DNA, 20 bp, Artificial Sequence
  chemically synthesized
taatgtattaagaatgtcta

SEQ ID NO: 23598 - DNA, 20 bp, Artificial Sequence
  chemically synthesized
aaatatatgtataatgtatt

SEQ ID NO: 23599 - DNA, 20 bp, Artificial Sequence
  chemically synthesized
ttcatgaaatttgtagacat

SEQ ID NO: 23600 - DNA, 20 bp, Artificial Sequence
  chemically synthesized
caggatgttcatgaaatttg

SEQ ID NO: 23601 - DNA, 20 bp, Artificial Sequence
  chemically synthesized
tacaaatttcatgaacatcc

SEQ ID NO: 23602 - DNA, 20 bp, Artificial Sequence
  chemically synthesized
cagtctaacaagggataacc

SEQ ID NO: 23603 - DNA, 20 bp, Artificial Sequence
  chemically synthesized
acagtctaacaagggataac

SEQ ID NO: 23604 - DNA, 20 bp, Artificial Sequence
  chemically synthesized
acatcctggttatcccttgt

SEQ ID NO: 23605 - DNA, 20 bp, Artificial Sequence
  chemically synthesized
tggaacttacagtctaacaa

SEQ ID NO: 23606 - DNA, 20 bp, Artificial Sequence
  chemically synthesized
atggaacttacagtctaaca

SEQ ID NO: 23607 - DNA, 20 bp, Artificial Sequence
  chemically synthesized
gatggaacttacagtctaac

SEQ ID NO: 23608 - DNA, 20 bp, Artificial Sequence
  chemically synthesized
gttatcccttgttagactgt

SEQ ID NO: 23609 - DNA, 20 bp, Artificial Sequence
  chemically synthesized
ttctgctctgatggaactta

SEQ ID NO: 23610 - DNA, 20 bp, Artificial Sequence
  chemically synthesized
tgttagactgtaagttccat

SEQ ID NO: 23611 - DNA, 20 bp, Artificial Sequence
  chemically synthesized
ttagactgtaagttccatca

SEQ ID NO: 23612 - DNA, 20 bp, Artificial Sequence
  chemically synthesized
gactgtaagttccatcagag

SEQ ID NO: 23613 - DNA, 20 bp, Artificial Sequence
  chemically synthesized
aggcacagtttctgctctga

SEQ ID NO: 23614 - DNA, 20 bp, Artificial Sequence
  chemically synthesized
agagcagaaactgtgcctgt

SEQ ID NO: 23615 - DNA, 20 bp, Artificial Sequence
  chemically synthesized
tgcgcccggcccaacaggca

SEQ ID NO: 23616 - DNA, 20 bp, Artificial Sequence
  chemically synthesized
gagcagaaactgtgcctgtt

SEQ ID NO: 23617 - DNA, 20 bp, Artificial Sequence
  chemically synthesized
agaaactgtgcctgttgggc

SEQ ID NO: 23618 - DNA, 20 bp, Artificial Sequence
  chemically synthesized
gccaatgcgcccggcccaac

SEQ ID NO: 23619 - DNA, 20 bp, Artificial Sequence
  chemically synthesized
gaaactgtgcctgttgggcc

SEQ ID NO: 23620 - DNA, 20 bp, Artificial Sequence
  chemically synthesized
agccaatgcgcccggcccaa

SEQ ID NO: 23621 - DNA, 20 bp, Artificial Sequence
  chemically synthesized
gcctgttgggccgggcgcat

SEQ ID NO: 23622 - DNA, 20 bp, Artificial Sequence
  chemically synthesized
caggcgtgagccaatgcgcc

SEQ ID NO: 23623 - DNA, 20 bp, Artificial Sequence
  chemically synthesized
agtgctgggattacaggcgt

SEQ ID NO: 23624 - DNA, 20 bp, Artificial Sequence
  chemically synthesized
ttggctcacgcctgtaatcc

SEQ ID NO: 23625 - DNA, 20 bp, Artificial Sequence
  chemically synthesized
tcccaaagtgctgggattac

SEQ ID NO: 23626 - DNA, 20 bp, Artificial Sequence
  chemically synthesized
ctcccaaagtgctgggatta

SEQ ID NO: 23627 - DNA, 20 bp, Artificial Sequence
  chemically synthesized
cgcctgtaatcccagcactt

SEQ ID NO: 23628 - DNA, 20 bp, Artificial Sequence
  chemically synthesized
cctcagcctcccaaagtgct

SEQ ID NO: 23629 - DNA, 20 bp, Artificial Sequence
  chemically synthesized
gcctgtaatcccagcacttt

SEQ ID NO: 23630 - DNA, 20 bp, Artificial Sequence
  chemically synthesized
gcctcagcctcccaaagtgc

SEQ ID NO: 23631 - DNA, 20 bp, Artificial Sequence
  chemically synthesized
ctgtaatcccagcactttgg

SEQ ID NO: 23632 - DNA, 20 bp, Artificial Sequence
  chemically synthesized
tgtaatcccagcactttggg

SEQ ID NO: 23633 - DNA, 20 bp, Artificial Sequence
  chemically synthesized
tcacccgcctcagcctccca

SEQ ID NO: 23634 - DNA, 20 bp, Artificial Sequence
  chemically synthesized
tcccagcactttgggaggct

SEQ ID NO: 23635 - DNA, 20 bp, Artificial Sequence
  chemically synthesized
cccagcactttgggaggctg

SEQ ID NO: 23636 - DNA, 20 bp, Artificial Sequence
  chemically synthesized
agcactttgggaggctgagg

SEQ ID NO: 23637 - DNA, 20 bp, Artificial Sequence
  chemically synthesized
gcactttgggaggctgaggc

SEQ ID NO: 23638 - DNA, 20 bp, Artificial Sequence
  chemically synthesized
ctcaggtgattcacccgcct

SEQ ID NO: 23639 - DNA, 20 bp, Artificial Sequence
  chemically synthesized
ctgaggcgggtgaatcacct

SEQ ID NO: 23640 - DNA, 20 bp, Artificial Sequence
  chemically synthesized
tgaggcgggtgaatcacctg

SEQ ID NO: 23641 - DNA, 20 bp, Artificial Sequence
  chemically synthesized
gcgggtgaatcacctgaggt

SEQ ID NO: 23642 - DNA, 20 bp, Artificial Sequence
  chemically synthesized
cgggtgaatcacctgaggtc

SEQ ID NO: 23643 - DNA, 20 bp, Artificial Sequence
  chemically synthesized
ggtctcgaactcctgacctc

SEQ ID NO: 23644 - DNA, 20 bp, Artificial Sequence
  chemically synthesized
ggtgaatcacctgaggtcag

SEQ ID NO: 23645 - DNA, 20 bp, Artificial Sequence
  chemically synthesized
tggtctcgaactcctgacct

SEQ ID NO: 23646 - DNA, 20 bp, Artificial Sequence
  chemically synthesized
tcacctgaggtcaggagttc

SEQ ID NO: 23647 - DNA, 20 bp, Artificial Sequence
  chemically synthesized
tgaggtcaggagttcgagac

SEQ ID NO: 23648 - DNA, 20 bp, Artificial Sequence
  chemically synthesized
tttcaccatgttggtcaggc

SEQ ID NO: 23649 - DNA, 20 bp, Artificial Sequence
  chemically synthesized
ggggtttcaccatgttggtc

SEQ ID NO: 23650 - DNA, 20 bp, Artificial Sequence
  chemically synthesized
cgagaccagcctgaccaaca

SEQ ID NO: 23651 - DNA, 20 bp, Artificial Sequence
  chemically synthesized
cggggtttcaccatgttggt

SEQ ID NO: 23652 - DNA, 20 bp, Artificial Sequence
  chemically synthesized
gagacggggtttcaccatgt

SEQ ID NO: 23653 - DNA, 20 bp, Artificial Sequence
  chemically synthesized
tgtattttttaatagagacg

SEQ ID NO: 23654 - DNA, 20 bp, Artificial Sequence
  chemically synthesized
ttgtattttttaatagagac

SEQ ID NO: 23655 - DNA, 20 bp, Artificial Sequence
  chemically synthesized
tttgtattttttaatagaga

SEQ ID NO: 23656 - DNA, 20 bp, Artificial Sequence
  chemically synthesized
aatttttgtattttttaata

SEQ ID NO: 23657 - DNA, 20 bp, Artificial Sequence
  chemically synthesized
ctaatttttgtattttttaa

SEQ ID NO: 23658 - DNA, 20 bp, Artificial Sequence
  chemically synthesized
ctattaaaaaatacaaaaat

SEQ ID NO: 23659 - DNA, 20 bp, Artificial Sequence
  chemically synthesized
tattaaaaaatacaaaaatt

SEQ ID NO: 23660 - DNA, 20 bp, Artificial Sequence
  chemically synthesized
aaaaaatacaaaaattaggc

SEQ ID NO: 23661 - DNA, 20 bp, Artificial Sequence
  chemically synthesized
aaaaatacaaaaattaggcc

SEQ ID NO: 23662 - DNA, 20 bp, Artificial Sequence
  chemically synthesized
tacaaaaattaggccgggcg

SEQ ID NO: 23663 - DNA, 20 bp, Artificial Sequence
  chemically synthesized
aaaaattaggccgggcgtgg

SEQ ID NO: 23664 - DNA, 20 bp, Artificial Sequence
  chemically synthesized
caggcatgagccaccacgcc

SEQ ID NO: 23665 - DNA, 20 bp, Artificial Sequence
  chemically synthesized
agtgctgggattacaggcat

SEQ ID NO: 23666 - DNA, 20 bp, Artificial Sequence
  chemically synthesized
gtggctcatgcctgtaatcc

SEQ ID NO: 23667 - DNA, 20 bp, Artificial Sequence
  chemically synthesized
tcccaaagtgctgggattac

SEQ ID NO: 23668 - DNA, 20 bp, Artificial Sequence
  chemically synthesized
ctcccaaagtgctgggatta

SEQ ID NO: 23669 - DNA, 20 bp, Artificial Sequence
  chemically synthesized
tgcctgtaatcccagcactt

SEQ ID NO: 23670 - DNA, 20 bp, Artificial Sequence
  chemically synthesized
cctcggcctcccaaagtgct

SEQ ID NO: 23671 - DNA, 20 bp, Artificial Sequence
  chemically synthesized
gcctgtaatcccagcacttt

SEQ ID NO: 23672 - DNA, 20 bp, Artificial Sequence
  chemically synthesized
tcctcggcctcccaaagtgc

SEQ ID NO: 23673 - DNA, 20 bp, Artificial Sequence
  chemically synthesized
ctgtaatcccagcactttgg

SEQ ID NO: 23674 - DNA, 20 bp, Artificial Sequence
  chemically synthesized
tgtaatcccagcactttggg

SEQ ID NO: 23675 - DNA, 20 bp, Artificial Sequence
  chemically synthesized
ccgccctcctcggcctccca

SEQ ID NO: 23676 - DNA, 20 bp, Artificial Sequence
  chemically synthesized
tcccagcactttgggaggcc

SEQ ID NO: 23677 - DNA, 20 bp, Artificial Sequence
  chemically synthesized
cccagcactttgggaggccg

SEQ ID NO: 23678 - DNA, 20 bp, Artificial Sequence
  chemically synthesized
cagcactttgggaggccgag

SEQ ID NO: 23679 - DNA, 20 bp, Artificial Sequence
  chemically synthesized
agcactttgggaggccgagg

SEQ ID NO: 23680 - DNA, 20 bp, Artificial Sequence
  chemically synthesized
gcactttgggaggccgagga

SEQ ID NO: 23681 - DNA, 20 bp, Artificial Sequence
  chemically synthesized
ctttgggaggccgaggaggg

SEQ ID NO: 23682 - DNA, 20 bp, Artificial Sequence
  chemically synthesized
accttgtgatccgccctcct

SEQ ID NO: 23683 - DNA, 20 bp, Artificial Sequence
  chemically synthesized
ggccgaggagggcggatcac

SEQ ID NO: 23684 - DNA, 20 bp, Artificial Sequence
  chemically synthesized
gccgaggagggcggatcaca

SEQ ID NO: 23685 - DNA, 20 bp, Artificial Sequence
  chemically synthesized
aggagggcggatcacaaggt

SEQ ID NO: 23686 - DNA, 20 bp, Artificial Sequence
  chemically synthesized
ggagggcggatcacaaggtc

SEQ ID NO: 23687 - DNA, 20 bp, Artificial Sequence
  chemically synthesized
agggcggatcacaaggtcag

SEQ ID NO: 23688 - DNA, 20 bp, Artificial Sequence
  chemically synthesized
gatcacaaggtcaggagatc

SEQ ID NO: 23689 - DNA, 20 bp, Artificial Sequence
  chemically synthesized
tcaggagatcgagaccatcc

SEQ ID NO: 23690 - DNA, 20 bp, Artificial Sequence
  chemically synthesized
tttcaccgtgttagccagga

SEQ ID NO: 23691 - DNA, 20 bp, Artificial Sequence
  chemically synthesized
ggggtttcaccgtgttagcc

SEQ ID NO: 23692 - DNA, 20 bp, Artificial Sequence
  chemically synthesized
cgagaccatcctggctaaca

SEQ ID NO: 23693 - DNA, 20 bp, Artificial Sequence
  chemically synthesized
cggggtttcaccgtgttagc

SEQ ID NO: 23694 - DNA, 20 bp, Artificial Sequence
  chemically synthesized
gaggcggggtttcaccgtgt

SEQ ID NO: 23695 - DNA, 20 bp, Artificial Sequence
  chemically synthesized
ttgtaattttagtagaggcg

SEQ ID NO: 23696 - DNA, 20 bp, Artificial Sequence
  chemically synthesized
tttgtaattttagtagaggc

SEQ ID NO: 23697 - DNA, 20 bp, Artificial Sequence
  chemically synthesized
ttttgtaattttagtagagg

SEQ ID NO: 23698 - DNA, 20 bp, Artificial Sequence
  chemically synthesized
tgtttttgtaattttagtag

SEQ ID NO: 23699 - DNA, 20 bp, Artificial Sequence
  chemically synthesized
ttgtttttgtaattttagta

SEQ ID NO: 23700 - DNA, 20 bp, Artificial Sequence
  chemically synthesized
ttttgtttttgtaattttag

SEQ ID NO: 23701 - DNA, 20 bp, Artificial Sequence
  chemically synthesized
taattttgtttttgtaattt

SEQ ID NO: 23702 - DNA, 20 bp, Artificial Sequence
  chemically synthesized
taaaattacaaaaacaaaat

SEQ ID NO: 23703 - DNA, 20 bp, Artificial Sequence
  chemically synthesized
attacaaaaacaaaattagc

SEQ ID NO: 23704 - DNA, 20 bp, Artificial Sequence
  chemically synthesized
ttacaaaaacaaaattagcc

SEQ ID NO: 23705 - DNA, 20 bp, Artificial Sequence
  chemically synthesized
aaaacaaaattagccaggcg

SEQ ID NO: 23706 - DNA, 20 bp, Artificial Sequence
  chemically synthesized
acaaaattagccaggcgtgg

SEQ ID NO: 23707 - DNA, 20 bp, Artificial Sequence
  chemically synthesized
caggcacccaccaccacgcc

SEQ ID NO: 23708 - DNA, 20 bp, Artificial Sequence
  chemically synthesized
aaattagccaggcgtggtgg

SEQ ID NO: 23709 - DNA, 20 bp, Artificial Sequence
  chemically synthesized
aattagccaggcgtggtggt

SEQ ID NO: 23710 - DNA, 20 bp, Artificial Sequence
  chemically synthesized
ggcgtggtggtgggtgcctg

SEQ ID NO: 23711 - DNA, 20 bp, Artificial Sequence
  chemically synthesized
gtggtgggtgcctgtagtcc

SEQ ID NO: 23712 - DNA, 20 bp, Artificial Sequence
  chemically synthesized
tccggagtagctgggactac

SEQ ID NO: 23713 - DNA, 20 bp, Artificial Sequence
  chemically synthesized
ctccggagtagctgggacta

SEQ ID NO: 23714 - DNA, 20 bp, Artificial Sequence
  chemically synthesized
gctcagcctccggagtagct

SEQ ID NO: 23715 - DNA, 20 bp, Artificial Sequence
  chemically synthesized
gcctgtagtcccagctactc

SEQ ID NO: 23716 - DNA, 20 bp, Artificial Sequence
  chemically synthesized
ggctcagcctccggagtagc

SEQ ID NO: 23717 - DNA, 20 bp, Artificial Sequence
  chemically synthesized
ctgtagtcccagctactccg

SEQ ID NO: 23718 - DNA, 20 bp, Artificial Sequence
  chemically synthesized
tgtagtcccagctactccgg

SEQ ID NO: 23719 - DNA, 20 bp, Artificial Sequence
  chemically synthesized
tcctggctcagcctccggag

SEQ ID NO: 23720 - DNA, 20 bp, Artificial Sequence
  chemically synthesized
ttctcctggctcagcctccg

SEQ ID NO: 23721 - DNA, 20 bp, Artificial Sequence
  chemically synthesized
tcccagctactccggaggct

SEQ ID NO: 23722 - DNA, 20 bp, Artificial Sequence
  chemically synthesized
cattctcctggctcagcctc

SEQ ID NO: 23723 - DNA, 20 bp, Artificial Sequence
  chemically synthesized
agctactccggaggctgagc

SEQ ID NO: 23724 - DNA, 20 bp, Artificial Sequence
  chemically synthesized
gctactccggaggctgagcc

SEQ ID NO: 23725 - DNA, 20 bp, Artificial Sequence
  chemically synthesized
tactccggaggctgagccag

SEQ ID NO: 23726 - DNA, 20 bp, Artificial Sequence
  chemically synthesized
ttcacgccattctcctggct

SEQ ID NO: 23727 - DNA, 20 bp, Artificial Sequence
  chemically synthesized
cggaggctgagccaggagaa

SEQ ID NO: 23728 - DNA, 20 bp, Artificial Sequence
  chemically synthesized
ccgggttcacgccattctcc

SEQ ID NO: 23729 - DNA, 20 bp, Artificial Sequence
  chemically synthesized
ccaggagaatggcgtgaacc

SEQ ID NO: 23730 - DNA, 20 bp, Artificial Sequence
  chemically synthesized
caggagaatggcgtgaaccc

SEQ ID NO: 23731 - DNA, 20 bp, Artificial Sequence
  chemically synthesized
ggagaatggcgtgaacccgg

SEQ ID NO: 23732 - DNA, 20 bp, Artificial Sequence
  chemically synthesized
gagaatggcgtgaacccggg

SEQ ID NO: 23733 - DNA, 20 bp, Artificial Sequence
  chemically synthesized
aatggcgtgaacccgggagg

SEQ ID NO: 23734 - DNA, 20 bp, Artificial Sequence
  chemically synthesized
cactgcagactccacctccc

SEQ ID NO: 23735 - DNA, 20 bp, Artificial Sequence
  chemically synthesized
tggcgtgaacccgggaggtg

SEQ ID NO: 23736 - DNA, 20 bp, Artificial Sequence
  chemically synthesized
tcactgcagactccacctcc

SEQ ID NO: 23737 - DNA, 20 bp, Artificial Sequence
  chemically synthesized
aacccgggaggtggagtctg

SEQ ID NO: 23738 - DNA, 20 bp, Artificial Sequence
  chemically synthesized
cgggaggtggagtctgcagt

SEQ ID NO: 23739 - DNA, 20 bp, Artificial Sequence
  chemically synthesized
ggcgcgttctaggctcactg

SEQ ID NO: 23740 - DNA, 20 bp, Artificial Sequence
  chemically synthesized
ggtggagtctgcagtgagcc

SEQ ID NO: 23741 - DNA, 20 bp, Artificial Sequence
  chemically synthesized
ggagtgcagtggcgcgttct

SEQ ID NO: 23742 - DNA, 20 bp, Artificial Sequence
  chemically synthesized
tggagtgcagtggcgcgttc

SEQ ID NO: 23743 - DNA, 20 bp, Artificial Sequence
  chemically synthesized
tcaccctggctggagtgcag

SEQ ID NO: 23744 - DNA, 20 bp, Artificial Sequence
  chemically synthesized
tagaacgcgccactgcactc

SEQ ID NO: 23745 - DNA, 20 bp, Artificial Sequence
  chemically synthesized
ctgtcaccctggctggagtg

SEQ ID NO: 23746 - DNA, 20 bp, Artificial Sequence
  chemically synthesized
acgcgccactgcactccagc

SEQ ID NO: 23747 - DNA, 20 bp, Artificial Sequence
  chemically synthesized
cgcgccactgcactccagcc

SEQ ID NO: 23748 - DNA, 20 bp, Artificial Sequence
  chemically synthesized
gcgccactgcactccagcca

SEQ ID NO: 23749 - DNA, 20 bp, Artificial Sequence
  chemically synthesized
tcgctctgtcaccctggctg

SEQ ID NO: 23750 - DNA, 20 bp, Artificial Sequence
  chemically synthesized
tctcgctctgtcaccctggc

SEQ ID NO: 23751 - DNA, 20 bp, Artificial Sequence
  chemically synthesized
ctgcactccagccagggtga

SEQ ID NO: 23752 - DNA, 20 bp, Artificial Sequence
  chemically synthesized
agagtctcgctctgtcaccc

SEQ ID NO: 23753 - DNA, 20 bp, Artificial Sequence
  chemically synthesized
gcactccagccagggtgaca

SEQ ID NO: 23754 - DNA, 20 bp, Artificial Sequence
  chemically synthesized
tccagccagggtgacagagc

SEQ ID NO: 23755 - DNA, 20 bp, Artificial Sequence
  chemically synthesized
ttttgtttttttttgagaca

SEQ ID NO: 23756 - DNA, 20 bp, Artificial Sequence
  chemically synthesized
tgttttgtttttttttgaga

SEQ ID NO: 23757 - DNA, 20 bp, Artificial Sequence
  chemically synthesized
tgtttgttttgttttttttt

SEQ ID NO: 23758 - DNA, 20 bp, Artificial Sequence
  chemically synthesized
aacaaacaaaaaacaaaaat

SEQ ID NO: 23759 - DNA, 20 bp, Artificial Sequence
  chemically synthesized
aacaaaaaacaaaaattagc

SEQ ID NO: 23760 - DNA, 20 bp, Artificial Sequence
  chemically synthesized
acaaaaaacaaaaattagcc

SEQ ID NO: 23761 - DNA, 20 bp, Artificial Sequence
  chemically synthesized
aaacaaaaattagccgggca

SEQ ID NO: 23762 - DNA, 20 bp, Artificial Sequence
  chemically synthesized
caaaaattagccgggcatgg

SEQ ID NO: 23763 - DNA, 20 bp, Artificial Sequence
  chemically synthesized
caggcatgccccaccatgcc

SEQ ID NO: 23764 - DNA, 20 bp, Artificial Sequence
  chemically synthesized
aaaaattagccgggcatggt

SEQ ID NO: 23765 - DNA, 20 bp, Artificial Sequence
  chemically synthesized
aaaattagccgggcatggtg

SEQ ID NO: 23766 - DNA, 20 bp, Artificial Sequence
  chemically synthesized
gtggggcatgcctgtaatcc

SEQ ID NO: 23767 - DNA, 20 bp, Artificial Sequence
  chemically synthesized
tcccaggtagctgggattac

SEQ ID NO: 23768 - DNA, 20 bp, Artificial Sequence
  chemically synthesized
ctcccaggtagctgggatta

SEQ ID NO: 23769 - DNA, 20 bp, Artificial Sequence
  chemically synthesized
tgcctgtaatcccagctacc

SEQ ID NO: 23770 - DNA, 20 bp, Artificial Sequence
  chemically synthesized
cgtcagcctcccaggtagct

SEQ ID NO: 23771 - DNA, 20 bp, Artificial Sequence
  chemically synthesized
gcctgtaatcccagctacct

SEQ ID NO: 23772 - DNA, 20 bp, Artificial Sequence
  chemically synthesized
gcgtcagcctcccaggtagc

SEQ ID NO: 23773 - DNA, 20 bp, Artificial Sequence
  chemically synthesized
ctgtaatcccagctacctgg

SEQ ID NO: 23774 - DNA, 20 bp, Artificial Sequence
  chemically synthesized
tgtaatcccagctacctggg

SEQ ID NO: 23775 - DNA, 20 bp, Artificial Sequence
  chemically synthesized
tcctgcgtcagcctcccagg

SEQ ID NO: 23776 - DNA, 20 bp, Artificial Sequence
  chemically synthesized
ttctcctgcgtcagcctccc

SEQ ID NO: 23777 - DNA, 20 bp, Artificial Sequence
  chemically synthesized
attctcctgcgtcagcctcc

SEQ ID NO: 23778 - DNA, 20 bp, Artificial Sequence
  chemically synthesized
agctacctgggaggctgacg

SEQ ID NO: 23779 - DNA, 20 bp, Artificial Sequence
  chemically synthesized
gctacctgggaggctgacgc

SEQ ID NO: 23780 - DNA, 20 bp, Artificial Sequence
  chemically synthesized
tacctgggaggctgacgcag

SEQ ID NO: 23781 - DNA, 20 bp, Artificial Sequence
  chemically synthesized
ttcaagtgattctcctgcgt

SEQ ID NO: 23782 - DNA, 20 bp, Artificial Sequence
  chemically synthesized
gcaggagaatcacttgaacc

SEQ ID NO: 23783 - DNA, 20 bp, Artificial Sequence
  chemically synthesized
caggagaatcacttgaacct

SEQ ID NO: 23784 - DNA, 20 bp, Artificial Sequence
  chemically synthesized
aacctccacctcccaggttc

SEQ ID NO: 23785 - DNA, 20 bp, Artificial Sequence
  chemically synthesized
ggagaatcacttgaacctgg

SEQ ID NO: 23786 - DNA, 20 bp, Artificial Sequence
  chemically synthesized
gagaatcacttgaacctggg

SEQ ID NO: 23787 - DNA, 20 bp, Artificial Sequence
  chemically synthesized
aatcacttgaacctgggagg

SEQ ID NO: 23788 - DNA, 20 bp, Artificial Sequence
  chemically synthesized
cactgcaacctccacctccc

SEQ ID NO: 23789 - DNA, 20 bp, Artificial Sequence
  chemically synthesized
tcacttgaacctgggaggtg

SEQ ID NO: 23790 - DNA, 20 bp, Artificial Sequence
  chemically synthesized
tcactgcaacctccacctcc

SEQ ID NO: 23791 - DNA, 20 bp, Artificial Sequence
  chemically synthesized
cacttgaacctgggaggtgg

SEQ ID NO: 23792 - DNA, 20 bp, Artificial Sequence
  chemically synthesized
aacctgggaggtggaggttg

SEQ ID NO: 23793 - DNA, 20 bp, Artificial Sequence
  chemically synthesized
tgggaggtggaggttgcagt

SEQ ID NO: 23794 - DNA, 20 bp, Artificial Sequence
  chemically synthesized
gcagtggagtggcgcaatat

SEQ ID NO: 23795 - DNA, 20 bp, Artificial Sequence
  chemically synthesized
tgcagtggagtggcgcaata

SEQ ID NO: 23796 - DNA, 20 bp, Artificial Sequence
  chemically synthesized
caggctggagtgcagtggag

SEQ ID NO: 23797 - DNA, 20 bp, Artificial Sequence
  chemically synthesized
gcccaggctggagtgcagtg

SEQ ID NO: 23798 - DNA, 20 bp, Artificial Sequence
  chemically synthesized
ttgcccaggctggagtgcag

SEQ ID NO: 23799 - DNA, 20 bp, Artificial Sequence
  chemically synthesized
tgcgccactccactgcactc

SEQ ID NO: 23800 - DNA, 20 bp, Artificial Sequence
  chemically synthesized
ctgttgcccaggctggagtg

SEQ ID NO: 23801 - DNA, 20 bp, Artificial Sequence
  chemically synthesized
cactccactgcactccagcc

SEQ ID NO: 23802 - DNA, 20 bp, Artificial Sequence
  chemically synthesized
actccactgcactccagcct

SEQ ID NO: 23803 - DNA, 20 bp, Artificial Sequence
  chemically synthesized
ttgctctgttgcccaggctg

SEQ ID NO: 23804 - DNA, 20 bp, Artificial Sequence
  chemically synthesized
tcttgctctgttgcccaggc

SEQ ID NO: 23805 - DNA, 20 bp, Artificial Sequence
  chemically synthesized
ctgcactccagcctgggcaa

SEQ ID NO: 23806 - DNA, 20 bp, Artificial Sequence
  chemically synthesized
ggagtcttgctctgttgccc

SEQ ID NO: 23807 - DNA, 20 bp, Artificial Sequence
  chemically synthesized
gcactccagcctgggcaaca

SEQ ID NO: 23808 - DNA, 20 bp, Artificial Sequence
  chemically synthesized
tggagtcttgctctgttgcc

SEQ ID NO: 23809 - DNA, 20 bp, Artificial Sequence
  chemically synthesized
tccagcctgggcaacagagc

SEQ ID NO: 23810 - DNA, 20 bp, Artificial Sequence
  chemically synthesized
ttttttttttttttgagatg

SEQ ID NO: 23811 - DNA, 20 bp, Artificial Sequence
  chemically synthesized
ttttttttttttttttgaga

SEQ ID NO: 23812 - DNA, 20 bp, Artificial Sequence
  chemically synthesized
tttttttttttttttttttt

SEQ ID NO: 23813 - DNA, 20 bp, Artificial Sequence
  chemically synthesized
aaaaaaaaaaaaaaaaaaaa

SEQ ID NO: 23814 - DNA, 20 bp, Artificial Sequence
  chemically synthesized
aaaaaaaaaaaacagaaaaa

SEQ ID NO: 23815 - DNA, 20 bp, Artificial Sequence
  chemically synthesized
aaaaaacagaaaaaaagaaa

SEQ ID NO: 23816 - DNA, 20 bp, Artificial Sequence
  chemically synthesized
atatgcccatgaaacaggca

SEQ ID NO: 23817 - DNA, 20 bp, Artificial Sequence
  chemically synthesized
aagaaactgtgcctgtttca

SEQ ID NO: 23818 - DNA, 20 bp, Artificial Sequence
  chemically synthesized
agaaactgtgcctgtttcat

SEQ ID NO: 23819 - DNA, 20 bp, Artificial Sequence
  chemically synthesized
tgatgatatgcccatgaaac

SEQ ID NO: 23820 - DNA, 20 bp, Artificial Sequence
  chemically synthesized
ttgatgatatgcccatgaaa

SEQ ID NO: 23821 - DNA, 20 bp, Artificial Sequence
  chemically synthesized
gggcatatcatcaatgcaca

SEQ ID NO: 23822 - DNA, 20 bp, Artificial Sequence
  chemically synthesized
catcaatgcacacagaccct

SEQ ID NO: 23823 - DNA, 20 bp, Artificial Sequence
  chemically synthesized
ataactctactattgtctga

SEQ ID NO: 23824 - DNA, 20 bp, Artificial Sequence
  chemically synthesized
gcacacagaccctcagacaa

SEQ ID NO: 23825 - DNA, 20 bp, Artificial Sequence
  chemically synthesized
tataactctactattgtctg

SEQ ID NO: 23826 - DNA, 20 bp, Artificial Sequence
  chemically synthesized
gtataactctactattgtct

SEQ ID NO: 23827 - DNA, 20 bp, Artificial Sequence
  chemically synthesized
cacagaccctcagacaatag

SEQ ID NO: 23828 - DNA, 20 bp, Artificial Sequence
  chemically synthesized
cagaccctcagacaatagta

SEQ ID NO: 23829 - DNA, 20 bp, Artificial Sequence
  chemically synthesized
agctctatcatgtcatcaaa

SEQ ID NO: 23830 - DNA, 20 bp, Artificial Sequence
  chemically synthesized
taaactatttgatgacatga

SEQ ID NO: 23831 - DNA, 20 bp, Artificial Sequence
  chemically synthesized
aactatttgatgacatgata

SEQ ID NO: 23832 - DNA, 20 bp, Artificial Sequence
  chemically synthesized
aaaaatcctgaagtgttaca

SEQ ID NO: 23833 - DNA, 20 bp, Artificial Sequence
  chemically synthesized
gatagagctgtgtaacactt

SEQ ID NO: 23834 - DNA, 20 bp, Artificial Sequence
  chemically synthesized
atagagctgtgtaacacttc

SEQ ID NO: 23835 - DNA, 20 bp, Artificial Sequence
  chemically synthesized
acatctgtggaaaaatcctg

SEQ ID NO: 23836 - DNA, 20 bp, Artificial Sequence
  chemically synthesized
aacacttcaggatttttcca

SEQ ID NO: 23837 - DNA, 20 bp, Artificial Sequence
  chemically synthesized
ccttttttatcatacatctg

SEQ ID NO: 23838 - DNA, 20 bp, Artificial Sequence
  chemically synthesized
tccacagatgtatgataaaa

SEQ ID NO: 23839 - DNA, 20 bp, Artificial Sequence
  chemically synthesized
ccacagatgtatgataaaaa

SEQ ID NO: 23840 - DNA, 20 bp, Artificial Sequence
  chemically synthesized
acagatgtatgataaaaaag

SEQ ID NO: 23841 - DNA, 20 bp, Artificial Sequence
  chemically synthesized
cagatgtatgataaaaaagg

SEQ ID NO: 23842 - DNA, 20 bp, Artificial Sequence
  chemically synthesized
tgtatgataaaaaaggagga

SEQ ID NO: 23843 - DNA, 20 bp, Artificial Sequence
  chemically synthesized
aagtggtagaggaaaaatga

SEQ ID NO: 23844 - DNA, 20 bp, Artificial Sequence
  chemically synthesized
gcagatgaatgaagtggtag

SEQ ID NO: 23845 - DNA, 20 bp, Artificial Sequence
  chemically synthesized
tgcagatgaatgaagtggta

SEQ ID NO: 23846 - DNA, 20 bp, Artificial Sequence
  chemically synthesized
cgtgcagatgaatgaagtgg

SEQ ID NO: 23847 - DNA, 20 bp, Artificial Sequence
  chemically synthesized
taacgtgcagatgaatgaag

SEQ ID NO: 23848 - DNA, 20 bp, Artificial Sequence
  chemically synthesized
tgctaacgtgcagatgaatg

SEQ ID NO: 23849 - DNA, 20 bp, Artificial Sequence
  chemically synthesized
cacttcattcatctgcacgt

SEQ ID NO: 23850 - DNA, 20 bp, Artificial Sequence
  chemically synthesized
ttagcttgaatgctaacgtg

SEQ ID NO: 23851 - DNA, 20 bp, Artificial Sequence
  chemically synthesized
tcatctgcacgttagcattc

SEQ ID NO: 23852 - DNA, 20 bp, Artificial Sequence
  chemically synthesized
catagacatgtgtggtttat

SEQ ID NO: 23853 - DNA, 20 bp, Artificial Sequence
  chemically synthesized
ccaaacttcatagacatgtg

SEQ ID NO: 23854 - DNA, 20 bp, Artificial Sequence
  chemically synthesized
ataaaccacacatgtctatg

SEQ ID NO: 23855 - DNA, 20 bp, Artificial Sequence
  chemically synthesized
ccacacatgtctatgaagtt

SEQ ID NO: 23856 - DNA, 20 bp, Artificial Sequence
  chemically synthesized
ctgatctaaaccaaacttca

SEQ ID NO: 23857 - DNA, 20 bp, Artificial Sequence
  chemically synthesized
catgtctatgaagtttggtt

SEQ ID NO: 23858 - DNA, 20 bp, Artificial Sequence
  chemically synthesized
ctatgaagtttggtttagat

SEQ ID NO: 23859 - DNA, 20 bp, Artificial Sequence
  chemically synthesized
gaagtttggtttagatcaga

SEQ ID NO: 23860 - DNA, 20 bp, Artificial Sequence
  chemically synthesized
tggtttagatcagatagtca

SEQ ID NO: 23861 - DNA, 20 bp, Artificial Sequence
  chemically synthesized
caaaatgtacttagtattag

SEQ ID NO: 23862 - DNA, 20 bp, Artificial Sequence
  chemically synthesized
agtcatagtcttctaatact

SEQ ID NO: 23863 - DNA, 20 bp, Artificial Sequence
  chemically synthesized
ttacaaaatgtacttagtat

SEQ ID NO: 23864 - DNA, 20 bp, Artificial Sequence
  chemically synthesized
ttctttttacaaaatgtact

SEQ ID NO: 23865 - DNA, 20 bp, Artificial Sequence
  chemically synthesized
tactaagtacattttgtaaa

SEQ ID NO: 23866 - DNA, 20 bp, Artificial Sequence
  chemically synthesized
tgtaaaaagaaaaaaaaaca

SEQ ID NO: 23867 - DNA, 20 bp, Artificial Sequence
  chemically synthesized
gtaaaaagaaaaaaaaacaa

SEQ ID NO: 23868 - DNA, 20 bp, Artificial Sequence
  chemically synthesized
aaaagaaaaaaaaacaaagg

SEQ ID NO: 23869 - DNA, 20 bp, Artificial Sequence
  chemically synthesized
aaaaaaaacaaaggtagaac

SEQ ID NO: 23870 - DNA, 20 bp, Artificial Sequence
  chemically synthesized
aaaaaaacaaaggtagaaca

SEQ ID NO: 23871 - DNA, 20 bp, Artificial Sequence
  chemically synthesized
aggtagaacaaggattgtgc

SEQ ID NO: 23872 - DNA, 20 bp, Artificial Sequence
  chemically synthesized
aggattgtgcaagtttcaca

SEQ ID NO: 23873 - DNA, 20 bp, Artificial Sequence
  chemically synthesized
ggattgtgcaagtttcacaa

SEQ ID NO: 23874 - DNA, 20 bp, Artificial Sequence
  chemically synthesized
aagtttcacaaaggtaatta

SEQ ID NO: 23875 - DNA, 20 bp, Artificial Sequence
  chemically synthesized
ccaactactggcattggcat

SEQ ID NO: 23876 - DNA, 20 bp, Artificial Sequence
  chemically synthesized
atggatgccgatgccaatgc

SEQ ID NO: 23877 - DNA, 20 bp, Artificial Sequence
  chemically synthesized
gatgccgatgccaatgccag

SEQ ID NO: 23878 - DNA, 20 bp, Artificial Sequence
  chemically synthesized
tattttccaactactggcat

SEQ ID NO: 23879 - DNA, 20 bp, Artificial Sequence
  chemically synthesized
ccgatgccaatgccagtagt

SEQ ID NO: 23880 - DNA, 20 bp, Artificial Sequence
  chemically synthesized
aatttttattttccaactac

SEQ ID NO: 23881 - DNA, 20 bp, Artificial Sequence
  chemically synthesized
tgatgttgaattaagatatt

SEQ ID NO: 23882 - DNA, 20 bp, Artificial Sequence
  chemically synthesized
tcagctactgatgttgaatt

SEQ ID NO: 23883 - DNA, 20 bp, Artificial Sequence
  chemically synthesized
tcaatatcttaattcaacat

SEQ ID NO: 23884 - DNA, 20 bp, Artificial Sequence
  chemically synthesized
atatcttaattcaacatcag

SEQ ID NO: 23885 - DNA, 20 bp, Artificial Sequence
  chemically synthesized
ttaattcaacatcagtagct

SEQ ID NO: 23886 - DNA, 20 bp, Artificial Sequence
  chemically synthesized
taattcaacatcagtagctg

SEQ ID NO: 23887 - DNA, 20 bp, Artificial Sequence
  chemically synthesized
caacatcagtagctgaggaa

SEQ ID NO: 23888 - DNA, 20 bp, Artificial Sequence
  chemically synthesized
tcattcctgtcaccattcct

SEQ ID NO: 23889 - DNA, 20 bp, Artificial Sequence
  chemically synthesized
cagtagctgaggaatggtga

SEQ ID NO: 23890 - DNA, 20 bp, Artificial Sequence
  chemically synthesized
agtagctgaggaatggtgac

SEQ ID NO: 23891 - DNA, 20 bp, Artificial Sequence
  chemically synthesized
agaatgttttgttttatttt

SEQ ID NO: 23892 - DNA, 20 bp, Artificial Sequence
  chemically synthesized
aaaaataaaacaaaacattc

SEQ ID NO: 23893 - DNA, 20 bp, Artificial Sequence
  chemically synthesized
aaaataaaacaaaacattct

SEQ ID NO: 23894 - DNA, 20 bp, Artificial Sequence
  chemically synthesized
tccttggcctagagtttgcc

SEQ ID NO: 23895 - DNA, 20 bp, Artificial Sequence
  chemically synthesized
aaaacattctaggcaaactc

SEQ ID NO: 23896 - DNA, 20 bp, Artificial Sequence
  chemically synthesized
aaacattctaggcaaactct

SEQ ID NO: 23897 - DNA, 20 bp, Artificial Sequence
  chemically synthesized
ttctaggcaaactctaggcc

SEQ ID NO: 23898 - DNA, 20 bp, Artificial Sequence
  chemically synthesized
tctaggcaaactctaggcca

SEQ ID NO: 23899 - DNA, 20 bp, Artificial Sequence
  chemically synthesized
tttaatgtatccttggccta

SEQ ID NO: 23900 - DNA, 20 bp, Artificial Sequence
  chemically synthesized
tctttaatgtatccttggcc

SEQ ID NO: 23901 - DNA, 20 bp, Artificial Sequence
  chemically synthesized
ttcattctttaatgtatcct

SEQ ID NO: 23902 - DNA, 20 bp, Artificial Sequence
  chemically synthesized
tctaggccaaggatacatta

SEQ ID NO: 23903 - DNA, 20 bp, Artificial Sequence
  chemically synthesized
gaatgaattatacattgcaa

SEQ ID NO: 23904 - DNA, 20 bp, Artificial Sequence
  chemically synthesized
aatgaattatacattgcaac

SEQ ID NO: 23905 - DNA, 20 bp, Artificial Sequence
  chemically synthesized
cattgcaacaggaattgtga

SEQ ID NO: 23906 - DNA, 20 bp, Artificial Sequence
  chemically synthesized
ttacttagagaggggagaaa

SEQ ID NO: 23907 - DNA, 20 bp, Artificial Sequence
  chemically synthesized
acatttttacttagagaggg

SEQ ID NO: 23908 - DNA, 20 bp, Artificial Sequence
  chemically synthesized
cagctgtttctcccctctct

SEQ ID NO: 23909 - DNA, 20 bp, Artificial Sequence
  chemically synthesized
gtacatttttacttagagag

SEQ ID NO: 23910 - DNA, 20 bp, Artificial Sequence
  chemically synthesized
ggtacatttttacttagaga

SEQ ID NO: 23911 - DNA, 20 bp, Artificial Sequence
  chemically synthesized
gggtacatttttacttagag

SEQ ID NO: 23912 - DNA, 20 bp, Artificial Sequence
  chemically synthesized
tgggtacatttttacttaga

SEQ ID NO: 23913 - DNA, 20 bp, Artificial Sequence
  chemically synthesized
gttgggtacatttttactta

SEQ ID NO: 23914 - DNA, 20 bp, Artificial Sequence
  chemically synthesized
aggttgggtacatttttact

SEQ ID NO: 23915 - DNA, 20 bp, Artificial Sequence
  chemically synthesized
cttagaataaaaagtaggtt

SEQ ID NO: 23916 - DNA, 20 bp, Artificial Sequence
  chemically synthesized
gcttagaataaaaagtaggt

SEQ ID NO: 23917 - DNA, 20 bp, Artificial Sequence
  chemically synthesized
ctttgcttagaataaaaagt

SEQ ID NO: 23918 - DNA, 20 bp, Artificial Sequence
  chemically synthesized
tctttgcttagaataaaaag

SEQ ID NO: 23919 - DNA, 20 bp, Artificial Sequence
  chemically synthesized
atgtctttgcttagaataaa

SEQ ID NO: 23920 - DNA, 20 bp, Artificial Sequence
  chemically synthesized
cccaacctactttttattct

SEQ ID NO: 23921 - DNA, 20 bp, Artificial Sequence
  chemically synthesized
cctactttttattctaagca

SEQ ID NO: 23922 - DNA, 20 bp, Artificial Sequence
  chemically synthesized
cttgatactatgtctttgct

SEQ ID NO: 23923 - DNA, 20 bp, Artificial Sequence
  chemically synthesized
ttttattctaagcaaagaca

SEQ ID NO: 23924 - DNA, 20 bp, Artificial Sequence
  chemically synthesized
ctaagcaaagacatagtatc

SEQ ID NO: 23925 - DNA, 20 bp, Artificial Sequence
  chemically synthesized
gtatcaagatcttcaaatac

SEQ ID NO: 23926 - DNA, 20 bp, Artificial Sequence
  chemically synthesized
taagtattggccagtatttg

SEQ ID NO: 23927 - DNA, 20 bp, Artificial Sequence
  chemically synthesized
cctttgctgtaagtattggc

SEQ ID NO: 23928 - DNA, 20 bp, Artificial Sequence
  chemically synthesized
caaatactggccaatactta

SEQ ID NO: 23929 - DNA, 20 bp, Artificial Sequence
  chemically synthesized
aggccctttgctgtaagtat

SEQ ID NO: 23930 - DNA, 20 bp, Artificial Sequence
  chemically synthesized
actggccaatacttacagca

SEQ ID NO: 23931 - DNA, 20 bp, Artificial Sequence
  chemically synthesized
ctggccaatacttacagcaa

SEQ ID NO: 23932 - DNA, 20 bp, Artificial Sequence
  chemically synthesized
tgcagaaggccctttgctgt

SEQ ID NO: 23933 - DNA, 20 bp, Artificial Sequence
  chemically synthesized
tggccaatacttacagcaaa

SEQ ID NO: 23934 - DNA, 20 bp, Artificial Sequence
  chemically synthesized
ttacagcaaagggccttctg

SEQ ID NO: 23935 - DNA, 20 bp, Artificial Sequence
  chemically synthesized
gaaactccgaagactgcaga

SEQ ID NO: 23936 - DNA, 20 bp, Artificial Sequence
  chemically synthesized
tgaaactccgaagactgcag

SEQ ID NO: 23937 - DNA, 20 bp, Artificial Sequence
  chemically synthesized
aaagggccttctgcagtctt

SEQ ID NO: 23938 - DNA, 20 bp, Artificial Sequence
  chemically synthesized
ccatgaaactccgaagactg

SEQ ID NO: 23939 - DNA, 20 bp, Artificial Sequence
  chemically synthesized
agggccttctgcagtcttcg

SEQ ID NO: 23940 - DNA, 20 bp, Artificial Sequence
  chemically synthesized
aggactgccatgaaactccg

SEQ ID NO: 23941 - DNA, 20 bp, Artificial Sequence
  chemically synthesized
ctgcagtcttcggagtttca

SEQ ID NO: 23942 - DNA, 20 bp, Artificial Sequence
  chemically synthesized
cagtcttcggagtttcatgg

SEQ ID NO: 23943 - DNA, 20 bp, Artificial Sequence
  chemically synthesized
gagtttcatggcagtcctat

SEQ ID NO: 23944 - DNA, 20 bp, Artificial Sequence
  chemically synthesized
tcatggcagtcctataagct

SEQ ID NO: 23945 - DNA, 20 bp, Artificial Sequence
  chemically synthesized
atgtcagattctcagcttat

SEQ ID NO: 23946 - DNA, 20 bp, Artificial Sequence
  chemically synthesized
aatgtcagattctcagctta

SEQ ID NO: 23947 - DNA, 20 bp, Artificial Sequence
  chemically synthesized
cctgaataatgtcagattct

SEQ ID NO: 23948 - DNA, 20 bp, Artificial Sequence
  chemically synthesized
tcagctgacctgaataatgt

SEQ ID NO: 23949 - DNA, 20 bp, Artificial Sequence
  chemically synthesized
gctgagaatctgacattatt

SEQ ID NO: 23950 - DNA, 20 bp, Artificial Sequence
  chemically synthesized
ctgagaatctgacattattc

SEQ ID NO: 23951 - DNA, 20 bp, Artificial Sequence
  chemically synthesized
gaatctgacattattcaggt

SEQ ID NO: 23952 - DNA, 20 bp, Artificial Sequence
  chemically synthesized
cattattcaggtcagctgaa

SEQ ID NO: 23953 - DNA, 20 bp, Artificial Sequence
  chemically synthesized
ttattcaggtcagctgaaaa

SEQ ID NO: 23954 - DNA, 20 bp, Artificial Sequence
  chemically synthesized
tattcaggtcagctgaaaag

SEQ ID NO: 23955 - DNA, 20 bp, Artificial Sequence
  chemically synthesized
attcaggtcagctgaaaaga

SEQ ID NO: 23956 - DNA, 20 bp, Artificial Sequence
  chemically synthesized
ctctttgttttccctctttt

SEQ ID NO: 23957 - DNA, 20 bp, Artificial Sequence
  chemically synthesized
agctgaaaagagggaaaaca

SEQ ID NO: 23958 - DNA, 20 bp, Artificial Sequence
  chemically synthesized
ctgaaaagagggaaaacaaa

SEQ ID NO: 23959 - DNA, 20 bp, Artificial Sequence
  chemically synthesized
aagagcatttgttattccat

SEQ ID NO: 23960 - DNA, 20 bp, Artificial Sequence
  chemically synthesized
gggttgtctgttatttctga

SEQ ID NO: 23961 - DNA, 20 bp, Artificial Sequence
  chemically synthesized
tgttattccatcagaaataa

SEQ ID NO: 23962 - DNA, 20 bp, Artificial Sequence
  chemically synthesized
aatcactgggcgtcgggggt

SEQ ID NO: 23963 - DNA, 20 bp, Artificial Sequence
  chemically synthesized
aaatcactgggcgtcggggg

SEQ ID NO: 23964 - DNA, 20 bp, Artificial Sequence
  chemically synthesized
ggcaaatcactgggcgtcgg

SEQ ID NO: 23965 - DNA, 20 bp, Artificial Sequence
  chemically synthesized
gacaacccacccccgacgcc

SEQ ID NO: 23966 - DNA, 20 bp, Artificial Sequence
  chemically synthesized
tggcaaatcactgggcgtcg

SEQ ID NO: 23967 - DNA, 20 bp, Artificial Sequence
  chemically synthesized
ttggcaaatcactgggcgtc

SEQ ID NO: 23968 - DNA, 20 bp, Artificial Sequence
  chemically synthesized
attggcaaatcactgggcgt

SEQ ID NO: 23969 - DNA, 20 bp, Artificial Sequence
  chemically synthesized
gtagttattggcaaatcact

SEQ ID NO: 23970 - DNA, 20 bp, Artificial Sequence
  chemically synthesized
tgtagttattggcaaatcac

SEQ ID NO: 23971 - DNA, 20 bp, Artificial Sequence
  chemically synthesized
tttgtggtggttgtagttat

SEQ ID NO: 23972 - DNA, 20 bp, Artificial Sequence
  chemically synthesized
ggctatttttgtggtggttg

SEQ ID NO: 23973 - DNA, 20 bp, Artificial Sequence
  chemically synthesized
tttctaggctatttttgtgg

SEQ ID NO: 23974 - DNA, 20 bp, Artificial Sequence
  chemically synthesized
aactacaaccaccacaaaaa

SEQ ID NO: 23975 - DNA, 20 bp, Artificial Sequence
  chemically synthesized
tgttttctaggctatttttg

SEQ ID NO: 23976 - DNA, 20 bp, Artificial Sequence
  chemically synthesized
caaccaccacaaaaatagcc

SEQ ID NO: 23977 - DNA, 20 bp, Artificial Sequence
  chemically synthesized
atacacactatatgttttct

SEQ ID NO: 23978 - DNA, 20 bp, Artificial Sequence
  chemically synthesized
tatacacactatatgttttc

SEQ ID NO: 23979 - DNA, 20 bp, Artificial Sequence
  chemically synthesized
aaaatagcctagaaaacata

SEQ ID NO: 23980 - DNA, 20 bp, Artificial Sequence
  chemically synthesized
acatatagtgtgtatacgcc

SEQ ID NO: 23981 - DNA, 20 bp, Artificial Sequence
  chemically synthesized
gtgtgtatacgccaagcttt

SEQ ID NO: 23982 - DNA, 20 bp, Artificial Sequence
  chemically synthesized
aattttcacctccgaaagct

SEQ ID NO: 23983 - DNA, 20 bp, Artificial Sequence
  chemically synthesized
gtgtatacgccaagctttcg

SEQ ID NO: 23984 - DNA, 20 bp, Artificial Sequence
  chemically synthesized
tgtatacgccaagctttcgg

SEQ ID NO: 23985 - DNA, 20 bp, Artificial Sequence
  chemically synthesized
aacagaattttcacctccga

SEQ ID NO: 23986 - DNA, 20 bp, Artificial Sequence
  chemically synthesized
aggtgaaaattctgttaacg

SEQ ID NO: 23987 - DNA, 20 bp, Artificial Sequence
  chemically synthesized
ggtgaaaattctgttaacgt

SEQ ID NO: 23988 - DNA, 20 bp, Artificial Sequence
  chemically synthesized
ttttcttttccccacgttaa

SEQ ID NO: 23989 - DNA, 20 bp, Artificial Sequence
  chemically synthesized
gtgaaaattctgttaacgtg

SEQ ID NO: 23990 - DNA, 20 bp, Artificial Sequence
  chemically synthesized
aattctgttaacgtggggaa

SEQ ID NO: 23991 - DNA, 20 bp, Artificial Sequence
  chemically synthesized
cctggttgtcaaagggcaaa

SEQ ID NO: 23992 - DNA, 20 bp, Artificial Sequence
  chemically synthesized
tcctggttgtcaaagggcaa

SEQ ID NO: 23993 - DNA, 20 bp, Artificial Sequence
  chemically synthesized
tagccttcctggttgtcaaa

SEQ ID NO: 23994 - DNA, 20 bp, Artificial Sequence
  chemically synthesized
ttagccttcctggttgtcaa

SEQ ID NO: 23995 - DNA, 20 bp, Artificial Sequence
  chemically synthesized
tccttttgccctttgacaac

SEQ ID NO: 23996 - DNA, 20 bp, Artificial Sequence
  chemically synthesized
cttagccttcctggttgtca

SEQ ID NO: 23997 - DNA, 20 bp, Artificial Sequence
  chemically synthesized
ccttttgccctttgacaacc

SEQ ID NO: 23998 - DNA, 20 bp, Artificial Sequence
  chemically synthesized
tttgccctttgacaaccagg

SEQ ID NO: 23999 - DNA, 20 bp, Artificial Sequence
  chemically synthesized
ttgccctttgacaaccagga

SEQ ID NO: 24000 - DNA, 20 bp, Artificial Sequence
  chemically synthesized
ttcacagaacttagccttcc

SEQ ID NO: 24001 - DNA, 20 bp, Artificial Sequence
  chemically synthesized
ctttgacaaccaggaaggct

SEQ ID NO: 24002 - DNA, 20 bp, Artificial Sequence
  chemically synthesized
actttagtcttcacagaact

SEQ ID NO: 24003 - DNA, 20 bp, Artificial Sequence
  chemically synthesized
caggaaggctaagttctgtg

SEQ ID NO: 24004 - DNA, 20 bp, Artificial Sequence
  chemically synthesized
ctataccactttagtcttca

SEQ ID NO: 24005 - DNA, 20 bp, Artificial Sequence
  chemically synthesized
gctaagttctgtgaagacta

SEQ ID NO: 24006 - DNA, 20 bp, Artificial Sequence
  chemically synthesized
aagttctgtgaagactaaag

SEQ ID NO: 24007 - DNA, 20 bp, Artificial Sequence
  chemically synthesized
cccttcaggctataccactt

SEQ ID NO: 24008 - DNA, 20 bp, Artificial Sequence
  chemically synthesized
ctgtgaagactaaagtggta

SEQ ID NO: 24009 - DNA, 20 bp, Artificial Sequence
  chemically synthesized
gactaaagtggtatagcctg

SEQ ID NO: 24010 - DNA, 20 bp, Artificial Sequence
  chemically synthesized
actaaagtggtatagcctga

SEQ ID NO: 24011 - DNA, 20 bp, Artificial Sequence
  chemically synthesized
ctaaagtggtatagcctgaa

SEQ ID NO: 24012 - DNA, 20 bp, Artificial Sequence
  chemically synthesized
ggactacatgaatgcccttc

SEQ ID NO: 24013 - DNA, 20 bp, Artificial Sequence
  chemically synthesized
aggactacatgaatgccctt

SEQ ID NO: 24014 - DNA, 20 bp, Artificial Sequence
  chemically synthesized
tagcctgaagggcattcatg

SEQ ID NO: 24015 - DNA, 20 bp, Artificial Sequence
  chemically synthesized
attcatgtagtcctgttccc

SEQ ID NO: 24016 - DNA, 20 bp, Artificial Sequence
  chemically synthesized
atctctttcctcttgggaac

SEQ ID NO: 24017 - DNA, 20 bp, Artificial Sequence
  chemically synthesized
tcatgtagtcctgttcccaa

SEQ ID NO: 24018 - DNA, 20 bp, Artificial Sequence
  chemically synthesized
catctctttcctcttgggaa

SEQ ID NO: 24019 - DNA, 20 bp, Artificial Sequence
  chemically synthesized
catgtagtcctgttcccaag

SEQ ID NO: 24020 - DNA, 20 bp, Artificial Sequence
  chemically synthesized
tagtcctgttcccaagagga

SEQ ID NO: 24021 - DNA, 20 bp, Artificial Sequence
  chemically synthesized
ctgtccatctctttcctctt

SEQ ID NO: 24022 - DNA, 20 bp, Artificial Sequence
  chemically synthesized
cctgtccatctctttcctct

SEQ ID NO: 24023 - DNA, 20 bp, Artificial Sequence
  chemically synthesized
gtcctgttcccaagaggaaa

SEQ ID NO: 24024 - DNA, 20 bp, Artificial Sequence
  chemically synthesized
tgttcccaagaggaaagaga

SEQ ID NO: 24025 - DNA, 20 bp, Artificial Sequence
  chemically synthesized
cccaagaggaaagagatgga

SEQ ID NO: 24026 - DNA, 20 bp, Artificial Sequence
  chemically synthesized
ccaagaggaaagagatggac

SEQ ID NO: 24027 - DNA, 20 bp, Artificial Sequence
  chemically synthesized
ggacaggcattatttttttc

SEQ ID NO: 24028 - DNA, 20 bp, Artificial Sequence
  chemically synthesized
aggcattatttttttctaga

SEQ ID NO: 24029 - DNA, 20 bp, Artificial Sequence
  chemically synthesized
agtagatccagattactttc

SEQ ID NO: 24030 - DNA, 20 bp, Artificial Sequence
  chemically synthesized
tttttttctagaaagtaatc

SEQ ID NO: 24031 - DNA, 20 bp, Artificial Sequence
  chemically synthesized
aagattcactacagtagatc

SEQ ID NO: 24032 - DNA, 20 bp, Artificial Sequence
  chemically synthesized
aaagtaatctggatctactg

SEQ ID NO: 24033 - DNA, 20 bp, Artificial Sequence
  chemically synthesized
gcagaaaagattcactacag

SEQ ID NO: 24034 - DNA, 20 bp, Artificial Sequence
  chemically synthesized
tgtgcagaaaagattcacta

SEQ ID NO: 24035 - DNA, 20 bp, Artificial Sequence
  chemically synthesized
ctctttaatcttgtgcagaa

SEQ ID NO: 24036 - DNA, 20 bp, Artificial Sequence
  chemically synthesized
gtagtgaatcttttctgcac

SEQ ID NO: 24037 - DNA, 20 bp, Artificial Sequence
  chemically synthesized
ttgttctctttaatcttgtg

SEQ ID NO: 24038 - DNA, 20 bp, Artificial Sequence
  chemically synthesized
atcttttctgcacaagatta

SEQ ID NO: 24039 - DNA, 20 bp, Artificial Sequence
  chemically synthesized
cttttctgcacaagattaaa

SEQ ID NO: 24040 - DNA, 20 bp, Artificial Sequence
  chemically synthesized
tgcacaagattaaagagaac

SEQ ID NO: 24041 - DNA, 20 bp, Artificial Sequence
  chemically synthesized
caagaaatacattatttaaa

SEQ ID NO: 24042 - DNA, 20 bp, Artificial Sequence
  chemically synthesized
tacattatttaaatagctat

SEQ ID NO: 24043 - DNA, 20 bp, Artificial Sequence
  chemically synthesized
cttgattgtttaaggtctta

SEQ ID NO: 24044 - DNA, 20 bp, Artificial Sequence
  chemically synthesized
tattgccacttgattgttta

SEQ ID NO: 24045 - DNA, 20 bp, Artificial Sequence
  chemically synthesized
atattgccacttgattgttt

SEQ ID NO: 24046 - DNA, 20 bp, Artificial Sequence
  chemically synthesized
ctataagaccttaaacaatc

SEQ ID NO: 24047 - DNA, 20 bp, Artificial Sequence
  chemically synthesized
taagaccttaaacaatcaag

SEQ ID NO: 24048 - DNA, 20 bp, Artificial Sequence
  chemically synthesized
tataacattttttctgactg

SEQ ID NO: 24049 - DNA, 20 bp, Artificial Sequence
  chemically synthesized
aacattttttctgactgtag

SEQ ID NO: 24050 - DNA, 20 bp, Artificial Sequence
  chemically synthesized
gcatgtataacttctacagt

SEQ ID NO: 24051 - DNA, 20 bp, Artificial Sequence
  chemically synthesized
gtgagcatgtataacttcta

SEQ ID NO: 24052 - DNA, 20 bp, Artificial Sequence
  chemically synthesized
gaagttatacatgctcactt

SEQ ID NO: 24053 - DNA, 20 bp, Artificial Sequence
  chemically synthesized
aagttatacatgctcacttt

SEQ ID NO: 24054 - DNA, 20 bp, Artificial Sequence
  chemically synthesized
atgtctaagttacccaaagt

SEQ ID NO: 24055 - DNA, 20 bp, Artificial Sequence
  chemically synthesized
ttaaatgtctaagttaccca

SEQ ID NO: 24056 - DNA, 20 bp, Artificial Sequence
  chemically synthesized
catgctcactttgggtaact

SEQ ID NO: 24057 - DNA, 20 bp, Artificial Sequence
  chemically synthesized
tatgtatatgttaaatgtct

SEQ ID NO: 24058 - DNA, 20 bp, Artificial Sequence
  chemically synthesized
taatcaaataaatcatccac

SEQ ID NO: 24059 - DNA, 20 bp, Artificial Sequence
  chemically synthesized
tttttgagtttatgggcttg

SEQ ID NO: 24060 - DNA, 20 bp, Artificial Sequence
  chemically synthesized
gtgcctatttttgagtttat

SEQ ID NO: 24061 - DNA, 20 bp, Artificial Sequence
  chemically synthesized
tgtgcctatttttgagttta

SEQ ID NO: 24062 - DNA, 20 bp, Artificial Sequence
  chemically synthesized
caagcccataaactcaaaaa

SEQ ID NO: 24063 - DNA, 20 bp, Artificial Sequence
  chemically synthesized
aagcccataaactcaaaaat

SEQ ID NO: 24064 - DNA, 20 bp, Artificial Sequence
  chemically synthesized
agccagttgtgcctattttt

SEQ ID NO: 24065 - DNA, 20 bp, Artificial Sequence
  chemically synthesized
aactcaaaaataggcacaac

SEQ ID NO: 24066 - DNA, 20 bp, Artificial Sequence
  chemically synthesized
caaaaataggcacaactggc

SEQ ID NO: 24067 - DNA, 20 bp, Artificial Sequence
  chemically synthesized
catgagccactgaatccagc

SEQ ID NO: 24068 - DNA, 20 bp, Artificial Sequence
  chemically synthesized
taggcacaactggctggatt

SEQ ID NO: 24069 - DNA, 20 bp, Artificial Sequence
  chemically synthesized
gcacaactggctggattcag

SEQ ID NO: 24070 - DNA, 20 bp, Artificial Sequence
  chemically synthesized
caggcatgagccactgaatc

SEQ ID NO: 24071 - DNA, 20 bp, Artificial Sequence
  chemically synthesized
agcgttgggattacaggcat

SEQ ID NO: 24072 - DNA, 20 bp, Artificial Sequence
  chemically synthesized
tctcaaagcgttgggattac

SEQ ID NO: 24073 - DNA, 20 bp, Artificial Sequence
  chemically synthesized
ctctcaaagcgttgggatta

SEQ ID NO: 24074 - DNA, 20 bp, Artificial Sequence
  chemically synthesized
ccttggcctctcaaagcgtt

SEQ ID NO: 24075 - DNA, 20 bp, Artificial Sequence
  chemically synthesized
gcctgtaatcccaacgcttt

SEQ ID NO: 24076 - DNA, 20 bp, Artificial Sequence
  chemically synthesized
accttggcctctcaaagcgt

SEQ ID NO: 24077 - DNA, 20 bp, Artificial Sequence
  chemically synthesized
ctgtaatcccaacgctttga

SEQ ID NO: 24078 - DNA, 20 bp, Artificial Sequence
  chemically synthesized
tgtaatcccaacgctttgag

SEQ ID NO: 24079 - DNA, 20 bp, Artificial Sequence
  chemically synthesized
cctcccaccttggcctctca

SEQ ID NO: 24080 - DNA, 20 bp, Artificial Sequence
  chemically synthesized
tcccaacgctttgagaggcc

SEQ ID NO: 24081 - DNA, 20 bp, Artificial Sequence
  chemically synthesized
cccaacgctttgagaggcca

SEQ ID NO: 24082 - DNA, 20 bp, Artificial Sequence
  chemically synthesized
aacgctttgagaggccaagg

SEQ ID NO: 24083 - DNA, 20 bp, Artificial Sequence
  chemically synthesized
acgctttgagaggccaaggt

SEQ ID NO: 24084 - DNA, 20 bp, Artificial Sequence
  chemically synthesized
gctttgagaggccaaggtgg

SEQ ID NO: 24085 - DNA, 20 bp, Artificial Sequence
  chemically synthesized
ctttgagaggccaaggtggg

SEQ ID NO: 24086 - DNA, 20 bp, Artificial Sequence
  chemically synthesized
ctcaagcagtcctcccacct

SEQ ID NO: 24087 - DNA, 20 bp, Artificial Sequence
  chemically synthesized
ccaaggtgggaggactgctt

SEQ ID NO: 24088 - DNA, 20 bp, Artificial Sequence
  chemically synthesized
caaggtgggaggactgcttg

SEQ ID NO: 24089 - DNA, 20 bp, Artificial Sequence
  chemically synthesized
cttaagctcctggcctcaag

SEQ ID NO: 24090 - DNA, 20 bp, Artificial Sequence
  chemically synthesized
gtgggaggactgcttgaggc

SEQ ID NO: 24091 - DNA, 20 bp, Artificial Sequence
  chemically synthesized
tgggaggactgcttgaggcc

SEQ ID NO: 24092 - DNA, 20 bp, Artificial Sequence
  chemically synthesized
ggtcttaagctcctggcctc

SEQ ID NO: 24093 - DNA, 20 bp, Artificial Sequence
  chemically synthesized
ggaggactgcttgaggccag

SEQ ID NO: 24094 - DNA, 20 bp, Artificial Sequence
  chemically synthesized
ctgcttgaggccaggagctt

SEQ ID NO: 24095 - DNA, 20 bp, Artificial Sequence
  chemically synthesized
ccaagctggtcttaagctcc

SEQ ID NO: 24096 - DNA, 20 bp, Artificial Sequence
  chemically synthesized
tgaggccaggagcttaagac

SEQ ID NO: 24097 - DNA, 20 bp, Artificial Sequence
  chemically synthesized
atgttgcccaagctggtctt

SEQ ID NO: 24098 - DNA, 20 bp, Artificial Sequence
  chemically synthesized
ccaggagcttaagaccagct

SEQ ID NO: 24099 - DNA, 20 bp, Artificial Sequence
  chemically synthesized
caggagcttaagaccagctt

SEQ ID NO: 24100 - DNA, 20 bp, Artificial Sequence
  chemically synthesized
tctcactatgttgcccaagc

SEQ ID NO: 24101 - DNA, 20 bp, Artificial Sequence
  chemically synthesized
gggatctcactatgttgccc

SEQ ID NO: 24102 - DNA, 20 bp, Artificial Sequence
  chemically synthesized
taagaccagcttgggcaaca

SEQ ID NO: 24103 - DNA, 20 bp, Artificial Sequence
  chemically synthesized
accagcttgggcaacatagt

SEQ ID NO: 24104 - DNA, 20 bp, Artificial Sequence
  chemically synthesized
taaactttttttgtagagat

SEQ ID NO: 24105 - DNA, 20 bp, Artificial Sequence
  chemically synthesized
ataaactttttttgtagaga

SEQ ID NO: 24106 - DNA, 20 bp, Artificial Sequence
  chemically synthesized
ttatataaactttttttgta

SEQ ID NO: 24107 - DNA, 20 bp, Artificial Sequence
  chemically synthesized
agatcccatctctacaaaaa

SEQ ID NO: 24108 - DNA, 20 bp, Artificial Sequence
  chemically synthesized
gtttatataaactttttttg

SEQ ID NO: 24109 - DNA, 20 bp, Artificial Sequence
  chemically synthesized
tttatataaaccttttaaat

SEQ ID NO: 24110 - DNA, 20 bp, Artificial Sequence
  chemically synthesized
gttaacagtgcttatttaaa

SEQ ID NO: 24111 - DNA, 20 bp, Artificial Sequence
  chemically synthesized
tgttaacagtgcttatttaa

SEQ ID NO: 24112 - DNA, 20 bp, Artificial Sequence
  chemically synthesized
aaaaatactcaaaatgttaa

SEQ ID NO: 24113 - DNA, 20 bp, Artificial Sequence
  chemically synthesized
ataagcactgttaacatttt

SEQ ID NO: 24114 - DNA, 20 bp, Artificial Sequence
  chemically synthesized
acacacatagacacatatgt

SEQ ID NO: 24115 - DNA, 20 bp, Artificial Sequence
  chemically synthesized
ttaaatacatatcacacaca

SEQ ID NO: 24116 - DNA, 20 bp, Artificial Sequence
  chemically synthesized
tatgtatttaaaaatataat

SEQ ID NO: 24117 - DNA, 20 bp, Artificial Sequence
  chemically synthesized
atgtatttaaaaatataatt

SEQ ID NO: 24118 - DNA, 20 bp, Artificial Sequence
  chemically synthesized
ttaggaataaaataaacatt

SEQ ID NO: 24119 - DNA, 20 bp, Artificial Sequence
  chemically synthesized
tgattgtaccttagaatata

SEQ ID NO: 24120 - DNA, 20 bp, Artificial Sequence
  chemically synthesized
aacatttggctctatattct

SEQ ID NO: 24121 - DNA, 20 bp, Artificial Sequence
  chemically synthesized
acatttggctctatattcta

SEQ ID NO: 24122 - DNA, 20 bp, Artificial Sequence
  chemically synthesized
aatgattgtaccttagaata

SEQ ID NO: 24123 - DNA, 20 bp, Artificial Sequence
  chemically synthesized
acattagaatgattgtacct

SEQ ID NO: 24124 - DNA, 20 bp, Artificial Sequence
  chemically synthesized
ggtacaatcattctaatgtt

SEQ ID NO: 24125 - DNA, 20 bp, Artificial Sequence
  chemically synthesized
tgttattctgtgctgaacat

SEQ ID NO: 24126 - DNA, 20 bp, Artificial Sequence
  chemically synthesized
aatcattctaatgttcagca

SEQ ID NO: 24127 - DNA, 20 bp, Artificial Sequence
  chemically synthesized
aacaacaatatatgttactg

SEQ ID NO: 24128 - DNA, 20 bp, Artificial Sequence
  chemically synthesized
accggtgactgcagaaacca

SEQ ID NO: 24129 - DNA, 20 bp, Artificial Sequence
  chemically synthesized
atatgttactgtggtttctg

SEQ ID NO: 24130 - DNA, 20 bp, Artificial Sequence
  chemically synthesized
actgtggtttctgcagtcac

SEQ ID NO: 24131 - DNA, 20 bp, Artificial Sequence
  chemically synthesized
gcttgatagaccggtgactg

SEQ ID NO: 24132 - DNA, 20 bp, Artificial Sequence
  chemically synthesized
tctgcagtcaccggtctatc

SEQ ID NO: 24133 - DNA, 20 bp, Artificial Sequence
  chemically synthesized
tgagtcagggcttgatagac

SEQ ID NO: 24134 - DNA, 20 bp, Artificial Sequence
  chemically synthesized
tggcgtgagtcagggcttga

SEQ ID NO: 24135 - DNA, 20 bp, Artificial Sequence
  chemically synthesized
ctgctaggtggcgtgagtca

SEQ ID NO: 24136 - DNA, 20 bp, Artificial Sequence
  chemically synthesized
cctgctaggtggcgtgagtc

SEQ ID NO: 24137 - DNA, 20 bp, Artificial Sequence
  chemically synthesized
tcctgctaggtggcgtgagt

SEQ ID NO: 24138 - DNA, 20 bp, Artificial Sequence
  chemically synthesized
agcttcctgctaggtggcgt

SEQ ID NO: 24139 - DNA, 20 bp, Artificial Sequence
  chemically synthesized
aagccctgactcacgccacc

SEQ ID NO: 24140 - DNA, 20 bp, Artificial Sequence
  chemically synthesized
ccctgactcacgccacctag

SEQ ID NO: 24141 - DNA, 20 bp, Artificial Sequence
  chemically synthesized
cctgactcacgccacctagc

SEQ ID NO: 24142 - DNA, 20 bp, Artificial Sequence
  chemically synthesized
aaatatagcttcctgctagg

SEQ ID NO: 24143 - DNA, 20 bp, Artificial Sequence
  chemically synthesized
gactcacgccacctagcagg

SEQ ID NO: 24144 - DNA, 20 bp, Artificial Sequence
  chemically synthesized
tctaaatatagcttcctgct

SEQ ID NO: 24145 - DNA, 20 bp, Artificial Sequence
  chemically synthesized
atctaaatatagcttcctgc

SEQ ID NO: 24146 - DNA, 20 bp, Artificial Sequence
  chemically synthesized
acctagcaggaagctatatt

SEQ ID NO: 24147 - DNA, 20 bp, Artificial Sequence
  chemically synthesized
gtaagaacatcatctaaata

SEQ ID NO: 24148 - DNA, 20 bp, Artificial Sequence
  chemically synthesized
tttagatgatgttcttactc

SEQ ID NO: 24149 - DNA, 20 bp, Artificial Sequence
  chemically synthesized
aggcttgtgcagacttgagt

SEQ ID NO: 24150 - DNA, 20 bp, Artificial Sequence
  chemically synthesized
atcaaggcttgtgcagactt

SEQ ID NO: 24151 - DNA, 20 bp, Artificial Sequence
  chemically synthesized
gttcttactcaagtctgcac

SEQ ID NO: 24152 - DNA, 20 bp, Artificial Sequence
  chemically synthesized
agtatctatcaaggcttgtg

SEQ ID NO: 24153 - DNA, 20 bp, Artificial Sequence
  chemically synthesized
caagtctgcacaagccttga

SEQ ID NO: 24154 - DNA, 20 bp, Artificial Sequence
  chemically synthesized
atgtagcccagtatctatca

SEQ ID NO: 24155 - DNA, 20 bp, Artificial Sequence
  chemically synthesized
aatgtagcccagtatctatc

SEQ ID NO: 24156 - DNA, 20 bp, Artificial Sequence
  chemically synthesized
gcacaagccttgatagatac

SEQ ID NO: 24157 - DNA, 20 bp, Artificial Sequence
  chemically synthesized
cacaagccttgatagatact

SEQ ID NO: 24158 - DNA, 20 bp, Artificial Sequence
  chemically synthesized
ttcctgaaataaatgtagcc

SEQ ID NO: 24159 - DNA, 20 bp, Artificial Sequence
  chemically synthesized
ctgagttcctgaaataaatg

SEQ ID NO: 24160 - DNA, 20 bp, Artificial Sequence
  chemically synthesized
atactgggctacatttattt

SEQ ID NO: 24161 - DNA, 20 bp, Artificial Sequence
  chemically synthesized
tactgggctacatttatttc

SEQ ID NO: 24162 - DNA, 20 bp, Artificial Sequence
  chemically synthesized
ctacatttatttcaggaact

SEQ ID NO: 24163 - DNA, 20 bp, Artificial Sequence
  chemically synthesized
tcaaggagctttttggagct

SEQ ID NO: 24164 - DNA, 20 bp, Artificial Sequence
  chemically synthesized
ttcaggaactcagctccaaa

SEQ ID NO: 24165 - DNA, 20 bp, Artificial Sequence
  chemically synthesized
tgtcttcaaggagctttttg

SEQ ID NO: 24166 - DNA, 20 bp, Artificial Sequence
  chemically synthesized
cttgtcttcaaggagctttt

SEQ ID NO: 24167 - DNA, 20 bp, Artificial Sequence
  chemically synthesized
cagctccaaaaagctccttg

SEQ ID NO: 24168 - DNA, 20 bp, Artificial Sequence
  chemically synthesized
acagagttcttgtcttcaag

SEQ ID NO: 24169 - DNA, 20 bp, Artificial Sequence
  chemically synthesized
ccaaaaagctccttgaagac

SEQ ID NO: 24170 - DNA, 20 bp, Artificial Sequence
  chemically synthesized
tgacagagttcttgtcttca

SEQ ID NO: 24171 - DNA, 20 bp, Artificial Sequence
  chemically synthesized
gtgacagagttcttgtcttc

SEQ ID NO: 24172 - DNA, 20 bp, Artificial Sequence
  chemically synthesized
aatgacagaagtaggtgaca

SEQ ID NO: 24173 - DNA, 20 bp, Artificial Sequence
  chemically synthesized
aaaatgacagaagtaggtga

SEQ ID NO: 24174 - DNA, 20 bp, Artificial Sequence
  chemically synthesized
ctaggaaaaatgacagaagt

SEQ ID NO: 24175 - DNA, 20 bp, Artificial Sequence
  chemically synthesized
gctaggaaaaatgacagaag

SEQ ID NO: 24176 - DNA, 20 bp, Artificial Sequence
  chemically synthesized
gttgctaggaaaaatgacag

SEQ ID NO: 24177 - DNA, 20 bp, Artificial Sequence
  chemically synthesized
taagttgctaggaaaaatga

SEQ ID NO: 24178 - DNA, 20 bp, Artificial Sequence
  chemically synthesized
cctacttctgtcatttttcc

SEQ ID NO: 24179 - DNA, 20 bp, Artificial Sequence
  chemically synthesized
cagttgcatattaagttgct

SEQ ID NO: 24180 - DNA, 20 bp, Artificial Sequence
  chemically synthesized
gcagttgcatattaagttgc

SEQ ID NO: 24181 - DNA, 20 bp, Artificial Sequence
  chemically synthesized
tcagagggcagttgcatatt

SEQ ID NO: 24182 - DNA, 20 bp, Artificial Sequence
  chemically synthesized
aaaacagctttttcagaggg

SEQ ID NO: 24183 - DNA, 20 bp, Artificial Sequence
  chemically synthesized
tatgcaactgccctctgaaa

SEQ ID NO: 24184 - DNA, 20 bp, Artificial Sequence
  chemically synthesized
attaaaacagctttttcaga

SEQ ID NO: 24185 - DNA, 20 bp, Artificial Sequence
  chemically synthesized
tattaaaacagctttttcag

SEQ ID NO: 24186 - DNA, 20 bp, Artificial Sequence
  chemically synthesized
gtattaaaacagctttttca

SEQ ID NO: 24187 - DNA, 20 bp, Artificial Sequence
  chemically synthesized
ctgtattaaaacagcttttt

SEQ ID NO: 24188 - DNA, 20 bp, Artificial Sequence
  chemically synthesized
gtccatgatctgtattaaaa

SEQ ID NO: 24189 - DNA, 20 bp, Artificial Sequence
  chemically synthesized
ctgaaaaagctgttttaata

SEQ ID NO: 24190 - DNA, 20 bp, Artificial Sequence
  chemically synthesized
agctgttttaatacagatca

SEQ ID NO: 24191 - DNA, 20 bp, Artificial Sequence
  chemically synthesized
tattgattcagttggtcagt

SEQ ID NO: 24192 - DNA, 20 bp, Artificial Sequence
  chemically synthesized
tgtttattgattcagttggt

SEQ ID NO: 24193 - DNA, 20 bp, Artificial Sequence
  chemically synthesized
cttttgtttattgattcagt

SEQ ID NO: 24194 - DNA, 20 bp, Artificial Sequence
  chemically synthesized
cattcttttgtttattgatt

SEQ ID NO: 24195 - DNA, 20 bp, Artificial Sequence
  chemically synthesized
ccaactgaatcaataaacaa

SEQ ID NO: 24196 - DNA, 20 bp, Artificial Sequence
  chemically synthesized
atcaataaacaaaagaatga

SEQ ID NO: 24197 - DNA, 20 bp, Artificial Sequence
  chemically synthesized
ataaacaaaagaatgaaaga

SEQ ID NO: 24198 - DNA, 20 bp, Artificial Sequence
  chemically synthesized
aaaagaatgaaagaaagaaa

SEQ ID NO: 24199 - DNA, 20 bp, Artificial Sequence
  chemically synthesized
attatggcagtcatgtatgt

SEQ ID NO: 24200 - DNA, 20 bp, Artificial Sequence
  chemically synthesized
taggtgtcatttgattatgg

SEQ ID NO: 24201 - DNA, 20 bp, Artificial Sequence
  chemically synthesized
tcgtaggtgtcatttgatta

SEQ ID NO: 24202 - DNA, 20 bp, Artificial Sequence
  chemically synthesized
ctcatcagaattggtttcgt

SEQ ID NO: 24203 - DNA, 20 bp, Artificial Sequence
  chemically synthesized
cctcatcagaattggtttcg

SEQ ID NO: 24204 - DNA, 20 bp, Artificial Sequence
  chemically synthesized
tcctaacacctcatcagaat

SEQ ID NO: 24205 - DNA, 20 bp, Artificial Sequence
  chemically synthesized
cctacgaaaccaattctgat

SEQ ID NO: 24206 - DNA, 20 bp, Artificial Sequence
  chemically synthesized
ctacgaaaccaattctgatg

SEQ ID NO: 24207 - DNA, 20 bp, Artificial Sequence
  chemically synthesized
gccctttcctaacacctcat

SEQ ID NO: 24208 - DNA, 20 bp, Artificial Sequence
  chemically synthesized
aaccaattctgatgaggtgt

SEQ ID NO: 24209 - DNA, 20 bp, Artificial Sequence
  chemically synthesized
accaattctgatgaggtgtt

SEQ ID NO: 24210 - DNA, 20 bp, Artificial Sequence
  chemically synthesized
attctgatgaggtgttagga

SEQ ID NO: 24211 - DNA, 20 bp, Artificial Sequence
  chemically synthesized
ttctgatgaggtgttaggaa

SEQ ID NO: 24212 - DNA, 20 bp, Artificial Sequence
  chemically synthesized
tctgatgaggtgttaggaaa

SEQ ID NO: 24213 - DNA, 20 bp, Artificial Sequence
  chemically synthesized
caataattcaatccatatcc

SEQ ID NO: 24214 - DNA, 20 bp, Artificial Sequence
  chemically synthesized
tgacccaagtgacttggata

SEQ ID NO: 24215 - DNA, 20 bp, Artificial Sequence
  chemically synthesized
caatccatatccaagtcact

SEQ ID NO: 24216 - DNA, 20 bp, Artificial Sequence
  chemically synthesized
aaatgttgacccaagtgact

SEQ ID NO: 24217 - DNA, 20 bp, Artificial Sequence
  chemically synthesized
aatccatatccaagtcactt

SEQ ID NO: 24218 - DNA, 20 bp, Artificial Sequence
  chemically synthesized
aaagctgaaaatgttgaccc

SEQ ID NO: 24219 - DNA, 20 bp, Artificial Sequence
  chemically synthesized
gtcacttgggtcaacatttt

SEQ ID NO: 24220 - DNA, 20 bp, Artificial Sequence
  chemically synthesized
ggtcaacattttcagcttta

SEQ ID NO: 24221 - DNA, 20 bp, Artificial Sequence
  chemically synthesized
tggtctctgcgatggccata

SEQ ID NO: 24222 - DNA, 20 bp, Artificial Sequence
  chemically synthesized
tttcagctttatggccatcg

SEQ ID NO: 24223 - DNA, 20 bp, Artificial Sequence
  chemically synthesized
tcagctttatggccatcgca

SEQ ID NO: 24224 - DNA, 20 bp, Artificial Sequence
  chemically synthesized
tttatgtttggtctctgcga

SEQ ID NO: 24225 - DNA, 20 bp, Artificial Sequence
  chemically synthesized
atcgcagagaccaaacataa

SEQ ID NO: 24226 - DNA, 20 bp, Artificial Sequence
  chemically synthesized
gaaattcaggcttttatgtt

SEQ ID NO: 24227 - DNA, 20 bp, Artificial Sequence
  chemically synthesized
ctttcccctagttgaaattc

SEQ ID NO: 24228 - DNA, 20 bp, Artificial Sequence
  chemically synthesized
tctttcccctagttgaaatt

SEQ ID NO: 24229 - DNA, 20 bp, Artificial Sequence
  chemically synthesized
ataaaagcctgaatttcaac

SEQ ID NO: 24230 - DNA, 20 bp, Artificial Sequence
  chemically synthesized
taaaagcctgaatttcaact

SEQ ID NO: 24231 - DNA, 20 bp, Artificial Sequence
  chemically synthesized
aaaagcctgaatttcaacta

SEQ ID NO: 24232 - DNA, 20 bp, Artificial Sequence
  chemically synthesized
aaagcctgaatttcaactag

SEQ ID NO: 24233 - DNA, 20 bp, Artificial Sequence
  chemically synthesized
cctgaatttcaactagggga

SEQ ID NO: 24234 - DNA, 20 bp, Artificial Sequence
  chemically synthesized
agacattgttttctttcccc

SEQ ID NO: 24235 - DNA, 20 bp, Artificial Sequence
  chemically synthesized
atgctgaatagtttaaatta

SEQ ID NO: 24236 - DNA, 20 bp, Artificial Sequence
  chemically synthesized
tgtctgtaatttaaactatt

SEQ ID NO: 24237 - DNA, 20 bp, Artificial Sequence
  chemically synthesized
aaacaaaattgtatgctgaa

SEQ ID NO: 24238 - DNA, 20 bp, Artificial Sequence
  chemically synthesized
cagcatacaattttgtttaa

SEQ ID NO: 24239 - DNA, 20 bp, Artificial Sequence
  chemically synthesized
tacaattttgtttaaaagac

SEQ ID NO: 24240 - DNA, 20 bp, Artificial Sequence
  chemically synthesized
ctcaccaacatttggtattc

SEQ ID NO: 24241 - DNA, 20 bp, Artificial Sequence
  chemically synthesized
aagaccggaataccaaatgt

SEQ ID NO: 24242 - DNA, 20 bp, Artificial Sequence
  chemically synthesized
tccatatcctcaccaacatt

SEQ ID NO: 24243 - DNA, 20 bp, Artificial Sequence
  chemically synthesized
ccggaataccaaatgttggt

SEQ ID NO: 24244 - DNA, 20 bp, Artificial Sequence
  chemically synthesized
cggaataccaaatgttggtg

SEQ ID NO: 24245 - DNA, 20 bp, Artificial Sequence
  chemically synthesized
accaaatgttggtgaggata

SEQ ID NO: 24246 - DNA, 20 bp, Artificial Sequence
  chemically synthesized
caaatgttggtgaggatatg

SEQ ID NO: 24247 - DNA, 20 bp, Artificial Sequence
  chemically synthesized
tggtgaggatatggagcgac

SEQ ID NO: 24248 - DNA, 20 bp, Artificial Sequence
  chemically synthesized
tatggagcgactggaattct

SEQ ID NO: 24249 - DNA, 20 bp, Artificial Sequence
  chemically synthesized
caagcagtgtctgagaattc

SEQ ID NO: 24250 - DNA, 20 bp, Artificial Sequence
  chemically synthesized
attcccaacaagcagtgtct

SEQ ID NO: 24251 - DNA, 20 bp, Artificial Sequence
  chemically synthesized
aattctcagacactgcttgt

SEQ ID NO: 24252 - DNA, 20 bp, Artificial Sequence
  chemically synthesized
attctcagacactgcttgtt

SEQ ID NO: 24253 - DNA, 20 bp, Artificial Sequence
  chemically synthesized
tgtcgtacattcccaacaag

SEQ ID NO: 24254 - DNA, 20 bp, Artificial Sequence
  chemically synthesized
agttgtcgtacattcccaac

SEQ ID NO: 24255 - DNA, 20 bp, Artificial Sequence
  chemically synthesized
ttgggaatgtacgacaactt

SEQ ID NO: 24256 - DNA, 20 bp, Artificial Sequence
  chemically synthesized
tgggaatgtacgacaacttt

SEQ ID NO: 24257 - DNA, 20 bp, Artificial Sequence
  chemically synthesized
actgcctaactggtttccca

SEQ ID NO: 24258 - DNA, 20 bp, Artificial Sequence
  chemically synthesized
gtacgacaactttgggaaac

SEQ ID NO: 24259 - DNA, 20 bp, Artificial Sequence
  chemically synthesized
gacaactttgggaaaccagt

SEQ ID NO: 24260 - DNA, 20 bp, Artificial Sequence
  chemically synthesized
acaactttgggaaaccagtt

SEQ ID NO: 24261 - DNA, 20 bp, Artificial Sequence
  chemically synthesized
actttgggaaaccagttagg

SEQ ID NO: 24262 - DNA, 20 bp, Artificial Sequence
  chemically synthesized
ttcataagaaactgcctaac

SEQ ID NO: 24263 - DNA, 20 bp, Artificial Sequence
  chemically synthesized
acatgtgtgtttaatttcat

SEQ ID NO: 24264 - DNA, 20 bp, Artificial Sequence
  chemically synthesized
tatccaggaaaagaatattt

SEQ ID NO: 24265 - DNA, 20 bp, Artificial Sequence
  chemically synthesized
tgactcaaatattcttttcc

SEQ ID NO: 24266 - DNA, 20 bp, Artificial Sequence
  chemically synthesized
tctgtgcaaatatccaggaa

SEQ ID NO: 24267 - DNA, 20 bp, Artificial Sequence
  chemically synthesized
tttattctgtgcaaatatcc

SEQ ID NO: 24268 - DNA, 20 bp, Artificial Sequence
  chemically synthesized
ttttattctgtgcaaatatc

SEQ ID NO: 24269 - DNA, 20 bp, Artificial Sequence
  chemically synthesized
tcttttcctggatatttgca

SEQ ID NO: 24270 - DNA, 20 bp, Artificial Sequence
  chemically synthesized
aaaaaatgtatgtccacaaa

SEQ ID NO: 24271 - DNA, 20 bp, Artificial Sequence
  chemically synthesized
ttcatgtacacatctttttg

SEQ ID NO: 24272 - DNA, 20 bp, Artificial Sequence
  chemically synthesized
gatgtgtacatgaatatcca

SEQ ID NO: 24273 - DNA, 20 bp, Artificial Sequence
  chemically synthesized
gtgtacatgaatatccatag

SEQ ID NO: 24274 - DNA, 20 bp, Artificial Sequence
  chemically synthesized
tattatgaataaagctgcta

SEQ ID NO: 24275 - DNA, 20 bp, Artificial Sequence
  chemically synthesized
gtttttgactattatgaata

SEQ ID NO: 24276 - DNA, 20 bp, Artificial Sequence
  chemically synthesized
catagcagctttattcataa

SEQ ID NO: 24277 - DNA, 20 bp, Artificial Sequence
  chemically synthesized
tattcataatagtcaaaaac

SEQ ID NO: 24278 - DNA, 20 bp, Artificial Sequence
  chemically synthesized
ttaccttactggttggtttc

SEQ ID NO: 24279 - DNA, 20 bp, Artificial Sequence
  chemically synthesized
gtcaaaaaccggaaaccaac

SEQ ID NO: 24280 - DNA, 20 bp, Artificial Sequence
  chemically synthesized
aaaaccggaaaccaaccagt

SEQ ID NO: 24281 - DNA, 20 bp, Artificial Sequence
  chemically synthesized
aaaccggaaaccaaccagta

SEQ ID NO: 24282 - DNA, 20 bp, Artificial Sequence
  chemically synthesized
ttatccattaccttactggt

SEQ ID NO: 24283 - DNA, 20 bp, Artificial Sequence
  chemically synthesized
ttgtttatccattaccttac

SEQ ID NO: 24284 - DNA, 20 bp, Artificial Sequence
  chemically synthesized
gaaaccaaccagtaaggtaa

SEQ ID NO: 24285 - DNA, 20 bp, Artificial Sequence
  chemically synthesized
cagtaaggtaatggataaac

SEQ ID NO: 24286 - DNA, 20 bp, Artificial Sequence
  chemically synthesized
ggtaatggataaacaagttg

SEQ ID NO: 24287 - DNA, 20 bp, Artificial Sequence
  chemically synthesized
tggataaacaagttgtggta

SEQ ID NO: 24288 - DNA, 20 bp, Artificial Sequence
  chemically synthesized
caagttgtggtaaagtcatt

SEQ ID NO: 24289 - DNA, 20 bp, Artificial Sequence
  chemically synthesized
gttgtggtaaagtcattcag

SEQ ID NO: 24290 - DNA, 20 bp, Artificial Sequence
  chemically synthesized
ttgtggtaaagtcattcagt

SEQ ID NO: 24291 - DNA, 20 bp, Artificial Sequence
  chemically synthesized
cagtgggatactactgtgca

SEQ ID NO: 24292 - DNA, 20 bp, Artificial Sequence
  chemically synthesized
ttttattgcactttgcacag

SEQ ID NO: 24293 - DNA, 20 bp, Artificial Sequence
  chemically synthesized
cctttttattgcactttgca

SEQ ID NO: 24294 - DNA, 20 bp, Artificial Sequence
  chemically synthesized
actgtgcaaagtgcaataaa

SEQ ID NO: 24295 - DNA, 20 bp, Artificial Sequence
  chemically synthesized
ctgtgcaaagtgcaataaaa

SEQ ID NO: 24296 - DNA, 20 bp, Artificial Sequence
  chemically synthesized
attgttgcattatcagtagt

SEQ ID NO: 24297 - DNA, 20 bp, Artificial Sequence
  chemically synthesized
tcacattgttgcattatcag

SEQ ID NO: 24298 - DNA, 20 bp, Artificial Sequence
  chemically synthesized
agttcacattgttgcattat

SEQ ID NO: 24299 - DNA, 20 bp, Artificial Sequence
  chemically synthesized
cagcttagtgtttttcagat

SEQ ID NO: 24300 - DNA, 20 bp, Artificial Sequence
  chemically synthesized
ttacccagcttagtgttttt

SEQ ID NO: 24301 - DNA, 20 bp, Artificial Sequence
  chemically synthesized
gaactgatctgaaaaacact

SEQ ID NO: 24302 - DNA, 20 bp, Artificial Sequence
  chemically synthesized
tgatctgaaaaacactaagc

SEQ ID NO: 24303 - DNA, 20 bp, Artificial Sequence
  chemically synthesized
gatctgaaaaacactaagct

SEQ ID NO: 24304 - DNA, 20 bp, Artificial Sequence
  chemically synthesized
ctggcttcttttacccagct

SEQ ID NO: 24305 - DNA, 20 bp, Artificial Sequence
  chemically synthesized
aaaaacactaagctgggtaa

SEQ ID NO: 24306 - DNA, 20 bp, Artificial Sequence
  chemically synthesized
tgtgcctggcttcttttacc

SEQ ID NO: 24307 - DNA, 20 bp, Artificial Sequence
  chemically synthesized
aacactaagctgggtaaaag

SEQ ID NO: 24308 - DNA, 20 bp, Artificial Sequence
  chemically synthesized
ctaagctgggtaaaagaagc

SEQ ID NO: 24309 - DNA, 20 bp, Artificial Sequence
  chemically synthesized
taagctgggtaaaagaagcc

SEQ ID NO: 24310 - DNA, 20 bp, Artificial Sequence
  chemically synthesized
agtatgtactgttttgtgcc

SEQ ID NO: 24311 - DNA, 20 bp, Artificial Sequence
  chemically synthesized
aaaagaagccaggcacaaaa

SEQ ID NO: 24312 - DNA, 20 bp, Artificial Sequence
  chemically synthesized
ttgatataagtgaaatcaaa

SEQ ID NO: 24313 - DNA, 20 bp, Artificial Sequence
  chemically synthesized
cctgttctagaagttgatat

SEQ ID NO: 24314 - DNA, 20 bp, Artificial Sequence
  chemically synthesized
atttcacttatatcaacttc

SEQ ID NO: 24315 - DNA, 20 bp, Artificial Sequence
  chemically synthesized
acttatatcaacttctagaa

SEQ ID NO: 24316 - DNA, 20 bp, Artificial Sequence
  chemically synthesized
cttatatcaacttctagaac

SEQ ID NO: 24317 - DNA, 20 bp, Artificial Sequence
  chemically synthesized
ctaagttttgcctgttctag

SEQ ID NO: 24318 - DNA, 20 bp, Artificial Sequence
  chemically synthesized
tagctaagttttgcctgttc

SEQ ID NO: 24319 - DNA, 20 bp, Artificial Sequence
  chemically synthesized
cttctagaacaggcaaaact

SEQ ID NO: 24320 - DNA, 20 bp, Artificial Sequence
  chemically synthesized
taccatctggcatagtagct

SEQ ID NO: 24321 - DNA, 20 bp, Artificial Sequence
  chemically synthesized
gcaaaacttagctactatgc

SEQ ID NO: 24322 - DNA, 20 bp, Artificial Sequence
  chemically synthesized
caggctaccatctggcatag

SEQ ID NO: 24323 - DNA, 20 bp, Artificial Sequence
  chemically synthesized
aacttagctactatgccaga

SEQ ID NO: 24324 - DNA, 20 bp, Artificial Sequence
  chemically synthesized
ccccaggctaccatctggca

SEQ ID NO: 24325 - DNA, 20 bp, Artificial Sequence
  chemically synthesized
ttagctactatgccagatgg

SEQ ID NO: 24326 - DNA, 20 bp, Artificial Sequence
  chemically synthesized
ccacaccccaggctaccatc

SEQ ID NO: 24327 - DNA, 20 bp, Artificial Sequence
  chemically synthesized
tactatgccagatggtagcc

SEQ ID NO: 24328 - DNA, 20 bp, Artificial Sequence
  chemically synthesized
actatgccagatggtagcct

SEQ ID NO: 24329 - DNA, 20 bp, Artificial Sequence
  chemically synthesized
ctatgccagatggtagcctg

SEQ ID NO: 24330 - DNA, 20 bp, Artificial Sequence
  chemically synthesized
ccagatggtagcctggggtg

SEQ ID NO: 24331 - DNA, 20 bp, Artificial Sequence
  chemically synthesized
acctactcccaccacacccc

SEQ ID NO: 24332 - DNA, 20 bp, Artificial Sequence
  chemically synthesized
tacctactcccaccacaccc

SEQ ID NO: 24333 - DNA, 20 bp, Artificial Sequence
  chemically synthesized
gatggtagcctggggtgtgg

SEQ ID NO: 24334 - DNA, 20 bp, Artificial Sequence
  chemically synthesized
atggtagcctggggtgtggt

SEQ ID NO: 24335 - DNA, 20 bp, Artificial Sequence
  chemically synthesized
ggtagcctggggtgtggtgg

SEQ ID NO: 24336 - DNA, 20 bp, Artificial Sequence
  chemically synthesized
agcctggggtgtggtgggag

SEQ ID NO: 24337 - DNA, 20 bp, Artificial Sequence
  chemically synthesized
gcctggggtgtggtgggagt

SEQ ID NO: 24338 - DNA, 20 bp, Artificial Sequence
  chemically synthesized
ggagtaggtaactgacctca

SEQ ID NO: 24339 - DNA, 20 bp, Artificial Sequence
  chemically synthesized
gagtaggtaactgacctcaa

SEQ ID NO: 24340 - DNA, 20 bp, Artificial Sequence
  chemically synthesized
cccttgtgttcctttgaggt

SEQ ID NO: 24341 - DNA, 20 bp, Artificial Sequence
  chemically synthesized
aacacccttgtgttcctttg

SEQ ID NO: 24342 - DNA, 20 bp, Artificial Sequence
  chemically synthesized
aaacacccttgtgttccttt

SEQ ID NO: 24343 - DNA, 20 bp, Artificial Sequence
  chemically synthesized
aactgacctcaaaggaacac

SEQ ID NO: 24344 - DNA, 20 bp, Artificial Sequence
  chemically synthesized
actgacctcaaaggaacaca

SEQ ID NO: 24345 - DNA, 20 bp, Artificial Sequence
  chemically synthesized
ctgacctcaaaggaacacaa

SEQ ID NO: 24346 - DNA, 20 bp, Artificial Sequence
  chemically synthesized
aggaacacaagggtgttttc

SEQ ID NO: 24347 - DNA, 20 bp, Artificial Sequence
  chemically synthesized
ggaacacaagggtgttttct

SEQ ID NO: 24348 - DNA, 20 bp, Artificial Sequence
  chemically synthesized
gatataacatttcgatcacc

SEQ ID NO: 24349 - DNA, 20 bp, Artificial Sequence
  chemically synthesized
tcgaaatgttatatcttgat

SEQ ID NO: 24350 - DNA, 20 bp, Artificial Sequence
  chemically synthesized
gtgtaaccaccatgccaatc

SEQ ID NO: 24351 - DNA, 20 bp, Artificial Sequence
  chemically synthesized
atgttatatcttgattggca

SEQ ID NO: 24352 - DNA, 20 bp, Artificial Sequence
  chemically synthesized
ttatatcttgattggcatgg

SEQ ID NO: 24353 - DNA, 20 bp, Artificial Sequence
  chemically synthesized
gattggcatggtggttacac

SEQ ID NO: 24354 - DNA, 20 bp, Artificial Sequence
  chemically synthesized
taagtgttcaggttagattt

SEQ ID NO: 24355 - DNA, 20 bp, Artificial Sequence
  chemically synthesized
tccattttaagtgttcaggt

SEQ ID NO: 24356 - DNA, 20 bp, Artificial Sequence
  chemically synthesized
tgtttccattttaagtgttc

SEQ ID NO: 24357 - DNA, 20 bp, Artificial Sequence
  chemically synthesized
atgtttccattttaagtgtt

SEQ ID NO: 24358 - DNA, 20 bp, Artificial Sequence
  chemically synthesized
tctaacctgaacacttaaaa

SEQ ID NO: 24359 - DNA, 20 bp, Artificial Sequence
  chemically synthesized
ctataacatgtttccatttt

SEQ ID NO: 24360 - DNA, 20 bp, Artificial Sequence
  chemically synthesized
cttaaaatggaaacatgtta

SEQ ID NO: 24361 - DNA, 20 bp, Artificial Sequence
  chemically synthesized
tgtttaaattatgccctgat

SEQ ID NO: 24362 - DNA, 20 bp, Artificial Sequence
  chemically synthesized
gtttaaattatgccctgata

SEQ ID NO: 24363 - DNA, 20 bp, Artificial Sequence
  chemically synthesized
tcttaaaatttaccttatca

SEQ ID NO: 24364 - DNA, 20 bp, Artificial Sequence
  chemically synthesized
ctcttaaaatttaccttatc

SEQ ID NO: 24365 - DNA, 20 bp, Artificial Sequence
  chemically synthesized
actcttaaaatttaccttat

SEQ ID NO: 24366 - DNA, 20 bp, Artificial Sequence
  chemically synthesized
gccctgataaggtaaatttt

SEQ ID NO: 24367 - DNA, 20 bp, Artificial Sequence
  chemically synthesized
cctgataaggtaaattttaa

SEQ ID NO: 24368 - DNA, 20 bp, Artificial Sequence
  chemically synthesized
tgttcatgtgagggttttta

SEQ ID NO: 24369 - DNA, 20 bp, Artificial Sequence
  chemically synthesized
agagtgtactgttcatgtga

SEQ ID NO: 24370 - DNA, 20 bp, Artificial Sequence
  chemically synthesized
cagagtgtactgttcatgtg

SEQ ID NO: 24371 - DNA, 20 bp, Artificial Sequence
  chemically synthesized
tttaaaaaccctcacatgaa

SEQ ID NO: 24372 - DNA, 20 bp, Artificial Sequence
  chemically synthesized
tcagagtgtactgttcatgt

SEQ ID NO: 24373 - DNA, 20 bp, Artificial Sequence
  chemically synthesized
gctaacacacacatacatca

SEQ ID NO: 24374 - DNA, 20 bp, Artificial Sequence
  chemically synthesized
aagctaacacacacatacat

SEQ ID NO: 24375 - DNA, 20 bp, Artificial Sequence
  chemically synthesized
actctgatgtatgtgtgtgt

SEQ ID NO: 24376 - DNA, 20 bp, Artificial Sequence
  chemically synthesized
atgtatgtgtgtgttagctt

SEQ ID NO: 24377 - DNA, 20 bp, Artificial Sequence
  chemically synthesized
ccacctctacagtgtagctt

SEQ ID NO: 24378 - DNA, 20 bp, Artificial Sequence
  chemically synthesized
tgttagcttaagctacactg

SEQ ID NO: 24379 - DNA, 20 bp, Artificial Sequence
  chemically synthesized
ttagcttaagctacactgta

SEQ ID NO: 24380 - DNA, 20 bp, Artificial Sequence
  chemically synthesized
aactgaccacctctacagtg

SEQ ID NO: 24381 - DNA, 20 bp, Artificial Sequence
  chemically synthesized
tagcttaagctacactgtag

SEQ ID NO: 24382 - DNA, 20 bp, Artificial Sequence
  chemically synthesized
cttaagctacactgtagagg

SEQ ID NO: 24383 - DNA, 20 bp, Artificial Sequence
  chemically synthesized
aagacaactgaccacctcta

SEQ ID NO: 24384 - DNA, 20 bp, Artificial Sequence
  chemically synthesized
agctacactgtagaggtggt

SEQ ID NO: 24385 - DNA, 20 bp, Artificial Sequence
  chemically synthesized
aggtggtcagttgtcttaat

SEQ ID NO: 24386 - DNA, 20 bp, Artificial Sequence
  chemically synthesized
ggtggtcagttgtcttaatc

SEQ ID NO: 24387 - DNA, 20 bp, Artificial Sequence
  chemically synthesized
tggtcagttgtcttaatcag

SEQ ID NO: 24388 - DNA, 20 bp, Artificial Sequence
  chemically synthesized
cttggagttcactcctgatt

SEQ ID NO: 24389 - DNA, 20 bp, Artificial Sequence
  chemically synthesized
cttaatcaggagtgaactcc

SEQ ID NO: 24390 - DNA, 20 bp, Artificial Sequence
  chemically synthesized
ttaatcaggagtgaactcca

SEQ ID NO: 24391 - DNA, 20 bp, Artificial Sequence
  chemically synthesized
taatcaggagtgaactccaa

SEQ ID NO: 24392 - DNA, 20 bp, Artificial Sequence
  chemically synthesized
tcaggagtgaactccaaggg

SEQ ID NO: 24393 - DNA, 20 bp, Artificial Sequence
  chemically synthesized
ttgctagccaaccacccttg

SEQ ID NO: 24394 - DNA, 20 bp, Artificial Sequence
  chemically synthesized
aattgctagccaaccaccct

SEQ ID NO: 24395 - DNA, 20 bp, Artificial Sequence
  chemically synthesized
gagtgaactccaagggtggt

SEQ ID NO: 24396 - DNA, 20 bp, Artificial Sequence
  chemically synthesized
gaactccaagggtggttggc

SEQ ID NO: 24397 - DNA, 20 bp, Artificial Sequence
  chemically synthesized
gaggctttttgattaattgc

SEQ ID NO: 24398 - DNA, 20 bp, Artificial Sequence
  chemically synthesized
ttggctagcaattaatcaaa

SEQ ID NO: 24399 - DNA, 20 bp, Artificial Sequence
  chemically synthesized
aatcaaaaagcctcatgcca

SEQ ID NO: 24400 - DNA, 20 bp, Artificial Sequence
  chemically synthesized
cagtggccgcctgtggcatg

SEQ ID NO: 24401 - DNA, 20 bp, Artificial Sequence
  chemically synthesized
atcaaaaagcctcatgccac

SEQ ID NO: 24402 - DNA, 20 bp, Artificial Sequence
  chemically synthesized
acagtggccgcctgtggcat

SEQ ID NO: 24403 - DNA, 20 bp, Artificial Sequence
  chemically synthesized
aaaaagcctcatgccacagg

SEQ ID NO: 24404 - DNA, 20 bp, Artificial Sequence
  chemically synthesized
tcacttacagtggccgcctg

SEQ ID NO: 24405 - DNA, 20 bp, Artificial Sequence
  chemically synthesized
atgccacaggcggccactgt

SEQ ID NO: 24406 - DNA, 20 bp, Artificial Sequence
  chemically synthesized
tataactgaatcacttacag

SEQ ID NO: 24407 - DNA, 20 bp, Artificial Sequence
  chemically synthesized
aaatataactgaatcactta

SEQ ID NO: 24408 - DNA, 20 bp, Artificial Sequence
  chemically synthesized
ggcggccactgtaagtgatt

SEQ ID NO: 24409 - DNA, 20 bp, Artificial Sequence
  chemically synthesized
gtaagtgattcagttatatt

SEQ ID NO: 24410 - DNA, 20 bp, Artificial Sequence
  chemically synthesized
tgaaacccctggtgtaataa

SEQ ID NO: 24411 - DNA, 20 bp, Artificial Sequence
  chemically synthesized
atatttagctcttattacac

SEQ ID NO: 24412 - DNA, 20 bp, Artificial Sequence
  chemically synthesized
aatgaaacccctggtgtaat

SEQ ID NO: 24413 - DNA, 20 bp, Artificial Sequence
  chemically synthesized
tatttagctcttattacacc

SEQ ID NO: 24414 - DNA, 20 bp, Artificial Sequence
  chemically synthesized
atttagctcttattacacca

SEQ ID NO: 24415 - DNA, 20 bp, Artificial Sequence
  chemically synthesized
tttagctcttattacaccag

SEQ ID NO: 24416 - DNA, 20 bp, Artificial Sequence
  chemically synthesized
aggaaaattaatgaaacccc

SEQ ID NO: 24417 - DNA, 20 bp, Artificial Sequence
  chemically synthesized
tcattaattttcctaattaa

SEQ ID NO: 24418 - DNA, 20 bp, Artificial Sequence
  chemically synthesized
ggcccgtctaactattaatt

SEQ ID NO: 24419 - DNA, 20 bp, Artificial Sequence
  chemically synthesized
aggcccgtctaactattaat

SEQ ID NO: 24420 - DNA, 20 bp, Artificial Sequence
  chemically synthesized
taattttcctaattaatagt

SEQ ID NO: 24421 - DNA, 20 bp, Artificial Sequence
  chemically synthesized
tttcctaattaatagttaga

SEQ ID NO: 24422 - DNA, 20 bp, Artificial Sequence
  chemically synthesized
ttcctaattaatagttagac

SEQ ID NO: 24423 - DNA, 20 bp, Artificial Sequence
  chemically synthesized
aatagttagacgggcctgtg

SEQ ID NO: 24424 - DNA, 20 bp, Artificial Sequence
  chemically synthesized
aaccactaatatcactacac

SEQ ID NO: 24425 - DNA, 20 bp, Artificial Sequence
  chemically synthesized
aaaccactaatatcactaca

SEQ ID NO: 24426 - DNA, 20 bp, Artificial Sequence
  chemically synthesized
acgggcctgtgtagtgatat

SEQ ID NO: 24427 - DNA, 20 bp, Artificial Sequence
  chemically synthesized
ggcctgtgtagtgatattag

SEQ ID NO: 24428 - DNA, 20 bp, Artificial Sequence
  chemically synthesized
ttagtggtttgcaaaatatg

SEQ ID NO: 24429 - DNA, 20 bp, Artificial Sequence
  chemically synthesized
gaagattgttgaaaaacatt

SEQ ID NO: 24430 - DNA, 20 bp, Artificial Sequence
  chemically synthesized
aaactcaatttaaaggcagg

SEQ ID NO: 24431 - DNA, 20 bp, Artificial Sequence
  chemically synthesized
ttaaactcaatttaaaggca

SEQ ID NO: 24432 - DNA, 20 bp, Artificial Sequence
  chemically synthesized
cttaaactcaatttaaaggc

SEQ ID NO: 24433 - DNA, 20 bp, Artificial Sequence
  chemically synthesized
tcttaaactcaatttaaagg

SEQ ID NO: 24434 - DNA, 20 bp, Artificial Sequence
  chemically synthesized
acactccctgcctttaaatt

SEQ ID NO: 24435 - DNA, 20 bp, Artificial Sequence
  chemically synthesized
tcttcttaaactcaatttaa

SEQ ID NO: 24436 - DNA, 20 bp, Artificial Sequence
  chemically synthesized
ttcttcttaaactcaattta

SEQ ID NO: 24437 - DNA, 20 bp, Artificial Sequence
  chemically synthesized
cctgcctttaaattgagttt

SEQ ID NO: 24438 - DNA, 20 bp, Artificial Sequence
  chemically synthesized
gcctttaaattgagtttaag

SEQ ID NO: 24439 - DNA, 20 bp, Artificial Sequence
  chemically synthesized
aattgagtttaagaagaatc

SEQ ID NO: 24440 - DNA, 20 bp, Artificial Sequence
  chemically synthesized
tgagtttaagaagaatccag

SEQ ID NO: 24441 - DNA, 20 bp, Artificial Sequence
  chemically synthesized
gagtttaagaagaatccagt

SEQ ID NO: 24442 - DNA, 20 bp, Artificial Sequence
  chemically synthesized
tctaaagatggagaacctac

SEQ ID NO: 24443 - DNA, 20 bp, Artificial Sequence
  chemically synthesized
tccagtaggttctccatctt

SEQ ID NO: 24444 - DNA, 20 bp, Artificial Sequence
  chemically synthesized
gggcaccatttctaaagatg

SEQ ID NO: 24445 - DNA, 20 bp, Artificial Sequence
  chemically synthesized
tagggcaccatttctaaaga

SEQ ID NO: 24446 - DNA, 20 bp, Artificial Sequence
  chemically synthesized
aggttctccatctttagaaa

SEQ ID NO: 24447 - DNA, 20 bp, Artificial Sequence
  chemically synthesized
agcctagggcaccatttcta

SEQ ID NO: 24448 - DNA, 20 bp, Artificial Sequence
  chemically synthesized
catctttagaaatggtgccc

SEQ ID NO: 24449 - DNA, 20 bp, Artificial Sequence
  chemically synthesized
atctttagaaatggtgccct

SEQ ID NO: 24450 - DNA, 20 bp, Artificial Sequence
  chemically synthesized
acattttggaattcagccta

SEQ ID NO: 24451 - DNA, 20 bp, Artificial Sequence
  chemically synthesized
gacattttggaattcagcct

SEQ ID NO: 24452 - DNA, 20 bp, Artificial Sequence
  chemically synthesized
ggacattttggaattcagcc

SEQ ID NO: 24453 - DNA, 20 bp, Artificial Sequence
  chemically synthesized
cagctggacattttggaatt

SEQ ID NO: 24454 - DNA, 20 bp, Artificial Sequence
  chemically synthesized
aggctgaattccaaaatgtc

SEQ ID NO: 24455 - DNA, 20 bp, Artificial Sequence
  chemically synthesized
tgaaccacagctggacattt

SEQ ID NO: 24456 - DNA, 20 bp, Artificial Sequence
  chemically synthesized
aattccaaaatgtccagctg

SEQ ID NO: 24457 - DNA, 20 bp, Artificial Sequence
  chemically synthesized
agaatccggtgaaccacagc

SEQ ID NO: 24458 - DNA, 20 bp, Artificial Sequence
  chemically synthesized
actaagaatccggtgaacca

SEQ ID NO: 24459 - DNA, 20 bp, Artificial Sequence
  chemically synthesized
aatgtccagctgtggttcac

SEQ ID NO: 24460 - DNA, 20 bp, Artificial Sequence
  chemically synthesized
gctgtggttcaccggattct

SEQ ID NO: 24461 - DNA, 20 bp, Artificial Sequence
  chemically synthesized
aattctggcaactaagaatc

SEQ ID NO: 24462 - DNA, 20 bp, Artificial Sequence
  chemically synthesized
ttcaccggattcttagttgc

SEQ ID NO: 24463 - DNA, 20 bp, Artificial Sequence
  chemically synthesized
ctaactgaattctggcaact

SEQ ID NO: 24464 - DNA, 20 bp, Artificial Sequence
  chemically synthesized
gattcttagttgccagaatt

SEQ ID NO: 24465 - DNA, 20 bp, Artificial Sequence
  chemically synthesized
tcaaccatctaactgaattc

SEQ ID NO: 24466 - DNA, 20 bp, Artificial Sequence
  chemically synthesized
cttagttgccagaattcagt

SEQ ID NO: 24467 - DNA, 20 bp, Artificial Sequence
  chemically synthesized
gttgccagaattcagttaga

SEQ ID NO: 24468 - DNA, 20 bp, Artificial Sequence
  chemically synthesized
cagaattcagttagatggtt

SEQ ID NO: 24469 - DNA, 20 bp, Artificial Sequence
  chemically synthesized
agaattcagttagatggttg

SEQ ID NO: 24470 - DNA, 20 bp, Artificial Sequence
  chemically synthesized
gaattcagttagatggttga

SEQ ID NO: 24471 - DNA, 20 bp, Artificial Sequence
  chemically synthesized
ggttgagggaatcctgctgc

SEQ ID NO: 24472 - DNA, 20 bp, Artificial Sequence
  chemically synthesized
aaaaccattgttctagcagc

SEQ ID NO: 24473 - DNA, 20 bp, Artificial Sequence
  chemically synthesized
gaaaaccattgttctagcag

SEQ ID NO: 24474 - DNA, 20 bp, Artificial Sequence
  chemically synthesized
tctgaaaaccattgttctag

SEQ ID NO: 24475 - DNA, 20 bp, Artificial Sequence
  chemically synthesized
gaatcctgctgctagaacaa

SEQ ID NO: 24476 - DNA, 20 bp, Artificial Sequence
  chemically synthesized
aagtctgaaaaccattgttc

SEQ ID NO: 24477 - DNA, 20 bp, Artificial Sequence
  chemically synthesized
gctgctagaacaatggtttt

SEQ ID NO: 24478 - DNA, 20 bp, Artificial Sequence
  chemically synthesized
gaacaatggttttcagactt

SEQ ID NO: 24479 - DNA, 20 bp, Artificial Sequence
  chemically synthesized
ggtgattctgatgtttgctc

SEQ ID NO: 24480 - DNA, 20 bp, Artificial Sequence
  chemically synthesized
tttcagacttgagcaaacat

SEQ ID NO: 24481 - DNA, 20 bp, Artificial Sequence
  chemically synthesized
gagcaaacatcagaatcacc

SEQ ID NO: 24482 - DNA, 20 bp, Artificial Sequence
  chemically synthesized
gcaaacatcagaatcacctg

SEQ ID NO: 24483 - DNA, 20 bp, Artificial Sequence
  chemically synthesized
aacatcagaatcacctggag

SEQ ID NO: 24484 - DNA, 20 bp, Artificial Sequence
  chemically synthesized
atctttaaactatccactcc

SEQ ID NO: 24485 - DNA, 20 bp, Artificial Sequence
  chemically synthesized
tcagaatcacctggagtgga

SEQ ID NO: 24486 - DNA, 20 bp, Artificial Sequence
  chemically synthesized
catctttaaactatccactc

SEQ ID NO: 24487 - DNA, 20 bp, Artificial Sequence
  chemically synthesized
cacctggagtggatagttta

SEQ ID NO: 24488 - DNA, 20 bp, Artificial Sequence
  chemically synthesized
gagtggatagtttaaagatg

SEQ ID NO: 24489 - DNA, 20 bp, Artificial Sequence
  chemically synthesized
gtttaaagatgcagatttcc

SEQ ID NO: 24490 - DNA, 20 bp, Artificial Sequence
  chemically synthesized
tttaaagatgcagatttcct

SEQ ID NO: 24491 - DNA, 20 bp, Artificial Sequence
  chemically synthesized
aaaatctggaggtggggcct

SEQ ID NO: 24492 - DNA, 20 bp, Artificial Sequence
  chemically synthesized
gaaaatctggaggtggggcc

SEQ ID NO: 24493 - DNA, 20 bp, Artificial Sequence
  chemically synthesized
gatttcctaggccccacctc

SEQ ID NO: 24494 - DNA, 20 bp, Artificial Sequence
  chemically synthesized
aattagaaaatctggaggtg

SEQ ID NO: 24495 - DNA, 20 bp, Artificial Sequence
  chemically synthesized
gaattagaaaatctggaggt

SEQ ID NO: 24496 - DNA, 20 bp, Artificial Sequence
  chemically synthesized
tgaattagaaaatctggagg

SEQ ID NO: 24497 - DNA, 20 bp, Artificial Sequence
  chemically synthesized
tactgaattagaaaatctgg

SEQ ID NO: 24498 - DNA, 20 bp, Artificial Sequence
  chemically synthesized
ctactgaattagaaaatctg

SEQ ID NO: 24499 - DNA, 20 bp, Artificial Sequence
  chemically synthesized
acctactgaattagaaaatc

SEQ ID NO: 24500 - DNA, 20 bp, Artificial Sequence
  chemically synthesized
cacctccagattttctaatt

SEQ ID NO: 24501 - DNA, 20 bp, Artificial Sequence
  chemically synthesized
ctccagattttctaattcag

SEQ ID NO: 24502 - DNA, 20 bp, Artificial Sequence
  chemically synthesized
tccagattttctaattcagt

SEQ ID NO: 24503 - DNA, 20 bp, Artificial Sequence
  chemically synthesized
ccttcccatacctactgaat

SEQ ID NO: 24504 - DNA, 20 bp, Artificial Sequence
  chemically synthesized
attttctaattcagtaggta

SEQ ID NO: 24505 - DNA, 20 bp, Artificial Sequence
  chemically synthesized
ttttctaattcagtaggtat

SEQ ID NO: 24506 - DNA, 20 bp, Artificial Sequence
  chemically synthesized
tctaattcagtaggtatggg

SEQ ID NO: 24507 - DNA, 20 bp, Artificial Sequence
  chemically synthesized
ctaattcagtaggtatggga

SEQ ID NO: 24508 - DNA, 20 bp, Artificial Sequence
  chemically synthesized
taattcagtaggtatgggaa

SEQ ID NO: 24509 - DNA, 20 bp, Artificial Sequence
  chemically synthesized
cagtaggtatgggaagggcc

SEQ ID NO: 24510 - DNA, 20 bp, Artificial Sequence
  chemically synthesized
agtaggtatgggaagggcct

SEQ ID NO: 24511 - DNA, 20 bp, Artificial Sequence
  chemically synthesized
tgctagaaattcagattccc

SEQ ID NO: 24512 - DNA, 20 bp, Artificial Sequence
  chemically synthesized
ttgctagaaattcagattcc

SEQ ID NO: 24513 - DNA, 20 bp, Artificial Sequence
  chemically synthesized
ggcctgggaatctgaatttc

SEQ ID NO: 24514 - DNA, 20 bp, Artificial Sequence
  chemically synthesized
ctggaaacttgctagaaatt

SEQ ID NO: 24515 - DNA, 20 bp, Artificial Sequence
  chemically synthesized
tgggaatctgaatttctagc

SEQ ID NO: 24516 - DNA, 20 bp, Artificial Sequence
  chemically synthesized
agcatcacctggaaacttgc

SEQ ID NO: 24517 - DNA, 20 bp, Artificial Sequence
  chemically synthesized
ctgaatttctagcaagtttc

SEQ ID NO: 24518 - DNA, 20 bp, Artificial Sequence
  chemically synthesized
tgaatttctagcaagtttcc

SEQ ID NO: 24519 - DNA, 20 bp, Artificial Sequence
  chemically synthesized
ccagcagcatcagcatcacc

SEQ ID NO: 24520 - DNA, 20 bp, Artificial Sequence
  chemically synthesized
ccaggtgatgctgatgctgc

SEQ ID NO: 24521 - DNA, 20 bp, Artificial Sequence
  chemically synthesized
ggtccctggaccagcagcat

SEQ ID NO: 24522 - DNA, 20 bp, Artificial Sequence
  chemically synthesized
tgatgctgatgctgctggtc

SEQ ID NO: 24523 - DNA, 20 bp, Artificial Sequence
  chemically synthesized
gatgctgatgctgctggtcc

SEQ ID NO: 24524 - DNA, 20 bp, Artificial Sequence
  chemically synthesized
aagtgtggtccctggaccag

SEQ ID NO: 24525 - DNA, 20 bp, Artificial Sequence
  chemically synthesized
atgctgatgctgctggtcca

SEQ ID NO: 24526 - DNA, 20 bp, Artificial Sequence
  chemically synthesized
tcaaagtgtggtccctggac

SEQ ID NO: 24527 - DNA, 20 bp, Artificial Sequence
  chemically synthesized
ggttctcaaagtgtggtccc

SEQ ID NO: 24528 - DNA, 20 bp, Artificial Sequence
  chemically synthesized
tggtccagggaccacacttt

SEQ ID NO: 24529 - DNA, 20 bp, Artificial Sequence
  chemically synthesized
ttagagtggttctcaaagtg

SEQ ID NO: 24530 - DNA, 20 bp, Artificial Sequence
  chemically synthesized
ctctattagagtggttctca

SEQ ID NO: 24531 - DNA, 20 bp, Artificial Sequence
  chemically synthesized
cactttgagaaccactctaa

SEQ ID NO: 24532 - DNA, 20 bp, Artificial Sequence
  chemically synthesized
gccacagtcctctattagag

SEQ ID NO: 24533 - DNA, 20 bp, Artificial Sequence
  chemically synthesized
ctttgagaaccactctaata

SEQ ID NO: 24534 - DNA, 20 bp, Artificial Sequence
  chemically synthesized
tttgagaaccactctaatag

SEQ ID NO: 24535 - DNA, 20 bp, Artificial Sequence
  chemically synthesized
caggccacagtcctctatta

SEQ ID NO: 24536 - DNA, 20 bp, Artificial Sequence
  chemically synthesized
cacaggccacagtcctctat

SEQ ID NO: 24537 - DNA, 20 bp, Artificial Sequence
  chemically synthesized
accactctaatagaggactg

SEQ ID NO: 24538 - DNA, 20 bp, Artificial Sequence
  chemically synthesized
ctcacagtctacacaggcca

SEQ ID NO: 24539 - DNA, 20 bp, Artificial Sequence
  chemically synthesized
atagaggactgtggcctgtg

SEQ ID NO: 24540 - DNA, 20 bp, Artificial Sequence
  chemically synthesized
gagaggctcacagtctacac

SEQ ID NO: 24541 - DNA, 20 bp, Artificial Sequence
  chemically synthesized
tgagaggctcacagtctaca

SEQ ID NO: 24542 - DNA, 20 bp, Artificial Sequence
  chemically synthesized
ctgtggcctgtgtagactgt

SEQ ID NO: 24543 - DNA, 20 bp, Artificial Sequence
  chemically synthesized
tgcttggtgtgagaggctca

SEQ ID NO: 24544 - DNA, 20 bp, Artificial Sequence
  chemically synthesized
tttggggtgcttggtgtgag

SEQ ID NO: 24545 - DNA, 20 bp, Artificial Sequence
  chemically synthesized
gactgtgagcctctcacacc

SEQ ID NO: 24546 - DNA, 20 bp, Artificial Sequence
  chemically synthesized
ttttggggtgcttggtgtga

SEQ ID NO: 24547 - DNA, 20 bp, Artificial Sequence
  chemically synthesized
tcttttggggtgcttggtgt

SEQ ID NO: 24548 - DNA, 20 bp, Artificial Sequence
  chemically synthesized
gttctgtcttttggggtgct

SEQ ID NO: 24549 - DNA, 20 bp, Artificial Sequence
  chemically synthesized
tctcacaccaagcaccccaa

SEQ ID NO: 24550 - DNA, 20 bp, Artificial Sequence
  chemically synthesized
acaccaagcaccccaaaaga

SEQ ID NO: 24551 - DNA, 20 bp, Artificial Sequence
  chemically synthesized
agtcacagttctgtcttttg

SEQ ID NO: 24552 - DNA, 20 bp, Artificial Sequence
  chemically synthesized
aagtcacagttctgtctttt

SEQ ID NO: 24553 - DNA, 20 bp, Artificial Sequence
  chemically synthesized
gaagtcacagttctgtcttt

SEQ ID NO: 24554 - DNA, 20 bp, Artificial Sequence
  chemically synthesized
ccagagacacagtgaagtca

SEQ ID NO: 24555 - DNA, 20 bp, Artificial Sequence
  chemically synthesized
cctgtgccagagacacagtg

SEQ ID NO: 24556 - DNA, 20 bp, Artificial Sequence
  chemically synthesized
ctgtgacttcactgtgtctc

SEQ ID NO: 24557 - DNA, 20 bp, Artificial Sequence
  chemically synthesized
tacagcctgtgccagagaca

SEQ ID NO: 24558 - DNA, 20 bp, Artificial Sequence
  chemically synthesized
acttcactgtgtctctggca

SEQ ID NO: 24559 - DNA, 20 bp, Artificial Sequence
  chemically synthesized
cttcactgtgtctctggcac

SEQ ID NO: 24560 - DNA, 20 bp, Artificial Sequence
  chemically synthesized
caatcttacagcctgtgcca

SEQ ID NO: 24561 - DNA, 20 bp, Artificial Sequence
  chemically synthesized
aacaatcttacagcctgtgc

SEQ ID NO: 24562 - DNA, 20 bp, Artificial Sequence
  chemically synthesized
gtgtctctggcacaggctgt

SEQ ID NO: 24563 - DNA, 20 bp, Artificial Sequence
  chemically synthesized
atgggtacaaaacaatctta

SEQ ID NO: 24564 - DNA, 20 bp, Artificial Sequence
  chemically synthesized
taagattgttttgtacccat

SEQ ID NO: 24565 - DNA, 20 bp, Artificial Sequence
  chemically synthesized
aggagcatttattagccaat

SEQ ID NO: 24566 - DNA, 20 bp, Artificial Sequence
  chemically synthesized
taggagcatttattagccaa

SEQ ID NO: 24567 - DNA, 20 bp, Artificial Sequence
  chemically synthesized
tgtcacttaggagcatttat

SEQ ID NO: 24568 - DNA, 20 bp, Artificial Sequence
  chemically synthesized
attggctaataaatgctcct

SEQ ID NO: 24569 - DNA, 20 bp, Artificial Sequence
  chemically synthesized
gtacaagttctgtcacttag

SEQ ID NO: 24570 - DNA, 20 bp, Artificial Sequence
  chemically synthesized
taataaatgctcctaagtga

SEQ ID NO: 24571 - DNA, 20 bp, Artificial Sequence
  chemically synthesized
cagtacaagttctgtcactt

SEQ ID NO: 24572 - DNA, 20 bp, Artificial Sequence
  chemically synthesized
tcagtacaagttctgtcact

SEQ ID NO: 24573 - DNA, 20 bp, Artificial Sequence
  chemically synthesized
taagtgacagaacttgtact

SEQ ID NO: 24574 - DNA, 20 bp, Artificial Sequence
  chemically synthesized
aagaaagcaagtctcagtac

SEQ ID NO: 24575 - DNA, 20 bp, Artificial Sequence
  chemically synthesized
gttataaagaaagcaagtct

SEQ ID NO: 24576 - DNA, 20 bp, Artificial Sequence
  chemically synthesized
tgccaggttataaagaaagc

SEQ ID NO: 24577 - DNA, 20 bp, Artificial Sequence
  chemically synthesized
cggctgccaggttataaaga

SEQ ID NO: 24578 - DNA, 20 bp, Artificial Sequence
  chemically synthesized
gacttgctttctttataacc

SEQ ID NO: 24579 - DNA, 20 bp, Artificial Sequence
  chemically synthesized
ctctcggctgccaggttata

SEQ ID NO: 24580 - DNA, 20 bp, Artificial Sequence
  chemically synthesized
ttgctttctttataacctgg

SEQ ID NO: 24581 - DNA, 20 bp, Artificial Sequence
  chemically synthesized
ttctttataacctggcagcc

SEQ ID NO: 24582 - DNA, 20 bp, Artificial Sequence
  chemically synthesized
ttaactacctctcggctgcc

SEQ ID NO: 24583 - DNA, 20 bp, Artificial Sequence
  chemically synthesized
cttaactacctctcggctgc

SEQ ID NO: 24584 - DNA, 20 bp, Artificial Sequence
  chemically synthesized
ctttataacctggcagccga

SEQ ID NO: 24585 - DNA, 20 bp, Artificial Sequence
  chemically synthesized
tttataacctggcagccgag

SEQ ID NO: 24586 - DNA, 20 bp, Artificial Sequence
  chemically synthesized
ataacctggcagccgagagg

SEQ ID NO: 24587 - DNA, 20 bp, Artificial Sequence
  chemically synthesized
ctgccctcttaactacctct

SEQ ID NO: 24588 - DNA, 20 bp, Artificial Sequence
  chemically synthesized
ctggcagccgagaggtagtt

SEQ ID NO: 24589 - DNA, 20 bp, Artificial Sequence
  chemically synthesized
ggcagccgagaggtagttaa

SEQ ID NO: 24590 - DNA, 20 bp, Artificial Sequence
  chemically synthesized
gcagccgagaggtagttaag

SEQ ID NO: 24591 - DNA, 20 bp, Artificial Sequence
  chemically synthesized
cagccgagaggtagttaaga

SEQ ID NO: 24592 - DNA, 20 bp, Artificial Sequence
  chemically synthesized
ccgagaggtagttaagaggg

SEQ ID NO: 24593 - DNA, 20 bp, Artificial Sequence
  chemically synthesized
ttcatggttagatgtagttg

SEQ ID NO: 24594 - DNA, 20 bp, Artificial Sequence
  chemically synthesized
attcatggttagatgtagtt

SEQ ID NO: 24595 - DNA, 20 bp, Artificial Sequence
  chemically synthesized
tagtcattcatggttagatg

SEQ ID NO: 24596 - DNA, 20 bp, Artificial Sequence
  chemically synthesized
tgttggtagtcattcatggt

SEQ ID NO: 24597 - DNA, 20 bp, Artificial Sequence
  chemically synthesized
ttggtgttggtagtcattca

SEQ ID NO: 24598 - DNA, 20 bp, Artificial Sequence
  chemically synthesized
ttctctgtaattggtgttgg

SEQ ID NO: 24599 - DNA, 20 bp, Artificial Sequence
  chemically synthesized
aggttctctgtaattggtgt

SEQ ID NO: 24600 - DNA, 20 bp, Artificial Sequence
  chemically synthesized
atgactaccaacaccaatta

SEQ ID NO: 24601 - DNA, 20 bp, Artificial Sequence
  chemically synthesized
gactaccaacaccaattaca

SEQ ID NO: 24602 - DNA, 20 bp, Artificial Sequence
  chemically synthesized
tcacacaggttctctgtaat

SEQ ID NO: 24603 - DNA, 20 bp, Artificial Sequence
  chemically synthesized
caattacagagaacctgtgt

SEQ ID NO: 24604 - DNA, 20 bp, Artificial Sequence
  chemically synthesized
tgactaacaaggactcacac

SEQ ID NO: 24605 - DNA, 20 bp, Artificial Sequence
  chemically synthesized
ttgactaacaaggactcaca

SEQ ID NO: 24606 - DNA, 20 bp, Artificial Sequence
  chemically synthesized
gaacctgtgtgagtccttgt

SEQ ID NO: 24607 - DNA, 20 bp, Artificial Sequence
  chemically synthesized
aaatcacactttgactaaca

SEQ ID NO: 24608 - DNA, 20 bp, Artificial Sequence
  chemically synthesized
caaatcacactttgactaac

SEQ ID NO: 24609 - DNA, 20 bp, Artificial Sequence
  chemically synthesized
gtgtgagtccttgttagtca

SEQ ID NO: 24610 - DNA, 20 bp, Artificial Sequence
  chemically synthesized
tgttagtcaaagtgtgattt

SEQ ID NO: 24611 - DNA, 20 bp, Artificial Sequence
  chemically synthesized
gttagtcaaagtgtgatttg

SEQ ID NO: 24612 - DNA, 20 bp, Artificial Sequence
  chemically synthesized
agtcaaagtgtgatttgagg

SEQ ID NO: 24613 - DNA, 20 bp, Artificial Sequence
  chemically synthesized
aagtgtgatttgaggaagaa

SEQ ID NO: 24614 - DNA, 20 bp, Artificial Sequence
  chemically synthesized
gatttgaggaagaatagcat

SEQ ID NO: 24615 - DNA, 20 bp, Artificial Sequence
  chemically synthesized
gaatagcatcagtatctgct

SEQ ID NO: 24616 - DNA, 20 bp, Artificial Sequence
  chemically synthesized
atagcatcagtatctgcttg

SEQ ID NO: 24617 - DNA, 20 bp, Artificial Sequence
  chemically synthesized
catttctcataagctccaag

SEQ ID NO: 24618 - DNA, 20 bp, Artificial Sequence
  chemically synthesized
ctgcatttctcataagctcc

SEQ ID NO: 24619 - DNA, 20 bp, Artificial Sequence
  chemically synthesized
agtatctgcttggagcttat

SEQ ID NO: 24620 - DNA, 20 bp, Artificial Sequence
  chemically synthesized
tgagattctgcatttctcat

SEQ ID NO: 24621 - DNA, 20 bp, Artificial Sequence
  chemically synthesized
cttggagcttatgagaaatg

SEQ ID NO: 24622 - DNA, 20 bp, Artificial Sequence
  chemically synthesized
ttatgagaaatgcagaatct

SEQ ID NO: 24623 - DNA, 20 bp, Artificial Sequence
  chemically synthesized
tatgagaaatgcagaatctc

SEQ ID NO: 24624 - DNA, 20 bp, Artificial Sequence
  chemically synthesized
cacagatctgggtggggcct

SEQ ID NO: 24625 - DNA, 20 bp, Artificial Sequence
  chemically synthesized
gcagaatctcaggccccacc

SEQ ID NO: 24626 - DNA, 20 bp, Artificial Sequence
  chemically synthesized
cggattcacagatctgggtg

SEQ ID NO: 24627 - DNA, 20 bp, Artificial Sequence
  chemically synthesized
tcggattcacagatctgggt

SEQ ID NO: 24628 - DNA, 20 bp, Artificial Sequence
  chemically synthesized
ttcggattcacagatctggg

SEQ ID NO: 24629 - DNA, 20 bp, Artificial Sequence
  chemically synthesized
tgattcggattcacagatct

SEQ ID NO: 24630 - DNA, 20 bp, Artificial Sequence
  chemically synthesized
ttgattcggattcacagatc

SEQ ID NO: 24631 - DNA, 20 bp, Artificial Sequence
  chemically synthesized
aaaatattgattcggattca

SEQ ID NO: 24632 - DNA, 20 bp, Artificial Sequence
  chemically synthesized
ctcttagtaaaatattgatt

SEQ ID NO: 24633 - DNA, 20 bp, Artificial Sequence
  chemically synthesized
atccgaatcaatattttact

SEQ ID NO: 24634 - DNA, 20 bp, Artificial Sequence
  chemically synthesized
ccgaatcaatattttactaa

SEQ ID NO: 24635 - DNA, 20 bp, Artificial Sequence
  chemically synthesized
tatgaatcaccagaggctct

SEQ ID NO: 24636 - DNA, 20 bp, Artificial Sequence
  chemically synthesized
aatattttactaagagcctc

SEQ ID NO: 24637 - DNA, 20 bp, Artificial Sequence
  chemically synthesized
acttccatatgaatcaccag

SEQ ID NO: 24638 - DNA, 20 bp, Artificial Sequence
  chemically synthesized
aacttccatatgaatcacca

SEQ ID NO: 24639 - DNA, 20 bp, Artificial Sequence
  chemically synthesized
agaacttccatatgaatcac

SEQ ID NO: 24640 - DNA, 20 bp, Artificial Sequence
  chemically synthesized
agagcctctggtgattcata

SEQ ID NO: 24641 - DNA, 20 bp, Artificial Sequence
  chemically synthesized
gcctctggtgattcatatgg

SEQ ID NO: 24642 - DNA, 20 bp, Artificial Sequence
  chemically synthesized
tttattaaaatattcattta

SEQ ID NO: 24643 - DNA, 20 bp, Artificial Sequence
  chemically synthesized
tttaaatgaatattttaata

SEQ ID NO: 24644 - DNA, 20 bp, Artificial Sequence
  chemically synthesized
gaagtttaacaacacggaac

SEQ ID NO: 24645 - DNA, 20 bp, Artificial Sequence
  chemically synthesized
atacttgaagtttaacaaca

SEQ ID NO: 24646 - DNA, 20 bp, Artificial Sequence
  chemically synthesized
gttccgtgttgttaaacttc

SEQ ID NO: 24647 - DNA, 20 bp, Artificial Sequence
  chemically synthesized
gtatacagaatttatacttg

SEQ ID NO: 24648 - DNA, 20 bp, Artificial Sequence
  chemically synthesized
cacaggatggtgttggtata

SEQ ID NO: 24649 - DNA, 20 bp, Artificial Sequence
  chemically synthesized
aagacaacacaggatggtgt

SEQ ID NO: 24650 - DNA, 20 bp, Artificial Sequence
  chemically synthesized
aaacaaaagacaacacagga

SEQ ID NO: 24651 - DNA, 20 bp, Artificial Sequence
  chemically synthesized
agaaaaacaaaagacaacac

SEQ ID NO: 24652 - DNA, 20 bp, Artificial Sequence
  chemically synthesized
tagaaaaacaaaagacaaca

SEQ ID NO: 24653 - DNA, 20 bp, Artificial Sequence
  chemically synthesized
atagaaagatagaaaaacaa

SEQ ID NO: 24654 - DNA, 20 bp, Artificial Sequence
  chemically synthesized
caaaatggaagatagaaaga

SEQ ID NO: 24655 - DNA, 20 bp, Artificial Sequence
  chemically synthesized
cccacaaaatggaagataga

SEQ ID NO: 24656 - DNA, 20 bp, Artificial Sequence
  chemically synthesized
aaagcccacaaaatggaaga

SEQ ID NO: 24657 - DNA, 20 bp, Artificial Sequence
  chemically synthesized
aataaaagcccacaaaatgg

SEQ ID NO: 24658 - DNA, 20 bp, Artificial Sequence
  chemically synthesized
tctttctatcttccattttg

SEQ ID NO: 24659 - DNA, 20 bp, Artificial Sequence
  chemically synthesized
ctttctatcttccattttgt

SEQ ID NO: 24660 - DNA, 20 bp, Artificial Sequence
  chemically synthesized
attaataaaagcccacaaaa

SEQ ID NO: 24661 - DNA, 20 bp, Artificial Sequence
  chemically synthesized
attttgtgggcttttattaa

SEQ ID NO: 24662 - DNA, 20 bp, Artificial Sequence
  chemically synthesized
attaaataatctattaataa

SEQ ID NO: 24663 - DNA, 20 bp, Artificial Sequence
  chemically synthesized
agattatttaataactacta

SEQ ID NO: 24664 - DNA, 20 bp, Artificial Sequence
  chemically synthesized
tttggtgtagttgactatag

SEQ ID NO: 24665 - DNA, 20 bp, Artificial Sequence
  chemically synthesized
ggttttggtgtagttgacta

SEQ ID NO: 24666 - DNA, 20 bp, Artificial Sequence
  chemically synthesized
ccagaggggaggttttggtg

SEQ ID NO: 24667 - DNA, 20 bp, Artificial Sequence
  chemically synthesized
atatcccagaggggaggttt

SEQ ID NO: 24668 - DNA, 20 bp, Artificial Sequence
  chemically synthesized
ctacaccaaaacctcccctc

SEQ ID NO: 24669 - DNA, 20 bp, Artificial Sequence
  chemically synthesized
tacaccaaaacctcccctct

SEQ ID NO: 24670 - DNA, 20 bp, Artificial Sequence
  chemically synthesized
acaaatatatcccagagggg

SEQ ID NO: 24671 - DNA, 20 bp, Artificial Sequence
  chemically synthesized
cacaaatatatcccagaggg

SEQ ID NO: 24672 - DNA, 20 bp, Artificial Sequence
  chemically synthesized
ctcacaaatatatcccagag

SEQ ID NO: 24673 - DNA, 20 bp, Artificial Sequence
  chemically synthesized
actcacaaatatatcccaga

SEQ ID NO: 24674 - DNA, 20 bp, Artificial Sequence
  chemically synthesized
gactcacaaatatatcccag

SEQ ID NO: 24675 - DNA, 20 bp, Artificial Sequence
  chemically synthesized
agactcacaaatatatccca

SEQ ID NO: 24676 - DNA, 20 bp, Artificial Sequence
  chemically synthesized
agagactcacaaatatatcc

SEQ ID NO: 24677 - DNA, 20 bp, Artificial Sequence
  chemically synthesized
cccctctgggatatatttgt

SEQ ID NO: 24678 - DNA, 20 bp, Artificial Sequence
  chemically synthesized
ttggtatttatcataaacaa

SEQ ID NO: 24679 - DNA, 20 bp, Artificial Sequence
  chemically synthesized
tattggtatttatcataaac

SEQ ID NO: 24680 - DNA, 20 bp, Artificial Sequence
  chemically synthesized
ttatgataaataccaataaa

SEQ ID NO: 24681 - DNA, 20 bp, Artificial Sequence
  chemically synthesized
atttattgaatactttttat

SEQ ID NO: 24682 - DNA, 20 bp, Artificial Sequence
  chemically synthesized
aaaagtattcaataaattaa

SEQ ID NO: 24683 - DNA, 20 bp, Artificial Sequence
  chemically synthesized
tcaataaattaaaagcatct

SEQ ID NO: 24684 - DNA, 20 bp, Artificial Sequence
  chemically synthesized
aataaattaaaagcatctcg

SEQ ID NO: 24685 - DNA, 20 bp, Artificial Sequence
  chemically synthesized
atagcatttcaagatactcc

SEQ ID NO: 24686 - DNA, 20 bp, Artificial Sequence
  chemically synthesized
atctgtatatatagcatttc

SEQ ID NO: 24687 - DNA, 20 bp, Artificial Sequence
  chemically synthesized
atcttgaaatgctatatata

SEQ ID NO: 24688 - DNA, 20 bp, Artificial Sequence
  chemically synthesized
caagaagcaatctgtatata

SEQ ID NO: 24689 - DNA, 20 bp, Artificial Sequence
  chemically synthesized
tatatacagattgcttcttg

SEQ ID NO: 24690 - DNA, 20 bp, Artificial Sequence
  chemically synthesized
aaatgttaattatcttcaag

SEQ ID NO: 24691 - DNA, 20 bp, Artificial Sequence
  chemically synthesized
ggcaaatgttaattatcttc

SEQ ID NO: 24692 - DNA, 20 bp, Artificial Sequence
  chemically synthesized
gaagataattaacatttgcc

SEQ ID NO: 24693 - DNA, 20 bp, Artificial Sequence
  chemically synthesized
ctcactaaaggacagcgtcc

SEQ ID NO: 24694 - DNA, 20 bp, Artificial Sequence
  chemically synthesized
gctcactaaaggacagcgtc

SEQ ID NO: 24695 - DNA, 20 bp, Artificial Sequence
  chemically synthesized
tttgcctggacgctgtcctt

SEQ ID NO: 24696 - DNA, 20 bp, Artificial Sequence
  chemically synthesized
aagttctgctcactaaagga

SEQ ID NO: 24697 - DNA, 20 bp, Artificial Sequence
  chemically synthesized
cctggacgctgtcctttagt

SEQ ID NO: 24698 - DNA, 20 bp, Artificial Sequence
  chemically synthesized
gatcaagttctgctcactaa

SEQ ID NO: 24699 - DNA, 20 bp, Artificial Sequence
  chemically synthesized
ggacgctgtcctttagtgag

SEQ ID NO: 24700 - DNA, 20 bp, Artificial Sequence
  chemically synthesized
agatcaagttctgctcacta

SEQ ID NO: 24701 - DNA, 20 bp, Artificial Sequence
  chemically synthesized
ttagtgagcagaacttgatc

SEQ ID NO: 24702 - DNA, 20 bp, Artificial Sequence
  chemically synthesized
taaagggactcaactagatc

SEQ ID NO: 24703 - DNA, 20 bp, Artificial Sequence
  chemically synthesized
gagcagaacttgatctagtt

SEQ ID NO: 24704 - DNA, 20 bp, Artificial Sequence
  chemically synthesized
gacaattaaagggactcaac

SEQ ID NO: 24705 - DNA, 20 bp, Artificial Sequence
  chemically synthesized
gagagagaaggacaattaaa

SEQ ID NO: 24706 - DNA, 20 bp, Artificial Sequence
  chemically synthesized
agagagagaaggacaattaa

SEQ ID NO: 24707 - DNA, 20 bp, Artificial Sequence
  chemically synthesized
gagagagagaaggacaatta

SEQ ID NO: 24708 - DNA, 20 bp, Artificial Sequence
  chemically synthesized
ttttaggggagagagagaga

SEQ ID NO: 24709 - DNA, 20 bp, Artificial Sequence
  chemically synthesized
cttttaggggagagagagag

SEQ ID NO: 24710 - DNA, 20 bp, Artificial Sequence
  chemically synthesized
catcttttaggggagagaga

SEQ ID NO: 24711 - DNA, 20 bp, Artificial Sequence
  chemically synthesized
cacatcttttaggggagaga

SEQ ID NO: 24712 - DNA, 20 bp, Artificial Sequence
  chemically synthesized
accacatcttttaggggaga

SEQ ID NO: 24713 - DNA, 20 bp, Artificial Sequence
  chemically synthesized
gaaccacatcttttagggga

SEQ ID NO: 24714 - DNA, 20 bp, Artificial Sequence
  chemically synthesized
cttctctctctctcccctaa

SEQ ID NO: 24715 - DNA, 20 bp, Artificial Sequence
  chemically synthesized
aagaaccacatcttttaggg

SEQ ID NO: 24716 - DNA, 20 bp, Artificial Sequence
  chemically synthesized
ggaagaaccacatcttttag

SEQ ID NO: 24717 - DNA, 20 bp, Artificial Sequence
  chemically synthesized
aggaagaaccacatctttta

SEQ ID NO: 24718 - DNA, 20 bp, Artificial Sequence
  chemically synthesized
aaggaagaaccacatctttt

SEQ ID NO: 24719 - DNA, 20 bp, Artificial Sequence
  chemically synthesized
tctctctcccctaaaagatg

SEQ ID NO: 24720 - DNA, 20 bp, Artificial Sequence
  chemically synthesized
aaaggaagaaccacatcttt

SEQ ID NO: 24721 - DNA, 20 bp, Artificial Sequence
  chemically synthesized
ctgggcaaaagagacaaagg

SEQ ID NO: 24722 - DNA, 20 bp, Artificial Sequence
  chemically synthesized
tgactgggcaaaagagacaa

SEQ ID NO: 24723 - DNA, 20 bp, Artificial Sequence
  chemically synthesized
atgactgggcaaaagagaca

SEQ ID NO: 24724 - DNA, 20 bp, Artificial Sequence
  chemically synthesized
cttcctttgtctcttttgcc

SEQ ID NO: 24725 - DNA, 20 bp, Artificial Sequence
  chemically synthesized
gcagtgatgactgggcaaaa

SEQ ID NO: 24726 - DNA, 20 bp, Artificial Sequence
  chemically synthesized
aagcagtgatgactgggcaa

SEQ ID NO: 24727 - DNA, 20 bp, Artificial Sequence
  chemically synthesized
aaaagtaagcagtgatgact

SEQ ID NO: 24728 - DNA, 20 bp, Artificial Sequence
  chemically synthesized
aaaaagtaagcagtgatgac

SEQ ID NO: 24729 - DNA, 20 bp, Artificial Sequence
  chemically synthesized
agaccacttaaaaaagtaag

SEQ ID NO: 24730 - DNA, 20 bp, Artificial Sequence
  chemically synthesized
ctgagaccacttaaaaaagt

SEQ ID NO: 24731 - DNA, 20 bp, Artificial Sequence
  chemically synthesized
tcatcactgcttactttttt

SEQ ID NO: 24732 - DNA, 20 bp, Artificial Sequence
  chemically synthesized
tcactgcttacttttttaag

SEQ ID NO: 24733 - DNA, 20 bp, Artificial Sequence
  chemically synthesized
ttggctgagaccacttaaaa

SEQ ID NO: 24734 - DNA, 20 bp, Artificial Sequence
  chemically synthesized
cttacttttttaagtggtct

SEQ ID NO: 24735 - DNA, 20 bp, Artificial Sequence
  chemically synthesized
attcataccatgagttggct

SEQ ID NO: 24736 - DNA, 20 bp, Artificial Sequence
  chemically synthesized
aagtggtctcagccaactca

SEQ ID NO: 24737 - DNA, 20 bp, Artificial Sequence
  chemically synthesized
agacaattcataccatgagt

SEQ ID NO: 24738 - DNA, 20 bp, Artificial Sequence
  chemically synthesized
cgcaagacaattcataccat

SEQ ID NO: 24739 - DNA, 20 bp, Artificial Sequence
  chemically synthesized
tcatggtatgaattgtcttg

SEQ ID NO: 24740 - DNA, 20 bp, Artificial Sequence
  chemically synthesized
ttctcatggattgatgccgc

SEQ ID NO: 24741 - DNA, 20 bp, Artificial Sequence
  chemically synthesized
gtcttgcggcatcaatccat

SEQ ID NO: 24742 - DNA, 20 bp, Artificial Sequence
  chemically synthesized
ggacaggaattggtttctca

SEQ ID NO: 24743 - DNA, 20 bp, Artificial Sequence
  chemically synthesized
ctggaggggaggacaggaat

SEQ ID NO: 24744 - DNA, 20 bp, Artificial Sequence
  chemically synthesized
accaatctggaggggaggac

SEQ ID NO: 24745 - DNA, 20 bp, Artificial Sequence
  chemically synthesized
caccaatctggaggggagga

SEQ ID NO: 24746 - DNA, 20 bp, Artificial Sequence
  chemically synthesized
ccaattcctgtcctcccctc

SEQ ID NO: 24747 - DNA, 20 bp, Artificial Sequence
  chemically synthesized
gttgcaccaatctggagggg

SEQ ID NO: 24748 - DNA, 20 bp, Artificial Sequence
  chemically synthesized
tgttgcaccaatctggaggg

SEQ ID NO: 24749 - DNA, 20 bp, Artificial Sequence
  chemically synthesized
gatgttgcaccaatctggag

SEQ ID NO: 24750 - DNA, 20 bp, Artificial Sequence
  chemically synthesized
tcctgtcctcccctccagat

SEQ ID NO: 24751 - DNA, 20 bp, Artificial Sequence
  chemically synthesized
ggatgttgcaccaatctgga

SEQ ID NO: 24752 - DNA, 20 bp, Artificial Sequence
  chemically synthesized
aggatgttgcaccaatctgg

SEQ ID NO: 24753 - DNA, 20 bp, Artificial Sequence
  chemically synthesized
aaggatgttgcaccaatctg

SEQ ID NO: 24754 - DNA, 20 bp, Artificial Sequence
  chemically synthesized
tgaaggatgttgcaccaatc

SEQ ID NO: 24755 - DNA, 20 bp, Artificial Sequence
  chemically synthesized
attggtgcaacatccttcac

SEQ ID NO: 24756 - DNA, 20 bp, Artificial Sequence
  chemically synthesized
aaatttgatggtactggtga

SEQ ID NO: 24757 - DNA, 20 bp, Artificial Sequence
  chemically synthesized
aaaatttgatggtactggtg

SEQ ID NO: 24758 - DNA, 20 bp, Artificial Sequence
  chemically synthesized
caggaaaaatttgatggtac

SEQ ID NO: 24759 - DNA, 20 bp, Artificial Sequence
  chemically synthesized
caagtacaggaaaaatttga

SEQ ID NO: 24760 - DNA, 20 bp, Artificial Sequence
  chemically synthesized
aactccacactagcaagtac

SEQ ID NO: 24761 - DNA, 20 bp, Artificial Sequence
  chemically synthesized
caaatttttcctgtacttgc

SEQ ID NO: 24762 - DNA, 20 bp, Artificial Sequence
  chemically synthesized
gaactccacactagcaagta

SEQ ID NO: 24763 - DNA, 20 bp, Artificial Sequence
  chemically synthesized
ttttcctgtacttgctagtg

SEQ ID NO: 24764 - DNA, 20 bp, Artificial Sequence
  chemically synthesized
taagggaactccacactagc

SEQ ID NO: 24765 - DNA, 20 bp, Artificial Sequence
  chemically synthesized
ttcctgtacttgctagtgtg

SEQ ID NO: 24766 - DNA, 20 bp, Artificial Sequence
  chemically synthesized
tgtgtaagggaactccacac

SEQ ID NO: 24767 - DNA, 20 bp, Artificial Sequence
  chemically synthesized
aatgatgagtgtgtgtgtaa

SEQ ID NO: 24768 - DNA, 20 bp, Artificial Sequence
  chemically synthesized
caatgatgagtgtgtgtgta

SEQ ID NO: 24769 - DNA, 20 bp, Artificial Sequence
  chemically synthesized
tcaatgatgagtgtgtgtgt

SEQ ID NO: 24770 - DNA, 20 bp, Artificial Sequence
  chemically synthesized
ttacacacacactcatcatt

SEQ ID NO: 24771 - DNA, 20 bp, Artificial Sequence
  chemically synthesized
agtcaaagggactcaatgat

SEQ ID NO: 24772 - DNA, 20 bp, Artificial Sequence
  chemically synthesized
tctttttataaagagtcaaa

SEQ ID NO: 24773 - DNA, 20 bp, Artificial Sequence
  chemically synthesized
ttctttttataaagagtcaa

SEQ ID NO: 24774 - DNA, 20 bp, Artificial Sequence
  chemically synthesized
tttctttttataaagagtca

SEQ ID NO: 24775 - DNA, 20 bp, Artificial Sequence
  chemically synthesized
tctacatttctttttataaa

SEQ ID NO: 24776 - DNA, 20 bp, Artificial Sequence
  chemically synthesized
tccctttgactctttataaa

SEQ ID NO: 24777 - DNA, 20 bp, Artificial Sequence
  chemically synthesized
tctctacatttctttttata

SEQ ID NO: 24778 - DNA, 20 bp, Artificial Sequence
  chemically synthesized
actctttataaaaagaaatg

SEQ ID NO: 24779 - DNA, 20 bp, Artificial Sequence
  chemically synthesized
tctttataaaaagaaatgta

SEQ ID NO: 24780 - DNA, 20 bp, Artificial Sequence
  chemically synthesized
taaaaagaaatgtagagacg

SEQ ID NO: 24781 - DNA, 20 bp, Artificial Sequence
  chemically synthesized
gagacgtggaaatgcacttt

SEQ ID NO: 24782 - DNA, 20 bp, Artificial Sequence
  chemically synthesized
agggatctgtatttgaccaa

SEQ ID NO: 24783 - DNA, 20 bp, Artificial Sequence
  chemically synthesized
aatgcacttttggtcaaata

SEQ ID NO: 24784 - DNA, 20 bp, Artificial Sequence
  chemically synthesized
aggctggtgttaatgggaaa

SEQ ID NO: 24785 - DNA, 20 bp, Artificial Sequence
  chemically synthesized
caggctggtgttaatgggaa

SEQ ID NO: 24786 - DNA, 20 bp, Artificial Sequence
  chemically synthesized
acaggctggtgttaatggga

SEQ ID NO: 24787 - DNA, 20 bp, Artificial Sequence
  chemically synthesized
tgctacaggctggtgttaat

SEQ ID NO: 24788 - DNA, 20 bp, Artificial Sequence
  chemically synthesized
gatccctttcccattaacac

SEQ ID NO: 24789 - DNA, 20 bp, Artificial Sequence
  chemically synthesized
ctgctacaggctggtgttaa

SEQ ID NO: 24790 - DNA, 20 bp, Artificial Sequence
  chemically synthesized
ttcccattaacaccagcctg

SEQ ID NO: 24791 - DNA, 20 bp, Artificial Sequence
  chemically synthesized
ccctggaaactgctacaggc

SEQ ID NO: 24792 - DNA, 20 bp, Artificial Sequence
  chemically synthesized
ccattaacaccagcctgtag

SEQ ID NO: 24793 - DNA, 20 bp, Artificial Sequence
  chemically synthesized
tatcccctggaaactgctac

SEQ ID NO: 24794 - DNA, 20 bp, Artificial Sequence
  chemically synthesized
ttatcccctggaaactgcta

SEQ ID NO: 24795 - DNA, 20 bp, Artificial Sequence
  chemically synthesized
caccagcctgtagcagtttc

SEQ ID NO: 24796 - DNA, 20 bp, Artificial Sequence
  chemically synthesized
accagcctgtagcagtttcc

SEQ ID NO: 24797 - DNA, 20 bp, Artificial Sequence
  chemically synthesized
ccagcctgtagcagtttcca

SEQ ID NO: 24798 - DNA, 20 bp, Artificial Sequence
  chemically synthesized
cagcctgtagcagtttccag

SEQ ID NO: 24799 - DNA, 20 bp, Artificial Sequence
  chemically synthesized
tgtagcagtttccaggggat

SEQ ID NO: 24800 - DNA, 20 bp, Artificial Sequence
  chemically synthesized
gggattggatgcttatcccc

SEQ ID NO: 24801 - DNA, 20 bp, Artificial Sequence
  chemically synthesized
aatgagagaaaatttgggat

SEQ ID NO: 24802 - DNA, 20 bp, Artificial Sequence
  chemically synthesized
aaaggaatgagagaaaattt

SEQ ID NO: 24803 - DNA, 20 bp, Artificial Sequence
  chemically synthesized
taaaggaatgagagaaaatt

SEQ ID NO: 24804 - DNA, 20 bp, Artificial Sequence
  chemically synthesized
ttgcataagtaaaggaatga

SEQ ID NO: 24805 - DNA, 20 bp, Artificial Sequence
  chemically synthesized
ttttgcataagtaaaggaat

SEQ ID NO: 24806 - DNA, 20 bp, Artificial Sequence
  chemically synthesized
caatacttttgcataagtaa

SEQ ID NO: 24807 - DNA, 20 bp, Artificial Sequence
  chemically synthesized
tcaatacttttgcataagta

SEQ ID NO: 24808 - DNA, 20 bp, Artificial Sequence
  chemically synthesized
tcattcctttacttatgcaa

SEQ ID NO: 24809 - DNA, 20 bp, Artificial Sequence
  chemically synthesized
aacactcaatacttttgcat

SEQ ID NO: 24810 - DNA, 20 bp, Artificial Sequence
  chemically synthesized
tttacttatgcaaaagtatt

SEQ ID NO: 24811 - DNA, 20 bp, Artificial Sequence
  chemically synthesized
tatgcaaaagtattgagtgt

SEQ ID NO: 24812 - DNA, 20 bp, Artificial Sequence
  chemically synthesized
attgagtgttagttttgtgc

SEQ ID NO: 24813 - DNA, 20 bp, Artificial Sequence
  chemically synthesized
tcttctacaagatgtttggc

SEQ ID NO: 24814 - DNA, 20 bp, Artificial Sequence
  chemically synthesized
aatatcttctacaagatgtt

SEQ ID NO: 24815 - DNA, 20 bp, Artificial Sequence
  chemically synthesized
tgtgccagccaaacatcttg

SEQ ID NO: 24816 - DNA, 20 bp, Artificial Sequence
  chemically synthesized
gccagccaaacatcttgtag

SEQ ID NO: 24817 - DNA, 20 bp, Artificial Sequence
  chemically synthesized
tttatgccaatatcttctac

SEQ ID NO: 24818 - DNA, 20 bp, Artificial Sequence
  chemically synthesized
aaacatcttgtagaagatat

SEQ ID NO: 24819 - DNA, 20 bp, Artificial Sequence
  chemically synthesized
ttgtagaagatattggcata

SEQ ID NO: 24820 - DNA, 20 bp, Artificial Sequence
  chemically synthesized
ttagaaagggaaaaaaagaa

SEQ ID NO: 24821 - DNA, 20 bp, Artificial Sequence
  chemically synthesized
gattagaaagggaaaaaaag

SEQ ID NO: 24822 - DNA, 20 bp, Artificial Sequence
  chemically synthesized
gaggattagaaagggaaaaa

SEQ ID NO: 24823 - DNA, 20 bp, Artificial Sequence
  chemically synthesized
tggagaaggaggattagaaa

SEQ ID NO: 24824 - DNA, 20 bp, Artificial Sequence
  chemically synthesized
gtggagaaggaggattagaa

SEQ ID NO: 24825 - DNA, 20 bp, Artificial Sequence
  chemically synthesized
agtggagaaggaggattaga

SEQ ID NO: 24826 - DNA, 20 bp, Artificial Sequence
  chemically synthesized
aggcagtggagaaggaggat

SEQ ID NO: 24827 - DNA, 20 bp, Artificial Sequence
  chemically synthesized
ttacgaggcagtggagaagg

SEQ ID NO: 24828 - DNA, 20 bp, Artificial Sequence
  chemically synthesized
gttacgaggcagtggagaag

SEQ ID NO: 24829 - DNA, 20 bp, Artificial Sequence
  chemically synthesized
gagttacgaggcagtggaga

SEQ ID NO: 24830 - DNA, 20 bp, Artificial Sequence
  chemically synthesized
tgagttacgaggcagtggag

SEQ ID NO: 24831 - DNA, 20 bp, Artificial Sequence
  chemically synthesized
acatgagttacgaggcagtg

SEQ ID NO: 24832 - DNA, 20 bp, Artificial Sequence
  chemically synthesized
gcacatgagttacgaggcag

SEQ ID NO: 24833 - DNA, 20 bp, Artificial Sequence
  chemically synthesized
taggcacatgagttacgagg

SEQ ID NO: 24834 - DNA, 20 bp, Artificial Sequence
  chemically synthesized
aactaggcacatgagttacg

SEQ ID NO: 24835 - DNA, 20 bp, Artificial Sequence
  chemically synthesized
aaactaggcacatgagttac

SEQ ID NO: 24836 - DNA, 20 bp, Artificial Sequence
  chemically synthesized
tgcctcgtaactcatgtgcc

SEQ ID NO: 24837 - DNA, 20 bp, Artificial Sequence
  chemically synthesized
tgataggaaactaggcacat

SEQ ID NO: 24838 - DNA, 20 bp, Artificial Sequence
  chemically synthesized
aagaaagatgataggaaact

SEQ ID NO: 24839 - DNA, 20 bp, Artificial Sequence
  chemically synthesized
gaagaaagatgataggaaac

SEQ ID NO: 24840 - DNA, 20 bp, Artificial Sequence
  chemically synthesized
tttgaaagaagaaagatgat

SEQ ID NO: 24841 - DNA, 20 bp, Artificial Sequence
  chemically synthesized
ctttgaaagaagaaagatga

SEQ ID NO: 24842 - DNA, 20 bp, Artificial Sequence
  chemically synthesized
cgtcgttctttgaaagaaga

SEQ ID NO: 24843 - DNA, 20 bp, Artificial Sequence
  chemically synthesized
ctatcatctttcttctttca

SEQ ID NO: 24844 - DNA, 20 bp, Artificial Sequence
  chemically synthesized
gaatcgtcgttctttgaaag

SEQ ID NO: 24845 - DNA, 20 bp, Artificial Sequence
  chemically synthesized
gaggaatcgtcgttctttga

SEQ ID NO: 24846 - DNA, 20 bp, Artificial Sequence
  chemically synthesized
tagaattggggtcataagag

SEQ ID NO: 24847 - DNA, 20 bp, Artificial Sequence
  chemically synthesized
gtagaattggggtcataaga

SEQ ID NO: 24848 - DNA, 20 bp, Artificial Sequence
  chemically synthesized
gggtagaattggggtcataa

SEQ ID NO: 24849 - DNA, 20 bp, Artificial Sequence
  chemically synthesized
gagggtagaattggggtcat

SEQ ID NO: 24850 - DNA, 20 bp, Artificial Sequence
  chemically synthesized
aggaaaagagggtagaattg

SEQ ID NO: 24851 - DNA, 20 bp, Artificial Sequence
  chemically synthesized
taggaaaagagggtagaatt

SEQ ID NO: 24852 - DNA, 20 bp, Artificial Sequence
  chemically synthesized
ataggaaaagagggtagaat

SEQ ID NO: 24853 - DNA, 20 bp, Artificial Sequence
  chemically synthesized
aggaaaataggaaaagaggg

SEQ ID NO: 24854 - DNA, 20 bp, Artificial Sequence
  chemically synthesized
accaggaaaataggaaaaga

SEQ ID NO: 24855 - DNA, 20 bp, Artificial Sequence
  chemically synthesized
aaccaggaaaataggaaaag

SEQ ID NO: 24856 - DNA, 20 bp, Artificial Sequence
  chemically synthesized
gaaccaggaaaataggaaaa

SEQ ID NO: 24857 - DNA, 20 bp, Artificial Sequence
  chemically synthesized
tagaaccaggaaaataggaa

SEQ ID NO: 24858 - DNA, 20 bp, Artificial Sequence
  chemically synthesized
accctcttttcctattttcc

SEQ ID NO: 24859 - DNA, 20 bp, Artificial Sequence
  chemically synthesized
ctgaatagaaccaggaaaat

SEQ ID NO: 24860 - DNA, 20 bp, Artificial Sequence
  chemically synthesized
gctgaatagaaccaggaaaa

SEQ ID NO: 24861 - DNA, 20 bp, Artificial Sequence
  chemically synthesized
tctaaatgctgaatagaacc

SEQ ID NO: 24862 - DNA, 20 bp, Artificial Sequence
  chemically synthesized
ttctaaatgctgaatagaac

SEQ ID NO: 24863 - DNA, 20 bp, Artificial Sequence
  chemically synthesized
cctattttcctggttctatt

SEQ ID NO: 24864 - DNA, 20 bp, Artificial Sequence
  chemically synthesized
catttgttctaaatgctgaa

SEQ ID NO: 24865 - DNA, 20 bp, Artificial Sequence
  chemically synthesized
tcctggttctattcagcatt

SEQ ID NO: 24866 - DNA, 20 bp, Artificial Sequence
  chemically synthesized
tattcagcatttagaacaaa

SEQ ID NO: 24867 - DNA, 20 bp, Artificial Sequence
  chemically synthesized
ttagaacaaatggtctaaat

SEQ ID NO: 24868 - DNA, 20 bp, Artificial Sequence
  chemically synthesized
tagaacaaatggtctaaatg

SEQ ID NO: 24869 - DNA, 20 bp, Artificial Sequence
  chemically synthesized
atggagcttgtgacctcatt

SEQ ID NO: 24870 - DNA, 20 bp, Artificial Sequence
  chemically synthesized
aatggtctaaatgaggtcac

SEQ ID NO: 24871 - DNA, 20 bp, Artificial Sequence
  chemically synthesized
tgaacgctaagatttggatg

SEQ ID NO: 24872 - DNA, 20 bp, Artificial Sequence
  chemically synthesized
tatgaacgctaagatttgga

SEQ ID NO: 24873 - DNA, 20 bp, Artificial Sequence
  chemically synthesized
cacaagctccatccaaatct

SEQ ID NO: 24874 - DNA, 20 bp, Artificial Sequence
  chemically synthesized
ttgatatgaacgctaagatt

SEQ ID NO: 24875 - DNA, 20 bp, Artificial Sequence
  chemically synthesized
caattcttgatatgaacgct

SEQ ID NO: 24876 - DNA, 20 bp, Artificial Sequence
  chemically synthesized
caaatcttagcgttcatatc

SEQ ID NO: 24877 - DNA, 20 bp, Artificial Sequence
  chemically synthesized
ttagcgttcatatcaagaat

SEQ ID NO: 24878 - DNA, 20 bp, Artificial Sequence
  chemically synthesized
tatcaagaattggcaaattc

SEQ ID NO: 24879 - DNA, 20 bp, Artificial Sequence
  chemically synthesized
caagaattggcaaattccag

SEQ ID NO: 24880 - DNA, 20 bp, Artificial Sequence
  chemically synthesized
aattggcaaattccagtagc

SEQ ID NO: 24881 - DNA, 20 bp, Artificial Sequence
  chemically synthesized
ttggcaaattccagtagcta

SEQ ID NO: 24882 - DNA, 20 bp, Artificial Sequence
  chemically synthesized
ccacttggatctctagctac

SEQ ID NO: 24883 - DNA, 20 bp, Artificial Sequence
  chemically synthesized
attccagtagctagagatcc

SEQ ID NO: 24884 - DNA, 20 bp, Artificial Sequence
  chemically synthesized
gcctctcccacttggatctc

SEQ ID NO: 24885 - DNA, 20 bp, Artificial Sequence
  chemically synthesized
ccagtagctagagatccaag

SEQ ID NO: 24886 - DNA, 20 bp, Artificial Sequence
  chemically synthesized
cagtagctagagatccaagt

SEQ ID NO: 24887 - DNA, 20 bp, Artificial Sequence
  chemically synthesized
gtagctagagatccaagtgg

SEQ ID NO: 24888 - DNA, 20 bp, Artificial Sequence
  chemically synthesized
agctagagatccaagtggga

SEQ ID NO: 24889 - DNA, 20 bp, Artificial Sequence
  chemically synthesized
tcattcttgcctctcccact

SEQ ID NO: 24890 - DNA, 20 bp, Artificial Sequence
  chemically synthesized
gctagagatccaagtgggag

SEQ ID NO: 24891 - DNA, 20 bp, Artificial Sequence
  chemically synthesized
gagatccaagtgggagaggc

SEQ ID NO: 24892 - DNA, 20 bp, Artificial Sequence
  chemically synthesized
caagaatgatctgattcttt

SEQ ID NO: 24893 - DNA, 20 bp, Artificial Sequence
  chemically synthesized
tattcatgccctgaaagaat

SEQ ID NO: 24894 - DNA, 20 bp, Artificial Sequence
  chemically synthesized
aagaatgatctgattctttc

SEQ ID NO: 24895 - DNA, 20 bp, Artificial Sequence
  chemically synthesized
agaatgatctgattctttca

SEQ ID NO: 24896 - DNA, 20 bp, Artificial Sequence
  chemically synthesized
cactaatattcatgccctga

SEQ ID NO: 24897 - DNA, 20 bp, Artificial Sequence
  chemically synthesized
ttctttcagggcatgaatat

SEQ ID NO: 24898 - DNA, 20 bp, Artificial Sequence
  chemically synthesized
tcagggcatgaatattagtg

SEQ ID NO: 24899 - DNA, 20 bp, Artificial Sequence
  chemically synthesized
gcatgaatattagtgtggaa

SEQ ID NO: 24900 - DNA, 20 bp, Artificial Sequence
  chemically synthesized
atattagtgtggaacagtat

SEQ ID NO: 24901 - DNA, 20 bp, Artificial Sequence
  chemically synthesized
attagtgtggaacagtatca

SEQ ID NO: 24902 - DNA, 20 bp, Artificial Sequence
  chemically synthesized
gaagtatttagaagggaaga

SEQ ID NO: 24903 - DNA, 20 bp, Artificial Sequence
  chemically synthesized
gttagaagtatttagaaggg

SEQ ID NO: 24904 - DNA, 20 bp, Artificial Sequence
  chemically synthesized
atagttagaagtatttagaa

SEQ ID NO: 24905 - DNA, 20 bp, Artificial Sequence
  chemically synthesized
catagttagaagtatttaga

SEQ ID NO: 24906 - DNA, 20 bp, Artificial Sequence
  chemically synthesized
tcatagttagaagtatttag

SEQ ID NO: 24907 - DNA, 20 bp, Artificial Sequence
  chemically synthesized
gtgtcatagttagaagtatt

SEQ ID NO: 24908 - DNA, 20 bp, Artificial Sequence
  chemically synthesized
gcagaatgtgtcatagttag

SEQ ID NO: 24909 - DNA, 20 bp, Artificial Sequence
  chemically synthesized
gaggcagaatgtgtcatagt

SEQ ID NO: 24910 - DNA, 20 bp, Artificial Sequence
  chemically synthesized
actagaggcagaatgtgtca

SEQ ID NO: 24911 - DNA, 20 bp, Artificial Sequence
  chemically synthesized
actatgacacattctgcctc

SEQ ID NO: 24912 - DNA, 20 bp, Artificial Sequence
  chemically synthesized
cagggaggattaactagagg

SEQ ID NO: 24913 - DNA, 20 bp, Artificial Sequence
  chemically synthesized
tgtcagggaggattaactag

SEQ ID NO: 24914 - DNA, 20 bp, Artificial Sequence
  chemically synthesized
atgtcagggaggattaacta

SEQ ID NO: 24915 - DNA, 20 bp, Artificial Sequence
  chemically synthesized
agatgtcagggaggattaac

SEQ ID NO: 24916 - DNA, 20 bp, Artificial Sequence
  chemically synthesized
aggctgaaaagatgtcaggg

SEQ ID NO: 24917 - DNA, 20 bp, Artificial Sequence
  chemically synthesized
taggctgaaaagatgtcagg

SEQ ID NO: 24918 - DNA, 20 bp, Artificial Sequence
  chemically synthesized
ggtaggctgaaaagatgtca

SEQ ID NO: 24919 - DNA, 20 bp, Artificial Sequence
  chemically synthesized
gggtaggctgaaaagatgtc

SEQ ID NO: 24920 - DNA, 20 bp, Artificial Sequence
  chemically synthesized
ggggtaggctgaaaagatgt

SEQ ID NO: 24921 - DNA, 20 bp, Artificial Sequence
  chemically synthesized
aatcctccctgacatctttt

SEQ ID NO: 24922 - DNA, 20 bp, Artificial Sequence
  chemically synthesized
tgggttgggggtaggctgaa

SEQ ID NO: 24923 - DNA, 20 bp, Artificial Sequence
  chemically synthesized
cactgcagtgggttgggggt

SEQ ID NO: 24924 - DNA, 20 bp, Artificial Sequence
  chemically synthesized
tcactgcagtgggttggggg

SEQ ID NO: 24925 - DNA, 20 bp, Artificial Sequence
  chemically synthesized
tattcactgcagtgggttgg

SEQ ID NO: 24926 - DNA, 20 bp, Artificial Sequence
  chemically synthesized
ttattcactgcagtgggttg

SEQ ID NO: 24927 - DNA, 20 bp, Artificial Sequence
  chemically synthesized
cttattcactgcagtgggtt

SEQ ID NO: 24928 - DNA, 20 bp, Artificial Sequence
  chemically synthesized
gcttattcactgcagtgggt

SEQ ID NO: 24929 - DNA, 20 bp, Artificial Sequence
  chemically synthesized
agcctacccccaacccactg

SEQ ID NO: 24930 - DNA, 20 bp, Artificial Sequence
  chemically synthesized
gaaggcttattcactgcagt

SEQ ID NO: 24931 - DNA, 20 bp, Artificial Sequence
  chemically synthesized
agaaggcttattcactgcag

SEQ ID NO: 24932 - DNA, 20 bp, Artificial Sequence
  chemically synthesized
agcagaaggcttattcactg

SEQ ID NO: 24933 - DNA, 20 bp, Artificial Sequence
  chemically synthesized
cccaacccactgcagtgaat

SEQ ID NO: 24934 - DNA, 20 bp, Artificial Sequence
  chemically synthesized
cgtggaaaactggtagcaga

SEQ ID NO: 24935 - DNA, 20 bp, Artificial Sequence
  chemically synthesized
gtgaataagccttctgctac

SEQ ID NO: 24936 - DNA, 20 bp, Artificial Sequence
  chemically synthesized
gcgtggaaaactggtagcag

SEQ ID NO: 24937 - DNA, 20 bp, Artificial Sequence
  chemically synthesized
ggtgcgtggaaaactggtag

SEQ ID NO: 24938 - DNA, 20 bp, Artificial Sequence
  chemically synthesized
tttggtgcgtggaaaactgg

SEQ ID NO: 24939 - DNA, 20 bp, Artificial Sequence
  chemically synthesized
gactttggtgcgtggaaaac

SEQ ID NO: 24940 - DNA, 20 bp, Artificial Sequence
  chemically synthesized
taccagttttccacgcacca

SEQ ID NO: 24941 - DNA, 20 bp, Artificial Sequence
  chemically synthesized
atggattggactttggtgcg

SEQ ID NO: 24942 - DNA, 20 bp, Artificial Sequence
  chemically synthesized
tttgagaatggattggactt

SEQ ID NO: 24943 - DNA, 20 bp, Artificial Sequence
  chemically synthesized
atcactgtttgagaatggat

SEQ ID NO: 24944 - DNA, 20 bp, Artificial Sequence
  chemically synthesized
cctgaatcactgtttgagaa

SEQ ID NO: 24945 - DNA, 20 bp, Artificial Sequence
  chemically synthesized
aagtccaatccattctcaaa

SEQ ID NO: 24946 - DNA, 20 bp, Artificial Sequence
  chemically synthesized
gtatgcctgaatcactgttt

SEQ ID NO: 24947 - DNA, 20 bp, Artificial Sequence
  chemically synthesized
tccattctcaaacagtgatt

SEQ ID NO: 24948 - DNA, 20 bp, Artificial Sequence
  chemically synthesized
ccattctcaaacagtgattc

SEQ ID NO: 24949 - DNA, 20 bp, Artificial Sequence
  chemically synthesized
aaacagtgattcaggcatac

SEQ ID NO: 24950 - DNA, 20 bp, Artificial Sequence
  chemically synthesized
cagtgattcaggcataccag

SEQ ID NO: 24951 - DNA, 20 bp, Artificial Sequence
  chemically synthesized
gattcaggcataccagaaga

SEQ ID NO: 24952 - DNA, 20 bp, Artificial Sequence
  chemically synthesized
cattccctgctactttcttc

SEQ ID NO: 24953 - DNA, 20 bp, Artificial Sequence
  chemically synthesized
tcaggcataccagaagaaag

SEQ ID NO: 24954 - DNA, 20 bp, Artificial Sequence
  chemically synthesized
ggcataccagaagaaagtag

SEQ ID NO: 24955 - DNA, 20 bp, Artificial Sequence
  chemically synthesized
gcataccagaagaaagtagc

SEQ ID NO: 24956 - DNA, 20 bp, Artificial Sequence
  chemically synthesized
cataccagaagaaagtagca

SEQ ID NO: 24957 - DNA, 20 bp, Artificial Sequence
  chemically synthesized
aaagtagcagggaatgcctc

SEQ ID NO: 24958 - DNA, 20 bp, Artificial Sequence
  chemically synthesized
agccaaaagaacaaagctgg

SEQ ID NO: 24959 - DNA, 20 bp, Artificial Sequence
  chemically synthesized
aagccaaaagaacaaagctg

SEQ ID NO: 24960 - DNA, 20 bp, Artificial Sequence
  chemically synthesized
ctaagccaaaagaacaaagc

SEQ ID NO: 24961 - DNA, 20 bp, Artificial Sequence
  chemically synthesized
agtcctaagccaaaagaaca

SEQ ID NO: 24962 - DNA, 20 bp, Artificial Sequence
  chemically synthesized
tgcctccagctttgttcttt

SEQ ID NO: 24963 - DNA, 20 bp, Artificial Sequence
  chemically synthesized
ccagctttgttcttttggct

SEQ ID NO: 24964 - DNA, 20 bp, Artificial Sequence
  chemically synthesized
cagctttgttcttttggctt

SEQ ID NO: 24965 - DNA, 20 bp, Artificial Sequence
  chemically synthesized
ccaagtcagtcctaagccaa

SEQ ID NO: 24966 - DNA, 20 bp, Artificial Sequence
  chemically synthesized
cgcattgccaagtcagtcct

SEQ ID NO: 24967 - DNA, 20 bp, Artificial Sequence
  chemically synthesized
cttttggcttaggactgact

SEQ ID NO: 24968 - DNA, 20 bp, Artificial Sequence
  chemically synthesized
aagagcccgcattgccaagt

SEQ ID NO: 24969 - DNA, 20 bp, Artificial Sequence
  chemically synthesized
ttaggactgacttggcaatg

SEQ ID NO: 24970 - DNA, 20 bp, Artificial Sequence
  chemically synthesized
aaaaaagagcccgcattgcc

SEQ ID NO: 24971 - DNA, 20 bp, Artificial Sequence
  chemically synthesized
taggactgacttggcaatgc

SEQ ID NO: 24972 - DNA, 20 bp, Artificial Sequence
  chemically synthesized
tggcaatgcgggctcttttt

SEQ ID NO: 24973 - DNA, 20 bp, Artificial Sequence
  chemically synthesized
gttcatatggaaccaaaaaa

SEQ ID NO: 24974 - DNA, 20 bp, Artificial Sequence
  chemically synthesized
aagttcatatggaaccaaaa

SEQ ID NO: 24975 - DNA, 20 bp, Artificial Sequence
  chemically synthesized
aaactactttaaagttcata

SEQ ID NO: 24976 - DNA, 20 bp, Artificial Sequence
  chemically synthesized
ttggttccatatgaacttta

SEQ ID NO: 24977 - DNA, 20 bp, Artificial Sequence
  chemically synthesized
gttccatatgaactttaaag

SEQ ID NO: 24978 - DNA, 20 bp, Artificial Sequence
  chemically synthesized
aattggaaaaaactacttta

SEQ ID NO: 24979 - DNA, 20 bp, Artificial Sequence
  chemically synthesized
aatgactttcttcacagaat

SEQ ID NO: 24980 - DNA, 20 bp, Artificial Sequence
  chemically synthesized
tagttttttccaattctgtg

SEQ ID NO: 24981 - DNA, 20 bp, Artificial Sequence
  chemically synthesized
tttttccaattctgtgaaga

SEQ ID NO: 24982 - DNA, 20 bp, Artificial Sequence
  chemically synthesized
gctaccaatgactttcttca

SEQ ID NO: 24983 - DNA, 20 bp, Artificial Sequence
  chemically synthesized
aattctgtgaagaaagtcat

SEQ ID NO: 24984 - DNA, 20 bp, Artificial Sequence
  chemically synthesized
tctgtgaagaaagtcattgg

SEQ ID NO: 24985 - DNA, 20 bp, Artificial Sequence
  chemically synthesized
gaaagtcattggtagcttga

SEQ ID NO: 24986 - DNA, 20 bp, Artificial Sequence
  chemically synthesized
aaagtcattggtagcttgat

SEQ ID NO: 24987 - DNA, 20 bp, Artificial Sequence
  chemically synthesized
aagtcattggtagcttgatg

SEQ ID NO: 24988 - DNA, 20 bp, Artificial Sequence
  chemically synthesized
gattcaatgccatccccatc

SEQ ID NO: 24989 - DNA, 20 bp, Artificial Sequence
  chemically synthesized
cattggtagcttgatgggga

SEQ ID NO: 24990 - DNA, 20 bp, Artificial Sequence
  chemically synthesized
atactgcccaaggtaattta

SEQ ID NO: 24991 - DNA, 20 bp, Artificial Sequence
  chemically synthesized
attgaatctgtaaattacct

SEQ ID NO: 24992 - DNA, 20 bp, Artificial Sequence
  chemically synthesized
ttgaatctgtaaattacctt

SEQ ID NO: 24993 - DNA, 20 bp, Artificial Sequence
  chemically synthesized
aatctgtaaattaccttggg

SEQ ID NO: 24994 - DNA, 20 bp, Artificial Sequence
  chemically synthesized
gaaaatggtcatactgccca

SEQ ID NO: 24995 - DNA, 20 bp, Artificial Sequence
  chemically synthesized
tgaaaatggtcatactgccc

SEQ ID NO: 24996 - DNA, 20 bp, Artificial Sequence
  chemically synthesized
aagaatcaatatcgtgaaaa

SEQ ID NO: 24997 - DNA, 20 bp, Artificial Sequence
  chemically synthesized
attccatgctcatgggtagg

SEQ ID NO: 24998 - DNA, 20 bp, Artificial Sequence
  chemically synthesized
tattgattcttcctacccat

SEQ ID NO: 24999 - DNA, 20 bp, Artificial Sequence
  chemically synthesized
aacattccatgctcatgggt

SEQ ID NO: 25000 - DNA, 20 bp, Artificial Sequence
  chemically synthesized
gaacattccatgctcatggg

SEQ ID NO: 25001 - DNA, 20 bp, Artificial Sequence
  chemically synthesized
attcttcctacccatgagca

SEQ ID NO: 25002 - DNA, 20 bp, Artificial Sequence
  chemically synthesized
gaagaacattccatgctcat

SEQ ID NO: 25003 - DNA, 20 bp, Artificial Sequence
  chemically synthesized
ggaagaacattccatgctca

SEQ ID NO: 25004 - DNA, 20 bp, Artificial Sequence
  chemically synthesized
aagaggatacaaacaaatgg

SEQ ID NO: 25005 - DNA, 20 bp, Artificial Sequence
  chemically synthesized
taaaagaggatacaaacaaa

SEQ ID NO: 25006 - DNA, 20 bp, Artificial Sequence
  chemically synthesized
actgctcaaggaaataaaag

SEQ ID NO: 25007 - DNA, 20 bp, Artificial Sequence
  chemically synthesized
cactgctcaaggaaataaaa

SEQ ID NO: 25008 - DNA, 20 bp, Artificial Sequence
  chemically synthesized
accactgctcaaggaaataa

SEQ ID NO: 25009 - DNA, 20 bp, Artificial Sequence
  chemically synthesized
gtatcctcttttatttcctt

SEQ ID NO: 25010 - DNA, 20 bp, Artificial Sequence
  chemically synthesized
tcctcttttatttccttgag

SEQ ID NO: 25011 - DNA, 20 bp, Artificial Sequence
  chemically synthesized
tcttttatttccttgagcag

SEQ ID NO: 25012 - DNA, 20 bp, Artificial Sequence
  chemically synthesized
gaactacaaaccactgctca

SEQ ID NO: 25013 - DNA, 20 bp, Artificial Sequence
  chemically synthesized
agaactacaaaccactgctc

SEQ ID NO: 25014 - DNA, 20 bp, Artificial Sequence
  chemically synthesized
tttccttgagcagtggtttg

SEQ ID NO: 25015 - DNA, 20 bp, Artificial Sequence
  chemically synthesized
gtggtttgtagttctccttg

SEQ ID NO: 25016 - DNA, 20 bp, Artificial Sequence
  chemically synthesized
ggtttgtagttctccttgaa

SEQ ID NO: 25017 - DNA, 20 bp, Artificial Sequence
  chemically synthesized
gtttgtagttctccttgaag

SEQ ID NO: 25018 - DNA, 20 bp, Artificial Sequence
  chemically synthesized
atgtgaaggacctcttcaag

SEQ ID NO: 25019 - DNA, 20 bp, Artificial Sequence
  chemically synthesized
caatgtgaaggacctcttca

SEQ ID NO: 25020 - DNA, 20 bp, Artificial Sequence
  chemically synthesized
acaatgtgaaggacctcttc

SEQ ID NO: 25021 - DNA, 20 bp, Artificial Sequence
  chemically synthesized
tgaataatgccacaatgtga

SEQ ID NO: 25022 - DNA, 20 bp, Artificial Sequence
  chemically synthesized
tgaagaggtccttcacattg

SEQ ID NO: 25023 - DNA, 20 bp, Artificial Sequence
  chemically synthesized
gtgaataatgccacaatgtg

SEQ ID NO: 25024 - DNA, 20 bp, Artificial Sequence
  chemically synthesized
cattgtggcattattcacaa

SEQ ID NO: 25025 - DNA, 20 bp, Artificial Sequence
  chemically synthesized
tggcattattcacaatagca

SEQ ID NO: 25026 - DNA, 20 bp, Artificial Sequence
  chemically synthesized
tattcacaatagcaaagact

SEQ ID NO: 25027 - DNA, 20 bp, Artificial Sequence
  chemically synthesized
tggacatttgggttggttcc

SEQ ID NO: 25028 - DNA, 20 bp, Artificial Sequence
  chemically synthesized
tcattgttggacatttgggt

SEQ ID NO: 25029 - DNA, 20 bp, Artificial Sequence
  chemically synthesized
tctatcattgttggacattt

SEQ ID NO: 25030 - DNA, 20 bp, Artificial Sequence
  chemically synthesized
gtctatcattgttggacatt

SEQ ID NO: 25031 - DNA, 20 bp, Artificial Sequence
  chemically synthesized
acccaaatgtccaacaatga

SEQ ID NO: 25032 - DNA, 20 bp, Artificial Sequence
  chemically synthesized
ttaatccagtctatcattgt

SEQ ID NO: 25033 - DNA, 20 bp, Artificial Sequence
  chemically synthesized
aatgtccaacaatgatagac

SEQ ID NO: 25034 - DNA, 20 bp, Artificial Sequence
  chemically synthesized
caacaatgatagactggatt

SEQ ID NO: 25035 - DNA, 20 bp, Artificial Sequence
  chemically synthesized
tgtgccacattttcttaatc

SEQ ID NO: 25036 - DNA, 20 bp, Artificial Sequence
  chemically synthesized
tagactggattaagaaaatg

SEQ ID NO: 25037 - DNA, 20 bp, Artificial Sequence
  chemically synthesized
aatgtggcacatatacacca

SEQ ID NO: 25038 - DNA, 20 bp, Artificial Sequence
  chemically synthesized
tatggctgcatagtattcca

SEQ ID NO: 25039 - DNA, 20 bp, Artificial Sequence
  chemically synthesized
atacaccatggaatactatg

SEQ ID NO: 25040 - DNA, 20 bp, Artificial Sequence
  chemically synthesized
catccttttttatggctgca

SEQ ID NO: 25041 - DNA, 20 bp, Artificial Sequence
  chemically synthesized
aatactatgcagccataaaa

SEQ ID NO: 25042 - DNA, 20 bp, Artificial Sequence
  chemically synthesized
atactatgcagccataaaaa

SEQ ID NO: 25043 - DNA, 20 bp, Artificial Sequence
  chemically synthesized
catgaactcatcctttttta

SEQ ID NO: 25044 - DNA, 20 bp, Artificial Sequence
  chemically synthesized
atgcagccataaaaaaggat

SEQ ID NO: 25045 - DNA, 20 bp, Artificial Sequence
  chemically synthesized
ggatgagttcatgtcctttg

SEQ ID NO: 25046 - DNA, 20 bp, Artificial Sequence
  chemically synthesized
gatgagttcatgtcctttgt

SEQ ID NO: 25047 - DNA, 20 bp, Artificial Sequence
  chemically synthesized
atgagttcatgtcctttgta

SEQ ID NO: 25048 - DNA, 20 bp, Artificial Sequence
  chemically synthesized
tttcatccatgtccctacaa

SEQ ID NO: 25049 - DNA, 20 bp, Artificial Sequence
  chemically synthesized
atttcatccatgtccctaca

SEQ ID NO: 25050 - DNA, 20 bp, Artificial Sequence
  chemically synthesized
tcatgtcctttgtagggaca

SEQ ID NO: 25051 - DNA, 20 bp, Artificial Sequence
  chemically synthesized
tgtagggacatggatgaaat

SEQ ID NO: 25052 - DNA, 20 bp, Artificial Sequence
  chemically synthesized
aaattggaaatcatcattct

SEQ ID NO: 25053 - DNA, 20 bp, Artificial Sequence
  chemically synthesized
tgttcttgcgatagtttact

SEQ ID NO: 25054 - DNA, 20 bp, Artificial Sequence
  chemically synthesized
cattctcagtaaactatcgc

SEQ ID NO: 25055 - DNA, 20 bp, Artificial Sequence
  chemically synthesized
ttggttttttgttcttgcga

SEQ ID NO: 25056 - DNA, 20 bp, Artificial Sequence
  chemically synthesized
gagtgagaatatgcggtgtt

SEQ ID NO: 25057 - DNA, 20 bp, Artificial Sequence
  chemically synthesized
cacctatgagtgagaatatg

SEQ ID NO: 25058 - DNA, 20 bp, Artificial Sequence
  chemically synthesized
acaccgcatattctcactca

SEQ ID NO: 25059 - DNA, 20 bp, Artificial Sequence
  chemically synthesized
caccgcatattctcactcat

SEQ ID NO: 25060 - DNA, 20 bp, Artificial Sequence
  chemically synthesized
ttcaattcccacctatgagt

SEQ ID NO: 25061 - DNA, 20 bp, Artificial Sequence
  chemically synthesized
cgcatattctcactcatagg

SEQ ID NO: 25062 - DNA, 20 bp, Artificial Sequence
  chemically synthesized
gcatattctcactcataggt

SEQ ID NO: 25063 - DNA, 20 bp, Artificial Sequence
  chemically synthesized
attgttcaattcccacctat

SEQ ID NO: 25064 - DNA, 20 bp, Artificial Sequence
  chemically synthesized
ataggtgggaattgaacaat

SEQ ID NO: 25065 - DNA, 20 bp, Artificial Sequence
  chemically synthesized
aattgaacaatgagatcaca

SEQ ID NO: 25066 - DNA, 20 bp, Artificial Sequence
  chemically synthesized
acaatgagatcacatggaca

SEQ ID NO: 25067 - DNA, 20 bp, Artificial Sequence
  chemically synthesized
caatgagatcacatggacac

SEQ ID NO: 25068 - DNA, 20 bp, Artificial Sequence
  chemically synthesized
tgagatcacatggacacagg

SEQ ID NO: 25069 - DNA, 20 bp, Artificial Sequence
  chemically synthesized
gagatcacatggacacagga

SEQ ID NO: 25070 - DNA, 20 bp, Artificial Sequence
  chemically synthesized
agatcacatggacacaggaa

SEQ ID NO: 25071 - DNA, 20 bp, Artificial Sequence
  chemically synthesized
gatcacatggacacaggaag

SEQ ID NO: 25072 - DNA, 20 bp, Artificial Sequence
  chemically synthesized
ggaaggggaatatcacactc

SEQ ID NO: 25073 - DNA, 20 bp, Artificial Sequence
  chemically synthesized
gaaggggaatatcacactct

SEQ ID NO: 25074 - DNA, 20 bp, Artificial Sequence
  chemically synthesized
aaggggaatatcacactctg

SEQ ID NO: 25075 - DNA, 20 bp, Artificial Sequence
  chemically synthesized
ccaccccaccacagtcccca

SEQ ID NO: 25076 - DNA, 20 bp, Artificial Sequence
  chemically synthesized
atatcacactctggggactg

SEQ ID NO: 25077 - DNA, 20 bp, Artificial Sequence
  chemically synthesized
ccccaccccaccacagtccc

SEQ ID NO: 25078 - DNA, 20 bp, Artificial Sequence
  chemically synthesized
tcacactctggggactgtgg

SEQ ID NO: 25079 - DNA, 20 bp, Artificial Sequence
  chemically synthesized
cacactctggggactgtggt

SEQ ID NO: 25080 - DNA, 20 bp, Artificial Sequence
  chemically synthesized
acactctggggactgtggtg

SEQ ID NO: 25081 - DNA, 20 bp, Artificial Sequence
  chemically synthesized
ccactccccccaccccacca

SEQ ID NO: 25082 - DNA, 20 bp, Artificial Sequence
  chemically synthesized
ctctggggactgtggtgggg

SEQ ID NO: 25083 - DNA, 20 bp, Artificial Sequence
  chemically synthesized
tctggggactgtggtggggt

SEQ ID NO: 25084 - DNA, 20 bp, Artificial Sequence
  chemically synthesized
ctggggactgtggtggggtg

SEQ ID NO: 25085 - DNA, 20 bp, Artificial Sequence
  chemically synthesized
tggggactgtggtggggtgg

SEQ ID NO: 25086 - DNA, 20 bp, Artificial Sequence
  chemically synthesized
ggggactgtggtggggtggg

SEQ ID NO: 25087 - DNA, 20 bp, Artificial Sequence
  chemically synthesized
ggactgtggtggggtggggg

SEQ ID NO: 25088 - DNA, 20 bp, Artificial Sequence
  chemically synthesized
ctgtggtggggtggggggag

SEQ ID NO: 25089 - DNA, 20 bp, Artificial Sequence
  chemically synthesized
tgtggtggggtggggggagt

SEQ ID NO: 25090 - DNA, 20 bp, Artificial Sequence
  chemically synthesized
gtggtggggtggggggagtg

SEQ ID NO: 25091 - DNA, 20 bp, Artificial Sequence
  chemically synthesized
tggtggggtggggggagtgg

SEQ ID NO: 25092 - DNA, 20 bp, Artificial Sequence
  chemically synthesized
ggtggggtggggggagtggg

SEQ ID NO: 25093 - DNA, 20 bp, Artificial Sequence
  chemically synthesized
gtggggtggggggagtgggg

SEQ ID NO: 25094 - DNA, 20 bp, Artificial Sequence
  chemically synthesized
ggtggggggagtggggggga

SEQ ID NO: 25095 - DNA, 20 bp, Artificial Sequence
  chemically synthesized
gggagtgggggggatagcac

SEQ ID NO: 25096 - DNA, 20 bp, Artificial Sequence
  chemically synthesized
ggagtgggggggatagcact

SEQ ID NO: 25097 - DNA, 20 bp, Artificial Sequence
  chemically synthesized
ctagcattaggtatatcacc

SEQ ID NO: 25098 - DNA, 20 bp, Artificial Sequence
  chemically synthesized
ctgggtgatatacctaatgc

SEQ ID NO: 25099 - DNA, 20 bp, Artificial Sequence
  chemically synthesized
ctaactcgtcatctagcatt

SEQ ID NO: 25100 - DNA, 20 bp, Artificial Sequence
  chemically synthesized
actaactcgtcatctagcat

SEQ ID NO: 25101 - DNA, 20 bp, Artificial Sequence
  chemically synthesized
tatacctaatgctagatgac

SEQ ID NO: 25102 - DNA, 20 bp, Artificial Sequence
  chemically synthesized
gcacccactaactcgtcatc

SEQ ID NO: 25103 - DNA, 20 bp, Artificial Sequence
  chemically synthesized
cctaatgctagatgacgagt

SEQ ID NO: 25104 - DNA, 20 bp, Artificial Sequence
  chemically synthesized
aatgctagatgacgagttag

SEQ ID NO: 25105 - DNA, 20 bp, Artificial Sequence
  chemically synthesized
atgctagatgacgagttagt

SEQ ID NO: 25106 - DNA, 20 bp, Artificial Sequence
  chemically synthesized
agatgacgagttagtgggtg

SEQ ID NO: 25107 - DNA, 20 bp, Artificial Sequence
  chemically synthesized
agttagtgggtgcagcgcac

SEQ ID NO: 25108 - DNA, 20 bp, Artificial Sequence
  chemically synthesized
gtgggtgcagcgcaccagca

SEQ ID NO: 25109 - DNA, 20 bp, Artificial Sequence
  chemically synthesized
tatgtatacatgtgccatgc

SEQ ID NO: 25110 - DNA, 20 bp, Artificial Sequence
  chemically synthesized
catgtgcacattgtgcaggt

SEQ ID NO: 25111 - DNA, 20 bp, Artificial Sequence
  chemically synthesized
ggtacatgtgcacattgtgc

SEQ ID NO: 25112 - DNA, 20 bp, Artificial Sequence
  chemically synthesized
gggtacatgtgcacattgtg

SEQ ID NO: 25113 - DNA, 20 bp, Artificial Sequence
  chemically synthesized
ttattatactttaagtttta

SEQ ID NO: 25114 - DNA, 20 bp, Artificial Sequence
  chemically synthesized
tttattatactttaagtttt

SEQ ID NO: 25115 - DNA, 20 bp, Artificial Sequence
  chemically synthesized
cacatgtaccctaaaactta

SEQ ID NO: 25116 - DNA, 20 bp, Artificial Sequence
  chemically synthesized
ttttattatactttaagttt

SEQ ID NO: 25117 - DNA, 20 bp, Artificial Sequence
  chemically synthesized
ttttttttttattatacttt

SEQ ID NO: 25118 - DNA, 20 bp, Artificial Sequence
  chemically synthesized
aaaaataaaaaaaaaaaaaa

SEQ ID NO: 25119 - DNA, 20 bp, Artificial Sequence
  chemically synthesized
ataaaaaaaaaaaaaaaaga

SEQ ID NO: 25120 - DNA, 20 bp, Artificial Sequence
  chemically synthesized
aaaaaaaaaaaaaaagaaag

SEQ ID NO: 25121 - DNA, 20 bp, Artificial Sequence
  chemically synthesized
aaaaaaaaaaaagaaagtag

SEQ ID NO: 25122 - DNA, 20 bp, Artificial Sequence
  chemically synthesized
aaaaaaaaaaagaaagtagc

SEQ ID NO: 25123 - DNA, 20 bp, Artificial Sequence
  chemically synthesized
aaaaaaaaaagaaagtagca

SEQ ID NO: 25124 - DNA, 20 bp, Artificial Sequence
  chemically synthesized
aaagtagcagggcaaacgtt

SEQ ID NO: 25125 - DNA, 20 bp, Artificial Sequence
  chemically synthesized
cttccgtagcattgtgatgg

SEQ ID NO: 25126 - DNA, 20 bp, Artificial Sequence
  chemically synthesized
tggcttccgtagcattgtga

SEQ ID NO: 25127 - DNA, 20 bp, Artificial Sequence
  chemically synthesized
tagcttccatcacaatgcta

SEQ ID NO: 25128 - DNA, 20 bp, Artificial Sequence
  chemically synthesized
cttccatcacaatgctacgg

SEQ ID NO: 25129 - DNA, 20 bp, Artificial Sequence
  chemically synthesized
atacatttgtatggcttccg

SEQ ID NO: 25130 - DNA, 20 bp, Artificial Sequence
  chemically synthesized
ttaccagatatacatttgta

SEQ ID NO: 25131 - DNA, 20 bp, Artificial Sequence
  chemically synthesized
aagccatacaaatgtatatc

SEQ ID NO: 25132 - DNA, 20 bp, Artificial Sequence
  chemically synthesized
tgcagttcactgacagttac

SEQ ID NO: 25133 - DNA, 20 bp, Artificial Sequence
  chemically synthesized
aatgtatatctggtaactgt

SEQ ID NO: 25134 - DNA, 20 bp, Artificial Sequence
  chemically synthesized
actccgttgcagttcactga

SEQ ID NO: 25135 - DNA, 20 bp, Artificial Sequence
  chemically synthesized
taactgtcagtgaactgcaa

SEQ ID NO: 25136 - DNA, 20 bp, Artificial Sequence
  chemically synthesized
actgtcagtgaactgcaacg

SEQ ID NO: 25137 - DNA, 20 bp, Artificial Sequence
  chemically synthesized
agggcaccagaactccgttg

SEQ ID NO: 25138 - DNA, 20 bp, Artificial Sequence
  chemically synthesized
agtgaactgcaacggagttc

SEQ ID NO: 25139 - DNA, 20 bp, Artificial Sequence
  chemically synthesized
gtagtagacttgtagggcac

SEQ ID NO: 25140 - DNA, 20 bp, Artificial Sequence
  chemically synthesized
acggagttctggtgccctac

SEQ ID NO: 25141 - DNA, 20 bp, Artificial Sequence
  chemically synthesized
tcttgagtagtagacttgta

SEQ ID NO: 25142 - DNA, 20 bp, Artificial Sequence
  chemically synthesized
ctcttgagtagtagacttgt

SEQ ID NO: 25143 - DNA, 20 bp, Artificial Sequence
  chemically synthesized
tctcttgagtagtagacttg

SEQ ID NO: 25144 - DNA, 20 bp, Artificial Sequence
  chemically synthesized
gccctacaagtctactactc

SEQ ID NO: 25145 - DNA, 20 bp, Artificial Sequence
  chemically synthesized
cagttaactctcttgagtag

SEQ ID NO: 25146 - DNA, 20 bp, Artificial Sequence
  chemically synthesized
cctacaagtctactactcaa

SEQ ID NO: 25147 - DNA, 20 bp, Artificial Sequence
  chemically synthesized
tacaagtctactactcaaga

SEQ ID NO: 25148 - DNA, 20 bp, Artificial Sequence
  chemically synthesized
aggcagttaactctcttgag

SEQ ID NO: 25149 - DNA, 20 bp, Artificial Sequence
  chemically synthesized
cacaggcagttaactctctt

SEQ ID NO: 25150 - DNA, 20 bp, Artificial Sequence
  chemically synthesized
gcggactcaaacaacacagg

SEQ ID NO: 25151 - DNA, 20 bp, Artificial Sequence
  chemically synthesized
catgcggactcaaacaacac

SEQ ID NO: 25152 - DNA, 20 bp, Artificial Sequence
  chemically synthesized
acatgcggactcaaacaaca

SEQ ID NO: 25153 - DNA, 20 bp, Artificial Sequence
  chemically synthesized
gttaactgcctgtgttgttt

SEQ ID NO: 25154 - DNA, 20 bp, Artificial Sequence
  chemically synthesized
cagactcctagcaacacatg

SEQ ID NO: 25155 - DNA, 20 bp, Artificial Sequence
  chemically synthesized
tttgagtccgcatgtgttgc

SEQ ID NO: 25156 - DNA, 20 bp, Artificial Sequence
  chemically synthesized
ttgagtccgcatgtgttgct

SEQ ID NO: 25157 - DNA, 20 bp, Artificial Sequence
  chemically synthesized
gagtccgcatgtgttgctag

SEQ ID NO: 25158 - DNA, 20 bp, Artificial Sequence
  chemically synthesized
ggagtggtgctgcagactcc

SEQ ID NO: 25159 - DNA, 20 bp, Artificial Sequence
  chemically synthesized
catgtgttgctaggagtctg

SEQ ID NO: 25160 - DNA, 20 bp, Artificial Sequence
  chemically synthesized
agccggagggagtggtgctg

SEQ ID NO: 25161 - DNA, 20 bp, Artificial Sequence
  chemically synthesized
gtctgcagcaccactccctc

SEQ ID NO: 25162 - DNA, 20 bp, Artificial Sequence
  chemically synthesized
cagctgtaagccggagggag

SEQ ID NO: 25163 - DNA, 20 bp, Artificial Sequence
  chemically synthesized
ttccagctgtaagccggagg

SEQ ID NO: 25164 - DNA, 20 bp, Artificial Sequence
  chemically synthesized
tcttccagctgtaagccgga

SEQ ID NO: 25165 - DNA, 20 bp, Artificial Sequence
  chemically synthesized
ctcttccagctgtaagccgg

SEQ ID NO: 25166 - DNA, 20 bp, Artificial Sequence
  chemically synthesized
gcaccactccctccggctta

SEQ ID NO: 25167 - DNA, 20 bp, Artificial Sequence
  chemically synthesized
tctcttccagctgtaagccg

SEQ ID NO: 25168 - DNA, 20 bp, Artificial Sequence
  chemically synthesized
tatctcttccagctgtaagc

SEQ ID NO: 25169 - DNA, 20 bp, Artificial Sequence
  chemically synthesized
cactccctccggcttacagc

SEQ ID NO: 25170 - DNA, 20 bp, Artificial Sequence
  chemically synthesized
gacttatctcttccagctgt

SEQ ID NO: 25171 - DNA, 20 bp, Artificial Sequence
  chemically synthesized
tccctccggcttacagctgg

SEQ ID NO: 25172 - DNA, 20 bp, Artificial Sequence
  chemically synthesized
cctccggcttacagctggaa

SEQ ID NO: 25173 - DNA, 20 bp, Artificial Sequence
  chemically synthesized
aggcagagacttatctcttc

SEQ ID NO: 25174 - DNA, 20 bp, Artificial Sequence
  chemically synthesized
ggcttacagctggaagagat

SEQ ID NO: 25175 - DNA, 20 bp, Artificial Sequence
  chemically synthesized
gaagagataagtctctgcct

SEQ ID NO: 25176 - DNA, 20 bp, Artificial Sequence
  chemically synthesized
aagagataagtctctgcctt

SEQ ID NO: 25177 - DNA, 20 bp, Artificial Sequence
  chemically synthesized
ctacacactttcctaaggca

SEQ ID NO: 25178 - DNA, 20 bp, Artificial Sequence
  chemically synthesized
tcctacacactttcctaagg

SEQ ID NO: 25179 - DNA, 20 bp, Artificial Sequence
  chemically synthesized
gataagtctctgccttagga

SEQ ID NO: 25180 - DNA, 20 bp, Artificial Sequence
  chemically synthesized
gcatcctacacactttccta

SEQ ID NO: 25181 - DNA, 20 bp, Artificial Sequence
  chemically synthesized
tgcatcctacacactttcct

SEQ ID NO: 25182 - DNA, 20 bp, Artificial Sequence
  chemically synthesized
ctctgccttaggaaagtgtg

SEQ ID NO: 25183 - DNA, 20 bp, Artificial Sequence
  chemically synthesized
tctgccttaggaaagtgtgt

SEQ ID NO: 25184 - DNA, 20 bp, Artificial Sequence
  chemically synthesized
gaaagtgtgtaggatgcaca

SEQ ID NO: 25185 - DNA, 20 bp, Artificial Sequence
  chemically synthesized
aggatgcacacagaaacctc

SEQ ID NO: 25186 - DNA, 20 bp, Artificial Sequence
  chemically synthesized
cacagctgtattgcatcttg

SEQ ID NO: 25187 - DNA, 20 bp, Artificial Sequence
  chemically synthesized
tcacagctgtattgcatctt

SEQ ID NO: 25188 - DNA, 20 bp, Artificial Sequence
  chemically synthesized
agaaacctcaagatgcaata

SEQ ID NO: 25189 - DNA, 20 bp, Artificial Sequence
  chemically synthesized
ggacagtgtcacattgttca

SEQ ID NO: 25190 - DNA, 20 bp, Artificial Sequence
  chemically synthesized
tgaacaatgtgacactgtcc

SEQ ID NO: 25191 - DNA, 20 bp, Artificial Sequence
  chemically synthesized
gaacaatgtgacactgtcct

SEQ ID NO: 25192 - DNA, 20 bp, Artificial Sequence
  chemically synthesized
tcccaagctttagcccagga

SEQ ID NO: 25193 - DNA, 20 bp, Artificial Sequence
  chemically synthesized
tgtgacactgtcctgggcta

SEQ ID NO: 25194 - DNA, 20 bp, Artificial Sequence
  chemically synthesized
gtcatcccaagctttagccc

SEQ ID NO: 25195 - DNA, 20 bp, Artificial Sequence
  chemically synthesized
agtcatcccaagctttagcc

SEQ ID NO: 25196 - DNA, 20 bp, Artificial Sequence
  chemically synthesized
cactgtcctgggctaaagct

SEQ ID NO: 25197 - DNA, 20 bp, Artificial Sequence
  chemically synthesized
actgtcctgggctaaagctt

SEQ ID NO: 25198 - DNA, 20 bp, Artificial Sequence
  chemically synthesized
tacacagtcatcccaagctt

SEQ ID NO: 25199 - DNA, 20 bp, Artificial Sequence
  chemically synthesized
tttcactacacagtcatccc

SEQ ID NO: 25200 - DNA, 20 bp, Artificial Sequence
  chemically synthesized
taaagcttgggatgactgtg

SEQ ID NO: 25201 - DNA, 20 bp, Artificial Sequence
  chemically synthesized
gcatacatactttcactaca

SEQ ID NO: 25202 - DNA, 20 bp, Artificial Sequence
  chemically synthesized
ttgggatgactgtgtagtga

SEQ ID NO: 25203 - DNA, 20 bp, Artificial Sequence
  chemically synthesized
gtgtagtgaaagtatgtatg

SEQ ID NO: 25204 - DNA, 20 bp, Artificial Sequence
  chemically synthesized
agtatgtatgcagtttaata

SEQ ID NO: 25205 - DNA, 20 bp, Artificial Sequence
  chemically synthesized
tatgcagtttaataaagcta

SEQ ID NO: 25206 - DNA, 20 bp, Artificial Sequence
  chemically synthesized
ggcacgggaatggggggctt

SEQ ID NO: 25207 - DNA, 20 bp, Artificial Sequence
  chemically synthesized
tcatggggcacgggaatggg

SEQ ID NO: 25208 - DNA, 20 bp, Artificial Sequence
  chemically synthesized
ctcatggggcacgggaatgg

SEQ ID NO: 25209 - DNA, 20 bp, Artificial Sequence
  chemically synthesized
tctcatggggcacgggaatg

SEQ ID NO: 25210 - DNA, 20 bp, Artificial Sequence
  chemically synthesized
ctctcatggggcacgggaat

SEQ ID NO: 25211 - DNA, 20 bp, Artificial Sequence
  chemically synthesized
tctctcatggggcacgggaa

SEQ ID NO: 25212 - DNA, 20 bp, Artificial Sequence
  chemically synthesized
gacagtctctcatggggcac

SEQ ID NO: 25213 - DNA, 20 bp, Artificial Sequence
  chemically synthesized
ggacagtctctcatggggca

SEQ ID NO: 25214 - DNA, 20 bp, Artificial Sequence
  chemically synthesized
cccccattcccgtgccccat

SEQ ID NO: 25215 - DNA, 20 bp, Artificial Sequence
  chemically synthesized
cccattcccgtgccccatga

SEQ ID NO: 25216 - DNA, 20 bp, Artificial Sequence
  chemically synthesized
gtggaggacagtctctcatg

SEQ ID NO: 25217 - DNA, 20 bp, Artificial Sequence
  chemically synthesized
agtggaggacagtctctcat

SEQ ID NO: 25218 - DNA, 20 bp, Artificial Sequence
  chemically synthesized
aagtggaggacagtctctca

SEQ ID NO: 25219 - DNA, 20 bp, Artificial Sequence
  chemically synthesized
ctcccagggaaagtggagga

SEQ ID NO: 25220 - DNA, 20 bp, Artificial Sequence
  chemically synthesized
tcagctcccagggaaagtgg

SEQ ID NO: 25221 - DNA, 20 bp, Artificial Sequence
  chemically synthesized
gtcagctcccagggaaagtg

SEQ ID NO: 25222 - DNA, 20 bp, Artificial Sequence
  chemically synthesized
agactgtcctccactttccc

SEQ ID NO: 25223 - DNA, 20 bp, Artificial Sequence
  chemically synthesized
aagtcagctcccagggaaag

SEQ ID NO: 25224 - DNA, 20 bp, Artificial Sequence
  chemically synthesized
gactgtcctccactttccct

SEQ ID NO: 25225 - DNA, 20 bp, Artificial Sequence
  chemically synthesized
ctgtcctccactttccctgg

SEQ ID NO: 25226 - DNA, 20 bp, Artificial Sequence
  chemically synthesized
ggaaagtcagctcccaggga

SEQ ID NO: 25227 - DNA, 20 bp, Artificial Sequence
  chemically synthesized
tcctggaaagtcagctccca

SEQ ID NO: 25228 - DNA, 20 bp, Artificial Sequence
  chemically synthesized
gtcctggaaagtcagctccc

SEQ ID NO: 25229 - DNA, 20 bp, Artificial Sequence
  chemically synthesized
agtcctggaaagtcagctcc

SEQ ID NO: 25230 - DNA, 20 bp, Artificial Sequence
  chemically synthesized
ttccctgggagctgactttc

SEQ ID NO: 25231 - DNA, 20 bp, Artificial Sequence
  chemically synthesized
tccctgggagctgactttcc

SEQ ID NO: 25232 - DNA, 20 bp, Artificial Sequence
  chemically synthesized
ggatcagagtcctggaaagt

SEQ ID NO: 25233 - DNA, 20 bp, Artificial Sequence
  chemically synthesized
acttggatcagagtcctgga

SEQ ID NO: 25234 - DNA, 20 bp, Artificial Sequence
  chemically synthesized
tacaacttggatcagagtcc

SEQ ID NO: 25235 - DNA, 20 bp, Artificial Sequence
  chemically synthesized
actttccaggactctgatcc

SEQ ID NO: 25236 - DNA, 20 bp, Artificial Sequence
  chemically synthesized
gctcattacaacttggatca

SEQ ID NO: 25237 - DNA, 20 bp, Artificial Sequence
  chemically synthesized
gagctcattacaacttggat

SEQ ID NO: 25238 - DNA, 20 bp, Artificial Sequence
  chemically synthesized
ctagtgagctcattacaact

SEQ ID NO: 25239 - DNA, 20 bp, Artificial Sequence
  chemically synthesized
actctgatccaagttgtaat

SEQ ID NO: 25240 - DNA, 20 bp, Artificial Sequence
  chemically synthesized
ccaagttgtaatgagctcac

SEQ ID NO: 25241 - DNA, 20 bp, Artificial Sequence
  chemically synthesized
ttccggctgtgagagctagt

SEQ ID NO: 25242 - DNA, 20 bp, Artificial Sequence
  chemically synthesized
aatgagctcactagctctca

SEQ ID NO: 25243 - DNA, 20 bp, Artificial Sequence
  chemically synthesized
tgagttccggctgtgagagc

SEQ ID NO: 25244 - DNA, 20 bp, Artificial Sequence
  chemically synthesized
agctcactagctctcacagc

SEQ ID NO: 25245 - DNA, 20 bp, Artificial Sequence
  chemically synthesized
ctcttgagttccggctgtga

SEQ ID NO: 25246 - DNA, 20 bp, Artificial Sequence
  chemically synthesized
tcctcttgagttccggctgt

SEQ ID NO: 25247 - DNA, 20 bp, Artificial Sequence
  chemically synthesized
agctctcacagccggaactc

SEQ ID NO: 25248 - DNA, 20 bp, Artificial Sequence
  chemically synthesized
gtctcactcctcttgagttc

SEQ ID NO: 25249 - DNA, 20 bp, Artificial Sequence
  chemically synthesized
ctctcacagccggaactcaa

SEQ ID NO: 25250 - DNA, 20 bp, Artificial Sequence
  chemically synthesized
tctcacagccggaactcaag

SEQ ID NO: 25251 - DNA, 20 bp, Artificial Sequence
  chemically synthesized
tcacagccggaactcaagag

SEQ ID NO: 25252 - DNA, 20 bp, Artificial Sequence
  chemically synthesized
tggatagtctcactcctctt

SEQ ID NO: 25253 - DNA, 20 bp, Artificial Sequence
  chemically synthesized
agccggaactcaagaggagt

SEQ ID NO: 25254 - DNA, 20 bp, Artificial Sequence
  chemically synthesized
caagaggagtgagactatcc

SEQ ID NO: 25255 - DNA, 20 bp, Artificial Sequence
  chemically synthesized
ggcgtaactggtttcttgga

SEQ ID NO: 25256 - DNA, 20 bp, Artificial Sequence
  chemically synthesized
agtgagactatccaagaaac

SEQ ID NO: 25257 - DNA, 20 bp, Artificial Sequence
  chemically synthesized
acatggcgtaactggtttct

SEQ ID NO: 25258 - DNA, 20 bp, Artificial Sequence
  chemically synthesized
ccatggaaacatggcgtaac

SEQ ID NO: 25259 - DNA, 20 bp, Artificial Sequence
  chemically synthesized
tcccagctgccatggaaaca

SEQ ID NO: 25260 - DNA, 20 bp, Artificial Sequence
  chemically synthesized
ccagttacgccatgtttcca

SEQ ID NO: 25261 - DNA, 20 bp, Artificial Sequence
  chemically synthesized
gttacgccatgtttccatgg

SEQ ID NO: 25262 - DNA, 20 bp, Artificial Sequence
  chemically synthesized
cgccatgtttccatggcagc

SEQ ID NO: 25263 - DNA, 20 bp, Artificial Sequence
  chemically synthesized
gcgctttctcccagctgcca

SEQ ID NO: 25264 - DNA, 20 bp, Artificial Sequence
  chemically synthesized
gccatgtttccatggcagct

SEQ ID NO: 25265 - DNA, 20 bp, Artificial Sequence
  chemically synthesized
catgtttccatggcagctgg

SEQ ID NO: 25266 - DNA, 20 bp, Artificial Sequence
  chemically synthesized
tttccatggcagctgggaga

SEQ ID NO: 25267 - DNA, 20 bp, Artificial Sequence
  chemically synthesized
ttctgaagtgcgctttctcc

SEQ ID NO: 25268 - DNA, 20 bp, Artificial Sequence
  chemically synthesized
agctgggagaaagcgcactt

SEQ ID NO: 25269 - DNA, 20 bp, Artificial Sequence
  chemically synthesized
tgggagaaagcgcacttcag

SEQ ID NO: 25270 - DNA, 20 bp, Artificial Sequence
  chemically synthesized
gggagaaagcgcacttcaga

SEQ ID NO: 25271 - DNA, 20 bp, Artificial Sequence
  chemically synthesized
ggagaaagcgcacttcagaa

SEQ ID NO: 25272 - DNA, 20 bp, Artificial Sequence
  chemically synthesized
tcagcatttttacccttctg

SEQ ID NO: 25273 - DNA, 20 bp, Artificial Sequence
  chemically synthesized
atgaagagaaatgtgcagtt

SEQ ID NO: 25274 - DNA, 20 bp, Artificial Sequence
  chemically synthesized
aagttatgaagagaaatgtg

SEQ ID NO: 25275 - DNA, 20 bp, Artificial Sequence
  chemically synthesized
aaaataatacaagttatgaa

SEQ ID NO: 25276 - DNA, 20 bp, Artificial Sequence
  chemically synthesized
ataaaataatacaagttatg

SEQ ID NO: 25277 - DNA, 20 bp, Artificial Sequence
  chemically synthesized
agccctggataaaataatac

SEQ ID NO: 25278 - DNA, 20 bp, Artificial Sequence
  chemically synthesized
ataacttgtattattttatc

SEQ ID NO: 25279 - DNA, 20 bp, Artificial Sequence
  chemically synthesized
taacttgtattattttatcc

SEQ ID NO: 25280 - DNA, 20 bp, Artificial Sequence
  chemically synthesized
aacttgtattattttatcca

SEQ ID NO: 25281 - DNA, 20 bp, Artificial Sequence
  chemically synthesized
tgtattattttatccagggc

SEQ ID NO: 25282 - DNA, 20 bp, Artificial Sequence
  chemically synthesized
ttataggctagaaccagccc

SEQ ID NO: 25283 - DNA, 20 bp, Artificial Sequence
  chemically synthesized
attttatccagggctggttc

SEQ ID NO: 25284 - DNA, 20 bp, Artificial Sequence
  chemically synthesized
ctctatttataggctagaac

SEQ ID NO: 25285 - DNA, 20 bp, Artificial Sequence
  chemically synthesized
agatttctctatttataggc

SEQ ID NO: 25286 - DNA, 20 bp, Artificial Sequence
  chemically synthesized
ggctggttctagcctataaa

SEQ ID NO: 25287 - DNA, 20 bp, Artificial Sequence
  chemically synthesized
ctggttctagcctataaata

SEQ ID NO: 25288 - DNA, 20 bp, Artificial Sequence
  chemically synthesized
ttctagatttctctatttat

SEQ ID NO: 25289 - DNA, 20 bp, Artificial Sequence
  chemically synthesized
tttctagatttctctattta

SEQ ID NO: 25290 - DNA, 20 bp, Artificial Sequence
  chemically synthesized
agcctataaatagagaaatc

SEQ ID NO: 25291 - DNA, 20 bp, Artificial Sequence
  chemically synthesized
atagagaaatctagaaacgt

SEQ ID NO: 25292 - DNA, 20 bp, Artificial Sequence
  chemically synthesized
gcccttgttccttacgtttc

SEQ ID NO: 25293 - DNA, 20 bp, Artificial Sequence
  chemically synthesized
tagagaaatctagaaacgta

SEQ ID NO: 25294 - DNA, 20 bp, Artificial Sequence
  chemically synthesized
aatctagaaacgtaaggaac

SEQ ID NO: 25295 - DNA, 20 bp, Artificial Sequence
  chemically synthesized
atctagaaacgtaaggaaca

SEQ ID NO: 25296 - DNA, 20 bp, Artificial Sequence
  chemically synthesized
tctagaaacgtaaggaacaa

SEQ ID NO: 25297 - DNA, 20 bp, Artificial Sequence
  chemically synthesized
attcaacttgagaaggtagg

SEQ ID NO: 25298 - DNA, 20 bp, Artificial Sequence
  chemically synthesized
gaaattcaacttgagaaggt

SEQ ID NO: 25299 - DNA, 20 bp, Artificial Sequence
  chemically synthesized
atcaaaccacctaccttctc

SEQ ID NO: 25300 - DNA, 20 bp, Artificial Sequence
  chemically synthesized
ggaaattcaacttgagaagg

SEQ ID NO: 25301 - DNA, 20 bp, Artificial Sequence
  chemically synthesized
gttggaaattcaacttgaga

SEQ ID NO: 25302 - DNA, 20 bp, Artificial Sequence
  chemically synthesized
agttggaaattcaacttgag

SEQ ID NO: 25303 - DNA, 20 bp, Artificial Sequence
  chemically synthesized
agtagttggaaattcaactt

SEQ ID NO: 25304 - DNA, 20 bp, Artificial Sequence
  chemically synthesized
agttgaatttccaactactg

SEQ ID NO: 25305 - DNA, 20 bp, Artificial Sequence
  chemically synthesized
tggcctatcacttcagtagt

SEQ ID NO: 25306 - DNA, 20 bp, Artificial Sequence
  chemically synthesized
tgaatggcctatcacttcag

SEQ ID NO: 25307 - DNA, 20 bp, Artificial Sequence
  chemically synthesized
atttccaactactgaagtga

SEQ ID NO: 25308 - DNA, 20 bp, Artificial Sequence
  chemically synthesized
tttccaactactgaagtgat

SEQ ID NO: 25309 - DNA, 20 bp, Artificial Sequence
  chemically synthesized
agatgaatggcctatcactt

SEQ ID NO: 25310 - DNA, 20 bp, Artificial Sequence
  chemically synthesized
gtttcaaaataaaagatgaa

SEQ ID NO: 25311 - DNA, 20 bp, Artificial Sequence
  chemically synthesized
tgtttcatgtttcaaaataa

SEQ ID NO: 25312 - DNA, 20 bp, Artificial Sequence
  chemically synthesized
tttattttgaaacatgaaac

SEQ ID NO: 25313 - DNA, 20 bp, Artificial Sequence
  chemically synthesized
ttgaaacatgaaacaagtaa

SEQ ID NO: 25314 - DNA, 20 bp, Artificial Sequence
  chemically synthesized
tgaaacatgaaacaagtaat

SEQ ID NO: 25315 - DNA, 20 bp, Artificial Sequence
  chemically synthesized
actaaacaaaggggcaagag

SEQ ID NO: 25316 - DNA, 20 bp, Artificial Sequence
  chemically synthesized
tagactaaacaaaggggcaa

SEQ ID NO: 25317 - DNA, 20 bp, Artificial Sequence
  chemically synthesized
catagactaaacaaaggggc

SEQ ID NO: 25318 - DNA, 20 bp, Artificial Sequence
  chemically synthesized
gcttctcttgcccctttgtt

SEQ ID NO: 25319 - DNA, 20 bp, Artificial Sequence
  chemically synthesized
aatgcatagactaaacaaag

SEQ ID NO: 25320 - DNA, 20 bp, Artificial Sequence
  chemically synthesized
aaatgcatagactaaacaaa

SEQ ID NO: 25321 - DNA, 20 bp, Artificial Sequence
  chemically synthesized
aaaatgcatagactaaacaa

SEQ ID NO: 25322 - DNA, 20 bp, Artificial Sequence
  chemically synthesized
aaaaatgcatagactaaaca

SEQ ID NO: 25323 - DNA, 20 bp, Artificial Sequence
  chemically synthesized
ccaaagtcaagaaaaatgca

SEQ ID NO: 25324 - DNA, 20 bp, Artificial Sequence
  chemically synthesized
ctatgcatttttcttgactt

SEQ ID NO: 25325 - DNA, 20 bp, Artificial Sequence
  chemically synthesized
cagaaatacttaccaaagtc

SEQ ID NO: 25326 - DNA, 20 bp, Artificial Sequence
  chemically synthesized
gcatttttcttgactttggt

SEQ ID NO: 25327 - DNA, 20 bp, Artificial Sequence
  chemically synthesized
taaaacagaaatacttacca

SEQ ID NO: 25328 - DNA, 20 bp, Artificial Sequence
  chemically synthesized
taaaagtgaaagtcataaaa

SEQ ID NO: 25329 - DNA, 20 bp, Artificial Sequence
  chemically synthesized
attacacagagtaaaagtga

SEQ ID NO: 25330 - DNA, 20 bp, Artificial Sequence
  chemically synthesized
gctactattacacagagtaa

SEQ ID NO: 25331 - DNA, 20 bp, Artificial Sequence
  chemically synthesized
ttcacttttactctgtgtaa

SEQ ID NO: 25332 - DNA, 20 bp, Artificial Sequence
  chemically synthesized
acacctgctactattacaca

SEQ ID NO: 25333 - DNA, 20 bp, Artificial Sequence
  chemically synthesized
tgacacctgctactattaca

SEQ ID NO: 25334 - DNA, 20 bp, Artificial Sequence
  chemically synthesized
acttttactctgtgtaatag

SEQ ID NO: 25335 - DNA, 20 bp, Artificial Sequence
  chemically synthesized
tttactctgtgtaatagtag

SEQ ID NO: 25336 - DNA, 20 bp, Artificial Sequence
  chemically synthesized
ttactctgtgtaatagtagc

SEQ ID NO: 25337 - DNA, 20 bp, Artificial Sequence
  chemically synthesized
tagcaggtgtcaaaattcac

SEQ ID NO: 25338 - DNA, 20 bp, Artificial Sequence
  chemically synthesized
ggtgtcaaaattcaccagaa

SEQ ID NO: 25339 - DNA, 20 bp, Artificial Sequence
  chemically synthesized
tgtcaaaattcaccagaaaa

SEQ ID NO: 25340 - DNA, 20 bp, Artificial Sequence
  chemically synthesized
gtcaaaattcaccagaaaag

SEQ ID NO: 25341 - DNA, 20 bp, Artificial Sequence
  chemically synthesized
gaccagttgttcctcttttc

SEQ ID NO: 25342 - DNA, 20 bp, Artificial Sequence
  chemically synthesized
caccagaaaagaggaacaac

SEQ ID NO: 25343 - DNA, 20 bp, Artificial Sequence
  chemically synthesized
gaaaagaggaacaactggtc

SEQ ID NO: 25344 - DNA, 20 bp, Artificial Sequence
  chemically synthesized
atatgtgacgcaaacttgac

SEQ ID NO: 25345 - DNA, 20 bp, Artificial Sequence
  chemically synthesized
tttcaaaagcatgtaacatg

SEQ ID NO: 25346 - DNA, 20 bp, Artificial Sequence
  chemically synthesized
tgtttctcactatttttcaa

SEQ ID NO: 25347 - DNA, 20 bp, Artificial Sequence
  chemically synthesized
tgttacatgcttttgaaaaa

SEQ ID NO: 25348 - DNA, 20 bp, Artificial Sequence
  chemically synthesized
acatgcttttgaaaaatagt

SEQ ID NO: 25349 - DNA, 20 bp, Artificial Sequence
  chemically synthesized
aaaaatagtgagaaacacct

SEQ ID NO: 25350 - DNA, 20 bp, Artificial Sequence
  chemically synthesized
tccatggctttaaaatgctg

SEQ ID NO: 25351 - DNA, 20 bp, Artificial Sequence
  chemically synthesized
ttccatggctttaaaatgct

SEQ ID NO: 25352 - DNA, 20 bp, Artificial Sequence
  chemically synthesized
agaaacacctcagcatttta

SEQ ID NO: 25353 - DNA, 20 bp, Artificial Sequence
  chemically synthesized
acctcagcattttaaagcca

SEQ ID NO: 25354 - DNA, 20 bp, Artificial Sequence
  chemically synthesized
tcagcattttaaagccatgg

SEQ ID NO: 25355 - DNA, 20 bp, Artificial Sequence
  chemically synthesized
atatctttggaatgcttcca

SEQ ID NO: 25356 - DNA, 20 bp, Artificial Sequence
  chemically synthesized
aaagccatggaagcattcca

SEQ ID NO: 25357 - DNA, 20 bp, Artificial Sequence
  chemically synthesized
ttttttttctgtaatatctt

SEQ ID NO: 25358 - DNA, 20 bp, Artificial Sequence
  chemically synthesized
gaagcattccaaagatatta

SEQ ID NO: 25359 - DNA, 20 bp, Artificial Sequence
  chemically synthesized
tattacagaaaaaaaacatt

SEQ ID NO: 25360 - DNA, 20 bp, Artificial Sequence
  chemically synthesized
agctataaaattgaaatgaa

SEQ ID NO: 25361 - DNA, 20 bp, Artificial Sequence
  chemically synthesized
cagctataaaattgaaatga

SEQ ID NO: 25362 - DNA, 20 bp, Artificial Sequence
  chemically synthesized
ccagctataaaattgaaatg

SEQ ID NO: 25363 - DNA, 20 bp, Artificial Sequence
  chemically synthesized
gtcccttcatttcaatttta

SEQ ID NO: 25364 - DNA, 20 bp, Artificial Sequence
  chemically synthesized
cttcatttcaattttatagc

SEQ ID NO: 25365 - DNA, 20 bp, Artificial Sequence
  chemically synthesized
attattaaaaagacagaaac

SEQ ID NO: 25366 - DNA, 20 bp, Artificial Sequence
  chemically synthesized
ttgcagtattattaaaaaga

SEQ ID NO: 25367 - DNA, 20 bp, Artificial Sequence
  chemically synthesized
atttttgcagtattattaaa

SEQ ID NO: 25368 - DNA, 20 bp, Artificial Sequence
  chemically synthesized
cagagatagtaggatttttg

SEQ ID NO: 25369 - DNA, 20 bp, Artificial Sequence
  chemically synthesized
tcagttcagtcagagatagt

SEQ ID NO: 25370 - DNA, 20 bp, Artificial Sequence
  chemically synthesized
ctcagttcagtcagagatag

SEQ ID NO: 25371 - DNA, 20 bp, Artificial Sequence
  chemically synthesized
gacctcagttcagtcagaga

SEQ ID NO: 25372 - DNA, 20 bp, Artificial Sequence
  chemically synthesized
tctagacctcagttcagtca

SEQ ID NO: 25373 - DNA, 20 bp, Artificial Sequence
  chemically synthesized
attctagacctcagttcagt

SEQ ID NO: 25374 - DNA, 20 bp, Artificial Sequence
  chemically synthesized
ctactatctctgactgaact

SEQ ID NO: 25375 - DNA, 20 bp, Artificial Sequence
  chemically synthesized
tactatctctgactgaactg

SEQ ID NO: 25376 - DNA, 20 bp, Artificial Sequence
  chemically synthesized
ttaaattctagacctcagtt

SEQ ID NO: 25377 - DNA, 20 bp, Artificial Sequence
  chemically synthesized
tctctgactgaactgaggtc

SEQ ID NO: 25378 - DNA, 20 bp, Artificial Sequence
  chemically synthesized
ttgttttaaattctagacct

SEQ ID NO: 25379 - DNA, 20 bp, Artificial Sequence
  chemically synthesized
acactccttgttttaaattc

SEQ ID NO: 25380 - DNA, 20 bp, Artificial Sequence
  chemically synthesized
tgaggtctagaatttaaaac

SEQ ID NO: 25381 - DNA, 20 bp, Artificial Sequence
  chemically synthesized
gaggtctagaatttaaaaca

SEQ ID NO: 25382 - DNA, 20 bp, Artificial Sequence
  chemically synthesized
ggtctagaatttaaaacaag

SEQ ID NO: 25383 - DNA, 20 bp, Artificial Sequence
  chemically synthesized
atttaaaacaaggagtgttt

SEQ ID NO: 25384 - DNA, 20 bp, Artificial Sequence
  chemically synthesized
tccataagccattggaaaga

SEQ ID NO: 25385 - DNA, 20 bp, Artificial Sequence
  chemically synthesized
gttttagtctatctttccaa

SEQ ID NO: 25386 - DNA, 20 bp, Artificial Sequence
  chemically synthesized
agtctccataagccattgga

SEQ ID NO: 25387 - DNA, 20 bp, Artificial Sequence
  chemically synthesized
aaaaagtctccataagccat

SEQ ID NO: 25388 - DNA, 20 bp, Artificial Sequence
  chemically synthesized
tctatctttccaatggctta

SEQ ID NO: 25389 - DNA, 20 bp, Artificial Sequence
  chemically synthesized
tatctttccaatggcttatg

SEQ ID NO: 25390 - DNA, 20 bp, Artificial Sequence
  chemically synthesized
cctttccaaaaagtctccat

SEQ ID NO: 25391 - DNA, 20 bp, Artificial Sequence
  chemically synthesized
aatggcttatggagactttt

SEQ ID NO: 25392 - DNA, 20 bp, Artificial Sequence
  chemically synthesized
gcttatggagactttttgga

SEQ ID NO: 25393 - DNA, 20 bp, Artificial Sequence
  chemically synthesized
cttatggagactttttggaa

SEQ ID NO: 25394 - DNA, 20 bp, Artificial Sequence
  chemically synthesized
aaaccttaggcctttccaaa

SEQ ID NO: 25395 - DNA, 20 bp, Artificial Sequence
  chemically synthesized
gagactttttggaaaggcct

SEQ ID NO: 25396 - DNA, 20 bp, Artificial Sequence
  chemically synthesized
agactttttggaaaggccta

SEQ ID NO: 25397 - DNA, 20 bp, Artificial Sequence
  chemically synthesized
gataggcatattgaaacctt

SEQ ID NO: 25398 - DNA, 20 bp, Artificial Sequence
  chemically synthesized
agataggcatattgaaacct

SEQ ID NO: 25399 - DNA, 20 bp, Artificial Sequence
  chemically synthesized
gtttcaatatgcctatctat

SEQ ID NO: 25400 - DNA, 20 bp, Artificial Sequence
  chemically synthesized
gttctttctagctaatagat

SEQ ID NO: 25401 - DNA, 20 bp, Artificial Sequence
  chemically synthesized
tgttctttctagctaataga

SEQ ID NO: 25402 - DNA, 20 bp, Artificial Sequence
  chemically synthesized
caatatgcctatctattagc

SEQ ID NO: 25403 - DNA, 20 bp, Artificial Sequence
  chemically synthesized
ttattgttctttctagctaa

SEQ ID NO: 25404 - DNA, 20 bp, Artificial Sequence
  chemically synthesized
atgcctatctattagctaga

SEQ ID NO: 25405 - DNA, 20 bp, Artificial Sequence
  chemically synthesized
gaggtcattattgttctttc

SEQ ID NO: 25406 - DNA, 20 bp, Artificial Sequence
  chemically synthesized
ttccactcataaagttaatg

SEQ ID NO: 25407 - DNA, 20 bp, Artificial Sequence
  chemically synthesized
tttccactcataaagttaat

SEQ ID NO: 25408 - DNA, 20 bp, Artificial Sequence
  chemically synthesized
aatgacctcattaactttat

SEQ ID NO: 25409 - DNA, 20 bp, Artificial Sequence
  chemically synthesized
gacctcattaactttatgag

SEQ ID NO: 25410 - DNA, 20 bp, Artificial Sequence
  chemically synthesized
tacagctctttccactcata

SEQ ID NO: 25411 - DNA, 20 bp, Artificial Sequence
  chemically synthesized
tcattaactttatgagtgga

SEQ ID NO: 25412 - DNA, 20 bp, Artificial Sequence
  chemically synthesized
attaactttatgagtggaaa

SEQ ID NO: 25413 - DNA, 20 bp, Artificial Sequence
  chemically synthesized
tatgagtggaaagagctgta

SEQ ID NO: 25414 - DNA, 20 bp, Artificial Sequence
  chemically synthesized
ggaataatcatttagccgta

SEQ ID NO: 25415 - DNA, 20 bp, Artificial Sequence
  chemically synthesized
tatctgttggaataatcatt

SEQ ID NO: 25416 - DNA, 20 bp, Artificial Sequence
  chemically synthesized
cggctaaatgattattccaa

SEQ ID NO: 25417 - DNA, 20 bp, Artificial Sequence
  chemically synthesized
cactataccaatttatctgt

SEQ ID NO: 25418 - DNA, 20 bp, Artificial Sequence
  chemically synthesized
gattattccaacagataaat

SEQ ID NO: 25419 - DNA, 20 bp, Artificial Sequence
  chemically synthesized
ttccaacagataaattggta

SEQ ID NO: 25420 - DNA, 20 bp, Artificial Sequence
  chemically synthesized
caacagataaattggtatag

SEQ ID NO: 25421 - DNA, 20 bp, Artificial Sequence
  chemically synthesized
agagttggtatgaagaaaca

SEQ ID NO: 25422 - DNA, 20 bp, Artificial Sequence
  chemically synthesized
tgggaaatagagttggtatg

SEQ ID NO: 25423 - DNA, 20 bp, Artificial Sequence
  chemically synthesized
tttcttctgggaaatagagt

SEQ ID NO: 25424 - DNA, 20 bp, Artificial Sequence
  chemically synthesized
ttcataccaactctatttcc

SEQ ID NO: 25425 - DNA, 20 bp, Artificial Sequence
  chemically synthesized
taaatttcttctgggaaata

SEQ ID NO: 25426 - DNA, 20 bp, Artificial Sequence
  chemically synthesized
attaaatttcttctgggaaa

SEQ ID NO: 25427 - DNA, 20 bp, Artificial Sequence
  chemically synthesized
ataccaactctatttcccag

SEQ ID NO: 25428 - DNA, 20 bp, Artificial Sequence
  chemically synthesized
atttggattaaatttcttct

SEQ ID NO: 25429 - DNA, 20 bp, Artificial Sequence
  chemically synthesized
gatttggattaaatttcttc

SEQ ID NO: 25430 - DNA, 20 bp, Artificial Sequence
  chemically synthesized
gaaatttaatccaaatctcc

SEQ ID NO: 25431 - DNA, 20 bp, Artificial Sequence
  chemically synthesized
cacttaccacctgggagatt

SEQ ID NO: 25432 - DNA, 20 bp, Artificial Sequence
  chemically synthesized
aaatttaatccaaatctccc

SEQ ID NO: 25433 - DNA, 20 bp, Artificial Sequence
  chemically synthesized
tttaatccaaatctcccagg

SEQ ID NO: 25434 - DNA, 20 bp, Artificial Sequence
  chemically synthesized
atttttcacttaccacctgg

SEQ ID NO: 25435 - DNA, 20 bp, Artificial Sequence
  chemically synthesized
atccaaatctcccaggtggt

SEQ ID NO: 25436 - DNA, 20 bp, Artificial Sequence
  chemically synthesized
ttatttttcacttaccacct

SEQ ID NO: 25437 - DNA, 20 bp, Artificial Sequence
  chemically synthesized
tttatttttcacttaccacc

SEQ ID NO: 25438 - DNA, 20 bp, Artificial Sequence
  chemically synthesized
ggtaagtgaaaaataaaatt

SEQ ID NO: 25439 - DNA, 20 bp, Artificial Sequence
  chemically synthesized
taagtgaaaaataaaattta

SEQ ID NO: 25440 - DNA, 20 bp, Artificial Sequence
  chemically synthesized
atttagagcacatatgcttt

SEQ ID NO: 25441 - DNA, 20 bp, Artificial Sequence
  chemically synthesized
tttagagcacatatgctttt

SEQ ID NO: 25442 - DNA, 20 bp, Artificial Sequence
  chemically synthesized
ttagagcacatatgcttttg

SEQ ID NO: 25443 - DNA, 20 bp, Artificial Sequence
  chemically synthesized
tagagcacatatgcttttgg

SEQ ID NO: 25444 - DNA, 20 bp, Artificial Sequence
  chemically synthesized
gagcacatatgcttttgggg

SEQ ID NO: 25445 - DNA, 20 bp, Artificial Sequence
  chemically synthesized
ttagaacaatactcccccaa

SEQ ID NO: 25446 - DNA, 20 bp, Artificial Sequence
  chemically synthesized
ggggagtattgttctaaatt

SEQ ID NO: 25447 - DNA, 20 bp, Artificial Sequence
  chemically synthesized
tgtatgccaaacactgaatt

SEQ ID NO: 25448 - DNA, 20 bp, Artificial Sequence
  chemically synthesized
attgttctaaattcagtgtt

SEQ ID NO: 25449 - DNA, 20 bp, Artificial Sequence
  chemically synthesized
gtaaaataggcaggcagtag

SEQ ID NO: 25450 - DNA, 20 bp, Artificial Sequence
  chemically synthesized
ttagtaaaataggcaggcag

SEQ ID NO: 25451 - DNA, 20 bp, Artificial Sequence
  chemically synthesized
aaattagtaaaataggcagg

SEQ ID NO: 25452 - DNA, 20 bp, Artificial Sequence
  chemically synthesized
ggaaaattagtaaaataggc

SEQ ID NO: 25453 - DNA, 20 bp, Artificial Sequence
  chemically synthesized
tggaaaattagtaaaatagg

SEQ ID NO: 25454 - DNA, 20 bp, Artificial Sequence
  chemically synthesized
atttggaaaattagtaaaat

SEQ ID NO: 25455 - DNA, 20 bp, Artificial Sequence
  chemically synthesized
aatttggaaaattagtaaaa

SEQ ID NO: 25456 - DNA, 20 bp, Artificial Sequence
  chemically synthesized
cttgggaaaatttggaaaat

SEQ ID NO: 25457 - DNA, 20 bp, Artificial Sequence
  chemically synthesized
tttggcttcttgggaaaatt

SEQ ID NO: 25458 - DNA, 20 bp, Artificial Sequence
  chemically synthesized
ctaattttccaaattttccc

SEQ ID NO: 25459 - DNA, 20 bp, Artificial Sequence
  chemically synthesized
attttccaaattttcccaag

SEQ ID NO: 25460 - DNA, 20 bp, Artificial Sequence
  chemically synthesized
ctgccttgttttggcttctt

SEQ ID NO: 25461 - DNA, 20 bp, Artificial Sequence
  chemically synthesized
actgccttgttttggcttct

SEQ ID NO: 25462 - DNA, 20 bp, Artificial Sequence
  chemically synthesized
ttttcccaagaagccaaaac

SEQ ID NO: 25463 - DNA, 20 bp, Artificial Sequence
  chemically synthesized
tttcccaagaagccaaaaca

SEQ ID NO: 25464 - DNA, 20 bp, Artificial Sequence
  chemically synthesized
gtggggagactgccttgttt

SEQ ID NO: 25465 - DNA, 20 bp, Artificial Sequence
  chemically synthesized
cccaagaagccaaaacaagg

SEQ ID NO: 25466 - DNA, 20 bp, Artificial Sequence
  chemically synthesized
ctataataggagtatgtggg

SEQ ID NO: 25467 - DNA, 20 bp, Artificial Sequence
  chemically synthesized
ttctataataggagtatgtg

SEQ ID NO: 25468 - DNA, 20 bp, Artificial Sequence
  chemically synthesized
tttctataataggagtatgt

SEQ ID NO: 25469 - DNA, 20 bp, Artificial Sequence
  chemically synthesized
ctttctataataggagtatg

SEQ ID NO: 25470 - DNA, 20 bp, Artificial Sequence
  chemically synthesized
ctccccacatactcctatta

SEQ ID NO: 25471 - DNA, 20 bp, Artificial Sequence
  chemically synthesized
atgccacctttctataatag

SEQ ID NO: 25472 - DNA, 20 bp, Artificial Sequence
  chemically synthesized
atatgccacctttctataat

SEQ ID NO: 25473 - DNA, 20 bp, Artificial Sequence
  chemically synthesized
ccacatactcctattataga

SEQ ID NO: 25474 - DNA, 20 bp, Artificial Sequence
  chemically synthesized
aatatgccacctttctataa

SEQ ID NO: 25475 - DNA, 20 bp, Artificial Sequence
  chemically synthesized
cacatactcctattatagaa

SEQ ID NO: 25476 - DNA, 20 bp, Artificial Sequence
  chemically synthesized
atactcctattatagaaagg

SEQ ID NO: 25477 - DNA, 20 bp, Artificial Sequence
  chemically synthesized
ggagtgagactggaaaattg

SEQ ID NO: 25478 - DNA, 20 bp, Artificial Sequence
  chemically synthesized
ataatatgtctccaattttc

SEQ ID NO: 25479 - DNA, 20 bp, Artificial Sequence
  chemically synthesized
gaggagtgagactggaaaat

SEQ ID NO: 25480 - DNA, 20 bp, Artificial Sequence
  chemically synthesized
atcctttggaggagtgagac

SEQ ID NO: 25481 - DNA, 20 bp, Artificial Sequence
  chemically synthesized
ttagaatcctttggaggagt

SEQ ID NO: 25482 - DNA, 20 bp, Artificial Sequence
  chemically synthesized
tttccagtctcactcctcca

SEQ ID NO: 25483 - DNA, 20 bp, Artificial Sequence
  chemically synthesized
ttccagtctcactcctccaa

SEQ ID NO: 25484 - DNA, 20 bp, Artificial Sequence
  chemically synthesized
tccattagaatcctttggag

SEQ ID NO: 25485 - DNA, 20 bp, Artificial Sequence
  chemically synthesized
agtccattagaatcctttgg

SEQ ID NO: 25486 - DNA, 20 bp, Artificial Sequence
  chemically synthesized
aagtccattagaatcctttg

SEQ ID NO: 25487 - DNA, 20 bp, Artificial Sequence
  chemically synthesized
aaaagtccattagaatcctt

SEQ ID NO: 25488 - DNA, 20 bp, Artificial Sequence
  chemically synthesized
actcctccaaaggattctaa

SEQ ID NO: 25489 - DNA, 20 bp, Artificial Sequence
  chemically synthesized
ttgtcatctgaaaagtccat

SEQ ID NO: 25490 - DNA, 20 bp, Artificial Sequence
  chemically synthesized
aaggattctaatggactttt

SEQ ID NO: 25491 - DNA, 20 bp, Artificial Sequence
  chemically synthesized
aataatacttgtcatctgaa

SEQ ID NO: 25492 - DNA, 20 bp, Artificial Sequence
  chemically synthesized
taatggacttttcagatgac

SEQ ID NO: 25493 - DNA, 20 bp, Artificial Sequence
  chemically synthesized
atgacaagtattattcttgc

SEQ ID NO: 25494 - DNA, 20 bp, Artificial Sequence
  chemically synthesized
tctagtgagtttgagctggc

SEQ ID NO: 25495 - DNA, 20 bp, Artificial Sequence
  chemically synthesized
ctgttctagtgagtttgagc

SEQ ID NO: 25496 - DNA, 20 bp, Artificial Sequence
  chemically synthesized
ttgtctgttctagtgagttt

SEQ ID NO: 25497 - DNA, 20 bp, Artificial Sequence
  chemically synthesized
tcttgccagctcaaactcac

SEQ ID NO: 25498 - DNA, 20 bp, Artificial Sequence
  chemically synthesized
ccagctcaaactcactagaa

SEQ ID NO: 25499 - DNA, 20 bp, Artificial Sequence
  chemically synthesized
aggttcttgtctgttctagt

SEQ ID NO: 25500 - DNA, 20 bp, Artificial Sequence
  chemically synthesized
tccaaggttcttgtctgttc

SEQ ID NO: 25501 - DNA, 20 bp, Artificial Sequence
  chemically synthesized
tcaaactcactagaacagac

SEQ ID NO: 25502 - DNA, 20 bp, Artificial Sequence
  chemically synthesized
actagaacagacaagaacct

SEQ ID NO: 25503 - DNA, 20 bp, Artificial Sequence
  chemically synthesized
tgaagtctcattaagatcca

SEQ ID NO: 25504 - DNA, 20 bp, Artificial Sequence
  chemically synthesized
ctgaagtctcattaagatcc

SEQ ID NO: 25505 - DNA, 20 bp, Artificial Sequence
  chemically synthesized
caagaaccttggatcttaat

SEQ ID NO: 25506 - DNA, 20 bp, Artificial Sequence
  chemically synthesized
aatttgtctgaagtctcatt

SEQ ID NO: 25507 - DNA, 20 bp, Artificial Sequence
  chemically synthesized
cttggatcttaatgagactt

SEQ ID NO: 25508 - DNA, 20 bp, Artificial Sequence
  chemically synthesized
taaattactcaatttgtctg

SEQ ID NO: 25509 - DNA, 20 bp, Artificial Sequence
  chemically synthesized
aatgagacttcagacaaatt

SEQ ID NO: 25510 - DNA, 20 bp, Artificial Sequence
  chemically synthesized
caaattgagtaatttaaatc

SEQ ID NO: 25511 - DNA, 20 bp, Artificial Sequence
  chemically synthesized
aatttgctttcaagacagac

SEQ ID NO: 25512 - DNA, 20 bp, Artificial Sequence
  chemically synthesized
ttaaatccagtctgtcttga

SEQ ID NO: 25513 - DNA, 20 bp, Artificial Sequence
  chemically synthesized
ggcttaatttgctttcaaga

SEQ ID NO: 25514 - DNA, 20 bp, Artificial Sequence
  chemically synthesized
ttttggcttaatttgctttc

SEQ ID NO: 25515 - DNA, 20 bp, Artificial Sequence
  chemically synthesized
gtctgtcttgaaagcaaatt

SEQ ID NO: 25516 - DNA, 20 bp, Artificial Sequence
  chemically synthesized
gcaaattaagccaaaatatc

SEQ ID NO: 25517 - DNA, 20 bp, Artificial Sequence
  chemically synthesized
cttctgaagcctggatattt

SEQ ID NO: 25518 - DNA, 20 bp, Artificial Sequence
  chemically synthesized
caaattaagccaaaatatcc

SEQ ID NO: 25519 - DNA, 20 bp, Artificial Sequence
  chemically synthesized
aagccaaaatatccaggctt

SEQ ID NO: 25520 - DNA, 20 bp, Artificial Sequence
  chemically synthesized
aattctagacttctgaagcc

SEQ ID NO: 25521 - DNA, 20 bp, Artificial Sequence
  chemically synthesized
ccaaaatatccaggcttcag

SEQ ID NO: 25522 - DNA, 20 bp, Artificial Sequence
  chemically synthesized
ccaataattctagacttctg

SEQ ID NO: 25523 - DNA, 20 bp, Artificial Sequence
  chemically synthesized
atatccaggcttcagaagtc

SEQ ID NO: 25524 - DNA, 20 bp, Artificial Sequence
  chemically synthesized
cttcagaagtctagaattat

SEQ ID NO: 25525 - DNA, 20 bp, Artificial Sequence
  chemically synthesized
tgaagatctcccaataattc

SEQ ID NO: 25526 - DNA, 20 bp, Artificial Sequence
  chemically synthesized
ttcagaagtctagaattatt

SEQ ID NO: 25527 - DNA, 20 bp, Artificial Sequence
  chemically synthesized
cagaagtctagaattattgg

SEQ ID NO: 25528 - DNA, 20 bp, Artificial Sequence
  chemically synthesized
agaattattgggagatcttc

SEQ ID NO: 25529 - DNA, 20 bp, Artificial Sequence
  chemically synthesized
tattgggagatcttcaagaa

SEQ ID NO: 25530 - DNA, 20 bp, Artificial Sequence
  chemically synthesized
gaattcctggtctgttcttg

SEQ ID NO: 25531 - DNA, 20 bp, Artificial Sequence
  chemically synthesized
ggagatcttcaagaacagac

SEQ ID NO: 25532 - DNA, 20 bp, Artificial Sequence
  chemically synthesized
gagatcttcaagaacagacc

SEQ ID NO: 25533 - DNA, 20 bp, Artificial Sequence
  chemically synthesized
caagaacagaccaggaattc

SEQ ID NO: 25534 - DNA, 20 bp, Artificial Sequence
  chemically synthesized
aagatatgttccagaattcc

SEQ ID NO: 25535 - DNA, 20 bp, Artificial Sequence
  chemically synthesized
aattctttaaagatatgttc

SEQ ID NO: 25536 - DNA, 20 bp, Artificial Sequence
  chemically synthesized
aattctggaacatatcttta

SEQ ID NO: 25537 - DNA, 20 bp, Artificial Sequence
  chemically synthesized
ttctctcagctaattcttta

SEQ ID NO: 25538 - DNA, 20 bp, Artificial Sequence
  chemically synthesized
ggaacatatctttaaagaat

SEQ ID NO: 25539 - DNA, 20 bp, Artificial Sequence
  chemically synthesized
atatctttaaagaattagct

SEQ ID NO: 25540 - DNA, 20 bp, Artificial Sequence
  chemically synthesized
atctttaaagaattagctga

SEQ ID NO: 25541 - DNA, 20 bp, Artificial Sequence
  chemically synthesized
tttaaagaattagctgagag

SEQ ID NO: 25542 - DNA, 20 bp, Artificial Sequence
  chemically synthesized
taaagaattagctgagagaa

SEQ ID NO: 25543 - DNA, 20 bp, Artificial Sequence
  chemically synthesized
aaagaattagctgagagaag

SEQ ID NO: 25544 - DNA, 20 bp, Artificial Sequence
  chemically synthesized
tgttagtgttcctcttctct

SEQ ID NO: 25545 - DNA, 20 bp, Artificial Sequence
  chemically synthesized
atagaccaagtatgatgtgt

SEQ ID NO: 25546 - DNA, 20 bp, Artificial Sequence
  chemically synthesized
gaacactaacacatcatact

SEQ ID NO: 25547 - DNA, 20 bp, Artificial Sequence
  chemically synthesized
tatctaaaaaattatagacc

SEQ ID NO: 25548 - DNA, 20 bp, Artificial Sequence
  chemically synthesized
caaatatatctaaaaaatta

SEQ ID NO: 25549 - DNA, 20 bp, Artificial Sequence
  chemically synthesized
atacttggtctataattttt

SEQ ID NO: 25550 - DNA, 20 bp, Artificial Sequence
  chemically synthesized
ataattttttagatatattt

SEQ ID NO: 25551 - DNA, 20 bp, Artificial Sequence
  chemically synthesized
taattttttagatatatttg

SEQ ID NO: 25552 - DNA, 20 bp, Artificial Sequence
  chemically synthesized
ttacgagttgagattttaag

SEQ ID NO: 25553 - DNA, 20 bp, Artificial Sequence
  chemically synthesized
tttacgagttgagattttaa

SEQ ID NO: 25554 - DNA, 20 bp, Artificial Sequence
  chemically synthesized
tttttacgagttgagatttt

SEQ ID NO: 25555 - DNA, 20 bp, Artificial Sequence
  chemically synthesized
tgatgaggtttttacgagtt

SEQ ID NO: 25556 - DNA, 20 bp, Artificial Sequence
  chemically synthesized
gttgatgatgaggtttttac

SEQ ID NO: 25557 - DNA, 20 bp, Artificial Sequence
  chemically synthesized
aaagctctatgttgatgatg

SEQ ID NO: 25558 - DNA, 20 bp, Artificial Sequence
  chemically synthesized
taaagctctatgttgatgat

SEQ ID NO: 25559 - DNA, 20 bp, Artificial Sequence
  chemically synthesized
taaaaacctcatcatcaaca

SEQ ID NO: 25560 - DNA, 20 bp, Artificial Sequence
  chemically synthesized
aaaacctcatcatcaacata

SEQ ID NO: 25561 - DNA, 20 bp, Artificial Sequence
  chemically synthesized
atttttcccccatttaagta

SEQ ID NO: 25562 - DNA, 20 bp, Artificial Sequence
  chemically synthesized
aacatagagctttacttaaa

SEQ ID NO: 25563 - DNA, 20 bp, Artificial Sequence
  chemically synthesized
acatagagctttacttaaat

SEQ ID NO: 25564 - DNA, 20 bp, Artificial Sequence
  chemically synthesized
catagagctttacttaaatg

SEQ ID NO: 25565 - DNA, 20 bp, Artificial Sequence
  chemically synthesized
atagagctttacttaaatgg

SEQ ID NO: 25566 - DNA, 20 bp, Artificial Sequence
  chemically synthesized
ggtttatttttcccccattt

SEQ ID NO: 25567 - DNA, 20 bp, Artificial Sequence
  chemically synthesized
gggaaaaataaacctacaca

SEQ ID NO: 25568 - DNA, 20 bp, Artificial Sequence
  chemically synthesized
attcctgtttatctgtgtgt

SEQ ID NO: 25569 - DNA, 20 bp, Artificial Sequence
  chemically synthesized
aattcctgtttatctgtgtg

SEQ ID NO: 25570 - DNA, 20 bp, Artificial Sequence
  chemically synthesized
taaacctacacacagataaa

SEQ ID NO: 25571 - DNA, 20 bp, Artificial Sequence
  chemically synthesized
aaacctacacacagataaac

SEQ ID NO: 25572 - DNA, 20 bp, Artificial Sequence
  chemically synthesized
aggaattatgcattcatact

SEQ ID NO: 25573 - DNA, 20 bp, Artificial Sequence
  chemically synthesized
ttatgcattcatacttagat

SEQ ID NO: 25574 - DNA, 20 bp, Artificial Sequence
  chemically synthesized
tgtactttctgtacttatct

SEQ ID NO: 25575 - DNA, 20 bp, Artificial Sequence
  chemically synthesized
cattcatacttagataagta

SEQ ID NO: 25576 - DNA, 20 bp, Artificial Sequence
  chemically synthesized
catacttagataagtacaga

SEQ ID NO: 25577 - DNA, 20 bp, Artificial Sequence
  chemically synthesized
ttagataagtacagaaagta

SEQ ID NO: 25578 - DNA, 20 bp, Artificial Sequence
  chemically synthesized
tgatagtaattataaattca

SEQ ID NO: 25579 - DNA, 20 bp, Artificial Sequence
  chemically synthesized
gtgaatttataattactatc

SEQ ID NO: 25580 - DNA, 20 bp, Artificial Sequence
  chemically synthesized
catctggaaacataacttga

SEQ ID NO: 25581 - DNA, 20 bp, Artificial Sequence
  chemically synthesized
ttactatcaagttatgtttc

SEQ ID NO: 25582 - DNA, 20 bp, Artificial Sequence
  chemically synthesized
aagtaataccatttcacatc

SEQ ID NO: 25583 - DNA, 20 bp, Artificial Sequence
  chemically synthesized
ttatgtttccagatgtgaaa

SEQ ID NO: 25584 - DNA, 20 bp, Artificial Sequence
  chemically synthesized
caaagtcattggtgataaat

SEQ ID NO: 25585 - DNA, 20 bp, Artificial Sequence
  chemically synthesized
gaagagttttacaaagtcat

SEQ ID NO: 25586 - DNA, 20 bp, Artificial Sequence
  chemically synthesized
tttcttagaagagttttaca

SEQ ID NO: 25587 - DNA, 20 bp, Artificial Sequence
  chemically synthesized
tgactttgtaaaactcttct

SEQ ID NO: 25588 - DNA, 20 bp, Artificial Sequence
  chemically synthesized
ctctccttcatttcttagaa

SEQ ID NO: 25589 - DNA, 20 bp, Artificial Sequence
  chemically synthesized
ccctctccttcatttcttag

SEQ ID NO: 25590 - DNA, 20 bp, Artificial Sequence
  chemically synthesized
taaaactcttctaagaaatg

SEQ ID NO: 25591 - DNA, 20 bp, Artificial Sequence
  chemically synthesized
tggccctctccttcatttct

SEQ ID NO: 25592 - DNA, 20 bp, Artificial Sequence
  chemically synthesized
aaaactcttctaagaaatga

SEQ ID NO: 25593 - DNA, 20 bp, Artificial Sequence
  chemically synthesized
aactcttctaagaaatgaag

SEQ ID NO: 25594 - DNA, 20 bp, Artificial Sequence
  chemically synthesized
ctcttctaagaaatgaagga

SEQ ID NO: 25595 - DNA, 20 bp, Artificial Sequence
  chemically synthesized
tcttctaagaaatgaaggag

SEQ ID NO: 25596 - DNA, 20 bp, Artificial Sequence
  chemically synthesized
cttctaagaaatgaaggaga

SEQ ID NO: 25597 - DNA, 20 bp, Artificial Sequence
  chemically synthesized
taagaaatgaaggagagggc

SEQ ID NO: 25598 - DNA, 20 bp, Artificial Sequence
  chemically synthesized
aagaaatgaaggagagggcc

SEQ ID NO: 25599 - DNA, 20 bp, Artificial Sequence
  chemically synthesized
atgaaggagagggccaggtg

SEQ ID NO: 25600 - DNA, 20 bp, Artificial Sequence
  chemically synthesized
aaggagagggccaggtgtgg

SEQ ID NO: 25601 - DNA, 20 bp, Artificial Sequence
  chemically synthesized
caggtgtgagccaccacacc

SEQ ID NO: 25602 - DNA, 20 bp, Artificial Sequence
  chemically synthesized
agtgctgggattacaggtgt

SEQ ID NO: 25603 - DNA, 20 bp, Artificial Sequence
  chemically synthesized
gtggctcacacctgtaatcc

SEQ ID NO: 25604 - DNA, 20 bp, Artificial Sequence
  chemically synthesized
tccataagtgctgggattac

SEQ ID NO: 25605 - DNA, 20 bp, Artificial Sequence
  chemically synthesized
ctccataagtgctgggatta

SEQ ID NO: 25606 - DNA, 20 bp, Artificial Sequence
  chemically synthesized
cctcgacctccataagtgct

SEQ ID NO: 25607 - DNA, 20 bp, Artificial Sequence
  chemically synthesized
acctgtaatcccagcactta

SEQ ID NO: 25608 - DNA, 20 bp, Artificial Sequence
  chemically synthesized
gcctcgacctccataagtgc

SEQ ID NO: 25609 - DNA, 20 bp, Artificial Sequence
  chemically synthesized
ctgtaatcccagcacttatg

SEQ ID NO: 25610 - DNA, 20 bp, Artificial Sequence
  chemically synthesized
tgtaatcccagcacttatgg

SEQ ID NO: 25611 - DNA, 20 bp, Artificial Sequence
  chemically synthesized
ccgcccgcctcgacctccat

SEQ ID NO: 25612 - DNA, 20 bp, Artificial Sequence
  chemically synthesized
tcccagcacttatggaggtc

SEQ ID NO: 25613 - DNA, 20 bp, Artificial Sequence
  chemically synthesized
cccagcacttatggaggtcg

SEQ ID NO: 25614 - DNA, 20 bp, Artificial Sequence
  chemically synthesized
agcacttatggaggtcgagg

SEQ ID NO: 25615 - DNA, 20 bp, Artificial Sequence
  chemically synthesized
gcacttatggaggtcgaggc

SEQ ID NO: 25616 - DNA, 20 bp, Artificial Sequence
  chemically synthesized
cttatggaggtcgaggcggg

SEQ ID NO: 25617 - DNA, 20 bp, Artificial Sequence
  chemically synthesized
ggtcgaggcgggcggatcac

SEQ ID NO: 25618 - DNA, 20 bp, Artificial Sequence
  chemically synthesized
gtcgaggcgggcggatcacg

SEQ ID NO: 25619 - DNA, 20 bp, Artificial Sequence
  chemically synthesized
aggcgggcggatcacgaggt

SEQ ID NO: 25620 - DNA, 20 bp, Artificial Sequence
  chemically synthesized
ggcgggcggatcacgaggtc

SEQ ID NO: 25621 - DNA, 20 bp, Artificial Sequence
  chemically synthesized
cgggcggatcacgaggtcag

SEQ ID NO: 25622 - DNA, 20 bp, Artificial Sequence
  chemically synthesized
gatcacgaggtcaggagttc

SEQ ID NO: 25623 - DNA, 20 bp, Artificial Sequence
  chemically synthesized
tcacgaggtcaggagttcga

SEQ ID NO: 25624 - DNA, 20 bp, Artificial Sequence
  chemically synthesized
cgaggtcaggagttcgagag

SEQ ID NO: 25625 - DNA, 20 bp, Artificial Sequence
  chemically synthesized
tcaggagttcgagagcagcc

SEQ ID NO: 25626 - DNA, 20 bp, Artificial Sequence
  chemically synthesized
ggggtttcaccatgttggcc

SEQ ID NO: 25627 - DNA, 20 bp, Artificial Sequence
  chemically synthesized
cgagagcagcctggccaaca

SEQ ID NO: 25628 - DNA, 20 bp, Artificial Sequence
  chemically synthesized
cggggtttcaccatgttggc

SEQ ID NO: 25629 - DNA, 20 bp, Artificial Sequence
  chemically synthesized
gagacggggtttcaccatgt

SEQ ID NO: 25630 - DNA, 20 bp, Artificial Sequence
  chemically synthesized
ttgtgtttttaatagagacg

SEQ ID NO: 25631 - DNA, 20 bp, Artificial Sequence
  chemically synthesized
tttgtgtttttaatagagac

SEQ ID NO: 25632 - DNA, 20 bp, Artificial Sequence
  chemically synthesized
ttttgtgtttttaatagaga

SEQ ID NO: 25633 - DNA, 20 bp, Artificial Sequence
  chemically synthesized
atttttttgtgtttttaata

SEQ ID NO: 25634 - DNA, 20 bp, Artificial Sequence
  chemically synthesized
taatttttttgtgtttttaa

SEQ ID NO: 25635 - DNA, 20 bp, Artificial Sequence
  chemically synthesized
tattaaaaacacaaaaaaat

SEQ ID NO: 25636 - DNA, 20 bp, Artificial Sequence
  chemically synthesized
aaaaacacaaaaaaattagc

SEQ ID NO: 25637 - DNA, 20 bp, Artificial Sequence
  chemically synthesized
aaaacacaaaaaaattagcc

SEQ ID NO: 25638 - DNA, 20 bp, Artificial Sequence
  chemically synthesized
acaaaaaaattagccaggca

SEQ ID NO: 25639 - DNA, 20 bp, Artificial Sequence
  chemically synthesized
aaaaaattagccaggcatgg

SEQ ID NO: 25640 - DNA, 20 bp, Artificial Sequence
  chemically synthesized
caggtgtgcaccaccatgcc

SEQ ID NO: 25641 - DNA, 20 bp, Artificial Sequence
  chemically synthesized
gtggtgcacacctgtaatcc

SEQ ID NO: 25642 - DNA, 20 bp, Artificial Sequence
  chemically synthesized
tcctgagtagctaggattac

SEQ ID NO: 25643 - DNA, 20 bp, Artificial Sequence
  chemically synthesized
ctcctgagtagctaggatta

SEQ ID NO: 25644 - DNA, 20 bp, Artificial Sequence
  chemically synthesized
cacctgtaatcctagctact

SEQ ID NO: 25645 - DNA, 20 bp, Artificial Sequence
  chemically synthesized
cttcagcctcctgagtagct

SEQ ID NO: 25646 - DNA, 20 bp, Artificial Sequence
  chemically synthesized
acctgtaatcctagctactc

SEQ ID NO: 25647 - DNA, 20 bp, Artificial Sequence
  chemically synthesized
gcttcagcctcctgagtagc

SEQ ID NO: 25648 - DNA, 20 bp, Artificial Sequence
  chemically synthesized
ctgtaatcctagctactcag

SEQ ID NO: 25649 - DNA, 20 bp, Artificial Sequence
  chemically synthesized
tgtaatcctagctactcagg

SEQ ID NO: 25650 - DNA, 20 bp, Artificial Sequence
  chemically synthesized
tcctgcttcagcctcctgag

SEQ ID NO: 25651 - DNA, 20 bp, Artificial Sequence
  chemically synthesized
ttatcctgcttcagcctcct

SEQ ID NO: 25652 - DNA, 20 bp, Artificial Sequence
  chemically synthesized
cctagctactcaggaggctg

SEQ ID NO: 25653 - DNA, 20 bp, Artificial Sequence
  chemically synthesized
agctactcaggaggctgaag

SEQ ID NO: 25654 - DNA, 20 bp, Artificial Sequence
  chemically synthesized
gctactcaggaggctgaagc

SEQ ID NO: 25655 - DNA, 20 bp, Artificial Sequence
  chemically synthesized
ttcaagcaattatcctgctt

SEQ ID NO: 25656 - DNA, 20 bp, Artificial Sequence
  chemically synthesized
gcaggataattgcttgaacc

SEQ ID NO: 25657 - DNA, 20 bp, Artificial Sequence
  chemically synthesized
caggataattgcttgaaccc

SEQ ID NO: 25658 - DNA, 20 bp, Artificial Sequence
  chemically synthesized
aacctccacctcctgggttc

SEQ ID NO: 25659 - DNA, 20 bp, Artificial Sequence
  chemically synthesized
ggataattgcttgaacccag

SEQ ID NO: 25660 - DNA, 20 bp, Artificial Sequence
  chemically synthesized
gataattgcttgaacccagg

SEQ ID NO: 25661 - DNA, 20 bp, Artificial Sequence
  chemically synthesized
aattgcttgaacccaggagg

SEQ ID NO: 25662 - DNA, 20 bp, Artificial Sequence
  chemically synthesized
cactacaacctccacctcct

SEQ ID NO: 25663 - DNA, 20 bp, Artificial Sequence
  chemically synthesized
ttgcttgaacccaggaggtg

SEQ ID NO: 25664 - DNA, 20 bp, Artificial Sequence
  chemically synthesized
tcactacaacctccacctcc

SEQ ID NO: 25665 - DNA, 20 bp, Artificial Sequence
  chemically synthesized
tgcttgaacccaggaggtgg

SEQ ID NO: 25666 - DNA, 20 bp, Artificial Sequence
  chemically synthesized
aacccaggaggtggaggttg

SEQ ID NO: 25667 - DNA, 20 bp, Artificial Sequence
  chemically synthesized
caggaggtggaggttgtagt

SEQ ID NO: 25668 - DNA, 20 bp, Artificial Sequence
  chemically synthesized
ggtggaggttgtagtgagct

SEQ ID NO: 25669 - DNA, 20 bp, Artificial Sequence
  chemically synthesized
gaagtgcagtggtgcgatct

SEQ ID NO: 25670 - DNA, 20 bp, Artificial Sequence
  chemically synthesized
tcgcccaggctgaagtgcag

SEQ ID NO: 25671 - DNA, 20 bp, Artificial Sequence
  chemically synthesized
gagatcgcaccactgcactt

SEQ ID NO: 25672 - DNA, 20 bp, Artificial Sequence
  chemically synthesized
ctgtcgcccaggctgaagtg

SEQ ID NO: 25673 - DNA, 20 bp, Artificial Sequence
  chemically synthesized
cgcaccactgcacttcagcc

SEQ ID NO: 25674 - DNA, 20 bp, Artificial Sequence
  chemically synthesized
gcaccactgcacttcagcct

SEQ ID NO: 25675 - DNA, 20 bp, Artificial Sequence
  chemically synthesized
tcattctgtcgcccaggctg

SEQ ID NO: 25676 - DNA, 20 bp, Artificial Sequence
  chemically synthesized
ctgcacttcagcctgggcga

SEQ ID NO: 25677 - DNA, 20 bp, Artificial Sequence
  chemically synthesized
ggagtctcattctgtcgccc

SEQ ID NO: 25678 - DNA, 20 bp, Artificial Sequence
  chemically synthesized
tggagtctcattctgtcgcc

SEQ ID NO: 25679 - DNA, 20 bp, Artificial Sequence
  chemically synthesized
ttcagcctgggcgacagaat

SEQ ID NO: 25680 - DNA, 20 bp, Artificial Sequence
  chemically synthesized
acagaatgagactccatctc

SEQ ID NO: 25681 - DNA, 20 bp, Artificial Sequence
  chemically synthesized
tttttttttttcttgagatg

SEQ ID NO: 25682 - DNA, 20 bp, Artificial Sequence
  chemically synthesized
cttttttttttttcttgaga

SEQ ID NO: 25683 - DNA, 20 bp, Artificial Sequence
  chemically synthesized
ctcccttttttttttttctt

SEQ ID NO: 25684 - DNA, 20 bp, Artificial Sequence
  chemically synthesized
ccatctcaagaaaaaaaaaa

SEQ ID NO: 25685 - DNA, 20 bp, Artificial Sequence
  chemically synthesized
catctcaagaaaaaaaaaaa

SEQ ID NO: 25686 - DNA, 20 bp, Artificial Sequence
  chemically synthesized
atctcaagaaaaaaaaaaaa

SEQ ID NO: 25687 - DNA, 20 bp, Artificial Sequence
  chemically synthesized
ctcaagaaaaaaaaaaaagg

SEQ ID NO: 25688 - DNA, 20 bp, Artificial Sequence
  chemically synthesized
caagaaaaaaaaaaaaggga

SEQ ID NO: 25689 - DNA, 20 bp, Artificial Sequence
  chemically synthesized
gaaaaaaaaaaaagggagag

SEQ ID NO: 25690 - DNA, 20 bp, Artificial Sequence
  chemically synthesized
aaaaagggagagaagcaata

SEQ ID NO: 25691 - DNA, 20 bp, Artificial Sequence
  chemically synthesized
gagagaagcaataaagtacc

SEQ ID NO: 25692 - DNA, 20 bp, Artificial Sequence
  chemically synthesized
aagcaataaagtacctagta

SEQ ID NO: 25693 - DNA, 20 bp, Artificial Sequence
  chemically synthesized
ttccacatttgtgccatact

SEQ ID NO: 25694 - DNA, 20 bp, Artificial Sequence
  chemically synthesized
cttccacatttgtgccatac

SEQ ID NO: 25695 - DNA, 20 bp, Artificial Sequence
  chemically synthesized
tacctagtatggcacaaatg

SEQ ID NO: 25696 - DNA, 20 bp, Artificial Sequence
  chemically synthesized
ctagtatggcacaaatgtgg

SEQ ID NO: 25697 - DNA, 20 bp, Artificial Sequence
  chemically synthesized
tggcacaaatgtggaagact

SEQ ID NO: 25698 - DNA, 20 bp, Artificial Sequence
  chemically synthesized
aatgtggaagactcagaatt

SEQ ID NO: 25699 - DNA, 20 bp, Artificial Sequence
  chemically synthesized
atgtggaagactcagaattg

SEQ ID NO: 25700 - DNA, 20 bp, Artificial Sequence
  chemically synthesized
tttctcttttcctcaattct

SEQ ID NO: 25701 - DNA, 20 bp, Artificial Sequence
  chemically synthesized
gaagactcagaattgaggaa

SEQ ID NO: 25702 - DNA, 20 bp, Artificial Sequence
  chemically synthesized
agactcagaattgaggaaaa

SEQ ID NO: 25703 - DNA, 20 bp, Artificial Sequence
  chemically synthesized
agaattgaggaaaagagaaa

SEQ ID NO: 25704 - DNA, 20 bp, Artificial Sequence
  chemically synthesized
gaattgaggaaaagagaaaa

SEQ ID NO: 25705 - DNA, 20 bp, Artificial Sequence
  chemically synthesized
ttgaacttctcagtattttt

SEQ ID NO: 25706 - DNA, 20 bp, Artificial Sequence
  chemically synthesized
gttatgaaccaaaaaatact

SEQ ID NO: 25707 - DNA, 20 bp, Artificial Sequence
  chemically synthesized
atgaaccaaaaaatactgag

SEQ ID NO: 25708 - DNA, 20 bp, Artificial Sequence
  chemically synthesized
tatttcacagttgaacttct

SEQ ID NO: 25709 - DNA, 20 bp, Artificial Sequence
  chemically synthesized
ttgtgctatcttttatttca

SEQ ID NO: 25710 - DNA, 20 bp, Artificial Sequence
  chemically synthesized
gaagttcaactgtgaaataa

SEQ ID NO: 25711 - DNA, 20 bp, Artificial Sequence
  chemically synthesized
ttcaactgtgaaataaaaga

SEQ ID NO: 25712 - DNA, 20 bp, Artificial Sequence
  chemically synthesized
taaaagatagcacaaaatcc

SEQ ID NO: 25713 - DNA, 20 bp, Artificial Sequence
  chemically synthesized
atagcacaaaatcctggctg

SEQ ID NO: 25714 - DNA, 20 bp, Artificial Sequence
  chemically synthesized
gccttaaacaatccacagcc

SEQ ID NO: 25715 - DNA, 20 bp, Artificial Sequence
  chemically synthesized
tgccttaaacaatccacagc

SEQ ID NO: 25716 - DNA, 20 bp, Artificial Sequence
  chemically synthesized
gaaatgccttaaacaatcca

SEQ ID NO: 25717 - DNA, 20 bp, Artificial Sequence
  chemically synthesized
atcctggctgtggattgttt

SEQ ID NO: 25718 - DNA, 20 bp, Artificial Sequence
  chemically synthesized
tcctggctgtggattgttta

SEQ ID NO: 25719 - DNA, 20 bp, Artificial Sequence
  chemically synthesized
tggattgtttaaggcatttc

SEQ ID NO: 25720 - DNA, 20 bp, Artificial Sequence
  chemically synthesized
gccaagcaagaggagggagc

SEQ ID NO: 25721 - DNA, 20 bp, Artificial Sequence
  chemically synthesized
gaaggccaagcaagaggagg

SEQ ID NO: 25722 - DNA, 20 bp, Artificial Sequence
  chemically synthesized
aggaaggccaagcaagagga

SEQ ID NO: 25723 - DNA, 20 bp, Artificial Sequence
  chemically synthesized
gaggaaggccaagcaagagg

SEQ ID NO: 25724 - DNA, 20 bp, Artificial Sequence
  chemically synthesized
tgaggaaggccaagcaagag

SEQ ID NO: 25725 - DNA, 20 bp, Artificial Sequence
  chemically synthesized
tctggctccctcctcttgct

SEQ ID NO: 25726 - DNA, 20 bp, Artificial Sequence
  chemically synthesized
gctgaggaaggccaagcaag

SEQ ID NO: 25727 - DNA, 20 bp, Artificial Sequence
  chemically synthesized
tgctgaggaaggccaagcaa

SEQ ID NO: 25728 - DNA, 20 bp, Artificial Sequence
  chemically synthesized
tctgctgaggaaggccaagc

SEQ ID NO: 25729 - DNA, 20 bp, Artificial Sequence
  chemically synthesized
agattctgctgaggaaggcc

SEQ ID NO: 25730 - DNA, 20 bp, Artificial Sequence
  chemically synthesized
tcctcttgcttggccttcct

SEQ ID NO: 25731 - DNA, 20 bp, Artificial Sequence
  chemically synthesized
tcttgcttggccttcctcag

SEQ ID NO: 25732 - DNA, 20 bp, Artificial Sequence
  chemically synthesized
tagtgagattctgctgagga

SEQ ID NO: 25733 - DNA, 20 bp, Artificial Sequence
  chemically synthesized
gtagtgagattctgctgagg

SEQ ID NO: 25734 - DNA, 20 bp, Artificial Sequence
  chemically synthesized
gaagtagtgagattctgctg

SEQ ID NO: 25735 - DNA, 20 bp, Artificial Sequence
  chemically synthesized
agaagtagtgagattctgct

SEQ ID NO: 25736 - DNA, 20 bp, Artificial Sequence
  chemically synthesized
cagtgttgctaagaagtagt

SEQ ID NO: 25737 - DNA, 20 bp, Artificial Sequence
  chemically synthesized
agcagaatctcactacttct

SEQ ID NO: 25738 - DNA, 20 bp, Artificial Sequence
  chemically synthesized
attacagtgttgctaagaag

SEQ ID NO: 25739 - DNA, 20 bp, Artificial Sequence
  chemically synthesized
attattacagtgttgctaag

SEQ ID NO: 25740 - DNA, 20 bp, Artificial Sequence
  chemically synthesized
gccattattacagtgttgct

SEQ ID NO: 25741 - DNA, 20 bp, Artificial Sequence
  chemically synthesized
tcttagcaacactgtaataa

SEQ ID NO: 25742 - DNA, 20 bp, Artificial Sequence
  chemically synthesized
tttcaactctgccattatta

SEQ ID NO: 25743 - DNA, 20 bp, Artificial Sequence
  chemically synthesized
tagcaacactgtaataatgg

SEQ ID NO: 25744 - DNA, 20 bp, Artificial Sequence
  chemically synthesized
gcaacactgtaataatggca

SEQ ID NO: 25745 - DNA, 20 bp, Artificial Sequence
  chemically synthesized
ggcagagttgaaattcaaat

SEQ ID NO: 25746 - DNA, 20 bp, Artificial Sequence
  chemically synthesized
aaattagttttgctcattgt

SEQ ID NO: 25747 - DNA, 20 bp, Artificial Sequence
  chemically synthesized
ttaccagggcagctaacaat

SEQ ID NO: 25748 - DNA, 20 bp, Artificial Sequence
  chemically synthesized
ttgctcattgttagctgccc

SEQ ID NO: 25749 - DNA, 20 bp, Artificial Sequence
  chemically synthesized
caacaaaccttttaccaggg

SEQ ID NO: 25750 - DNA, 20 bp, Artificial Sequence
  chemically synthesized
attgttagctgccctggtaa

SEQ ID NO: 25751 - DNA, 20 bp, Artificial Sequence
  chemically synthesized
ttgttagctgccctggtaaa

SEQ ID NO: 25752 - DNA, 20 bp, Artificial Sequence
  chemically synthesized
tctcaacaaaccttttacca

SEQ ID NO: 25753 - DNA, 20 bp, Artificial Sequence
  chemically synthesized
ttctcaacaaaccttttacc

SEQ ID NO: 25754 - DNA, 20 bp, Artificial Sequence
  chemically synthesized
tttctcaacaaaccttttac

SEQ ID NO: 25755 - DNA, 20 bp, Artificial Sequence
  chemically synthesized
gccctggtaaaaggtttgtt

SEQ ID NO: 25756 - DNA, 20 bp, Artificial Sequence
  chemically synthesized
tggtaaaaggtttgttgaga

SEQ ID NO: 25757 - DNA, 20 bp, Artificial Sequence
  chemically synthesized
taaaaggtttgttgagaaag

SEQ ID NO: 25758 - DNA, 20 bp, Artificial Sequence
  chemically synthesized
aaagcagtttctgtaacaaa

SEQ ID NO: 25759 - DNA, 20 bp, Artificial Sequence
  chemically synthesized
tttatatcggccatttgtta

SEQ ID NO: 25760 - DNA, 20 bp, Artificial Sequence
  chemically synthesized
tgtaacaaatggccgatata

SEQ ID NO: 25761 - DNA, 20 bp, Artificial Sequence
  chemically synthesized
tcccccagaaaactttatat

SEQ ID NO: 25762 - DNA, 20 bp, Artificial Sequence
  chemically synthesized
atggccgatataaagttttc

SEQ ID NO: 25763 - DNA, 20 bp, Artificial Sequence
  chemically synthesized
tggccgatataaagttttct

SEQ ID NO: 25764 - DNA, 20 bp, Artificial Sequence
  chemically synthesized
ggccgatataaagttttctg

SEQ ID NO: 25765 - DNA, 20 bp, Artificial Sequence
  chemically synthesized
gccgatataaagttttctgg

SEQ ID NO: 25766 - DNA, 20 bp, Artificial Sequence
  chemically synthesized
cgatataaagttttctgggg

SEQ ID NO: 25767 - DNA, 20 bp, Artificial Sequence
  chemically synthesized
taagatacacagttctcccc

SEQ ID NO: 25768 - DNA, 20 bp, Artificial Sequence
  chemically synthesized
gaaatggtacttaagataca

SEQ ID NO: 25769 - DNA, 20 bp, Artificial Sequence
  chemically synthesized
gggggagaactgtgtatctt

SEQ ID NO: 25770 - DNA, 20 bp, Artificial Sequence
  chemically synthesized
aggccccagaaatggtactt

SEQ ID NO: 25771 - DNA, 20 bp, Artificial Sequence
  chemically synthesized
tgtatcttaagtaccatttc

SEQ ID NO: 25772 - DNA, 20 bp, Artificial Sequence
  chemically synthesized
gtatcttaagtaccatttct

SEQ ID NO: 25773 - DNA, 20 bp, Artificial Sequence
  chemically synthesized
tatcttaagtaccatttctg

SEQ ID NO: 25774 - DNA, 20 bp, Artificial Sequence
  chemically synthesized
cagaattcaggccccagaaa

SEQ ID NO: 25775 - DNA, 20 bp, Artificial Sequence
  chemically synthesized
ctggggcagaattcaggccc

SEQ ID NO: 25776 - DNA, 20 bp, Artificial Sequence
  chemically synthesized
cattatctggggcagaattc

SEQ ID NO: 25777 - DNA, 20 bp, Artificial Sequence
  chemically synthesized
ccattatctggggcagaatt

SEQ ID NO: 25778 - DNA, 20 bp, Artificial Sequence
  chemically synthesized
ctggggcctgaattctgccc

SEQ ID NO: 25779 - DNA, 20 bp, Artificial Sequence
  chemically synthesized
cagccctccattatctgggg

SEQ ID NO: 25780 - DNA, 20 bp, Artificial Sequence
  chemically synthesized
ctgaattctgccccagataa

SEQ ID NO: 25781 - DNA, 20 bp, Artificial Sequence
  chemically synthesized
agtcagccctccattatctg

SEQ ID NO: 25782 - DNA, 20 bp, Artificial Sequence
  chemically synthesized
gagtcagccctccattatct

SEQ ID NO: 25783 - DNA, 20 bp, Artificial Sequence
  chemically synthesized
gaattctgccccagataatg

SEQ ID NO: 25784 - DNA, 20 bp, Artificial Sequence
  chemically synthesized
tgagtcagccctccattatc

SEQ ID NO: 25785 - DNA, 20 bp, Artificial Sequence
  chemically synthesized
aattctgccccagataatgg

SEQ ID NO: 25786 - DNA, 20 bp, Artificial Sequence
  chemically synthesized
attctgccccagataatgga

SEQ ID NO: 25787 - DNA, 20 bp, Artificial Sequence
  chemically synthesized
taatggagggctgactcata

SEQ ID NO: 25788 - DNA, 20 bp, Artificial Sequence
  chemically synthesized
acagtggtgcctatatgagt

SEQ ID NO: 25789 - DNA, 20 bp, Artificial Sequence
  chemically synthesized
aatggagggctgactcatat

SEQ ID NO: 25790 - DNA, 20 bp, Artificial Sequence
  chemically synthesized
tggcacagtggtgcctatat

SEQ ID NO: 25791 - DNA, 20 bp, Artificial Sequence
  chemically synthesized
tttaaaggagcatggcacag

SEQ ID NO: 25792 - DNA, 20 bp, Artificial Sequence
  chemically synthesized
tgatttaaaggagcatggca

SEQ ID NO: 25793 - DNA, 20 bp, Artificial Sequence
  chemically synthesized
aagcttgatttaaaggagca

SEQ ID NO: 25794 - DNA, 20 bp, Artificial Sequence
  chemically synthesized
tcttgaagcttgatttaaag

SEQ ID NO: 25795 - DNA, 20 bp, Artificial Sequence
  chemically synthesized
gtgccatgctcctttaaatc

SEQ ID NO: 25796 - DNA, 20 bp, Artificial Sequence
  chemically synthesized
gctcttgaagcttgatttaa

SEQ ID NO: 25797 - DNA, 20 bp, Artificial Sequence
  chemically synthesized
cgctcttgaagcttgattta

SEQ ID NO: 25798 - DNA, 20 bp, Artificial Sequence
  chemically synthesized
gctcctttaaatcaagcttc

SEQ ID NO: 25799 - DNA, 20 bp, Artificial Sequence
  chemically synthesized
tcctttaaatcaagcttcaa

SEQ ID NO: 25800 - DNA, 20 bp, Artificial Sequence
  chemically synthesized
tttaaatcaagcttcaagag

SEQ ID NO: 25801 - DNA, 20 bp, Artificial Sequence
  chemically synthesized
ccctgatccttccgctcttg

SEQ ID NO: 25802 - DNA, 20 bp, Artificial Sequence
  chemically synthesized
aaatcaagcttcaagagcgg

SEQ ID NO: 25803 - DNA, 20 bp, Artificial Sequence
  chemically synthesized
aatcaagcttcaagagcgga

SEQ ID NO: 25804 - DNA, 20 bp, Artificial Sequence
  chemically synthesized
agcttcaagagcggaaggat

SEQ ID NO: 25805 - DNA, 20 bp, Artificial Sequence
  chemically synthesized
gcttcaagagcggaaggatc

SEQ ID NO: 25806 - DNA, 20 bp, Artificial Sequence
  chemically synthesized
cttcaagagcggaaggatca

SEQ ID NO: 25807 - DNA, 20 bp, Artificial Sequence
  chemically synthesized
aatgaaggttttgggagtta

SEQ ID NO: 25808 - DNA, 20 bp, Artificial Sequence
  chemically synthesized
ataatgaaggttttgggagt

SEQ ID NO: 25809 - DNA, 20 bp, Artificial Sequence
  chemically synthesized
atatataatgaaggttttgg

SEQ ID NO: 25810 - DNA, 20 bp, Artificial Sequence
  chemically synthesized
ttatatataatgaaggtttt

SEQ ID NO: 25811 - DNA, 20 bp, Artificial Sequence
  chemically synthesized
tttatatataatgaaggttt

SEQ ID NO: 25812 - DNA, 20 bp, Artificial Sequence
  chemically synthesized
gtatgttttatatataatga

SEQ ID NO: 25813 - DNA, 20 bp, Artificial Sequence
  chemically synthesized
tgtatgttttatatataatg

SEQ ID NO: 25814 - DNA, 20 bp, Artificial Sequence
  chemically synthesized
ttatggatccataattatta

SEQ ID NO: 25815 - DNA, 20 bp, Artificial Sequence
  chemically synthesized
catacaatccataataatta

SEQ ID NO: 25816 - DNA, 20 bp, Artificial Sequence
  chemically synthesized
cataataattatggatccat

SEQ ID NO: 25817 - DNA, 20 bp, Artificial Sequence
  chemically synthesized
ataataattatggatccata

SEQ ID NO: 25818 - DNA, 20 bp, Artificial Sequence
  chemically synthesized
ttagaagacatttatcctta

SEQ ID NO: 25819 - DNA, 20 bp, Artificial Sequence
  chemically synthesized
aaggataaatgtcttctaaa

SEQ ID NO: 25820 - DNA, 20 bp, Artificial Sequence
  chemically synthesized
actgctttgtagctttttag

SEQ ID NO: 25821 - DNA, 20 bp, Artificial Sequence
  chemically synthesized
aacactgctttgtagctttt

SEQ ID NO: 25822 - DNA, 20 bp, Artificial Sequence
  chemically synthesized
atgtcttctaaaaagctaca

SEQ ID NO: 25823 - DNA, 20 bp, Artificial Sequence
  chemically synthesized
tcttctaaaaagctacaaag

SEQ ID NO: 25824 - DNA, 20 bp, Artificial Sequence
  chemically synthesized
gatcaggcaacactgctttg

SEQ ID NO: 25825 - DNA, 20 bp, Artificial Sequence
  chemically synthesized
ctaatgatttttaaaagatc

SEQ ID NO: 25826 - DNA, 20 bp, Artificial Sequence
  chemically synthesized
actaatgatttttaaaagat

SEQ ID NO: 25827 - DNA, 20 bp, Artificial Sequence
  chemically synthesized
ataatactaatgatttttaa

SEQ ID NO: 25828 - DNA, 20 bp, Artificial Sequence
  chemically synthesized
cctgatcttttaaaaatcat

SEQ ID NO: 25829 - DNA, 20 bp, Artificial Sequence
  chemically synthesized
tattttaaatacatttaaaa

SEQ ID NO: 25830 - DNA, 20 bp, Artificial Sequence
  chemically synthesized
tgtatttaaatatgtatttg

SEQ ID NO: 25831 - DNA, 20 bp, Artificial Sequence
  chemically synthesized
aaagagtcttttttaatcag

SEQ ID NO: 25832 - DNA, 20 bp, Artificial Sequence
  chemically synthesized
agtaatactactgattaaaa

SEQ ID NO: 25833 - DNA, 20 bp, Artificial Sequence
  chemically synthesized
cctaaagagtcttttttaat

SEQ ID NO: 25834 - DNA, 20 bp, Artificial Sequence
  chemically synthesized
actgattaaaaaagactctt

SEQ ID NO: 25835 - DNA, 20 bp, Artificial Sequence
  chemically synthesized
ctgattaaaaaagactcttt

SEQ ID NO: 25836 - DNA, 20 bp, Artificial Sequence
  chemically synthesized
attaaaaaagactctttagg

SEQ ID NO: 25837 - DNA, 20 bp, Artificial Sequence
  chemically synthesized
ataaaacagttctgcctaaa

SEQ ID NO: 25838 - DNA, 20 bp, Artificial Sequence
  chemically synthesized
ttataaaacagttctgccta

SEQ ID NO: 25839 - DNA, 20 bp, Artificial Sequence
  chemically synthesized
tcttttaagcagttataaaa

SEQ ID NO: 25840 - DNA, 20 bp, Artificial Sequence
  chemically synthesized
actgttttataactgcttaa

SEQ ID NO: 25841 - DNA, 20 bp, Artificial Sequence
  chemically synthesized
atagatgaatgtcttttaag

SEQ ID NO: 25842 - DNA, 20 bp, Artificial Sequence
  chemically synthesized
tggatagatgaatgtctttt

SEQ ID NO: 25843 - DNA, 20 bp, Artificial Sequence
  chemically synthesized
atagatgaaaggattatgga

SEQ ID NO: 25844 - DNA, 20 bp, Artificial Sequence
  chemically synthesized
aaggatagatgaaaggatta

SEQ ID NO: 25845 - DNA, 20 bp, Artificial Sequence
  chemically synthesized
atattgaaaggatagatgaa

SEQ ID NO: 25846 - DNA, 20 bp, Artificial Sequence
  chemically synthesized
aatattgaaaggatagatga

SEQ ID NO: 25847 - DNA, 20 bp, Artificial Sequence
  chemically synthesized
cacaataaatattgaaagga

SEQ ID NO: 25848 - DNA, 20 bp, Artificial Sequence
  chemically synthesized
catgcacaataaatattgaa

SEQ ID NO: 25849 - DNA, 20 bp, Artificial Sequence
  chemically synthesized
acatgcacaataaatattga

SEQ ID NO: 25850 - DNA, 20 bp, Artificial Sequence
  chemically synthesized
atttattgtgcatgtactat

SEQ ID NO: 25851 - DNA, 20 bp, Artificial Sequence
  chemically synthesized
ttgtgcatgtactataagcc

SEQ ID NO: 25852 - DNA, 20 bp, Artificial Sequence
  chemically synthesized
ttggcatggttcttggctta

SEQ ID NO: 25853 - DNA, 20 bp, Artificial Sequence
  chemically synthesized
catgtacttggcatggttct

SEQ ID NO: 25854 - DNA, 20 bp, Artificial Sequence
  chemically synthesized
tataagccaagaaccatgcc

SEQ ID NO: 25855 - DNA, 20 bp, Artificial Sequence
  chemically synthesized
tgtattccatgtacttggca

SEQ ID NO: 25856 - DNA, 20 bp, Artificial Sequence
  chemically synthesized
caagaaccatgccaagtaca

SEQ ID NO: 25857 - DNA, 20 bp, Artificial Sequence
  chemically synthesized
accagtgtattccatgtact

SEQ ID NO: 25858 - DNA, 20 bp, Artificial Sequence
  chemically synthesized
gccaagtacatggaatacac

SEQ ID NO: 25859 - DNA, 20 bp, Artificial Sequence
  chemically synthesized
cagagatttattttggttac

SEQ ID NO: 25860 - DNA, 20 bp, Artificial Sequence
  chemically synthesized
ataaaggcagagatttattt

SEQ ID NO: 25861 - DNA, 20 bp, Artificial Sequence
  chemically synthesized
ctgcaaagtcaataaaggca

SEQ ID NO: 25862 - DNA, 20 bp, Artificial Sequence
  chemically synthesized
cactgcaaagtcaataaagg

SEQ ID NO: 25863 - DNA, 20 bp, Artificial Sequence
  chemically synthesized
ctacactgcaaagtcaataa

SEQ ID NO: 25864 - DNA, 20 bp, Artificial Sequence
  chemically synthesized
gctacactgcaaagtcaata

SEQ ID NO: 25865 - DNA, 20 bp, Artificial Sequence
  chemically synthesized
ctctgcctttattgactttg

SEQ ID NO: 25866 - DNA, 20 bp, Artificial Sequence
  chemically synthesized
cctttattgactttgcagtg

SEQ ID NO: 25867 - DNA, 20 bp, Artificial Sequence
  chemically synthesized
atctccttcgctacactgca

SEQ ID NO: 25868 - DNA, 20 bp, Artificial Sequence
  chemically synthesized
attgactttgcagtgtagcg

SEQ ID NO: 25869 - DNA, 20 bp, Artificial Sequence
  chemically synthesized
ttgactttgcagtgtagcga

SEQ ID NO: 25870 - DNA, 20 bp, Artificial Sequence
  chemically synthesized
gactttgcagtgtagcgaag

SEQ ID NO: 25871 - DNA, 20 bp, Artificial Sequence
  chemically synthesized
ttgcagtgtagcgaaggaga

SEQ ID NO: 25872 - DNA, 20 bp, Artificial Sequence
  chemically synthesized
aataatcaaatattcatatg

SEQ ID NO: 25873 - DNA, 20 bp, Artificial Sequence
  chemically synthesized
ataatcaaatattcatatgt

SEQ ID NO: 25874 - DNA, 20 bp, Artificial Sequence
  chemically synthesized
tcaaatattcatatgtaggc

SEQ ID NO: 25875 - DNA, 20 bp, Artificial Sequence
  chemically synthesized
caaatattcatatgtaggcc

SEQ ID NO: 25876 - DNA, 20 bp, Artificial Sequence
  chemically synthesized
attcatatgtaggccaggtg

SEQ ID NO: 25877 - DNA, 20 bp, Artificial Sequence
  chemically synthesized
catatgtaggccaggtgcgg

SEQ ID NO: 25878 - DNA, 20 bp, Artificial Sequence
  chemically synthesized
caggcgcgagccaccgcacc

SEQ ID NO: 25879 - DNA, 20 bp, Artificial Sequence
  chemically synthesized
aaggctgggattacaggcgc

SEQ ID NO: 25880 - DNA, 20 bp, Artificial Sequence
  chemically synthesized
gtggctcgcgcctgtaatcc

SEQ ID NO: 25881 - DNA, 20 bp, Artificial Sequence
  chemically synthesized
ctcccaaaggctgggattac

SEQ ID NO: 25882 - DNA, 20 bp, Artificial Sequence
  chemically synthesized
cctcccaaaggctgggatta

SEQ ID NO: 25883 - DNA, 20 bp, Artificial Sequence
  chemically synthesized
gcgcctgtaatcccagcctt

SEQ ID NO: 25884 - DNA, 20 bp, Artificial Sequence
  chemically synthesized
cgcctgtaatcccagccttt

SEQ ID NO: 25885 - DNA, 20 bp, Artificial Sequence
  chemically synthesized
gccttggcctcccaaaggct

SEQ ID NO: 25886 - DNA, 20 bp, Artificial Sequence
  chemically synthesized
tgccttggcctcccaaaggc

SEQ ID NO: 25887 - DNA, 20 bp, Artificial Sequence
  chemically synthesized
cctgtaatcccagcctttgg

SEQ ID NO: 25888 - DNA, 20 bp, Artificial Sequence
  chemically synthesized
ctgtaatcccagcctttggg

SEQ ID NO: 25889 - DNA, 20 bp, Artificial Sequence
  chemically synthesized
tgcctgccttggcctcccaa

SEQ ID NO: 25890 - DNA, 20 bp, Artificial Sequence
  chemically synthesized
ctgcctgccttggcctccca

SEQ ID NO: 25891 - DNA, 20 bp, Artificial Sequence
  chemically synthesized
atcccagcctttgggaggcc

SEQ ID NO: 25892 - DNA, 20 bp, Artificial Sequence
  chemically synthesized
tcccagcctttgggaggcca

SEQ ID NO: 25893 - DNA, 20 bp, Artificial Sequence
  chemically synthesized
cagcctttgggaggccaagg

SEQ ID NO: 25894 - DNA, 20 bp, Artificial Sequence
  chemically synthesized
agcctttgggaggccaaggc

SEQ ID NO: 25895 - DNA, 20 bp, Artificial Sequence
  chemically synthesized
ctttgggaggccaaggcagg

SEQ ID NO: 25896 - DNA, 20 bp, Artificial Sequence
  chemically synthesized
ctcaggtgatctgcctgcct

SEQ ID NO: 25897 - DNA, 20 bp, Artificial Sequence
  chemically synthesized
ccaaggcaggcagatcacct

SEQ ID NO: 25898 - DNA, 20 bp, Artificial Sequence
  chemically synthesized
caaggcaggcagatcacctg

SEQ ID NO: 25899 - DNA, 20 bp, Artificial Sequence
  chemically synthesized
gcaggcagatcacctgaggt

SEQ ID NO: 25900 - DNA, 20 bp, Artificial Sequence
  chemically synthesized
ggtctcgaacttctgacctc

SEQ ID NO: 25901 - DNA, 20 bp, Artificial Sequence
  chemically synthesized
ggcagatcacctgaggtcag

SEQ ID NO: 25902 - DNA, 20 bp, Artificial Sequence
  chemically synthesized
tggtctcgaacttctgacct

SEQ ID NO: 25903 - DNA, 20 bp, Artificial Sequence
  chemically synthesized
tcacctgaggtcagaagttc

SEQ ID NO: 25904 - DNA, 20 bp, Artificial Sequence
  chemically synthesized
gtcagaagttcgagaccacc

SEQ ID NO: 25905 - DNA, 20 bp, Artificial Sequence
  chemically synthesized
tcagaagttcgagaccacct

SEQ ID NO: 25906 - DNA, 20 bp, Artificial Sequence
  chemically synthesized
tttcgccatgttggcccagg

SEQ ID NO: 25907 - DNA, 20 bp, Artificial Sequence
  chemically synthesized
gggtttcgccatgttggccc

SEQ ID NO: 25908 - DNA, 20 bp, Artificial Sequence
  chemically synthesized
ggggtttcgccatgttggcc

SEQ ID NO: 25909 - DNA, 20 bp, Artificial Sequence
  chemically synthesized
cgagaccacctgggccaaca

SEQ ID NO: 25910 - DNA, 20 bp, Artificial Sequence
  chemically synthesized
gagacggggtttcgccatgt

SEQ ID NO: 25911 - DNA, 20 bp, Artificial Sequence
  chemically synthesized
ttgtatttttagtagagacg

SEQ ID NO: 25912 - DNA, 20 bp, Artificial Sequence
  chemically synthesized
tttgtatttttagtagagac

SEQ ID NO: 25913 - DNA, 20 bp, Artificial Sequence
  chemically synthesized
ttttgtatttttagtagaga

SEQ ID NO: 25914 - DNA, 20 bp, Artificial Sequence
  chemically synthesized
aattttttgtatttttagta

SEQ ID NO: 25915 - DNA, 20 bp, Artificial Sequence
  chemically synthesized
ctaattttttgtatttttag

SEQ ID NO: 25916 - DNA, 20 bp, Artificial Sequence
  chemically synthesized
cagctaattttttgtatttt

SEQ ID NO: 25917 - DNA, 20 bp, Artificial Sequence
  chemically synthesized
ctactaaaaatacaaaaaat

SEQ ID NO: 25918 - DNA, 20 bp, Artificial Sequence
  chemically synthesized
taaaaatacaaaaaattagc

SEQ ID NO: 25919 - DNA, 20 bp, Artificial Sequence
  chemically synthesized
tacaaaaaattagctggatg

SEQ ID NO: 25920 - DNA, 20 bp, Artificial Sequence
  chemically synthesized
aaaaaattagctggatgcgg

SEQ ID NO: 25921 - DNA, 20 bp, Artificial Sequence
  chemically synthesized
caggtgcctgccgccgcatc

SEQ ID NO: 25922 - DNA, 20 bp, Artificial Sequence
  chemically synthesized
aaattagctggatgcggcgg

SEQ ID NO: 25923 - DNA, 20 bp, Artificial Sequence
  chemically synthesized
aattagctggatgcggcggc

SEQ ID NO: 25924 - DNA, 20 bp, Artificial Sequence
  chemically synthesized
gcggcaggcacctgtaatcc

SEQ ID NO: 25925 - DNA, 20 bp, Artificial Sequence
  chemically synthesized
caggtagtagctgggattac

SEQ ID NO: 25926 - DNA, 20 bp, Artificial Sequence
  chemically synthesized
ccaggtagtagctgggatta

SEQ ID NO: 25927 - DNA, 20 bp, Artificial Sequence
  chemically synthesized
cagcctcccaggtagtagct

SEQ ID NO: 25928 - DNA, 20 bp, Artificial Sequence
  chemically synthesized
tcagcctcccaggtagtagc

SEQ ID NO: 25929 - DNA, 20 bp, Artificial Sequence
  chemically synthesized
ctgtaatcccagctactacc

SEQ ID NO: 25930 - DNA, 20 bp, Artificial Sequence
  chemically synthesized
tgtaatcccagctactacct

SEQ ID NO: 25931 - DNA, 20 bp, Artificial Sequence
  chemically synthesized
tgcctcagcctcccaggtag

SEQ ID NO: 25932 - DNA, 20 bp, Artificial Sequence
  chemically synthesized
taatcccagctactacctgg

SEQ ID NO: 25933 - DNA, 20 bp, Artificial Sequence
  chemically synthesized
aatcccagctactacctggg

SEQ ID NO: 25934 - DNA, 20 bp, Artificial Sequence
  chemically synthesized
tcctgcctcagcctcccagg

SEQ ID NO: 25935 - DNA, 20 bp, Artificial Sequence
  chemically synthesized
ttctcctgcctcagcctccc

SEQ ID NO: 25936 - DNA, 20 bp, Artificial Sequence
  chemically synthesized
cagctactacctgggaggct

SEQ ID NO: 25937 - DNA, 20 bp, Artificial Sequence
  chemically synthesized
attctcctgcctcagcctcc

SEQ ID NO: 25938 - DNA, 20 bp, Artificial Sequence
  chemically synthesized
agctactacctgggaggctg

SEQ ID NO: 25939 - DNA, 20 bp, Artificial Sequence
  chemically synthesized
tactacctgggaggctgagg

SEQ ID NO: 25940 - DNA, 20 bp, Artificial Sequence
  chemically synthesized
actacctgggaggctgaggc

SEQ ID NO: 25941 - DNA, 20 bp, Artificial Sequence
  chemically synthesized
tacctgggaggctgaggcag

SEQ ID NO: 25942 - DNA, 20 bp, Artificial Sequence
  chemically synthesized
ttcaagcgattctcctgcct

SEQ ID NO: 25943 - DNA, 20 bp, Artificial Sequence
  chemically synthesized
gcaggagaatcgcttgaacc

SEQ ID NO: 25944 - DNA, 20 bp, Artificial Sequence
  chemically synthesized
caggagaatcgcttgaacct

SEQ ID NO: 25945 - DNA, 20 bp, Artificial Sequence
  chemically synthesized
agcctccacctcccaggttc

SEQ ID NO: 25946 - DNA, 20 bp, Artificial Sequence
  chemically synthesized
ggagaatcgcttgaacctgg

SEQ ID NO: 25947 - DNA, 20 bp, Artificial Sequence
  chemically synthesized
gagaatcgcttgaacctggg

SEQ ID NO: 25948 - DNA, 20 bp, Artificial Sequence
  chemically synthesized
aatcgcttgaacctgggagg

SEQ ID NO: 25949 - DNA, 20 bp, Artificial Sequence
  chemically synthesized
cactgcagcctccacctccc

SEQ ID NO: 25950 - DNA, 20 bp, Artificial Sequence
  chemically synthesized
tcgcttgaacctgggaggtg

SEQ ID NO: 25951 - DNA, 20 bp, Artificial Sequence
  chemically synthesized
tcactgcagcctccacctcc

SEQ ID NO: 25952 - DNA, 20 bp, Artificial Sequence
  chemically synthesized
cgcttgaacctgggaggtgg

SEQ ID NO: 25953 - DNA, 20 bp, Artificial Sequence
  chemically synthesized
aacctgggaggtggaggctg

SEQ ID NO: 25954 - DNA, 20 bp, Artificial Sequence
  chemically synthesized
tgggaggtggaggctgcagt

SEQ ID NO: 25955 - DNA, 20 bp, Artificial Sequence
  chemically synthesized
ggcacaatctcggctcactg

SEQ ID NO: 25956 - DNA, 20 bp, Artificial Sequence
  chemically synthesized
ggtggaggctgcagtgagcc

SEQ ID NO: 25957 - DNA, 20 bp, Artificial Sequence
  chemically synthesized
ggagtgcaacggcacaatct

SEQ ID NO: 25958 - DNA, 20 bp, Artificial Sequence
  chemically synthesized
ttgcccaggctggagtgcaa

SEQ ID NO: 25959 - DNA, 20 bp, Artificial Sequence
  chemically synthesized
gagattgtgccgttgcactc

SEQ ID NO: 25960 - DNA, 20 bp, Artificial Sequence
  chemically synthesized
tgtgccgttgcactccagcc

SEQ ID NO: 25961 - DNA, 20 bp, Artificial Sequence
  chemically synthesized
gtgccgttgcactccagcct

SEQ ID NO: 25962 - DNA, 20 bp, Artificial Sequence
  chemically synthesized
tgctcttgttgcccaggctg

SEQ ID NO: 25963 - DNA, 20 bp, Artificial Sequence
  chemically synthesized
tttgctcttgttgcccaggc

SEQ ID NO: 25964 - DNA, 20 bp, Artificial Sequence
  chemically synthesized
tgcactccagcctgggcaac

SEQ ID NO: 25965 - DNA, 20 bp, Artificial Sequence
  chemically synthesized
gagttttgctcttgttgccc

SEQ ID NO: 25966 - DNA, 20 bp, Artificial Sequence
  chemically synthesized
ggagttttgctcttgttgcc

SEQ ID NO: 25967 - DNA, 20 bp, Artificial Sequence
  chemically synthesized
cactccagcctgggcaacaa

SEQ ID NO: 25968 - DNA, 20 bp, Artificial Sequence
  chemically synthesized
ttgttagtttgtttgagacg

SEQ ID NO: 25969 - DNA, 20 bp, Artificial Sequence
  chemically synthesized
gtttgttagtttgtttgaga

SEQ ID NO: 25970 - DNA, 20 bp, Artificial Sequence
  chemically synthesized
atttgtttgttagtttgttt

SEQ ID NO: 25971 - DNA, 20 bp, Artificial Sequence
  chemically synthesized
acatatgaatatttgtttgt

SEQ ID NO: 25972 - DNA, 20 bp, Artificial Sequence
  chemically synthesized
acaaatattcatatgtactg

SEQ ID NO: 25973 - DNA, 20 bp, Artificial Sequence
  chemically synthesized
tttccttcaccattttacca

SEQ ID NO: 25974 - DNA, 20 bp, Artificial Sequence
  chemically synthesized
tcatatgtactgtggtaaaa

SEQ ID NO: 25975 - DNA, 20 bp, Artificial Sequence
  chemically synthesized
tgtactgtggtaaaatggtg

SEQ ID NO: 25976 - DNA, 20 bp, Artificial Sequence
  chemically synthesized
gtactgtggtaaaatggtga

SEQ ID NO: 25977 - DNA, 20 bp, Artificial Sequence
  chemically synthesized
aaaatggtgaaggaaacaca

SEQ ID NO: 25978 - DNA, 20 bp, Artificial Sequence
  chemically synthesized
aaatggtgaaggaaacacac

SEQ ID NO: 25979 - DNA, 20 bp, Artificial Sequence
  chemically synthesized
tggtgaaggaaacacacagg

SEQ ID NO: 25980 - DNA, 20 bp, Artificial Sequence
  chemically synthesized
ggaaacacacaggaagtgat

SEQ ID NO: 25981 - DNA, 20 bp, Artificial Sequence
  chemically synthesized
aagtgatgagactgtataca

SEQ ID NO: 25982 - DNA, 20 bp, Artificial Sequence
  chemically synthesized
agtgatgagactgtatacat

SEQ ID NO: 25983 - DNA, 20 bp, Artificial Sequence
  chemically synthesized
cctatgtttccctatgtata

SEQ ID NO: 25984 - DNA, 20 bp, Artificial Sequence
  chemically synthesized
gtgatgagactgtatacata

SEQ ID NO: 25985 - DNA, 20 bp, Artificial Sequence
  chemically synthesized
actgtatacatagggaaaca

SEQ ID NO: 25986 - DNA, 20 bp, Artificial Sequence
  chemically synthesized
ctgtatacatagggaaacat

SEQ ID NO: 25987 - DNA, 20 bp, Artificial Sequence
  chemically synthesized
acatagggaaacataggtcc

SEQ ID NO: 25988 - DNA, 20 bp, Artificial Sequence
  chemically synthesized
atagggaaacataggtccga

SEQ ID NO: 25989 - DNA, 20 bp, Artificial Sequence
  chemically synthesized
tagggaaacataggtccgag

SEQ ID NO: 25990 - DNA, 20 bp, Artificial Sequence
  chemically synthesized
accttctccaagaagcctct

SEQ ID NO: 25991 - DNA, 20 bp, Artificial Sequence
  chemically synthesized
cataggtccgagaggcttct

SEQ ID NO: 25992 - DNA, 20 bp, Artificial Sequence
  chemically synthesized
taggtccgagaggcttcttg

SEQ ID NO: 25993 - DNA, 20 bp, Artificial Sequence
  chemically synthesized
gtccgagaggcttcttggag

SEQ ID NO: 25994 - DNA, 20 bp, Artificial Sequence
  chemically synthesized
tcaatgtcaccttctccaag

SEQ ID NO: 25995 - DNA, 20 bp, Artificial Sequence
  chemically synthesized
tccgagaggcttcttggaga

SEQ ID NO: 25996 - DNA, 20 bp, Artificial Sequence
  chemically synthesized
gcttcaatgtcaccttctcc

SEQ ID NO: 25997 - DNA, 20 bp, Artificial Sequence
  chemically synthesized
tcttggagaaggtgacattg

SEQ ID NO: 25998 - DNA, 20 bp, Artificial Sequence
  chemically synthesized
gagaaggtgacattgaagca

SEQ ID NO: 25999 - DNA, 20 bp, Artificial Sequence
  chemically synthesized
gacattgaagcaaagacttg

SEQ ID NO: 26000 - DNA, 20 bp, Artificial Sequence
  chemically synthesized
acattgaagcaaagacttga

SEQ ID NO: 26001 - DNA, 20 bp, Artificial Sequence
  chemically synthesized
gcacgctcccatcatccttc

SEQ ID NO: 26002 - DNA, 20 bp, Artificial Sequence
  chemically synthesized
agcaaagacttgaaggatga

SEQ ID NO: 26003 - DNA, 20 bp, Artificial Sequence
  chemically synthesized
gcaaagacttgaaggatgat

SEQ ID NO: 26004 - DNA, 20 bp, Artificial Sequence
  chemically synthesized
aaagacttgaaggatgatgg

SEQ ID NO: 26005 - DNA, 20 bp, Artificial Sequence
  chemically synthesized
gaaggatgatgggagcgtgc

SEQ ID NO: 26006 - DNA, 20 bp, Artificial Sequence
  chemically synthesized
aaggatgatgggagcgtgcc

SEQ ID NO: 26007 - DNA, 20 bp, Artificial Sequence
  chemically synthesized
atgatgggagcgtgccaggt

SEQ ID NO: 26008 - DNA, 20 bp, Artificial Sequence
  chemically synthesized
tacgctgctgtgttcttacc

SEQ ID NO: 26009 - DNA, 20 bp, Artificial Sequence
  chemically synthesized
gagcgtgccaggtaagaaca

SEQ ID NO: 26010 - DNA, 20 bp, Artificial Sequence
  chemically synthesized
cgtgccaggtaagaacacag

SEQ ID NO: 26011 - DNA, 20 bp, Artificial Sequence
  chemically synthesized
gtaagaacacagcagcgtaa

SEQ ID NO: 26012 - DNA, 20 bp, Artificial Sequence
  chemically synthesized
taagaacacagcagcgtaat

SEQ ID NO: 26013 - DNA, 20 bp, Artificial Sequence
  chemically synthesized
aacacagcagcgtaataggt

SEQ ID NO: 26014 - DNA, 20 bp, Artificial Sequence
  chemically synthesized
aaaaaaaaaaaaaaaaaaaa

SEQ ID NO: 26015 - DNA, 20 bp, Artificial Sequence
  chemically synthesized
aaaaaaaaaaaaaagctctg

SEQ ID NO: 26016 - DNA, 20 bp, Artificial Sequence
  chemically synthesized
aaaaaaaaaaagctctgaag

SEQ ID NO: 26017 - DNA, 20 bp, Artificial Sequence
  chemically synthesized
aaaaaaaaagctctgaagca

SEQ ID NO: 26018 - DNA, 20 bp, Artificial Sequence
  chemically synthesized
ccaccttcttctctgcttca

SEQ ID NO: 26019 - DNA, 20 bp, Artificial Sequence
  chemically synthesized
ccccaccttcttctctgctt

SEQ ID NO: 26020 - DNA, 20 bp, Artificial Sequence
  chemically synthesized
aaaaaagctctgaagcagag

SEQ ID NO: 26021 - DNA, 20 bp, Artificial Sequence
  chemically synthesized
aaagctctgaagcagagaag

SEQ ID NO: 26022 - DNA, 20 bp, Artificial Sequence
  chemically synthesized
aagctctgaagcagagaaga

SEQ ID NO: 26023 - DNA, 20 bp, Artificial Sequence
  chemically synthesized
ctctgaagcagagaagaagg

SEQ ID NO: 26024 - DNA, 20 bp, Artificial Sequence
  chemically synthesized
tctgaagcagagaagaaggt

SEQ ID NO: 26025 - DNA, 20 bp, Artificial Sequence
  chemically synthesized
ctgaagcagagaagaaggtg

SEQ ID NO: 26026 - DNA, 20 bp, Artificial Sequence
  chemically synthesized
agagaagaaggtggggcttt

SEQ ID NO: 26027 - DNA, 20 bp, Artificial Sequence
  chemically synthesized
tggccttctaaggattctta

SEQ ID NO: 26028 - DNA, 20 bp, Artificial Sequence
  chemically synthesized
ggtggggctttaagaatcct

SEQ ID NO: 26029 - DNA, 20 bp, Artificial Sequence
  chemically synthesized
ggggctttaagaatccttag

SEQ ID NO: 26030 - DNA, 20 bp, Artificial Sequence
  chemically synthesized
gggctttaagaatccttaga

SEQ ID NO: 26031 - DNA, 20 bp, Artificial Sequence
  chemically synthesized
tcagcaatattggccttcta

SEQ ID NO: 26032 - DNA, 20 bp, Artificial Sequence
  chemically synthesized
ttcagcaatattggccttct

SEQ ID NO: 26033 - DNA, 20 bp, Artificial Sequence
  chemically synthesized
ctctgagatttcagcaatat

SEQ ID NO: 26034 - DNA, 20 bp, Artificial Sequence
  chemically synthesized
ggccaatattgctgaaatct

SEQ ID NO: 26035 - DNA, 20 bp, Artificial Sequence
  chemically synthesized
ctccttcctctctgagattt

SEQ ID NO: 26036 - DNA, 20 bp, Artificial Sequence
  chemically synthesized
ccaatattgctgaaatctca

SEQ ID NO: 26037 - DNA, 20 bp, Artificial Sequence
  chemically synthesized
aatattgctgaaatctcaga

SEQ ID NO: 26038 - DNA, 20 bp, Artificial Sequence
  chemically synthesized
atattgctgaaatctcagag

SEQ ID NO: 26039 - DNA, 20 bp, Artificial Sequence
  chemically synthesized
ttgctgaaatctcagagagg

SEQ ID NO: 26040 - DNA, 20 bp, Artificial Sequence
  chemically synthesized
actcttcctccttcctctct

SEQ ID NO: 26041 - DNA, 20 bp, Artificial Sequence
  chemically synthesized
tgctgaaatctcagagagga

SEQ ID NO: 26042 - DNA, 20 bp, Artificial Sequence
  chemically synthesized
ctgaaatctcagagaggaag

SEQ ID NO: 26043 - DNA, 20 bp, Artificial Sequence
  chemically synthesized
tgaaatctcagagaggaagg

SEQ ID NO: 26044 - DNA, 20 bp, Artificial Sequence
  chemically synthesized
aatctcagagaggaaggagg

SEQ ID NO: 26045 - DNA, 20 bp, Artificial Sequence
  chemically synthesized
tctcagagaggaaggaggaa

SEQ ID NO: 26046 - DNA, 20 bp, Artificial Sequence
  chemically synthesized
cagagaggaaggaggaagag

SEQ ID NO: 26047 - DNA, 20 bp, Artificial Sequence
  chemically synthesized
agagaggaaggaggaagagt

SEQ ID NO: 26048 - DNA, 20 bp, Artificial Sequence
  chemically synthesized
ggaaggaggaagagtgggca

SEQ ID NO: 26049 - DNA, 20 bp, Artificial Sequence
  chemically synthesized
gaggaagagtgggcacagat

SEQ ID NO: 26050 - DNA, 20 bp, Artificial Sequence
  chemically synthesized
aggaagagtgggcacagata

SEQ ID NO: 26051 - DNA, 20 bp, Artificial Sequence
  chemically synthesized
tgggcacagataaggcctga

SEQ ID NO: 26052 - DNA, 20 bp, Artificial Sequence
  chemically synthesized
gggcacagataaggcctgac

SEQ ID NO: 26053 - DNA, 20 bp, Artificial Sequence
  chemically synthesized
cacagataaggcctgacagg

SEQ ID NO: 26054 - DNA, 20 bp, Artificial Sequence
  chemically synthesized
acagataaggcctgacaggt

SEQ ID NO: 26055 - DNA, 20 bp, Artificial Sequence
  chemically synthesized
cctccccctgcctacctgtc

SEQ ID NO: 26056 - DNA, 20 bp, Artificial Sequence
  chemically synthesized
gcctccccctgcctacctgt

SEQ ID NO: 26057 - DNA, 20 bp, Artificial Sequence
  chemically synthesized
gataaggcctgacaggtagg

SEQ ID NO: 26058 - DNA, 20 bp, Artificial Sequence
  chemically synthesized
ataaggcctgacaggtaggc

SEQ ID NO: 26059 - DNA, 20 bp, Artificial Sequence
  chemically synthesized
taaggcctgacaggtaggca

SEQ ID NO: 26060 - DNA, 20 bp, Artificial Sequence
  chemically synthesized
aaggcctgacaggtaggcag

SEQ ID NO: 26061 - DNA, 20 bp, Artificial Sequence
  chemically synthesized
aggcctgacaggtaggcagg

SEQ ID NO: 26062 - DNA, 20 bp, Artificial Sequence
  chemically synthesized
gcctgacaggtaggcagggg

SEQ ID NO: 26063 - DNA, 20 bp, Artificial Sequence
  chemically synthesized
cctgacaggtaggcaggggg

SEQ ID NO: 26064 - DNA, 20 bp, Artificial Sequence
  chemically synthesized
aggcagggggaggcccactg

SEQ ID NO: 26065 - DNA, 20 bp, Artificial Sequence
  chemically synthesized
gcagggggaggcccactgca

SEQ ID NO: 26066 - DNA, 20 bp, Artificial Sequence
  chemically synthesized
gatgtgcagggctctgcagt

SEQ ID NO: 26067 - DNA, 20 bp, Artificial Sequence
  chemically synthesized
cgatgtgcagggctctgcag

SEQ ID NO: 26068 - DNA, 20 bp, Artificial Sequence
  chemically synthesized
acacgatgtgcagggctctg

SEQ ID NO: 26069 - DNA, 20 bp, Artificial Sequence
  chemically synthesized
aatccttcacacgatgtgca

SEQ ID NO: 26070 - DNA, 20 bp, Artificial Sequence
  chemically synthesized
aaatccttcacacgatgtgc

SEQ ID NO: 26071 - DNA, 20 bp, Artificial Sequence
  chemically synthesized
aaaatccttcacacgatgtg

SEQ ID NO: 26072 - DNA, 20 bp, Artificial Sequence
  chemically synthesized
agagccctgcacatcgtgtg

SEQ ID NO: 26073 - DNA, 20 bp, Artificial Sequence
  chemically synthesized
gagccctgcacatcgtgtga

SEQ ID NO: 26074 - DNA, 20 bp, Artificial Sequence
  chemically synthesized
gcacatcgtgtgaaggattt

SEQ ID NO: 26075 - DNA, 20 bp, Artificial Sequence
  chemically synthesized
cacatcgtgtgaaggatttt

SEQ ID NO: 26076 - DNA, 20 bp, Artificial Sequence
  chemically synthesized
gtgtgaaggattttgggtgt

SEQ ID NO: 26077 - DNA, 20 bp, Artificial Sequence
  chemically synthesized
tgtgaaggattttgggtgtt

SEQ ID NO: 26078 - DNA, 20 bp, Artificial Sequence
  chemically synthesized
attttgggtgttgggacttc

SEQ ID NO: 26079 - DNA, 20 bp, Artificial Sequence
  chemically synthesized
catctgctgtgtttaactag

SEQ ID NO: 26080 - DNA, 20 bp, Artificial Sequence
  chemically synthesized
ctccatctgctgtgtttaac

SEQ ID NO: 26081 - DNA, 20 bp, Artificial Sequence
  chemically synthesized
ttgggacttctagttaaaca

SEQ ID NO: 26082 - DNA, 20 bp, Artificial Sequence
  chemically synthesized
ggacttctagttaaacacag

SEQ ID NO: 26083 - DNA, 20 bp, Artificial Sequence
  chemically synthesized
ttctagttaaacacagcaga

SEQ ID NO: 26084 - DNA, 20 bp, Artificial Sequence
  chemically synthesized
ctagttaaacacagcagatg

SEQ ID NO: 26085 - DNA, 20 bp, Artificial Sequence
  chemically synthesized
gttaaacacagcagatggag

SEQ ID NO: 26086 - DNA, 20 bp, Artificial Sequence
  chemically synthesized
agggataaagagagacaaat

SEQ ID NO: 26087 - DNA, 20 bp, Artificial Sequence
  chemically synthesized
tagagtttcagggataaaga

SEQ ID NO: 26088 - DNA, 20 bp, Artificial Sequence
  chemically synthesized
ggtagagtttcagggataaa

SEQ ID NO: 26089 - DNA, 20 bp, Artificial Sequence
  chemically synthesized
ctggtagagtttcagggata

SEQ ID NO: 26090 - DNA, 20 bp, Artificial Sequence
  chemically synthesized
atcaacctggtagagtttca

SEQ ID NO: 26091 - DNA, 20 bp, Artificial Sequence
  chemically synthesized
tatcaacctggtagagtttc

SEQ ID NO: 26092 - DNA, 20 bp, Artificial Sequence
  chemically synthesized
ctatcaacctggtagagttt

SEQ ID NO: 26093 - DNA, 20 bp, Artificial Sequence
  chemically synthesized
ctttatccctgaaactctac

SEQ ID NO: 26094 - DNA, 20 bp, Artificial Sequence
  chemically synthesized
tttatccctgaaactctacc

SEQ ID NO: 26095 - DNA, 20 bp, Artificial Sequence
  chemically synthesized
cctcttctatcaacctggta

SEQ ID NO: 26096 - DNA, 20 bp, Artificial Sequence
  chemically synthesized
ttcctcttctatcaacctgg

SEQ ID NO: 26097 - DNA, 20 bp, Artificial Sequence
  chemically synthesized
ctgaaactctaccaggttga

SEQ ID NO: 26098 - DNA, 20 bp, Artificial Sequence
  chemically synthesized
ttattcctcttctatcaacc

SEQ ID NO: 26099 - DNA, 20 bp, Artificial Sequence
  chemically synthesized
aaactctaccaggttgatag

SEQ ID NO: 26100 - DNA, 20 bp, Artificial Sequence
  chemically synthesized
actctaccaggttgatagaa

SEQ ID NO: 26101 - DNA, 20 bp, Artificial Sequence
  chemically synthesized
ctctaccaggttgatagaag

SEQ ID NO: 26102 - DNA, 20 bp, Artificial Sequence
  chemically synthesized
gatagaagaggaataaaaaa

SEQ ID NO: 26103 - DNA, 20 bp, Artificial Sequence
  chemically synthesized
aaaaaatggcatttacccaa

SEQ ID NO: 26104 - DNA, 20 bp, Artificial Sequence
  chemically synthesized
tgttttgttaattttctttt

SEQ ID NO: 26105 - DNA, 20 bp, Artificial Sequence
  chemically synthesized
ctgttttgttaattttcttt

SEQ ID NO: 26106 - DNA, 20 bp, Artificial Sequence
  chemically synthesized
ccaaaagaaaattaacaaaa

SEQ ID NO: 26107 - DNA, 20 bp, Artificial Sequence
  chemically synthesized
caaaagaaaattaacaaaac

SEQ ID NO: 26108 - DNA, 20 bp, Artificial Sequence
  chemically synthesized
aaagaaaattaacaaaacag

SEQ ID NO: 26109 - DNA, 20 bp, Artificial Sequence
  chemically synthesized
agaaaattaacaaaacagga

SEQ ID NO: 26110 - DNA, 20 bp, Artificial Sequence
  chemically synthesized
gaaaattaacaaaacaggag

SEQ ID NO: 26111 - DNA, 20 bp, Artificial Sequence
  chemically synthesized
aaattaacaaaacaggagag

SEQ ID NO: 26112 - DNA, 20 bp, Artificial Sequence
  chemically synthesized
aacaaaacaggagaggagat

SEQ ID NO: 26113 - DNA, 20 bp, Artificial Sequence
  chemically synthesized
aacaggagaggagatgagaa

SEQ ID NO: 26114 - DNA, 20 bp, Artificial Sequence
  chemically synthesized
gagaggagatgagaacagat

SEQ ID NO: 26115 - DNA, 20 bp, Artificial Sequence
  chemically synthesized
gaggagatgagaacagatca

SEQ ID NO: 26116 - DNA, 20 bp, Artificial Sequence
  chemically synthesized
atgagaacagatcagagctc

SEQ ID NO: 26117 - DNA, 20 bp, Artificial Sequence
  chemically synthesized
tctaagccaccaaaatactg

SEQ ID NO: 26118 - DNA, 20 bp, Artificial Sequence
  chemically synthesized
agatcagagctccagtattt

SEQ ID NO: 26119 - DNA, 20 bp, Artificial Sequence
  chemically synthesized
tttctaagccaccaaaatac

SEQ ID NO: 26120 - DNA, 20 bp, Artificial Sequence
  chemically synthesized
tcagagctccagtattttgg

SEQ ID NO: 26121 - DNA, 20 bp, Artificial Sequence
  chemically synthesized
gctccagtattttggtggct

SEQ ID NO: 26122 - DNA, 20 bp, Artificial Sequence
  chemically synthesized
ttaccagcaggtcattttct

SEQ ID NO: 26123 - DNA, 20 bp, Artificial Sequence
  chemically synthesized
tggcttagaaaatgacctgc

SEQ ID NO: 26124 - DNA, 20 bp, Artificial Sequence
  chemically synthesized
ctcctaagttggttaccagc

SEQ ID NO: 26125 - DNA, 20 bp, Artificial Sequence
  chemically synthesized
tctcctaagttggttaccag

SEQ ID NO: 26126 - DNA, 20 bp, Artificial Sequence
  chemically synthesized
tggtctcctaagttggttac

SEQ ID NO: 26127 - DNA, 20 bp, Artificial Sequence
  chemically synthesized
tgacctgctggtaaccaact

SEQ ID NO: 26128 - DNA, 20 bp, Artificial Sequence
  chemically synthesized
gacctgctggtaaccaactt

SEQ ID NO: 26129 - DNA, 20 bp, Artificial Sequence
  chemically synthesized
cctgctggtaaccaacttag

SEQ ID NO: 26130 - DNA, 20 bp, Artificial Sequence
  chemically synthesized
atttctctggtctcctaagt

SEQ ID NO: 26131 - DNA, 20 bp, Artificial Sequence
  chemically synthesized
tggtaaccaacttaggagac

SEQ ID NO: 26132 - DNA, 20 bp, Artificial Sequence
  chemically synthesized
tgggatttctctggtctcct

SEQ ID NO: 26133 - DNA, 20 bp, Artificial Sequence
  chemically synthesized
gtaaccaacttaggagacca

SEQ ID NO: 26134 - DNA, 20 bp, Artificial Sequence
  chemically synthesized
aattgagcttgggatttctc

SEQ ID NO: 26135 - DNA, 20 bp, Artificial Sequence
  chemically synthesized
taggagaccagagaaatccc

SEQ ID NO: 26136 - DNA, 20 bp, Artificial Sequence
  chemically synthesized
caacatcattaattgagctt

SEQ ID NO: 26137 - DNA, 20 bp, Artificial Sequence
  chemically synthesized
ccaacatcattaattgagct

SEQ ID NO: 26138 - DNA, 20 bp, Artificial Sequence
  chemically synthesized
tctccccaacatcattaatt

SEQ ID NO: 26139 - DNA, 20 bp, Artificial Sequence
  chemically synthesized
ccaagctcaattaatgatgt

SEQ ID NO: 26140 - DNA, 20 bp, Artificial Sequence
  chemically synthesized
caagctcaattaatgatgtt

SEQ ID NO: 26141 - DNA, 20 bp, Artificial Sequence
  chemically synthesized
aagctcaattaatgatgttg

SEQ ID NO: 26142 - DNA, 20 bp, Artificial Sequence
  chemically synthesized
gctcaattaatgatgttggg

SEQ ID NO: 26143 - DNA, 20 bp, Artificial Sequence
  chemically synthesized
attaatgatgttggggagac

SEQ ID NO: 26144 - DNA, 20 bp, Artificial Sequence
  chemically synthesized
ttaatgatgttggggagaca

SEQ ID NO: 26145 - DNA, 20 bp, Artificial Sequence
  chemically synthesized
aatgatgttggggagacaag

SEQ ID NO: 26146 - DNA, 20 bp, Artificial Sequence
  chemically synthesized
tgttggggagacaaggagat

SEQ ID NO: 26147 - DNA, 20 bp, Artificial Sequence
  chemically synthesized
gttggggagacaaggagatt

SEQ ID NO: 26148 - DNA, 20 bp, Artificial Sequence
  chemically synthesized
ttggggagacaaggagattg

SEQ ID NO: 26149 - DNA, 20 bp, Artificial Sequence
  chemically synthesized
gggagacaaggagattgggg

SEQ ID NO: 26150 - DNA, 20 bp, Artificial Sequence
  chemically synthesized
ggagacaaggagattggggc

SEQ ID NO: 26151 - DNA, 20 bp, Artificial Sequence
  chemically synthesized
gagacaaggagattggggca

SEQ ID NO: 26152 - DNA, 20 bp, Artificial Sequence
  chemically synthesized
gacaaggagattggggcagg

SEQ ID NO: 26153 - DNA, 20 bp, Artificial Sequence
  chemically synthesized
aaggagattggggcagggag

SEQ ID NO: 26154 - DNA, 20 bp, Artificial Sequence
  chemically synthesized
aggagattggggcagggagt

SEQ ID NO: 26155 - DNA, 20 bp, Artificial Sequence
  chemically synthesized
gagattggggcagggagtgg

SEQ ID NO: 26156 - DNA, 20 bp, Artificial Sequence
  chemically synthesized
agattggggcagggagtggg

SEQ ID NO: 26157 - DNA, 20 bp, Artificial Sequence
  chemically synthesized
agggagtgggaggaactaac

SEQ ID NO: 26158 - DNA, 20 bp, Artificial Sequence
  chemically synthesized
taaactggcatgcgtcttgt

SEQ ID NO: 26159 - DNA, 20 bp, Artificial Sequence
  chemically synthesized
ggaactaacaagacgcatgc

SEQ ID NO: 26160 - DNA, 20 bp, Artificial Sequence
  chemically synthesized
aagacgcatgccagtttatg

SEQ ID NO: 26161 - DNA, 20 bp, Artificial Sequence
  chemically synthesized
gacttcttggctacataaac

SEQ ID NO: 26162 - DNA, 20 bp, Artificial Sequence
  chemically synthesized
gcatgccagtttatgtagcc

SEQ ID NO: 26163 - DNA, 20 bp, Artificial Sequence
  chemically synthesized
tgccagtttatgtagccaag

SEQ ID NO: 26164 - DNA, 20 bp, Artificial Sequence
  chemically synthesized
ctttcatttctgagacttct

SEQ ID NO: 26165 - DNA, 20 bp, Artificial Sequence
  chemically synthesized
tttatgtagccaagaagtct

SEQ ID NO: 26166 - DNA, 20 bp, Artificial Sequence
  chemically synthesized
acctggagcctttcatttct

SEQ ID NO: 26167 - DNA, 20 bp, Artificial Sequence
  chemically synthesized
ccaagaagtctcagaaatga

SEQ ID NO: 26168 - DNA, 20 bp, Artificial Sequence
  chemically synthesized
caagaagtctcagaaatgaa

SEQ ID NO: 26169 - DNA, 20 bp, Artificial Sequence
  chemically synthesized
gtctcagaaatgaaaggctc

SEQ ID NO: 26170 - DNA, 20 bp, Artificial Sequence
  chemically synthesized
tctcagaaatgaaaggctcc

SEQ ID NO: 26171 - DNA, 20 bp, Artificial Sequence
  chemically synthesized
tcagtcttcagaggaacctg

SEQ ID NO: 26172 - DNA, 20 bp, Artificial Sequence
  chemically synthesized
tttcagtcttcagaggaacc

SEQ ID NO: 26173 - DNA, 20 bp, Artificial Sequence
  chemically synthesized
aaaggctccaggttcctctg

SEQ ID NO: 26174 - DNA, 20 bp, Artificial Sequence
  chemically synthesized
agccacatttcagtcttcag

SEQ ID NO: 26175 - DNA, 20 bp, Artificial Sequence
  chemically synthesized
cagccacatttcagtcttca

SEQ ID NO: 26176 - DNA, 20 bp, Artificial Sequence
  chemically synthesized
ttcagccacatttcagtctt

SEQ ID NO: 26177 - DNA, 20 bp, Artificial Sequence
  chemically synthesized
ttcctctgaagactgaaatg

SEQ ID NO: 26178 - DNA, 20 bp, Artificial Sequence
  chemically synthesized
ttgtattttcagccacattt

SEQ ID NO: 26179 - DNA, 20 bp, Artificial Sequence
  chemically synthesized
tgaaatgtggctgaaaatac

SEQ ID NO: 26180 - DNA, 20 bp, Artificial Sequence
  chemically synthesized
tcaaccagtccttgtatttt

SEQ ID NO: 26181 - DNA, 20 bp, Artificial Sequence
  chemically synthesized
gaaatgtggctgaaaataca

SEQ ID NO: 26182 - DNA, 20 bp, Artificial Sequence
  chemically synthesized
gtggctgaaaatacaaggac

SEQ ID NO: 26183 - DNA, 20 bp, Artificial Sequence
  chemically synthesized
aaaatacaaggactggttga

SEQ ID NO: 26184 - DNA, 20 bp, Artificial Sequence
  chemically synthesized
gggctctaaagactttcaac

SEQ ID NO: 26185 - DNA, 20 bp, Artificial Sequence
  chemically synthesized
aaggactggttgaaagtctt

SEQ ID NO: 26186 - DNA, 20 bp, Artificial Sequence
  chemically synthesized
ggactggttgaaagtcttta

SEQ ID NO: 26187 - DNA, 20 bp, Artificial Sequence
  chemically synthesized
gggaggtgtttagggctcta

SEQ ID NO: 26188 - DNA, 20 bp, Artificial Sequence
  chemically synthesized
ccaagtgggggaggtgttta

SEQ ID NO: 26189 - DNA, 20 bp, Artificial Sequence
  chemically synthesized
tccaagtgggggaggtgttt

SEQ ID NO: 26190 - DNA, 20 bp, Artificial Sequence
  chemically synthesized
ctccaagtgggggaggtgtt

SEQ ID NO: 26191 - DNA, 20 bp, Artificial Sequence
  chemically synthesized
tgctaggctccaagtggggg

SEQ ID NO: 26192 - DNA, 20 bp, Artificial Sequence
  chemically synthesized
ccctaaacacctcccccact

SEQ ID NO: 26193 - DNA, 20 bp, Artificial Sequence
  chemically synthesized
atgctaggctccaagtgggg

SEQ ID NO: 26194 - DNA, 20 bp, Artificial Sequence
  chemically synthesized
ctaaacacctcccccacttg

SEQ ID NO: 26195 - DNA, 20 bp, Artificial Sequence
  chemically synthesized
agatgctaggctccaagtgg

SEQ ID NO: 26196 - DNA, 20 bp, Artificial Sequence
  chemically synthesized
gagatgctaggctccaagtg

SEQ ID NO: 26197 - DNA, 20 bp, Artificial Sequence
  chemically synthesized
tgagatgctaggctccaagt

SEQ ID NO: 26198 - DNA, 20 bp, Artificial Sequence
  chemically synthesized
ctgagatgctaggctccaag

SEQ ID NO: 26199 - DNA, 20 bp, Artificial Sequence
  chemically synthesized
cacctcccccacttggagcc

SEQ ID NO: 26200 - DNA, 20 bp, Artificial Sequence
  chemically synthesized
tggctgagatgctaggctcc

SEQ ID NO: 26201 - DNA, 20 bp, Artificial Sequence
  chemically synthesized
ccacttggagcctagcatct

SEQ ID NO: 26202 - DNA, 20 bp, Artificial Sequence
  chemically synthesized
cagcaggtggctgagatgct

SEQ ID NO: 26203 - DNA, 20 bp, Artificial Sequence
  chemically synthesized
gcagcaggtggctgagatgc

SEQ ID NO: 26204 - DNA, 20 bp, Artificial Sequence
  chemically synthesized
ggatgaagcagcaggtggct

SEQ ID NO: 26205 - DNA, 20 bp, Artificial Sequence
  chemically synthesized
tgtcaggatgaagcagcagg

SEQ ID NO: 26206 - DNA, 20 bp, Artificial Sequence
  chemically synthesized
ttctgtcaggatgaagcagc

SEQ ID NO: 26207 - DNA, 20 bp, Artificial Sequence
  chemically synthesized
cttctgtcaggatgaagcag

SEQ ID NO: 26208 - DNA, 20 bp, Artificial Sequence
  chemically synthesized
agccttctgtcaggatgaag

SEQ ID NO: 26209 - DNA, 20 bp, Artificial Sequence
  chemically synthesized
tccagccttctgtcaggatg

SEQ ID NO: 26210 - DNA, 20 bp, Artificial Sequence
  chemically synthesized
cacctgctgcttcatcctga

SEQ ID NO: 26211 - DNA, 20 bp, Artificial Sequence
  chemically synthesized
ctgctgcttcatcctgacag

SEQ ID NO: 26212 - DNA, 20 bp, Artificial Sequence
  chemically synthesized
tgctgcttcatcctgacaga

SEQ ID NO: 26213 - DNA, 20 bp, Artificial Sequence
  chemically synthesized
taagcctccagccttctgtc

SEQ ID NO: 26214 - DNA, 20 bp, Artificial Sequence
  chemically synthesized
ttaagcctccagccttctgt

SEQ ID NO: 26215 - DNA, 20 bp, Artificial Sequence
  chemically synthesized
gcttcatcctgacagaaggc

SEQ ID NO: 26216 - DNA, 20 bp, Artificial Sequence
  chemically synthesized
ttcatcctgacagaaggctg

SEQ ID NO: 26217 - DNA, 20 bp, Artificial Sequence
  chemically synthesized
tcatcctgacagaaggctgg

SEQ ID NO: 26218 - DNA, 20 bp, Artificial Sequence
  chemically synthesized
cagcttcgagattaagcctc

SEQ ID NO: 26219 - DNA, 20 bp, Artificial Sequence
  chemically synthesized
aggctggaggcttaatctcg

SEQ ID NO: 26220 - DNA, 20 bp, Artificial Sequence
  chemically synthesized
tgtggtgcagcttcgagatt

SEQ ID NO: 26221 - DNA, 20 bp, Artificial Sequence
  chemically synthesized
ctggtgtgtggtgcagcttc

SEQ ID NO: 26222 - DNA, 20 bp, Artificial Sequence
  chemically synthesized
atgcgccctggtgtgtggtg

SEQ ID NO: 26223 - DNA, 20 bp, Artificial Sequence
  chemically synthesized
ctcgaagctgcaccacacac

SEQ ID NO: 26224 - DNA, 20 bp, Artificial Sequence
  chemically synthesized
tcgaagctgcaccacacacc

SEQ ID NO: 26225 - DNA, 20 bp, Artificial Sequence
  chemically synthesized
cgaagctgcaccacacacca

SEQ ID NO: 26226 - DNA, 20 bp, Artificial Sequence
  chemically synthesized
tcctcatgcgccctggtgtg

SEQ ID NO: 26227 - DNA, 20 bp, Artificial Sequence
  chemically synthesized
tcactgctcctcatgcgccc

SEQ ID NO: 26228 - DNA, 20 bp, Artificial Sequence
  chemically synthesized
caccacacaccagggcgcat

SEQ ID NO: 26229 - DNA, 20 bp, Artificial Sequence
  chemically synthesized
accacacaccagggcgcatg

SEQ ID NO: 26230 - DNA, 20 bp, Artificial Sequence
  chemically synthesized
cacacaccagggcgcatgag

SEQ ID NO: 26231 - DNA, 20 bp, Artificial Sequence
  chemically synthesized
acaccagggcgcatgaggag

SEQ ID NO: 26232 - DNA, 20 bp, Artificial Sequence
  chemically synthesized
gcatgaggagcagtgaaatt

SEQ ID NO: 26233 - DNA, 20 bp, Artificial Sequence
  chemically synthesized
tgaggagcagtgaaatttgg

SEQ ID NO: 26234 - DNA, 20 bp, Artificial Sequence
  chemically synthesized
ggagcagtgaaatttggaag

SEQ ID NO: 26235 - DNA, 20 bp, Artificial Sequence
  chemically synthesized
gagcagtgaaatttggaagt

SEQ ID NO: 26236 - DNA, 20 bp, Artificial Sequence
  chemically synthesized
gcagtgaaatttggaagtgg

SEQ ID NO: 26237 - DNA, 20 bp, Artificial Sequence
  chemically synthesized
gtgaaatttggaagtgggag

SEQ ID NO: 26238 - DNA, 20 bp, Artificial Sequence
  chemically synthesized
tgaaatttggaagtgggaga

SEQ ID NO: 26239 - DNA, 20 bp, Artificial Sequence
  chemically synthesized
ttggaagtgggagaaggcac

SEQ ID NO: 26240 - DNA, 20 bp, Artificial Sequence
  chemically synthesized
gtgggagaaggcactggaaa

SEQ ID NO: 26241 - DNA, 20 bp, Artificial Sequence
  chemically synthesized
gggagaaggcactggaaaca

SEQ ID NO: 26242 - DNA, 20 bp, Artificial Sequence
  chemically synthesized
ggagaaggcactggaaacag

SEQ ID NO: 26243 - DNA, 20 bp, Artificial Sequence
  chemically synthesized
gtatgtaatccctctgtttc

SEQ ID NO: 26244 - DNA, 20 bp, Artificial Sequence
  chemically synthesized
gagaaggcactggaaacaga

SEQ ID NO: 26245 - DNA, 20 bp, Artificial Sequence
  chemically synthesized
gaaacagagggattacatac

SEQ ID NO: 26246 - DNA, 20 bp, Artificial Sequence
  chemically synthesized
tttctttcaggatgcagagc

SEQ ID NO: 26247 - DNA, 20 bp, Artificial Sequence
  chemically synthesized
ttactttctttcaggatgca

SEQ ID NO: 26248 - DNA, 20 bp, Artificial Sequence
  chemically synthesized
atttactttctttcaggatg

SEQ ID NO: 26249 - DNA, 20 bp, Artificial Sequence
  chemically synthesized
ataccagctctgcatcctga

SEQ ID NO: 26250 - DNA, 20 bp, Artificial Sequence
  chemically synthesized
cagctctgcatcctgaaaga

SEQ ID NO: 26251 - DNA, 20 bp, Artificial Sequence
  chemically synthesized
ttgaagatttactttctttc

SEQ ID NO: 26252 - DNA, 20 bp, Artificial Sequence
  chemically synthesized
tttgaagatttactttcttt

SEQ ID NO: 26253 - DNA, 20 bp, Artificial Sequence
  chemically synthesized
aaatgaaggaaatgaatttg

SEQ ID NO: 26254 - DNA, 20 bp, Artificial Sequence
  chemically synthesized
aattgaggagtaggaaatga

SEQ ID NO: 26255 - DNA, 20 bp, Artificial Sequence
  chemically synthesized
gaattgaggagtaggaaatg

SEQ ID NO: 26256 - DNA, 20 bp, Artificial Sequence
  chemically synthesized
taaatatggaattgaggagt

SEQ ID NO: 26257 - DNA, 20 bp, Artificial Sequence
  chemically synthesized
ctaaatatggaattgaggag

SEQ ID NO: 26258 - DNA, 20 bp, Artificial Sequence
  chemically synthesized
agactaaatatggaattgag

SEQ ID NO: 26259 - DNA, 20 bp, Artificial Sequence
  chemically synthesized
gcagactaaatatggaattg

SEQ ID NO: 26260 - DNA, 20 bp, Artificial Sequence
  chemically synthesized
agcagactaaatatggaatt

SEQ ID NO: 26261 - DNA, 20 bp, Artificial Sequence
  chemically synthesized
ctactcctcaattccatatt

SEQ ID NO: 26262 - DNA, 20 bp, Artificial Sequence
  chemically synthesized
agaaaacagcagactaaata

SEQ ID NO: 26263 - DNA, 20 bp, Artificial Sequence
  chemically synthesized
aatgagttaacagaaaacag

SEQ ID NO: 26264 - DNA, 20 bp, Artificial Sequence
  chemically synthesized
taaaatgagttaacagaaaa

SEQ ID NO: 26265 - DNA, 20 bp, Artificial Sequence
  chemically synthesized
agctttttaaaatgagttaa

SEQ ID NO: 26266 - DNA, 20 bp, Artificial Sequence
  chemically synthesized
gtagaagagctttttaaaat

SEQ ID NO: 26267 - DNA, 20 bp, Artificial Sequence
  chemically synthesized
ttctgttaactcattttaaa

SEQ ID NO: 26268 - DNA, 20 bp, Artificial Sequence
  chemically synthesized
aagaaagtgcttaggtagaa

SEQ ID NO: 26269 - DNA, 20 bp, Artificial Sequence
  chemically synthesized
tttaaaaagctcttctacct

SEQ ID NO: 26270 - DNA, 20 bp, Artificial Sequence
  chemically synthesized
aaaagaaagtgcttaggtag

SEQ ID NO: 26271 - DNA, 20 bp, Artificial Sequence
  chemically synthesized
caaaaaagaaagtgcttagg

SEQ ID NO: 26272 - DNA, 20 bp, Artificial Sequence
  chemically synthesized
tggcaaaaaagaaagtgctt

SEQ ID NO: 26273 - DNA, 20 bp, Artificial Sequence
  chemically synthesized
gtggcaaaaaagaaagtgct

SEQ ID NO: 26274 - DNA, 20 bp, Artificial Sequence
  chemically synthesized
gataaaggtggcaaaaaaga

SEQ ID NO: 26275 - DNA, 20 bp, Artificial Sequence
  chemically synthesized
tggagataaaggtggcaaaa

SEQ ID NO: 26276 - DNA, 20 bp, Artificial Sequence
  chemically synthesized
gttccttctggagataaagg

SEQ ID NO: 26277 - DNA, 20 bp, Artificial Sequence
  chemically synthesized
ttttttgccacctttatctc

SEQ ID NO: 26278 - DNA, 20 bp, Artificial Sequence
  chemically synthesized
gaagttccttctggagataa

SEQ ID NO: 26279 - DNA, 20 bp, Artificial Sequence
  chemically synthesized
tgaagttccttctggagata

SEQ ID NO: 26280 - DNA, 20 bp, Artificial Sequence
  chemically synthesized
tttgccacctttatctccag

SEQ ID NO: 26281 - DNA, 20 bp, Artificial Sequence
  chemically synthesized
ttgccacctttatctccaga

SEQ ID NO: 26282 - DNA, 20 bp, Artificial Sequence
  chemically synthesized
tgaagttgaagttccttctg

SEQ ID NO: 26283 - DNA, 20 bp, Artificial Sequence
  chemically synthesized
gctgaagttgaagttccttc

SEQ ID NO: 26284 - DNA, 20 bp, Artificial Sequence
  chemically synthesized
tccagaaggaacttcaactt

SEQ ID NO: 26285 - DNA, 20 bp, Artificial Sequence
  chemically synthesized
tgcataccttgctgaagttg

SEQ ID NO: 26286 - DNA, 20 bp, Artificial Sequence
  chemically synthesized
gaaggaacttcaacttcagc

SEQ ID NO: 26287 - DNA, 20 bp, Artificial Sequence
  chemically synthesized
aaggaacttcaacttcagca

SEQ ID NO: 26288 - DNA, 20 bp, Artificial Sequence
  chemically synthesized
aatggctgcataccttgctg

SEQ ID NO: 26289 - DNA, 20 bp, Artificial Sequence
  chemically synthesized
ttcaacttcagcaaggtatg

SEQ ID NO: 26290 - DNA, 20 bp, Artificial Sequence
  chemically synthesized
ataattgaggaacaatttaa

SEQ ID NO: 26291 - DNA, 20 bp, Artificial Sequence
  chemically synthesized
atatatagggatgataattg

SEQ ID NO: 26292 - DNA, 20 bp, Artificial Sequence
  chemically synthesized
gatatatagggatgataatt

SEQ ID NO: 26293 - DNA, 20 bp, Artificial Sequence
  chemically synthesized
catgaagaatatgatatata

SEQ ID NO: 26294 - DNA, 20 bp, Artificial Sequence
  chemically synthesized
gcatgaagaatatgatatat

SEQ ID NO: 26295 - DNA, 20 bp, Artificial Sequence
  chemically synthesized
agcatgaagaatatgatata

SEQ ID NO: 26296 - DNA, 20 bp, Artificial Sequence
  chemically synthesized
atatcatattcttcatgctg

SEQ ID NO: 26297 - DNA, 20 bp, Artificial Sequence
  chemically synthesized
gtagttgtaactgcagcatg

SEQ ID NO: 26298 - DNA, 20 bp, Artificial Sequence
  chemically synthesized
atttggagtagttgtaactg

SEQ ID NO: 26299 - DNA, 20 bp, Artificial Sequence
  chemically synthesized
tgcattgatttgatttggag

SEQ ID NO: 26300 - DNA, 20 bp, Artificial Sequence
  chemically synthesized
aagtgcattgatttgatttg

SEQ ID NO: 26301 - DNA, 20 bp, Artificial Sequence
  chemically synthesized
gaaagtgcattgatttgatt

SEQ ID NO: 26302 - DNA, 20 bp, Artificial Sequence
  chemically synthesized
aaatcaatgcactttccttg

SEQ ID NO: 26303 - DNA, 20 bp, Artificial Sequence
  chemically synthesized
caagagggagactgcaagga

SEQ ID NO: 26304 - DNA, 20 bp, Artificial Sequence
  chemically synthesized
ctgtcaagagggagactgca

SEQ ID NO: 26305 - DNA, 20 bp, Artificial Sequence
  chemically synthesized
cctgtcaagagggagactgc

SEQ ID NO: 26306 - DNA, 20 bp, Artificial Sequence
  chemically synthesized
gtaagtcgcctgtcaagagg

SEQ ID NO: 26307 - DNA, 20 bp, Artificial Sequence
  chemically synthesized
ccttgcagtctccctcttga

SEQ ID NO: 26308 - DNA, 20 bp, Artificial Sequence
  chemically synthesized
cttgcagtctccctcttgac

SEQ ID NO: 26309 - DNA, 20 bp, Artificial Sequence
  chemically synthesized
ctgtaagtcgcctgtcaaga

SEQ ID NO: 26310 - DNA, 20 bp, Artificial Sequence
  chemically synthesized
actgtaagtcgcctgtcaag

SEQ ID NO: 26311 - DNA, 20 bp, Artificial Sequence
  chemically synthesized
gactgtaagtcgcctgtcaa

SEQ ID NO: 26312 - DNA, 20 bp, Artificial Sequence
  chemically synthesized
gtgactgtaagtcgcctgtc

SEQ ID NO: 26313 - DNA, 20 bp, Artificial Sequence
  chemically synthesized
ccctcttgacaggcgactta

SEQ ID NO: 26314 - DNA, 20 bp, Artificial Sequence
  chemically synthesized
agagtggcctgtgtgactgt

SEQ ID NO: 26315 - DNA, 20 bp, Artificial Sequence
  chemically synthesized
acaggcgacttacagtcaca

SEQ ID NO: 26316 - DNA, 20 bp, Artificial Sequence
  chemically synthesized
caggcgacttacagtcacac

SEQ ID NO: 26317 - DNA, 20 bp, Artificial Sequence
  chemically synthesized
tacagtcacacaggccactc

SEQ ID NO: 26318 - DNA, 20 bp, Artificial Sequence
  chemically synthesized
gtttattccagcagccagag

SEQ ID NO: 26319 - DNA, 20 bp, Artificial Sequence
  chemically synthesized
acacaggccactctggctgc

SEQ ID NO: 26320 - DNA, 20 bp, Artificial Sequence
  chemically synthesized
attgtttattccagcagcca

SEQ ID NO: 26321 - DNA, 20 bp, Artificial Sequence
  chemically synthesized
gtattgtttattccagcagc

SEQ ID NO: 26322 - DNA, 20 bp, Artificial Sequence
  chemically synthesized
aatagtattgtttattccag

SEQ ID NO: 26323 - DNA, 20 bp, Artificial Sequence
  chemically synthesized
gagaatagtattgtttattc

SEQ ID NO: 26324 - DNA, 20 bp, Artificial Sequence
  chemically synthesized
tctgagccaaaggaggagaa

SEQ ID NO: 26325 - DNA, 20 bp, Artificial Sequence
  chemically synthesized
acaatactattctcctcctt

SEQ ID NO: 26326 - DNA, 20 bp, Artificial Sequence
  chemically synthesized
aaggttctgagccaaaggag

SEQ ID NO: 26327 - DNA, 20 bp, Artificial Sequence
  chemically synthesized
tgaaggttctgagccaaagg

SEQ ID NO: 26328 - DNA, 20 bp, Artificial Sequence
  chemically synthesized
ctgaaggttctgagccaaag

SEQ ID NO: 26329 - DNA, 20 bp, Artificial Sequence
  chemically synthesized
actattctcctcctttggct

SEQ ID NO: 26330 - DNA, 20 bp, Artificial Sequence
  chemically synthesized
gactgaaggttctgagccaa

SEQ ID NO: 26331 - DNA, 20 bp, Artificial Sequence
  chemically synthesized
tgactgaaggttctgagcca

SEQ ID NO: 26332 - DNA, 20 bp, Artificial Sequence
  chemically synthesized
gagcagtgactgaaggttct

SEQ ID NO: 26333 - DNA, 20 bp, Artificial Sequence
  chemically synthesized
ctcctttggctcagaacctt

SEQ ID NO: 26334 - DNA, 20 bp, Artificial Sequence
  chemically synthesized
caggagagagcagtgactga

SEQ ID NO: 26335 - DNA, 20 bp, Artificial Sequence
  chemically synthesized
acaggagagagcagtgactg

SEQ ID NO: 26336 - DNA, 20 bp, Artificial Sequence
  chemically synthesized
ctgagaaaaacaggagagag

SEQ ID NO: 26337 - DNA, 20 bp, Artificial Sequence
  chemically synthesized
tgactgagaaaaacaggaga

SEQ ID NO: 26338 - DNA, 20 bp, Artificial Sequence
  chemically synthesized
tgtgactgagaaaaacagga

SEQ ID NO: 26339 - DNA, 20 bp, Artificial Sequence
  chemically synthesized
gttgtgactgagaaaaacag

SEQ ID NO: 26340 - DNA, 20 bp, Artificial Sequence
  chemically synthesized
atgttgtgactgagaaaaac

SEQ ID NO: 26341 - DNA, 20 bp, Artificial Sequence
  chemically synthesized
ctgctctctcctgtttttct

SEQ ID NO: 26342 - DNA, 20 bp, Artificial Sequence
  chemically synthesized
catgttgtgactgagaaaaa

SEQ ID NO: 26343 - DNA, 20 bp, Artificial Sequence
  chemically synthesized
gagttacccatgttgtgact

SEQ ID NO: 26344 - DNA, 20 bp, Artificial Sequence
  chemically synthesized
tgtttttctcagtcacaaca

SEQ ID NO: 26345 - DNA, 20 bp, Artificial Sequence
  chemically synthesized
gtttttctcagtcacaacat

SEQ ID NO: 26346 - DNA, 20 bp, Artificial Sequence
  chemically synthesized
cagtcacaacatgggtaact

SEQ ID NO: 26347 - DNA, 20 bp, Artificial Sequence
  chemically synthesized
tgagagttctgtaagtagct

SEQ ID NO: 26348 - DNA, 20 bp, Artificial Sequence
  chemically synthesized
atgggtaactcagctactta

SEQ ID NO: 26349 - DNA, 20 bp, Artificial Sequence
  chemically synthesized
cattctgagagttctgtaag

SEQ ID NO: 26350 - DNA, 20 bp, Artificial Sequence
  chemically synthesized
tgtcattctgagagttctgt

SEQ ID NO: 26351 - DNA, 20 bp, Artificial Sequence
  chemically synthesized
tcagctacttacagaactct

SEQ ID NO: 26352 - DNA, 20 bp, Artificial Sequence
  chemically synthesized
ataagtttgtgtcattctga

SEQ ID NO: 26353 - DNA, 20 bp, Artificial Sequence
  chemically synthesized
ttataagtttgtgtcattct

SEQ ID NO: 26354 - DNA, 20 bp, Artificial Sequence
  chemically synthesized
ggagattggggtaaatttat

SEQ ID NO: 26355 - DNA, 20 bp, Artificial Sequence
  chemically synthesized
aatagagttgaaggagattg

SEQ ID NO: 26356 - DNA, 20 bp, Artificial Sequence
  chemically synthesized
gaatagagttgaaggagatt

SEQ ID NO: 26357 - DNA, 20 bp, Artificial Sequence
  chemically synthesized
agaatagagttgaaggagat

SEQ ID NO: 26358 - DNA, 20 bp, Artificial Sequence
  chemically synthesized
ggttgagaatagagttgaag

SEQ ID NO: 26359 - DNA, 20 bp, Artificial Sequence
  chemically synthesized
gaggttgagaatagagttga

SEQ ID NO: 26360 - DNA, 20 bp, Artificial Sequence
  chemically synthesized
tgaggttgagaatagagttg

SEQ ID NO: 26361 - DNA, 20 bp, Artificial Sequence
  chemically synthesized
aattaatgaggttgagaata

SEQ ID NO: 26362 - DNA, 20 bp, Artificial Sequence
  chemically synthesized
ttaattaatgaggttgagaa

SEQ ID NO: 26363 - DNA, 20 bp, Artificial Sequence
  chemically synthesized
attcgttaattaatgaggtt

SEQ ID NO: 26364 - DNA, 20 bp, Artificial Sequence
  chemically synthesized
ttaagattcgttaattaatg

SEQ ID NO: 26365 - DNA, 20 bp, Artificial Sequence
  chemically synthesized
gttaagattcgttaattaat

SEQ ID NO: 26366 - DNA, 20 bp, Artificial Sequence
  chemically synthesized
cattaattaacgaatcttaa

SEQ ID NO: 26367 - DNA, 20 bp, Artificial Sequence
  chemically synthesized
acttatgaagagagactgtt

SEQ ID NO: 26368 - DNA, 20 bp, Artificial Sequence
  chemically synthesized
tcttaacagtctctcttcat

SEQ ID NO: 26369 - DNA, 20 bp, Artificial Sequence
  chemically synthesized
tgtgtgttcacttatgaaga

SEQ ID NO: 26370 - DNA, 20 bp, Artificial Sequence
  chemically synthesized
gatgtgtgttcacttatgaa

SEQ ID NO: 26371 - DNA, 20 bp, Artificial Sequence
  chemically synthesized
gggatgtgtgttcacttatg

SEQ ID NO: 26372 - DNA, 20 bp, Artificial Sequence
  chemically synthesized
tcataagtgaacacacatcc

SEQ ID NO: 26373 - DNA, 20 bp, Artificial Sequence
  chemically synthesized
ggctctgccctggcgaatct

SEQ ID NO: 26374 - DNA, 20 bp, Artificial Sequence
  chemically synthesized
aacacacatcccagattcgc

SEQ ID NO: 26375 - DNA, 20 bp, Artificial Sequence
  chemically synthesized
tggctctgccctggcgaatc

SEQ ID NO: 26376 - DNA, 20 bp, Artificial Sequence
  chemically synthesized
acacacatcccagattcgcc

SEQ ID NO: 26377 - DNA, 20 bp, Artificial Sequence
  chemically synthesized
cacacatcccagattcgcca

SEQ ID NO: 26378 - DNA, 20 bp, Artificial Sequence
  chemically synthesized
acatcccagattcgccaggg

SEQ ID NO: 26379 - DNA, 20 bp, Artificial Sequence
  chemically synthesized
atcccagattcgccagggca

SEQ ID NO: 26380 - DNA, 20 bp, Artificial Sequence
  chemically synthesized
taattaaactggctctgccc

SEQ ID NO: 26381 - DNA, 20 bp, Artificial Sequence
  chemically synthesized
cagattcgccagggcagagc

SEQ ID NO: 26382 - DNA, 20 bp, Artificial Sequence
  chemically synthesized
agaggaaaatttaattaaac

SEQ ID NO: 26383 - DNA, 20 bp, Artificial Sequence
  chemically synthesized
tcttaccttttataacaaag

SEQ ID NO: 26384 - DNA, 20 bp, Artificial Sequence
  chemically synthesized
gtcttaccttttataacaaa

SEQ ID NO: 26385 - DNA, 20 bp, Artificial Sequence
  chemically synthesized
gagtcttaccttttataaca

SEQ ID NO: 26386 - DNA, 20 bp, Artificial Sequence
  chemically synthesized
aattttcctctttgttataa

SEQ ID NO: 26387 - DNA, 20 bp, Artificial Sequence
  chemically synthesized
attttcctctttgttataaa

SEQ ID NO: 26388 - DNA, 20 bp, Artificial Sequence
  chemically synthesized
tcctctttgttataaaaggt

SEQ ID NO: 26389 - DNA, 20 bp, Artificial Sequence
  chemically synthesized
gtcacatctgatcattttta

SEQ ID NO: 26390 - DNA, 20 bp, Artificial Sequence
  chemically synthesized
aagtcacatctgatcatttt

SEQ ID NO: 26391 - DNA, 20 bp, Artificial Sequence
  chemically synthesized
ggtaagactctaaaaatgat

SEQ ID NO: 26392 - DNA, 20 bp, Artificial Sequence
  chemically synthesized
tttgcaaaggtataagaatt

SEQ ID NO: 26393 - DNA, 20 bp, Artificial Sequence
  chemically synthesized
atttggctttgcaaaggtat

SEQ ID NO: 26394 - DNA, 20 bp, Artificial Sequence
  chemically synthesized
ttaattcttatacctttgca

SEQ ID NO: 26395 - DNA, 20 bp, Artificial Sequence
  chemically synthesized
ctgtgaatttggctttgcaa

SEQ ID NO: 26396 - DNA, 20 bp, Artificial Sequence
  chemically synthesized
tctgtgaatttggctttgca

SEQ ID NO: 26397 - DNA, 20 bp, Artificial Sequence
  chemically synthesized
cctttgcaaagccaaattca

SEQ ID NO: 26398 - DNA, 20 bp, Artificial Sequence
  chemically synthesized
aaaaaaaaaatctgtgaatt

SEQ ID NO: 26399 - DNA, 20 bp, Artificial Sequence
  chemically synthesized
ttttttttaatgttgtgcct

SEQ ID NO: 26400 - DNA, 20 bp, Artificial Sequence
  chemically synthesized
tttgcaatccaaaaaagcta

SEQ ID NO: 26401 - DNA, 20 bp, Artificial Sequence
  chemically synthesized
ttttgcaatccaaaaaagct

SEQ ID NO: 26402 - DNA, 20 bp, Artificial Sequence
  chemically synthesized
atgttgtgccttagcttttt

SEQ ID NO: 26403 - DNA, 20 bp, Artificial Sequence
  chemically synthesized
tatgtttttgcaatccaaaa

SEQ ID NO: 26404 - DNA, 20 bp, Artificial Sequence
  chemically synthesized
aatgtcaaccatattatgaa

SEQ ID NO: 26405 - DNA, 20 bp, Artificial Sequence
  chemically synthesized
aaaacatactcttcataata

SEQ ID NO: 26406 - DNA, 20 bp, Artificial Sequence
  chemically synthesized
gtaatgtcaaccatattatg

SEQ ID NO: 26407 - DNA, 20 bp, Artificial Sequence
  chemically synthesized
gagagtgataaattcaaaat

SEQ ID NO: 26408 - DNA, 20 bp, Artificial Sequence
  chemically synthesized
agagagtgataaattcaaaa

SEQ ID NO: 26409 - DNA, 20 bp, Artificial Sequence
  chemically synthesized
gaatttatcactctctctta

SEQ ID NO: 26410 - DNA, 20 bp, Artificial Sequence
  chemically synthesized
aatttttcaactgtaagaga

SEQ ID NO: 26411 - DNA, 20 bp, Artificial Sequence
  chemically synthesized
caaatttttcaactgtaaga

SEQ ID NO: 26412 - DNA, 20 bp, Artificial Sequence
  chemically synthesized
cacaaatttttcaactgtaa

SEQ ID NO: 26413 - DNA, 20 bp, Artificial Sequence
  chemically synthesized
tccacaaatttttcaactgt

SEQ ID NO: 26414 - DNA, 20 bp, Artificial Sequence
  chemically synthesized
tcttacagttgaaaaatttg

SEQ ID NO: 26415 - DNA, 20 bp, Artificial Sequence
  chemically synthesized
acagttgaaaaatttgtgga

SEQ ID NO: 26416 - DNA, 20 bp, Artificial Sequence
  chemically synthesized
ttaatgatgaaaataaataa

SEQ ID NO: 26417 - DNA, 20 bp, Artificial Sequence
  chemically synthesized
agatgaggttaaagcagatg

SEQ ID NO: 26418 - DNA, 20 bp, Artificial Sequence
  chemically synthesized
aagatgaggttaaagcagat

SEQ ID NO: 26419 - DNA, 20 bp, Artificial Sequence
  chemically synthesized
ggcaaaagatgaggttaaag

SEQ ID NO: 26420 - DNA, 20 bp, Artificial Sequence
  chemically synthesized
aggggcaaaagatgaggtta

SEQ ID NO: 26421 - DNA, 20 bp, Artificial Sequence
  chemically synthesized
acaggaaggggcaaaagatg

SEQ ID NO: 26422 - DNA, 20 bp, Artificial Sequence
  chemically synthesized
aacaggaaggggcaaaagat

SEQ ID NO: 26423 - DNA, 20 bp, Artificial Sequence
  chemically synthesized
tttaaaacaggaaggggcaa

SEQ ID NO: 26424 - DNA, 20 bp, Artificial Sequence
  chemically synthesized
agactttttaaaacaggaag

SEQ ID NO: 26425 - DNA, 20 bp, Artificial Sequence
  chemically synthesized
aagactttttaaaacaggaa

SEQ ID NO: 26426 - DNA, 20 bp, Artificial Sequence
  chemically synthesized
taagactttttaaaacagga

SEQ ID NO: 26427 - DNA, 20 bp, Artificial Sequence
  chemically synthesized
ttaagactttttaaaacagg

SEQ ID NO: 26428 - DNA, 20 bp, Artificial Sequence
  chemically synthesized
aagttaagactttttaaaac

SEQ ID NO: 26429 - DNA, 20 bp, Artificial Sequence
  chemically synthesized
ttgccccttcctgttttaaa

SEQ ID NO: 26430 - DNA, 20 bp, Artificial Sequence
  chemically synthesized
taagttaagactttttaaaa

SEQ ID NO: 26431 - DNA, 20 bp, Artificial Sequence
  chemically synthesized
gcctttaggaaaattaagtt

SEQ ID NO: 26432 - DNA, 20 bp, Artificial Sequence
  chemically synthesized
aggtagcctttaggaaaatt

SEQ ID NO: 26433 - DNA, 20 bp, Artificial Sequence
  chemically synthesized
gtcttaacttaattttccta

SEQ ID NO: 26434 - DNA, 20 bp, Artificial Sequence
  chemically synthesized
tcttaacttaattttcctaa

SEQ ID NO: 26435 - DNA, 20 bp, Artificial Sequence
  chemically synthesized
aggtagaaaaggtagccttt

SEQ ID NO: 26436 - DNA, 20 bp, Artificial Sequence
  chemically synthesized
aaggtagaaaaggtagcctt

SEQ ID NO: 26437 - DNA, 20 bp, Artificial Sequence
  chemically synthesized
taaggccaaggtagaaaagg

SEQ ID NO: 26438 - DNA, 20 bp, Artificial Sequence
  chemically synthesized
cggtaaggccaaggtagaaa

SEQ ID NO: 26439 - DNA, 20 bp, Artificial Sequence
  chemically synthesized
gcggtaaggccaaggtagaa

SEQ ID NO: 26440 - DNA, 20 bp, Artificial Sequence
  chemically synthesized
aaaggctaccttttctacct

SEQ ID NO: 26441 - DNA, 20 bp, Artificial Sequence
  chemically synthesized
agacggcggtaaggccaagg

SEQ ID NO: 26442 - DNA, 20 bp, Artificial Sequence
  chemically synthesized
ccgagacggcggtaaggcca

SEQ ID NO: 26443 - DNA, 20 bp, Artificial Sequence
  chemically synthesized
gccgagacggcggtaaggcc

SEQ ID NO: 26444 - DNA, 20 bp, Artificial Sequence
  chemically synthesized
agtaagccgagacggcggta

SEQ ID NO: 26445 - DNA, 20 bp, Artificial Sequence
  chemically synthesized
aagtaagccgagacggcggt

SEQ ID NO: 26446 - DNA, 20 bp, Artificial Sequence
  chemically synthesized
ccttggccttaccgccgtct

SEQ ID NO: 26447 - DNA, 20 bp, Artificial Sequence
  chemically synthesized
aaataagtaagccgagacgg

SEQ ID NO: 26448 - DNA, 20 bp, Artificial Sequence
  chemically synthesized
gagaaataagtaagccgaga

SEQ ID NO: 26449 - DNA, 20 bp, Artificial Sequence
  chemically synthesized
ggcagagaaataagtaagcc

SEQ ID NO: 26450 - DNA, 20 bp, Artificial Sequence
  chemically synthesized
ataagggcagagaaataagt

SEQ ID NO: 26451 - DNA, 20 bp, Artificial Sequence
  chemically synthesized
ggagataagggcagagaaat

SEQ ID NO: 26452 - DNA, 20 bp, Artificial Sequence
  chemically synthesized
aatcttgggagataagggca

SEQ ID NO: 26453 - DNA, 20 bp, Artificial Sequence
  chemically synthesized
gaaatcttgggagataaggg

SEQ ID NO: 26454 - DNA, 20 bp, Artificial Sequence
  chemically synthesized
gttgaaatcttgggagataa

SEQ ID NO: 26455 - DNA, 20 bp, Artificial Sequence
  chemically synthesized
tgttgaaatcttgggagata

SEQ ID NO: 26456 - DNA, 20 bp, Artificial Sequence
  chemically synthesized
tttctctgcccttatctccc

SEQ ID NO: 26457 - DNA, 20 bp, Artificial Sequence
  chemically synthesized
atgttgaaatcttgggagat

SEQ ID NO: 26458 - DNA, 20 bp, Artificial Sequence
  chemically synthesized
atcatatgttgaaatcttgg

SEQ ID NO: 26459 - DNA, 20 bp, Artificial Sequence
  chemically synthesized
agatcatatgttgaaatctt

SEQ ID NO: 26460 - DNA, 20 bp, Artificial Sequence
  chemically synthesized
aagatcatatgttgaaatct

SEQ ID NO: 26461 - DNA, 20 bp, Artificial Sequence
  chemically synthesized
tgaaatggagttttgggaga

SEQ ID NO: 26462 - DNA, 20 bp, Artificial Sequence
  chemically synthesized
taattgaaatggagttttgg

SEQ ID NO: 26463 - DNA, 20 bp, Artificial Sequence
  chemically synthesized
agtaattgaaatggagtttt

SEQ ID NO: 26464 - DNA, 20 bp, Artificial Sequence
  chemically synthesized
aagtaattgaaatggagttt

SEQ ID NO: 26465 - DNA, 20 bp, Artificial Sequence
  chemically synthesized
ccagagaagtaattgaaatg

SEQ ID NO: 26466 - DNA, 20 bp, Artificial Sequence
  chemically synthesized
taccagagaagtaattgaaa

SEQ ID NO: 26467 - DNA, 20 bp, Artificial Sequence
  chemically synthesized
ctccatttcaattacttctc

SEQ ID NO: 26468 - DNA, 20 bp, Artificial Sequence
  chemically synthesized
ctggtctgtggttaccagag

SEQ ID NO: 26469 - DNA, 20 bp, Artificial Sequence
  chemically synthesized
cctctggtctgtggttacca

SEQ ID NO: 26470 - DNA, 20 bp, Artificial Sequence
  chemically synthesized
aattacttctctggtaacca

SEQ ID NO: 26471 - DNA, 20 bp, Artificial Sequence
  chemically synthesized
gacctctggtctgtggttac

SEQ ID NO: 26472 - DNA, 20 bp, Artificial Sequence
  chemically synthesized
cttctctggtaaccacagac

SEQ ID NO: 26473 - DNA, 20 bp, Artificial Sequence
  chemically synthesized
tctctggtaaccacagacca

SEQ ID NO: 26474 - DNA, 20 bp, Artificial Sequence
  chemically synthesized
agttggtgacctctggtctg

SEQ ID NO: 26475 - DNA, 20 bp, Artificial Sequence
  chemically synthesized
ctctggtaaccacagaccag

SEQ ID NO: 26476 - DNA, 20 bp, Artificial Sequence
  chemically synthesized
ttcaaccagttggtgacctc

SEQ ID NO: 26477 - DNA, 20 bp, Artificial Sequence
  chemically synthesized
acagaccagaggtcaccaac

SEQ ID NO: 26478 - DNA, 20 bp, Artificial Sequence
  chemically synthesized
gcagactaaattcaaccagt

SEQ ID NO: 26479 - DNA, 20 bp, Artificial Sequence
  chemically synthesized
gtctgcagactaaattcaac

SEQ ID NO: 26480 - DNA, 20 bp, Artificial Sequence
  chemically synthesized
ggtcaccaactggttgaatt

SEQ ID NO: 26481 - DNA, 20 bp, Artificial Sequence
  chemically synthesized
aactggttgaatttagtctg

SEQ ID NO: 26482 - DNA, 20 bp, Artificial Sequence
  chemically synthesized
acacacaaaaaaagagtctg

SEQ ID NO: 26483 - DNA, 20 bp, Artificial Sequence
  chemically synthesized
cacacacacacacaaaaaaa

SEQ ID NO: 26484 - DNA, 20 bp, Artificial Sequence
  chemically synthesized
aacacacacacacacaaaaa

SEQ ID NO: 26485 - DNA, 20 bp, Artificial Sequence
  chemically synthesized
tgtgtgtgtgtttgattcgt

SEQ ID NO: 26486 - DNA, 20 bp, Artificial Sequence
  chemically synthesized
tgtgtgtttgattcgttggt

SEQ ID NO: 26487 - DNA, 20 bp, Artificial Sequence
  chemically synthesized
gtttgattcgttggtcagtt

SEQ ID NO: 26488 - DNA, 20 bp, Artificial Sequence
  chemically synthesized
tttgattcgttggtcagttt

SEQ ID NO: 26489 - DNA, 20 bp, Artificial Sequence
  chemically synthesized
gtcagtttgggctcacataa

SEQ ID NO: 26490 - DNA, 20 bp, Artificial Sequence
  chemically synthesized
aatttcaaaaaccattatgt

SEQ ID NO: 26491 - DNA, 20 bp, Artificial Sequence
  chemically synthesized
attgttgaatgatacgccat

SEQ ID NO: 26492 - DNA, 20 bp, Artificial Sequence
  chemically synthesized
atcaccagatttttaactaa

SEQ ID NO: 26493 - DNA, 20 bp, Artificial Sequence
  chemically synthesized
tacgccattagttaaaaatc

SEQ ID NO: 26494 - DNA, 20 bp, Artificial Sequence
  chemically synthesized
gcaagacaacgggaaatcac

SEQ ID NO: 26495 - DNA, 20 bp, Artificial Sequence
  chemically synthesized
ttccagagaagcaagacaac

SEQ ID NO: 26496 - DNA, 20 bp, Artificial Sequence
  chemically synthesized
cttccagagaagcaagacaa

SEQ ID NO: 26497 - DNA, 20 bp, Artificial Sequence
  chemically synthesized
ttcccgttgtcttgcttctc

SEQ ID NO: 26498 - DNA, 20 bp, Artificial Sequence
  chemically synthesized
tcaggttcttccagagaagc

SEQ ID NO: 26499 - DNA, 20 bp, Artificial Sequence
  chemically synthesized
ccgttgtcttgcttctctgg

SEQ ID NO: 26500 - DNA, 20 bp, Artificial Sequence
  chemically synthesized
gtcttcaggttcttccagag

SEQ ID NO: 26501 - DNA, 20 bp, Artificial Sequence
  chemically synthesized
caggtcttcaggttcttcca

SEQ ID NO: 26502 - DNA, 20 bp, Artificial Sequence
  chemically synthesized
gtcaggtcttcaggttcttc

SEQ ID NO: 26503 - DNA, 20 bp, Artificial Sequence
  chemically synthesized
tgcttctctggaagaacctg

SEQ ID NO: 26504 - DNA, 20 bp, Artificial Sequence
  chemically synthesized
gtctctattgtcaggtcttc

SEQ ID NO: 26505 - DNA, 20 bp, Artificial Sequence
  chemically synthesized
agtctctattgtcaggtctt

SEQ ID NO: 26506 - DNA, 20 bp, Artificial Sequence
  chemically synthesized
agaacctgaagacctgacaa

SEQ ID NO: 26507 - DNA, 20 bp, Artificial Sequence
  chemically synthesized
aacctgaagacctgacaata

SEQ ID NO: 26508 - DNA, 20 bp, Artificial Sequence
  chemically synthesized
gaatgtgagtctctattgtc

SEQ ID NO: 26509 - DNA, 20 bp, Artificial Sequence
  chemically synthesized
agaatgtgagtctctattgt

SEQ ID NO: 26510 - DNA, 20 bp, Artificial Sequence
  chemically synthesized
tgactgttctatgagaatgt

SEQ ID NO: 26511 - DNA, 20 bp, Artificial Sequence
  chemically synthesized
aatagagactcacattctca

SEQ ID NO: 26512 - DNA, 20 bp, Artificial Sequence
  chemically synthesized
agactcacattctcatagaa

SEQ ID NO: 26513 - DNA, 20 bp, Artificial Sequence
  chemically synthesized
gttgcagctgactgttctat

SEQ ID NO: 26514 - DNA, 20 bp, Artificial Sequence
  chemically synthesized
tcacattctcatagaacagt

SEQ ID NO: 26515 - DNA, 20 bp, Artificial Sequence
  chemically synthesized
catagaacagtcagctgcaa

SEQ ID NO: 26516 - DNA, 20 bp, Artificial Sequence
  chemically synthesized
tagaacagtcagctgcaacg

SEQ ID NO: 26517 - DNA, 20 bp, Artificial Sequence
  chemically synthesized
agaacagtcagctgcaacgg

SEQ ID NO: 26518 - DNA, 20 bp, Artificial Sequence
  chemically synthesized
gggtaacagagcctccgttg

SEQ ID NO: 26519 - DNA, 20 bp, Artificial Sequence
  chemically synthesized
aagcttctgttagggtaaca

SEQ ID NO: 26520 - DNA, 20 bp, Artificial Sequence
  chemically synthesized
aaaagcttctgttagggtaa

SEQ ID NO: 26521 - DNA, 20 bp, Artificial Sequence
  chemically synthesized
cggaggctctgttaccctaa

SEQ ID NO: 26522 - DNA, 20 bp, Artificial Sequence
  chemically synthesized
aggctctgttaccctaacag

SEQ ID NO: 26523 - DNA, 20 bp, Artificial Sequence
  chemically synthesized
aacctgaaaagcttctgtta

SEQ ID NO: 26524 - DNA, 20 bp, Artificial Sequence
  chemically synthesized
caacctgaaaagcttctgtt

SEQ ID NO: 26525 - DNA, 20 bp, Artificial Sequence
  chemically synthesized
gcaacctgaaaagcttctgt

SEQ ID NO: 26526 - DNA, 20 bp, Artificial Sequence
  chemically synthesized
ttaccctaacagaagctttt

SEQ ID NO: 26527 - DNA, 20 bp, Artificial Sequence
  chemically synthesized
taccctaacagaagcttttc

SEQ ID NO: 26528 - DNA, 20 bp, Artificial Sequence
  chemically synthesized
gggaactggggcaacctgaa

SEQ ID NO: 26529 - DNA, 20 bp, Artificial Sequence
  chemically synthesized
agaagcttttcaggttgccc

SEQ ID NO: 26530 - DNA, 20 bp, Artificial Sequence
  chemically synthesized
aggtgactgggtgggaactg

SEQ ID NO: 26531 - DNA, 20 bp, Artificial Sequence
  chemically synthesized
aaggtgactgggtgggaact

SEQ ID NO: 26532 - DNA, 20 bp, Artificial Sequence
  chemically synthesized
gaaggtgactgggtgggaac

SEQ ID NO: 26533 - DNA, 20 bp, Artificial Sequence
  chemically synthesized
aggttgccccagttcccacc

SEQ ID NO: 26534 - DNA, 20 bp, Artificial Sequence
  chemically synthesized
atgactgaaggtgactgggt

SEQ ID NO: 26535 - DNA, 20 bp, Artificial Sequence
  chemically synthesized
aatgactgaaggtgactggg

SEQ ID NO: 26536 - DNA, 20 bp, Artificial Sequence
  chemically synthesized
ttgaatgactgaaggtgact

SEQ ID NO: 26537 - DNA, 20 bp, Artificial Sequence
  chemically synthesized
tttgaatgactgaaggtgac

SEQ ID NO: 26538 - DNA, 20 bp, Artificial Sequence
  chemically synthesized
agttcccacccagtcacctt

SEQ ID NO: 26539 - DNA, 20 bp, Artificial Sequence
  chemically synthesized
ctggtaatttgaatgactga

SEQ ID NO: 26540 - DNA, 20 bp, Artificial Sequence
  chemically synthesized
gctggtaatttgaatgactg

SEQ ID NO: 26541 - DNA, 20 bp, Artificial Sequence
  chemically synthesized
ccttcagtcattcaaattac

SEQ ID NO: 26542 - DNA, 20 bp, Artificial Sequence
  chemically synthesized
agtcattcaaattaccagct

SEQ ID NO: 26543 - DNA, 20 bp, Artificial Sequence
  chemically synthesized
aatgcctcctggggccaagc

SEQ ID NO: 26544 - DNA, 20 bp, Artificial Sequence
  chemically synthesized
tcaaattaccagcttggccc

SEQ ID NO: 26545 - DNA, 20 bp, Artificial Sequence
  chemically synthesized
caaattaccagcttggcccc

SEQ ID NO: 26546 - DNA, 20 bp, Artificial Sequence
  chemically synthesized
aagaaatgcctcctggggcc

SEQ ID NO: 26547 - DNA, 20 bp, Artificial Sequence
  chemically synthesized
aattaccagcttggccccag

SEQ ID NO: 26548 - DNA, 20 bp, Artificial Sequence
  chemically synthesized
attaccagcttggccccagg

SEQ ID NO: 26549 - DNA, 20 bp, Artificial Sequence
  chemically synthesized
ctgaaaagaaatgcctcctg

SEQ ID NO: 26550 - DNA, 20 bp, Artificial Sequence
  chemically synthesized
tctgaaaagaaatgcctcct

SEQ ID NO: 26551 - DNA, 20 bp, Artificial Sequence
  chemically synthesized
atctgaaaagaaatgcctcc

SEQ ID NO: 26552 - DNA, 20 bp, Artificial Sequence
  chemically synthesized
ccccaggaggcatttctttt

SEQ ID NO: 26553 - DNA, 20 bp, Artificial Sequence
  chemically synthesized
ggctgaggcaaagatctgaa

SEQ ID NO: 26554 - DNA, 20 bp, Artificial Sequence
  chemically synthesized
ttcttttcagatctttgcct

SEQ ID NO: 26555 - DNA, 20 bp, Artificial Sequence
  chemically synthesized
ggagtggtcaggctgaggca

SEQ ID NO: 26556 - DNA, 20 bp, Artificial Sequence
  chemically synthesized
acaagggagtggtcaggctg

SEQ ID NO: 26557 - DNA, 20 bp, Artificial Sequence
  chemically synthesized
aacaagggagtggtcaggct

SEQ ID NO: 26558 - DNA, 20 bp, Artificial Sequence
  chemically synthesized
gggagaacaagggagtggtc

SEQ ID NO: 26559 - DNA, 20 bp, Artificial Sequence
  chemically synthesized
tgggagaacaagggagtggt

SEQ ID NO: 26560 - DNA, 20 bp, Artificial Sequence
  chemically synthesized
cttttgggagaacaagggag

SEQ ID NO: 26561 - DNA, 20 bp, Artificial Sequence
  chemically synthesized
aagcttttgggagaacaagg

SEQ ID NO: 26562 - DNA, 20 bp, Artificial Sequence
  chemically synthesized
aaaagcttttgggagaacaa

SEQ ID NO: 26563 - DNA, 20 bp, Artificial Sequence
  chemically synthesized
taaaagcttttgggagaaca

SEQ ID NO: 26564 - DNA, 20 bp, Artificial Sequence
  chemically synthesized
gtaaaagcttttgggagaac

SEQ ID NO: 26565 - DNA, 20 bp, Artificial Sequence
  chemically synthesized
ccactcccttgttctcccaa

SEQ ID NO: 26566 - DNA, 20 bp, Artificial Sequence
  chemically synthesized
gtaaatgtaaaagcttttgg

SEQ ID NO: 26567 - DNA, 20 bp, Artificial Sequence
  chemically synthesized
gggtaaatgtaaaagctttt

SEQ ID NO: 26568 - DNA, 20 bp, Artificial Sequence
  chemically synthesized
agggtaaatgtaaaagcttt

SEQ ID NO: 26569 - DNA, 20 bp, Artificial Sequence
  chemically synthesized
taactgaagggtaaatgtaa

SEQ ID NO: 26570 - DNA, 20 bp, Artificial Sequence
  chemically synthesized
aagcttttacatttaccctt

SEQ ID NO: 26571 - DNA, 20 bp, Artificial Sequence
  chemically synthesized
tgaaaaagagtgtaactgaa

SEQ ID NO: 26572 - DNA, 20 bp, Artificial Sequence
  chemically synthesized
ctgaaaaagagtgtaactga

SEQ ID NO: 26573 - DNA, 20 bp, Artificial Sequence
  chemically synthesized
cctgaaaaagagtgtaactg

SEQ ID NO: 26574 - DNA, 20 bp, Artificial Sequence
  chemically synthesized
ccttcagttacactcttttt

SEQ ID NO: 26575 - DNA, 20 bp, Artificial Sequence
  chemically synthesized
cttcagttacactctttttc

SEQ ID NO: 26576 - DNA, 20 bp, Artificial Sequence
  chemically synthesized
cttgacagggacctgaaaaa

SEQ ID NO: 26577 - DNA, 20 bp, Artificial Sequence
  chemically synthesized
gccttgacagggacctgaaa

SEQ ID NO: 26578 - DNA, 20 bp, Artificial Sequence
  chemically synthesized
ctctttttcaggtccctgtc

SEQ ID NO: 26579 - DNA, 20 bp, Artificial Sequence
  chemically synthesized
tctttttcaggtccctgtca

SEQ ID NO: 26580 - DNA, 20 bp, Artificial Sequence
  chemically synthesized
ccacagtcagagccttgaca

SEQ ID NO: 26581 - DNA, 20 bp, Artificial Sequence
  chemically synthesized
tccacagtcagagccttgac

SEQ ID NO: 26582 - DNA, 20 bp, Artificial Sequence
  chemically synthesized
ctccacagtcagagccttga

SEQ ID NO: 26583 - DNA, 20 bp, Artificial Sequence
  chemically synthesized
ccctgtcaaggctctgactg

SEQ ID NO: 26584 - DNA, 20 bp, Artificial Sequence
  chemically synthesized
ttggagggactccacagtca

SEQ ID NO: 26585 - DNA, 20 bp, Artificial Sequence
  chemically synthesized
ctgtcaaggctctgactgtg

SEQ ID NO: 26586 - DNA, 20 bp, Artificial Sequence
  chemically synthesized
tattggagggactccacagt

SEQ ID NO: 26587 - DNA, 20 bp, Artificial Sequence
  chemically synthesized
tacttattggagggactcca

SEQ ID NO: 26588 - DNA, 20 bp, Artificial Sequence
  chemically synthesized
gactgtggagtccctccaat

SEQ ID NO: 26589 - DNA, 20 bp, Artificial Sequence
  chemically synthesized
ggtaatagctacttattgga

SEQ ID NO: 26590 - DNA, 20 bp, Artificial Sequence
  chemically synthesized
aggtaatagctacttattgg

SEQ ID NO: 26591 - DNA, 20 bp, Artificial Sequence
  chemically synthesized
tgtggagtccctccaataag

SEQ ID NO: 26592 - DNA, 20 bp, Artificial Sequence
  chemically synthesized
caggtaatagctacttattg

SEQ ID NO: 26593 - DNA, 20 bp, Artificial Sequence
  chemically synthesized
gccaggtaatagctacttat

SEQ ID NO: 26594 - DNA, 20 bp, Artificial Sequence
  chemically synthesized
tccaataagtagctattacc

SEQ ID NO: 26595 - DNA, 20 bp, Artificial Sequence
  chemically synthesized
tttgagtgacagccaggtaa

SEQ ID NO: 26596 - DNA, 20 bp, Artificial Sequence
  chemically synthesized
gagtaatttgagtgacagcc

SEQ ID NO: 26597 - DNA, 20 bp, Artificial Sequence
  chemically synthesized
agagtaatttgagtgacagc

SEQ ID NO: 26598 - DNA, 20 bp, Artificial Sequence
  chemically synthesized
ccatagagtaatttgagtga

SEQ ID NO: 26599 - DNA, 20 bp, Artificial Sequence
  chemically synthesized
ctgtttccatagagtaattt

SEQ ID NO: 26600 - DNA, 20 bp, Artificial Sequence
  chemically synthesized
ctgtcactcaaattactcta

SEQ ID NO: 26601 - DNA, 20 bp, Artificial Sequence
  chemically synthesized
cagtaacaactgtttccata

SEQ ID NO: 26602 - DNA, 20 bp, Artificial Sequence
  chemically synthesized
ctcaaattactctatggaaa

SEQ ID NO: 26603 - DNA, 20 bp, Artificial Sequence
  chemically synthesized
cccagtaacaactgtttcca

SEQ ID NO: 26604 - DNA, 20 bp, Artificial Sequence
  chemically synthesized
tctatggaaacagttgttac

SEQ ID NO: 26605 - DNA, 20 bp, Artificial Sequence
  chemically synthesized
ctatggaaacagttgttact

SEQ ID NO: 26606 - DNA, 20 bp, Artificial Sequence
  chemically synthesized
tggaaagttttgggaaaacc

SEQ ID NO: 26607 - DNA, 20 bp, Artificial Sequence
  chemically synthesized
attaatcgctggaaagtttt

SEQ ID NO: 26608 - DNA, 20 bp, Artificial Sequence
  chemically synthesized
aattaatcgctggaaagttt

SEQ ID NO: 26609 - DNA, 20 bp, Artificial Sequence
  chemically synthesized
tgggttttcccaaaactttc

SEQ ID NO: 26610 - DNA, 20 bp, Artificial Sequence
  chemically synthesized
ccaaagaattaatcgctgga

SEQ ID NO: 26611 - DNA, 20 bp, Artificial Sequence
  chemically synthesized
gagtccaaagaattaatcgc

SEQ ID NO: 26612 - DNA, 20 bp, Artificial Sequence
  chemically synthesized
ctttccagcgattaattctt

SEQ ID NO: 26613 - DNA, 20 bp, Artificial Sequence
  chemically synthesized
ttagtaaaaggtggagtcca

SEQ ID NO: 26614 - DNA, 20 bp, Artificial Sequence
  chemically synthesized
gaatgcattagtaaaaggtg

SEQ ID NO: 26615 - DNA, 20 bp, Artificial Sequence
  chemically synthesized
ttgaatgcattagtaaaagg

SEQ ID NO: 26616 - DNA, 20 bp, Artificial Sequence
  chemically synthesized
agtttgaatgcattagtaaa

SEQ ID NO: 26617 - DNA, 20 bp, Artificial Sequence
  chemically synthesized
tagtttgaatgcattagtaa

SEQ ID NO: 26618 - DNA, 20 bp, Artificial Sequence
  chemically synthesized
atcatttagtttgaatgcat

SEQ ID NO: 26619 - DNA, 20 bp, Artificial Sequence
  chemically synthesized
tttttggcagcacaatcatt

SEQ ID NO: 26620 - DNA, 20 bp, Artificial Sequence
  chemically synthesized
tattaaggcaatatttttgg

SEQ ID NO: 26621 - DNA, 20 bp, Artificial Sequence
  chemically synthesized
gtgtattaaggcaatatttt

SEQ ID NO: 26622 - DNA, 20 bp, Artificial Sequence
  chemically synthesized
ctgcaacagtaagtgtatta

SEQ ID NO: 26623 - DNA, 20 bp, Artificial Sequence
  chemically synthesized
actgcaacagtaagtgtatt

SEQ ID NO: 26624 - DNA, 20 bp, Artificial Sequence
  chemically synthesized
ccttaatacacttactgttg

SEQ ID NO: 26625 - DNA, 20 bp, Artificial Sequence
  chemically synthesized
tgttcttgtactgcaacagt

SEQ ID NO: 26626 - DNA, 20 bp, Artificial Sequence
  chemically synthesized
tacctgttcttgtactgcaa

SEQ ID NO: 26627 - DNA, 20 bp, Artificial Sequence
  chemically synthesized
tacacttactgttgcagtac

SEQ ID NO: 26628 - DNA, 20 bp, Artificial Sequence
  chemically synthesized
ttactgttgcagtacaagaa

SEQ ID NO: 26629 - DNA, 20 bp, Artificial Sequence
  chemically synthesized
tactgttgcagtacaagaac

SEQ ID NO: 26630 - DNA, 20 bp, Artificial Sequence
  chemically synthesized
tgttgcagtacaagaacagg

SEQ ID NO: 26631 - DNA, 20 bp, Artificial Sequence
  chemically synthesized
gttgcagtacaagaacaggt

SEQ ID NO: 26632 - DNA, 20 bp, Artificial Sequence
  chemically synthesized
gcagtacaagaacaggtagg

SEQ ID NO: 26633 - DNA, 20 bp, Artificial Sequence
  chemically synthesized
tacaagaacaggtaggaaga

SEQ ID NO: 26634 - DNA, 20 bp, Artificial Sequence
  chemically synthesized
acaagaacaggtaggaagac

SEQ ID NO: 26635 - DNA, 20 bp, Artificial Sequence
  chemically synthesized
gtcaggagactcatggattt

SEQ ID NO: 26636 - DNA, 20 bp, Artificial Sequence
  chemically synthesized
gaagacaggccaaaatccat

SEQ ID NO: 26637 - DNA, 20 bp, Artificial Sequence
  chemically synthesized
aaatatagtcaggagactca

SEQ ID NO: 26638 - DNA, 20 bp, Artificial Sequence
  chemically synthesized
acttaatgaaatatagtcag

SEQ ID NO: 26639 - DNA, 20 bp, Artificial Sequence
  chemically synthesized
tcacttaatgaaatatagtc

SEQ ID NO: 26640 - DNA, 20 bp, Artificial Sequence
  chemically synthesized
gtcacttaatgaaatatagt

SEQ ID NO: 26641 - DNA, 20 bp, Artificial Sequence
  chemically synthesized
aattgtcacttaatgaaata

SEQ ID NO: 26642 - DNA, 20 bp, Artificial Sequence
  chemically synthesized
tctcctgactatatttcatt

SEQ ID NO: 26643 - DNA, 20 bp, Artificial Sequence
  chemically synthesized
actgatgattttaaatgcag

SEQ ID NO: 26644 - DNA, 20 bp, Artificial Sequence
  chemically synthesized
tcaactgatgattttaaatg

SEQ ID NO: 26645 - DNA, 20 bp, Artificial Sequence
  chemically synthesized
acttctgcatttaaaatcat

SEQ ID NO: 26646 - DNA, 20 bp, Artificial Sequence
  chemically synthesized
tcatcagttgacgcttactt

SEQ ID NO: 26647 - DNA, 20 bp, Artificial Sequence
  chemically synthesized
catataataggtgcttaagt

SEQ ID NO: 26648 - DNA, 20 bp, Artificial Sequence
  chemically synthesized
taggcatataataggtgctt

SEQ ID NO: 26649 - DNA, 20 bp, Artificial Sequence
  chemically synthesized
tacacagttaggcatataat

SEQ ID NO: 26650 - DNA, 20 bp, Artificial Sequence
  chemically synthesized
gtacacagttaggcatataa

SEQ ID NO: 26651 - DNA, 20 bp, Artificial Sequence
  chemically synthesized
cctgggcttagtacacagtt

SEQ ID NO: 26652 - DNA, 20 bp, Artificial Sequence
  chemically synthesized
ccctgggcttagtacacagt

SEQ ID NO: 26653 - DNA, 20 bp, Artificial Sequence
  chemically synthesized
tatatgcctaactgtgtact

SEQ ID NO: 26654 - DNA, 20 bp, Artificial Sequence
  chemically synthesized
taacccctgggcttagtaca

SEQ ID NO: 26655 - DNA, 20 bp, Artificial Sequence
  chemically synthesized
gcctaactgtgtactaagcc

SEQ ID NO: 26656 - DNA, 20 bp, Artificial Sequence
  chemically synthesized
cctaactgtgtactaagccc

SEQ ID NO: 26657 - DNA, 20 bp, Artificial Sequence
  chemically synthesized
ctaactgtgtactaagccca

SEQ ID NO: 26658 - DNA, 20 bp, Artificial Sequence
  chemically synthesized
taactgtgtactaagcccag

SEQ ID NO: 26659 - DNA, 20 bp, Artificial Sequence
  chemically synthesized
gaatctttaacccctgggct

SEQ ID NO: 26660 - DNA, 20 bp, Artificial Sequence
  chemically synthesized
aacctgaatctttaacccct

SEQ ID NO: 26661 - DNA, 20 bp, Artificial Sequence
  chemically synthesized
tgtactaagcccaggggtta

SEQ ID NO: 26662 - DNA, 20 bp, Artificial Sequence
  chemically synthesized
aaacctgaatctttaacccc

SEQ ID NO: 26663 - DNA, 20 bp, Artificial Sequence
  chemically synthesized
aagcccaggggttaaagatt

SEQ ID NO: 26664 - DNA, 20 bp, Artificial Sequence
  chemically synthesized
agcccaggggttaaagattc

SEQ ID NO: 26665 - DNA, 20 bp, Artificial Sequence
  chemically synthesized
ggttaaagattcaggtttct

SEQ ID NO: 26666 - DNA, 20 bp, Artificial Sequence
  chemically synthesized
gattcaggtttctaagatat

SEQ ID NO: 26667 - DNA, 20 bp, Artificial Sequence
  chemically synthesized
attcaggtttctaagatatt

SEQ ID NO: 26668 - DNA, 20 bp, Artificial Sequence
  chemically synthesized
ttttgttttccccaatatct

SEQ ID NO: 26669 - DNA, 20 bp, Artificial Sequence
  chemically synthesized
ttcaggtttctaagatattg

SEQ ID NO: 26670 - DNA, 20 bp, Artificial Sequence
  chemically synthesized
aagatattggggaaaacaaa

SEQ ID NO: 26671 - DNA, 20 bp, Artificial Sequence
  chemically synthesized
acgtgtactgattttttaca

SEQ ID NO: 26672 - DNA, 20 bp, Artificial Sequence
  chemically synthesized
tacgtgtactgattttttac

SEQ ID NO: 26673 - DNA, 20 bp, Artificial Sequence
  chemically synthesized
atacgtgtactgatttttta

SEQ ID NO: 26674 - DNA, 20 bp, Artificial Sequence
  chemically synthesized
ttattcaccctgtaaaaaat

SEQ ID NO: 26675 - DNA, 20 bp, Artificial Sequence
  chemically synthesized
aaaaatcagtacacgtatcc

SEQ ID NO: 26676 - DNA, 20 bp, Artificial Sequence
  chemically synthesized
aaaatcagtacacgtatccc

SEQ ID NO: 26677 - DNA, 20 bp, Artificial Sequence
  chemically synthesized
ttgacacatcacaaatacct

SEQ ID NO: 26678 - DNA, 20 bp, Artificial Sequence
  chemically synthesized
cttgacacatcacaaatacc

SEQ ID NO: 26679 - DNA, 20 bp, Artificial Sequence
  chemically synthesized
ccaggtatttgtgatgtgtc

SEQ ID NO: 26680 - DNA, 20 bp, Artificial Sequence
  chemically synthesized
aacacacacatacaaaactc

SEQ ID NO: 26681 - DNA, 20 bp, Artificial Sequence
  chemically synthesized
ctttgacactcacataacca

SEQ ID NO: 26682 - DNA, 20 bp, Artificial Sequence
  chemically synthesized
atacaaaactctggttatgt

SEQ ID NO: 26683 - DNA, 20 bp, Artificial Sequence
  chemically synthesized
ttctttgacactcacataac

SEQ ID NO: 26684 - DNA, 20 bp, Artificial Sequence
  chemically synthesized
ctctggttatgtgagtgtca

SEQ ID NO: 26685 - DNA, 20 bp, Artificial Sequence
  chemically synthesized
tgtgagtgtcaaagaaaaac

SEQ ID NO: 26686 - DNA, 20 bp, Artificial Sequence
  chemically synthesized
tgagtgtcaaagaaaaacca

SEQ ID NO: 26687 - DNA, 20 bp, Artificial Sequence
  chemically synthesized
tgtcaaagaaaaaccagaga

SEQ ID NO: 26688 - DNA, 20 bp, Artificial Sequence
  chemically synthesized
accactttaccgtccatctc

SEQ ID NO: 26689 - DNA, 20 bp, Artificial Sequence
  chemically synthesized
aaagaaaaaccagagatgga

SEQ ID NO: 26690 - DNA, 20 bp, Artificial Sequence
  chemically synthesized
aaaaccagagatggacggta

SEQ ID NO: 26691 - DNA, 20 bp, Artificial Sequence
  chemically synthesized
accagagatggacggtaaag

SEQ ID NO: 26692 - DNA, 20 bp, Artificial Sequence
  chemically synthesized
ggacggtaaagtggtaaaaa

SEQ ID NO: 26693 - DNA, 20 bp, Artificial Sequence
  chemically synthesized
tggtaaaaacagattttatt

SEQ ID NO: 26694 - DNA, 20 bp, Artificial Sequence
  chemically synthesized
ggtaaaaacagattttattc

SEQ ID NO: 26695 - DNA, 20 bp, Artificial Sequence
  chemically synthesized
tttattcaggaatattgcaa

SEQ ID NO: 26696 - DNA, 20 bp, Artificial Sequence
  chemically synthesized
attcaggaatattgcaatag

SEQ ID NO: 26697 - DNA, 20 bp, Artificial Sequence
  chemically synthesized
ttcaggaatattgcaatagt

SEQ ID NO: 26698 - DNA, 20 bp, Artificial Sequence
  chemically synthesized
ggaatattgcaatagtggga

SEQ ID NO: 26699 - DNA, 20 bp, Artificial Sequence
  chemically synthesized
aatattgcaatagtgggaaa

SEQ ID NO: 26700 - DNA, 20 bp, Artificial Sequence
  chemically synthesized
caatagtgggaaagagacct

SEQ ID NO: 26701 - DNA, 20 bp, Artificial Sequence
  chemically synthesized
gtgggaaagagacctcagta

SEQ ID NO: 26702 - DNA, 20 bp, Artificial Sequence
  chemically synthesized
ttgagcccagttctatactg

SEQ ID NO: 26703 - DNA, 20 bp, Artificial Sequence
  chemically synthesized
gttgagcccagttctatact

SEQ ID NO: 26704 - DNA, 20 bp, Artificial Sequence
  chemically synthesized
aagagacctcagtatagaac

SEQ ID NO: 26705 - DNA, 20 bp, Artificial Sequence
  chemically synthesized
agagacctcagtatagaact

SEQ ID NO: 26706 - DNA, 20 bp, Artificial Sequence
  chemically synthesized
gctgtattcagagttgagcc

SEQ ID NO: 26707 - DNA, 20 bp, Artificial Sequence
  chemically synthesized
tccatgctgtattcagagtt

SEQ ID NO: 26708 - DNA, 20 bp, Artificial Sequence
  chemically synthesized
actgggctcaactctgaata

SEQ ID NO: 26709 - DNA, 20 bp, Artificial Sequence
  chemically synthesized
acttgtccatgctgtattca

SEQ ID NO: 26710 - DNA, 20 bp, Artificial Sequence
  chemically synthesized
ccacttgtccatgctgtatt

SEQ ID NO: 26711 - DNA, 20 bp, Artificial Sequence
  chemically synthesized
gctcaactctgaatacagca

SEQ ID NO: 26712 - DNA, 20 bp, Artificial Sequence
  chemically synthesized
actctgaatacagcatggac

SEQ ID NO: 26713 - DNA, 20 bp, Artificial Sequence
  chemically synthesized
ctgaatacagcatggacaag

SEQ ID NO: 26714 - DNA, 20 bp, Artificial Sequence
  chemically synthesized
tgaatacagcatggacaagt

SEQ ID NO: 26715 - DNA, 20 bp, Artificial Sequence
  chemically synthesized
catggacaagtgggaattga

SEQ ID NO: 26716 - DNA, 20 bp, Artificial Sequence
  chemically synthesized
acaagtgggaattgatagcc

SEQ ID NO: 26717 - DNA, 20 bp, Artificial Sequence
  chemically synthesized
caagtgggaattgatagcca

SEQ ID NO: 26718 - DNA, 20 bp, Artificial Sequence
  chemically synthesized
agtgggaattgatagccaag

SEQ ID NO: 26719 - DNA, 20 bp, Artificial Sequence
  chemically synthesized
gggaattgatagccaaggag

SEQ ID NO: 26720 - DNA, 20 bp, Artificial Sequence
  chemically synthesized
ggaattgatagccaaggagc

SEQ ID NO: 26721 - DNA, 20 bp, Artificial Sequence
  chemically synthesized
gaattgatagccaaggagca

SEQ ID NO: 26722 - DNA, 20 bp, Artificial Sequence
  chemically synthesized
ccaaaccccaccctgctcct

SEQ ID NO: 26723 - DNA, 20 bp, Artificial Sequence
  chemically synthesized
ttgatagccaaggagcaggg

SEQ ID NO: 26724 - DNA, 20 bp, Artificial Sequence
  chemically synthesized
tgatagccaaggagcagggt

SEQ ID NO: 26725 - DNA, 20 bp, Artificial Sequence
  chemically synthesized
gatagccaaggagcagggtg

SEQ ID NO: 26726 - DNA, 20 bp, Artificial Sequence
  chemically synthesized
ccaaggagcagggtggggtt

SEQ ID NO: 26727 - DNA, 20 bp, Artificial Sequence
  chemically synthesized
aggagcagggtggggtttgg

SEQ ID NO: 26728 - DNA, 20 bp, Artificial Sequence
  chemically synthesized
gcagggtggggtttggtgga

SEQ ID NO: 26729 - DNA, 20 bp, Artificial Sequence
  chemically synthesized
ttggtggatggaaaactact

SEQ ID NO: 26730 - DNA, 20 bp, Artificial Sequence
  chemically synthesized
ggtggatggaaaactactaa

SEQ ID NO: 26731 - DNA, 20 bp, Artificial Sequence
  chemically synthesized
acccccatgctttctcttag

SEQ ID NO: 26732 - DNA, 20 bp, Artificial Sequence
  chemically synthesized
gatggaaaactactaagaga

SEQ ID NO: 26733 - DNA, 20 bp, Artificial Sequence
  chemically synthesized
cttacccccatgctttctct

SEQ ID NO: 26734 - DNA, 20 bp, Artificial Sequence
  chemically synthesized
aaaactactaagagaaagca

SEQ ID NO: 26735 - DNA, 20 bp, Artificial Sequence
  chemically synthesized
aaactactaagagaaagcat

SEQ ID NO: 26736 - DNA, 20 bp, Artificial Sequence
  chemically synthesized
aactactaagagaaagcatg

SEQ ID NO: 26737 - DNA, 20 bp, Artificial Sequence
  chemically synthesized
actactaagagaaagcatgg

SEQ ID NO: 26738 - DNA, 20 bp, Artificial Sequence
  chemically synthesized
ctaagagaaagcatgggggt

SEQ ID NO: 26739 - DNA, 20 bp, Artificial Sequence
  chemically synthesized
taagagaaagcatgggggta

SEQ ID NO: 26740 - DNA, 20 bp, Artificial Sequence
  chemically synthesized
aagagaaagcatgggggtaa

SEQ ID NO: 26741 - DNA, 20 bp, Artificial Sequence
  chemically synthesized
agagaaagcatgggggtaag

SEQ ID NO: 26742 - DNA, 20 bp, Artificial Sequence
  chemically synthesized
gagaaagcatgggggtaagg

SEQ ID NO: 26743 - DNA, 20 bp, Artificial Sequence
  chemically synthesized
catgggggtaagggggattc

SEQ ID NO: 26744 - DNA, 20 bp, Artificial Sequence
  chemically synthesized
cctgttaagttttttttagc

SEQ ID NO: 26745 - DNA, 20 bp, Artificial Sequence
  chemically synthesized
ggttcctgttaagttttttt

SEQ ID NO: 26746 - DNA, 20 bp, Artificial Sequence
  chemically synthesized
tctagctaaaaaaaacttaa

SEQ ID NO: 26747 - DNA, 20 bp, Artificial Sequence
  chemically synthesized
ctagctaaaaaaaacttaac

SEQ ID NO: 26748 - DNA, 20 bp, Artificial Sequence
  chemically synthesized
tcttcagcaaggttcctgtt

SEQ ID NO: 26749 - DNA, 20 bp, Artificial Sequence
  chemically synthesized
acttaacaggaaccttgctg

SEQ ID NO: 26750 - DNA, 20 bp, Artificial Sequence
  chemically synthesized
cctggcctgtgtcttcagca

SEQ ID NO: 26751 - DNA, 20 bp, Artificial Sequence
  chemically synthesized
ccctggcctgtgtcttcagc

SEQ ID NO: 26752 - DNA, 20 bp, Artificial Sequence
  chemically synthesized
caggaaccttgctgaagaca

SEQ ID NO: 26753 - DNA, 20 bp, Artificial Sequence
  chemically synthesized
aggaaccttgctgaagacac

SEQ ID NO: 26754 - DNA, 20 bp, Artificial Sequence
  chemically synthesized
atcaccctggcctgtgtctt

SEQ ID NO: 26755 - DNA, 20 bp, Artificial Sequence
  chemically synthesized
accttgctgaagacacaggc

SEQ ID NO: 26756 - DNA, 20 bp, Artificial Sequence
  chemically synthesized
ccttgctgaagacacaggcc

SEQ ID NO: 26757 - DNA, 20 bp, Artificial Sequence
  chemically synthesized
cttgctgaagacacaggcca

SEQ ID NO: 26758 - DNA, 20 bp, Artificial Sequence
  chemically synthesized
aagacacaggccagggtgat

SEQ ID NO: 26759 - DNA, 20 bp, Artificial Sequence
  chemically synthesized
catgtgacgtctgatcaccc

SEQ ID NO: 26760 - DNA, 20 bp, Artificial Sequence
  chemically synthesized
cagggtgatcagacgtcaca

SEQ ID NO: 26761 - DNA, 20 bp, Artificial Sequence
  chemically synthesized
agggtgatcagacgtcacat

SEQ ID NO: 26762 - DNA, 20 bp, Artificial Sequence
  chemically synthesized
gggtgatcagacgtcacatg

SEQ ID NO: 26763 - DNA, 20 bp, Artificial Sequence
  chemically synthesized
ggtgatcagacgtcacatgg

SEQ ID NO: 26764 - DNA, 20 bp, Artificial Sequence
  chemically synthesized
atcagacgtcacatggggga

SEQ ID NO: 26765 - DNA, 20 bp, Artificial Sequence
  chemically synthesized
agacgtcacatgggggatgg

SEQ ID NO: 26766 - DNA, 20 bp, Artificial Sequence
  chemically synthesized
acgtcacatgggggatggtg

SEQ ID NO: 26767 - DNA, 20 bp, Artificial Sequence
  chemically synthesized
cgtcacatgggggatggtgg

SEQ ID NO: 26768 - DNA, 20 bp, Artificial Sequence
  chemically synthesized
catgggggatggtggaggat

SEQ ID NO: 26769 - DNA, 20 bp, Artificial Sequence
  chemically synthesized
atgggggatggtggaggatg

SEQ ID NO: 26770 - DNA, 20 bp, Artificial Sequence
  chemically synthesized
tggaggatgaggaacctgat

SEQ ID NO: 26771 - DNA, 20 bp, Artificial Sequence
  chemically synthesized
ttcctcttatgtatctgatc

SEQ ID NO: 26772 - DNA, 20 bp, Artificial Sequence
  chemically synthesized
cttcctcttatgtatctgat

SEQ ID NO: 26773 - DNA, 20 bp, Artificial Sequence
  chemically synthesized
aggaacctgatcagatacat

SEQ ID NO: 26774 - DNA, 20 bp, Artificial Sequence
  chemically synthesized
gaacctgatcagatacataa

SEQ ID NO: 26775 - DNA, 20 bp, Artificial Sequence
  chemically synthesized
aacctgatcagatacataag

SEQ ID NO: 26776 - DNA, 20 bp, Artificial Sequence
  chemically synthesized
ctgatcagatacataagagg

SEQ ID NO: 26777 - DNA, 20 bp, Artificial Sequence
  chemically synthesized
tgatcagatacataagagga

SEQ ID NO: 26778 - DNA, 20 bp, Artificial Sequence
  chemically synthesized
tcagatacataagaggaagg

SEQ ID NO: 26779 - DNA, 20 bp, Artificial Sequence
  chemically synthesized
tcctgctaaatcagtttagc

SEQ ID NO: 26780 - DNA, 20 bp, Artificial Sequence
  chemically synthesized
agaatcctgctaaatcagtt

SEQ ID NO: 26781 - DNA, 20 bp, Artificial Sequence
  chemically synthesized
tggttcttgctaaactgatt

SEQ ID NO: 26782 - DNA, 20 bp, Artificial Sequence
  chemically synthesized
ttcttgctaaactgatttag

SEQ ID NO: 26783 - DNA, 20 bp, Artificial Sequence
  chemically synthesized
tcttgctaaactgatttagc

SEQ ID NO: 26784 - DNA, 20 bp, Artificial Sequence
  chemically synthesized
tagcgagaatcctgctaaat

SEQ ID NO: 26785 - DNA, 20 bp, Artificial Sequence
  chemically synthesized
atttagcaggattctcgcta

SEQ ID NO: 26786 - DNA, 20 bp, Artificial Sequence
  chemically synthesized
tgtaaaaatccagctgtagc

SEQ ID NO: 26787 - DNA, 20 bp, Artificial Sequence
  chemically synthesized
agcaggattctcgctacagc

SEQ ID NO: 26788 - DNA, 20 bp, Artificial Sequence
  chemically synthesized
tctttgtaaaaatccagctg

SEQ ID NO: 26789 - DNA, 20 bp, Artificial Sequence
  chemically synthesized
tgcacttctttgtaaaaatc

SEQ ID NO: 26790 - DNA, 20 bp, Artificial Sequence
  chemically synthesized
gctacagctggatttttaca

SEQ ID NO: 26791 - DNA, 20 bp, Artificial Sequence
  chemically synthesized
acagctggatttttacaaag

SEQ ID NO: 26792 - DNA, 20 bp, Artificial Sequence
  chemically synthesized
gatttttacaaagaagtgca

SEQ ID NO: 26793 - DNA, 20 bp, Artificial Sequence
  chemically synthesized
atttttacaaagaagtgcac

SEQ ID NO: 26794 - DNA, 20 bp, Artificial Sequence
  chemically synthesized
tttacaaagaagtgcacagg

SEQ ID NO: 26795 - DNA, 20 bp, Artificial Sequence
  chemically synthesized
ttacaaagaagtgcacaggt

SEQ ID NO: 26796 - DNA, 20 bp, Artificial Sequence
  chemically synthesized
aagaagtgcacaggtgggcc

SEQ ID NO: 26797 - DNA, 20 bp, Artificial Sequence
  chemically synthesized
agaagtgcacaggtgggcct

SEQ ID NO: 26798 - DNA, 20 bp, Artificial Sequence
  chemically synthesized
aagtgcacaggtgggcctag

SEQ ID NO: 26799 - DNA, 20 bp, Artificial Sequence
  chemically synthesized
tgcacaggtgggcctaggag

SEQ ID NO: 26800 - DNA, 20 bp, Artificial Sequence
  chemically synthesized
gcacaggtgggcctaggaga

SEQ ID NO: 26801 - DNA, 20 bp, Artificial Sequence
  chemically synthesized
agactcctgaaccttctcct

SEQ ID NO: 26802 - DNA, 20 bp, Artificial Sequence
  chemically synthesized
cagactcctgaaccttctcc

SEQ ID NO: 26803 - DNA, 20 bp, Artificial Sequence
  chemically synthesized
ggtgggcctaggagaaggtt

SEQ ID NO: 26804 - DNA, 20 bp, Artificial Sequence
  chemically synthesized
gtgggcctaggagaaggttc

SEQ ID NO: 26805 - DNA, 20 bp, Artificial Sequence
  chemically synthesized
gggcctaggagaaggttcag

SEQ ID NO: 26806 - DNA, 20 bp, Artificial Sequence
  chemically synthesized
taggagaaggttcaggagtc

SEQ ID NO: 26807 - DNA, 20 bp, Artificial Sequence
  chemically synthesized
aaggttcaggagtctggctg

SEQ ID NO: 26808 - DNA, 20 bp, Artificial Sequence
  chemically synthesized
ctacttgatcaaacttcagc

SEQ ID NO: 26809 - DNA, 20 bp, Artificial Sequence
  chemically synthesized
ttgtctacttgatcaaactt

SEQ ID NO: 26810 - DNA, 20 bp, Artificial Sequence
  chemically synthesized
agtctggctgaagtttgatc

SEQ ID NO: 26811 - DNA, 20 bp, Artificial Sequence
  chemically synthesized
ctggctgaagtttgatcaag

SEQ ID NO: 26812 - DNA, 20 bp, Artificial Sequence
  chemically synthesized
aagtagacaatctttatcat

SEQ ID NO: 26813 - DNA, 20 bp, Artificial Sequence
  chemically synthesized
agtagacaatctttatcatg

SEQ ID NO: 26814 - DNA, 20 bp, Artificial Sequence
  chemically synthesized
acataagcatcctcatgata

SEQ ID NO: 26815 - DNA, 20 bp, Artificial Sequence
  chemically synthesized
atatgtttctgtatgtacat

SEQ ID NO: 26816 - DNA, 20 bp, Artificial Sequence
  chemically synthesized
tgaggatgcttatgtacata

SEQ ID NO: 26817 - DNA, 20 bp, Artificial Sequence
  chemically synthesized
acagaaacatataatgaaaa

SEQ ID NO: 26818 - DNA, 20 bp, Artificial Sequence
  chemically synthesized
aatgaaaatagaccatcgtg

SEQ ID NO: 26819 - DNA, 20 bp, Artificial Sequence
  chemically synthesized
ttgacatataaactgcacga

SEQ ID NO: 26820 - DNA, 20 bp, Artificial Sequence
  chemically synthesized
cagtttatatgtcaaccgca

SEQ ID NO: 26821 - DNA, 20 bp, Artificial Sequence
  chemically synthesized
agtttatatgtcaaccgcaa

SEQ ID NO: 26822 - DNA, 20 bp, Artificial Sequence
  chemically synthesized
ttatatgtcaaccgcaaagg

SEQ ID NO: 26823 - DNA, 20 bp, Artificial Sequence
  chemically synthesized
catcttggaaactacctttg

SEQ ID NO: 26824 - DNA, 20 bp, Artificial Sequence
  chemically synthesized
caaccgcaaaggtagtttcc

SEQ ID NO: 26825 - DNA, 20 bp, Artificial Sequence
  chemically synthesized
gaatactgcttatgtcatct

SEQ ID NO: 26826 - DNA, 20 bp, Artificial Sequence
  chemically synthesized
ggtagtttccaagatgacat

SEQ ID NO: 26827 - DNA, 20 bp, Artificial Sequence
  chemically synthesized
agtttccaagatgacataag

SEQ ID NO: 26828 - DNA, 20 bp, Artificial Sequence
  chemically synthesized
ttaaccttaaaaatgttcat

SEQ ID NO: 26829 - DNA, 20 bp, Artificial Sequence
  chemically synthesized
gtattccaatgaacattttt

SEQ ID NO: 26830 - DNA, 20 bp, Artificial Sequence
  chemically synthesized
tattccaatgaacattttta

SEQ ID NO: 26831 - DNA, 20 bp, Artificial Sequence
  chemically synthesized
atgaacatttttaaggttaa

SEQ ID NO: 26832 - DNA, 20 bp, Artificial Sequence
  chemically synthesized
atttttaaggttaatggcat

SEQ ID NO: 26833 - DNA, 20 bp, Artificial Sequence
  chemically synthesized
gcattggaaatttcctacat

SEQ ID NO: 26834 - DNA, 20 bp, Artificial Sequence
  chemically synthesized
atgagtaacatggcttatgt

SEQ ID NO: 26835 - DNA, 20 bp, Artificial Sequence
  chemically synthesized
catgagtaacatggcttatg

SEQ ID NO: 26836 - DNA, 20 bp, Artificial Sequence
  chemically synthesized
ttactgtttcatgagtaaca

SEQ ID NO: 26837 - DNA, 20 bp, Artificial Sequence
  chemically synthesized
aagccatgttactcatgaaa

SEQ ID NO: 26838 - DNA, 20 bp, Artificial Sequence
  chemically synthesized
cttagaaattactgtttcat

SEQ ID NO: 26839 - DNA, 20 bp, Artificial Sequence
  chemically synthesized
ctcatgaaacagtaatttct

SEQ ID NO: 26840 - DNA, 20 bp, Artificial Sequence
  chemically synthesized
aatttaagcctttgtgggct

SEQ ID NO: 26841 - DNA, 20 bp, Artificial Sequence
  chemically synthesized
cagtaatttctaagcccaca

SEQ ID NO: 26842 - DNA, 20 bp, Artificial Sequence
  chemically synthesized
agtaatttctaagcccacaa

SEQ ID NO: 26843 - DNA, 20 bp, Artificial Sequence
  chemically synthesized
aactaaatttaagcctttgt

SEQ ID NO: 26844 - DNA, 20 bp, Artificial Sequence
  chemically synthesized
aaactaaatttaagcctttg

SEQ ID NO: 26845 - DNA, 20 bp, Artificial Sequence
  chemically synthesized
agcccacaaaggcttaaatt

SEQ ID NO: 26846 - DNA, 20 bp, Artificial Sequence
  chemically synthesized
tggatatttaaactaaattt

SEQ ID NO: 26847 - DNA, 20 bp, Artificial Sequence
  chemically synthesized
ttaaatttagtttaaatatc

SEQ ID NO: 26848 - DNA, 20 bp, Artificial Sequence
  chemically synthesized
attttatttttattgtatac

SEQ ID NO: 26849 - DNA, 20 bp, Artificial Sequence
  chemically synthesized
tacaataaaaataaaatcta

SEQ ID NO: 26850 - DNA, 20 bp, Artificial Sequence
  chemically synthesized
catttctatcagtattacta

SEQ ID NO: 26851 - DNA, 20 bp, Artificial Sequence
  chemically synthesized
aaaatctatagtaatactga

SEQ ID NO: 26852 - DNA, 20 bp, Artificial Sequence
  chemically synthesized
gttacatcagtcatttctat

SEQ ID NO: 26853 - DNA, 20 bp, Artificial Sequence
  chemically synthesized
ctatttctaattagttacat

SEQ ID NO: 26854 - DNA, 20 bp, Artificial Sequence
  chemically synthesized
aaatgactgatgtaactaat

SEQ ID NO: 26855 - DNA, 20 bp, Artificial Sequence
  chemically synthesized
aaaataaagctatttctaat

SEQ ID NO: 26856 - DNA, 20 bp, Artificial Sequence
  chemically synthesized
ctgatgtaactaattagaaa

SEQ ID NO: 26857 - DNA, 20 bp, Artificial Sequence
  chemically synthesized
aagtataagaatgaaaaata

SEQ ID NO: 26858 - DNA, 20 bp, Artificial Sequence
  chemically synthesized
tatttttcattcttatactt

SEQ ID NO: 26859 - DNA, 20 bp, Artificial Sequence
  chemically synthesized
atttttcattcttatacttg

SEQ ID NO: 26860 - DNA, 20 bp, Artificial Sequence
  chemically synthesized
atcttttttccctcaagtat

SEQ ID NO: 26861 - DNA, 20 bp, Artificial Sequence
  chemically synthesized
tttttcattcttatacttga

SEQ ID NO: 26862 - DNA, 20 bp, Artificial Sequence
  chemically synthesized
tttctcatcttttttccctc

SEQ ID NO: 26863 - DNA, 20 bp, Artificial Sequence
  chemically synthesized
ttcttatacttgagggaaaa

SEQ ID NO: 26864 - DNA, 20 bp, Artificial Sequence
  chemically synthesized
atacttgagggaaaaaagat

SEQ ID NO: 26865 - DNA, 20 bp, Artificial Sequence
  chemically synthesized
gaaaaaagatgagaaaaatg

SEQ ID NO: 26866 - DNA, 20 bp, Artificial Sequence
  chemically synthesized
gagaaaaatgcagacttctg

SEQ ID NO: 26867 - DNA, 20 bp, Artificial Sequence
  chemically synthesized
gaaaaatgcagacttctgaa

SEQ ID NO: 26868 - DNA, 20 bp, Artificial Sequence
  chemically synthesized
aaaaatgcagacttctgaag

SEQ ID NO: 26869 - DNA, 20 bp, Artificial Sequence
  chemically synthesized
acacaacatgacctcttcag

SEQ ID NO: 26870 - DNA, 20 bp, Artificial Sequence
  chemically synthesized
tgaacacaacatgacctctt

SEQ ID NO: 26871 - DNA, 20 bp, Artificial Sequence
  chemically synthesized
atgttgtgttcacttatcct

SEQ ID NO: 26872 - DNA, 20 bp, Artificial Sequence
  chemically synthesized
ttgccctagatgccaaggat

SEQ ID NO: 26873 - DNA, 20 bp, Artificial Sequence
  chemically synthesized
gttcacttatccttggcatc

SEQ ID NO: 26874 - DNA, 20 bp, Artificial Sequence
  chemically synthesized
atttattgccctagatgcca

SEQ ID NO: 26875 - DNA, 20 bp, Artificial Sequence
  chemically synthesized
ttcacttatccttggcatct

SEQ ID NO: 26876 - DNA, 20 bp, Artificial Sequence
  chemically synthesized
catttattgccctagatgcc

SEQ ID NO: 26877 - DNA, 20 bp, Artificial Sequence
  chemically synthesized
tcacttatccttggcatcta

SEQ ID NO: 26878 - DNA, 20 bp, Artificial Sequence
  chemically synthesized
agcaccatcatttattgccc

SEQ ID NO: 26879 - DNA, 20 bp, Artificial Sequence
  chemically synthesized
gcatctagggcaataaatga

SEQ ID NO: 26880 - DNA, 20 bp, Artificial Sequence
  chemically synthesized
ttattccaaatacatttatt

SEQ ID NO: 26881 - DNA, 20 bp, Artificial Sequence
  chemically synthesized
tggtgctcaataaatgtatt

SEQ ID NO: 26882 - DNA, 20 bp, Artificial Sequence
  chemically synthesized
aaatgtatttggaataaaat

SEQ ID NO: 26883 - DNA, 20 bp, Artificial Sequence
  chemically synthesized
ggaataaaattagattctga

SEQ ID NO: 26884 - DNA, 20 bp, Artificial Sequence
  chemically synthesized
gaataaaattagattctgaa

SEQ ID NO: 26885 - DNA, 20 bp, Artificial Sequence
  chemically synthesized
aaaagcaaggaagttccttt

SEQ ID NO: 26886 - DNA, 20 bp, Artificial Sequence
  chemically synthesized
taaacctggtaaaagcaagg

SEQ ID NO: 26887 - DNA, 20 bp, Artificial Sequence
  chemically synthesized
gcttaaacctggtaaaagca

SEQ ID NO: 26888 - DNA, 20 bp, Artificial Sequence
  chemically synthesized
agcttaaacctggtaaaagc

SEQ ID NO: 26889 - DNA, 20 bp, Artificial Sequence
  chemically synthesized
aggaacttccttgcttttac

SEQ ID NO: 26890 - DNA, 20 bp, Artificial Sequence
  chemically synthesized
ggaacttccttgcttttacc

SEQ ID NO: 26891 - DNA, 20 bp, Artificial Sequence
  chemically synthesized
cgacagcttaaacctggtaa

SEQ ID NO: 26892 - DNA, 20 bp, Artificial Sequence
  chemically synthesized
tccttgcttttaccaggttt

SEQ ID NO: 26893 - DNA, 20 bp, Artificial Sequence
  chemically synthesized
tgtcatcgacagcttaaacc

SEQ ID NO: 26894 - DNA, 20 bp, Artificial Sequence
  chemically synthesized
tgtaaaatcaatgtcatcga

SEQ ID NO: 26895 - DNA, 20 bp, Artificial Sequence
  chemically synthesized
tatattatttgaagaaaaat

SEQ ID NO: 26896 - DNA, 20 bp, Artificial Sequence
  chemically synthesized
gtggaaaattatattatttg

SEQ ID NO: 26897 - DNA, 20 bp, Artificial Sequence
  chemically synthesized
aatataattttccacttcta

SEQ ID NO: 26898 - DNA, 20 bp, Artificial Sequence
  chemically synthesized
cagtgattcagccatagaag

SEQ ID NO: 26899 - DNA, 20 bp, Artificial Sequence
  chemically synthesized
ttccagtgattcagccatag

SEQ ID NO: 26900 - DNA, 20 bp, Artificial Sequence
  chemically synthesized
taattccagtgattcagcca

SEQ ID NO: 26901 - DNA, 20 bp, Artificial Sequence
  chemically synthesized
cacttctatggctgaatcac

SEQ ID NO: 26902 - DNA, 20 bp, Artificial Sequence
  chemically synthesized
aaataataattccagtgatt

SEQ ID NO: 26903 - DNA, 20 bp, Artificial Sequence
  chemically synthesized
gtaagcaaaaataataattc

SEQ ID NO: 26904 - DNA, 20 bp, Artificial Sequence
  chemically synthesized
cagctcaggttgtaaggagt

SEQ ID NO: 26905 - DNA, 20 bp, Artificial Sequence
  chemically synthesized
gctccagctcaggttgtaag

SEQ ID NO: 26906 - DNA, 20 bp, Artificial Sequence
  chemically synthesized
aagctccagctcaggttgta

SEQ ID NO: 26907 - DNA, 20 bp, Artificial Sequence
  chemically synthesized
ttgcttactccttacaacct

SEQ ID NO: 26908 - DNA, 20 bp, Artificial Sequence
  chemically synthesized
gaagctccagctcaggttgt

SEQ ID NO: 26909 - DNA, 20 bp, Artificial Sequence
  chemically synthesized
ttactccttacaacctgagc

SEQ ID NO: 26910 - DNA, 20 bp, Artificial Sequence
  chemically synthesized
actccttacaacctgagctg

SEQ ID NO: 26911 - DNA, 20 bp, Artificial Sequence
  chemically synthesized
caaaaaagaagctccagctc

SEQ ID NO: 26912 - DNA, 20 bp, Artificial Sequence
  chemically synthesized
tcaaaaaagaagctccagct

SEQ ID NO: 26913 - DNA, 20 bp, Artificial Sequence
  chemically synthesized
gtgtttcaaaaaagaagctc

SEQ ID NO: 26914 - DNA, 20 bp, Artificial Sequence
  chemically synthesized
tgaggtgtgtttcaaaaaag

SEQ ID NO: 26915 - DNA, 20 bp, Artificial Sequence
  chemically synthesized
ttgtgaggtgtgtttcaaaa

SEQ ID NO: 26916 - DNA, 20 bp, Artificial Sequence
  chemically synthesized
tttttgaaacacacctcaca

SEQ ID NO: 26917 - DNA, 20 bp, Artificial Sequence
  chemically synthesized
aaagtcttgatatctttgtg

SEQ ID NO: 26918 - DNA, 20 bp, Artificial Sequence
  chemically synthesized
gaaagtcttgatatctttgt

SEQ ID NO: 26919 - DNA, 20 bp, Artificial Sequence
  chemically synthesized
acacacctcacaaagatatc

SEQ ID NO: 26920 - DNA, 20 bp, Artificial Sequence
  chemically synthesized
aaagatatcaagactttcct

SEQ ID NO: 26921 - DNA, 20 bp, Artificial Sequence
  chemically synthesized
aagatatcaagactttccta

SEQ ID NO: 26922 - DNA, 20 bp, Artificial Sequence
  chemically synthesized
aattcctttattccttagga

SEQ ID NO: 26923 - DNA, 20 bp, Artificial Sequence
  chemically synthesized
tcccaattcctttattcctt

SEQ ID NO: 26924 - DNA, 20 bp, Artificial Sequence
  chemically synthesized
caagactttcctaaggaata

SEQ ID NO: 26925 - DNA, 20 bp, Artificial Sequence
  chemically synthesized
gtcccaattcctttattcct

SEQ ID NO: 26926 - DNA, 20 bp, Artificial Sequence
  chemically synthesized
aagactttcctaaggaataa

SEQ ID NO: 26927 - DNA, 20 bp, Artificial Sequence
  chemically synthesized
ttcctaaggaataaaggaat

SEQ ID NO: 26928 - DNA, 20 bp, Artificial Sequence
  chemically synthesized
tcctaaggaataaaggaatt

SEQ ID NO: 26929 - DNA, 20 bp, Artificial Sequence
  chemically synthesized
ggaataaaggaattgggaca

SEQ ID NO: 26930 - DNA, 20 bp, Artificial Sequence
  chemically synthesized
aataaaggaattgggacaaa

SEQ ID NO: 26931 - DNA, 20 bp, Artificial Sequence
  chemically synthesized
taaaggaattgggacaaaga

SEQ ID NO: 26932 - DNA, 20 bp, Artificial Sequence
  chemically synthesized
ggaattgggacaaagagaga

SEQ ID NO: 26933 - DNA, 20 bp, Artificial Sequence
  chemically synthesized
aaagagagaaagaaaataaa

SEQ ID NO: 26934 - DNA, 20 bp, Artificial Sequence
  chemically synthesized
aagaaaataaatggtctaaa

SEQ ID NO: 26935 - DNA, 20 bp, Artificial Sequence
  chemically synthesized
ttgcaaataagcattctttt

SEQ ID NO: 26936 - DNA, 20 bp, Artificial Sequence
  chemically synthesized
taaaaagaatgcttatttgc

SEQ ID NO: 26937 - DNA, 20 bp, Artificial Sequence
  chemically synthesized
aaaaagaatgcttatttgca

SEQ ID NO: 26938 - DNA, 20 bp, Artificial Sequence
  chemically synthesized
agcggattcaccttgcaaat

SEQ ID NO: 26939 - DNA, 20 bp, Artificial Sequence
  chemically synthesized
tctgccacaattaaatacag

SEQ ID NO: 26940 - DNA, 20 bp, Artificial Sequence
  chemically synthesized
ttatctgccacaattaaata

SEQ ID NO: 26941 - DNA, 20 bp, Artificial Sequence
  chemically synthesized
gaatccgctgtatttaattg

SEQ ID NO: 26942 - DNA, 20 bp, Artificial Sequence
  chemically synthesized
tccgctgtatttaattgtgg

SEQ ID NO: 26943 - DNA, 20 bp, Artificial Sequence
  chemically synthesized
tgtggcagataactgtatgt

SEQ ID NO: 26944 - DNA, 20 bp, Artificial Sequence
  chemically synthesized
gtgttgagtgagccaacata

SEQ ID NO: 26945 - DNA, 20 bp, Artificial Sequence
  chemically synthesized
tttgggaaggggtgttgagt

SEQ ID NO: 26946 - DNA, 20 bp, Artificial Sequence
  chemically synthesized
agaatttgggaaggggtgtt

SEQ ID NO: 26947 - DNA, 20 bp, Artificial Sequence
  chemically synthesized
aggagaaagaatttgggaag

SEQ ID NO: 26948 - DNA, 20 bp, Artificial Sequence
  chemically synthesized
aaggagaaagaatttgggaa

SEQ ID NO: 26949 - DNA, 20 bp, Artificial Sequence
  chemically synthesized
caaggagaaagaatttggga

SEQ ID NO: 26950 - DNA, 20 bp, Artificial Sequence
  chemically synthesized
ccaaggagaaagaatttggg

SEQ ID NO: 26951 - DNA, 20 bp, Artificial Sequence
  chemically synthesized
agaccaaggagaaagaattt

SEQ ID NO: 26952 - DNA, 20 bp, Artificial Sequence
  chemically synthesized
aagaccaaggagaaagaatt

SEQ ID NO: 26953 - DNA, 20 bp, Artificial Sequence
  chemically synthesized
cttcccaaattctttctcct

SEQ ID NO: 26954 - DNA, 20 bp, Artificial Sequence
  chemically synthesized
gcagagaaagaccaaggaga

SEQ ID NO: 26955 - DNA, 20 bp, Artificial Sequence
  chemically synthesized
tgtagcagagaaagaccaag

SEQ ID NO: 26956 - DNA, 20 bp, Artificial Sequence
  chemically synthesized
tttgtagcagagaaagacca

SEQ ID NO: 26957 - DNA, 20 bp, Artificial Sequence
  chemically synthesized
ctttgtagcagagaaagacc

SEQ ID NO: 26958 - DNA, 20 bp, Artificial Sequence
  chemically synthesized
tccagcctttgtagcagaga

SEQ ID NO: 26959 - DNA, 20 bp, Artificial Sequence
  chemically synthesized
cttggtctttctctgctaca

SEQ ID NO: 26960 - DNA, 20 bp, Artificial Sequence
  chemically synthesized
atcctccagcctttgtagca

SEQ ID NO: 26961 - DNA, 20 bp, Artificial Sequence
  chemically synthesized
ttggtctttctctgctacaa

SEQ ID NO: 26962 - DNA, 20 bp, Artificial Sequence
  chemically synthesized
agatcctccagcctttgtag

SEQ ID NO: 26963 - DNA, 20 bp, Artificial Sequence
  chemically synthesized
tctttctctgctacaaaggc

SEQ ID NO: 26964 - DNA, 20 bp, Artificial Sequence
  chemically synthesized
ttgagatcctccagcctttg

SEQ ID NO: 26965 - DNA, 20 bp, Artificial Sequence
  chemically synthesized
tttctctgctacaaaggctg

SEQ ID NO: 26966 - DNA, 20 bp, Artificial Sequence
  chemically synthesized
ttctctgctacaaaggctgg

SEQ ID NO: 26967 - DNA, 20 bp, Artificial Sequence
  chemically synthesized
atcagggaattgagatcctc

SEQ ID NO: 26968 - DNA, 20 bp, Artificial Sequence
  chemically synthesized
cctggctggatcagggaatt

SEQ ID NO: 26969 - DNA, 20 bp, Artificial Sequence
  chemically synthesized
aggatctcaattccctgatc

SEQ ID NO: 26970 - DNA, 20 bp, Artificial Sequence
  chemically synthesized
agcttcccctggctggatca

SEQ ID NO: 26971 - DNA, 20 bp, Artificial Sequence
  chemically synthesized
cagcttcccctggctggatc

SEQ ID NO: 26972 - DNA, 20 bp, Artificial Sequence
  chemically synthesized
tctcaattccctgatccagc

SEQ ID NO: 26973 - DNA, 20 bp, Artificial Sequence
  chemically synthesized
acagcttcccctggctggat

SEQ ID NO: 26974 - DNA, 20 bp, Artificial Sequence
  chemically synthesized
ctcaattccctgatccagcc

SEQ ID NO: 26975 - DNA, 20 bp, Artificial Sequence
  chemically synthesized
tcaattccctgatccagcca

SEQ ID NO: 26976 - DNA, 20 bp, Artificial Sequence
  chemically synthesized
caattccctgatccagccag

SEQ ID NO: 26977 - DNA, 20 bp, Artificial Sequence
  chemically synthesized
tccacacagcttcccctggc

SEQ ID NO: 26978 - DNA, 20 bp, Artificial Sequence
  chemically synthesized
ttccctgatccagccagggg

SEQ ID NO: 26979 - DNA, 20 bp, Artificial Sequence
  chemically synthesized
tgtgtccacacagcttcccc

SEQ ID NO: 26980 - DNA, 20 bp, Artificial Sequence
  chemically synthesized
tccagccaggggaagctgtg

SEQ ID NO: 26981 - DNA, 20 bp, Artificial Sequence
  chemically synthesized
tggccaaaactgtgtccaca

SEQ ID NO: 26982 - DNA, 20 bp, Artificial Sequence
  chemically synthesized
caggggaagctgtgtggaca

SEQ ID NO: 26983 - DNA, 20 bp, Artificial Sequence
  chemically synthesized
aagctgtgtggacacagttt

SEQ ID NO: 26984 - DNA, 20 bp, Artificial Sequence
  chemically synthesized
cacagttttggccaatgctt

SEQ ID NO: 26985 - DNA, 20 bp, Artificial Sequence
  chemically synthesized
gcagatatcttctcaagcat

SEQ ID NO: 26986 - DNA, 20 bp, Artificial Sequence
  chemically synthesized
agttttggccaatgcttgag

SEQ ID NO: 26987 - DNA, 20 bp, Artificial Sequence
  chemically synthesized
tttcttgcagatatcttctc

SEQ ID NO: 26988 - DNA, 20 bp, Artificial Sequence
  chemically synthesized
atgcttgagaagatatctgc

SEQ ID NO: 26989 - DNA, 20 bp, Artificial Sequence
  chemically synthesized
ttgagaagatatctgcaaga

SEQ ID NO: 26990 - DNA, 20 bp, Artificial Sequence
  chemically synthesized
tgagaagatatctgcaagaa

SEQ ID NO: 26991 - DNA, 20 bp, Artificial Sequence
  chemically synthesized
ggaagggaaatcctttcttg

SEQ ID NO: 26992 - DNA, 20 bp, Artificial Sequence
  chemically synthesized
tttgtctttccatttgggaa

SEQ ID NO: 26993 - DNA, 20 bp, Artificial Sequence
  chemically synthesized
aaaggatttcccttcccaaa

SEQ ID NO: 26994 - DNA, 20 bp, Artificial Sequence
  chemically synthesized
ctttgtctttccatttggga

SEQ ID NO: 26995 - DNA, 20 bp, Artificial Sequence
  chemically synthesized
tctttgtctttccatttggg

SEQ ID NO: 26996 - DNA, 20 bp, Artificial Sequence
  chemically synthesized
gatttcccttcccaaatgga

SEQ ID NO: 26997 - DNA, 20 bp, Artificial Sequence
  chemically synthesized
gtctctttgtctttccattt

SEQ ID NO: 26998 - DNA, 20 bp, Artificial Sequence
  chemically synthesized
agtctctttgtctttccatt

SEQ ID NO: 26999 - DNA, 20 bp, Artificial Sequence
  chemically synthesized
ccttcccaaatggaaagaca

SEQ ID NO: 27000 - DNA, 20 bp, Artificial Sequence
  chemically synthesized
ttcccaaatggaaagacaaa

SEQ ID NO: 27001 - DNA, 20 bp, Artificial Sequence
  chemically synthesized
tggaaagacaaagagactct

SEQ ID NO: 27002 - DNA, 20 bp, Artificial Sequence
  chemically synthesized
ggaaagacaaagagactctg

SEQ ID NO: 27003 - DNA, 20 bp, Artificial Sequence
  chemically synthesized
agaaaggacgttcagcctca

SEQ ID NO: 27004 - DNA, 20 bp, Artificial Sequence
  chemically synthesized
agagaaaggacgttcagcct

SEQ ID NO: 27005 - DNA, 20 bp, Artificial Sequence
  chemically synthesized
gaagaaagagaaaggacgtt

SEQ ID NO: 27006 - DNA, 20 bp, Artificial Sequence
  chemically synthesized
tcaggcaggaagaaagagaa

SEQ ID NO: 27007 - DNA, 20 bp, Artificial Sequence
  chemically synthesized
ctcaggcaggaagaaagaga

SEQ ID NO: 27008 - DNA, 20 bp, Artificial Sequence
  chemically synthesized
gcttctcaggcaggaagaaa

SEQ ID NO: 27009 - DNA, 20 bp, Artificial Sequence
  chemically synthesized
ctgcttctcaggcaggaaga

SEQ ID NO: 27010 - DNA, 20 bp, Artificial Sequence
  chemically synthesized
ctttctctttcttcctgcct

SEQ ID NO: 27011 - DNA, 20 bp, Artificial Sequence
  chemically synthesized
actgctgcttctcaggcagg

SEQ ID NO: 27012 - DNA, 20 bp, Artificial Sequence
  chemically synthesized
tctctttcttcctgcctgag

SEQ ID NO: 27013 - DNA, 20 bp, Artificial Sequence
  chemically synthesized
acgactgctgcttctcaggc

SEQ ID NO: 27014 - DNA, 20 bp, Artificial Sequence
  chemically synthesized
gacgactgctgcttctcagg

SEQ ID NO: 27015 - DNA, 20 bp, Artificial Sequence
  chemically synthesized
ctttcttcctgcctgagaag

SEQ ID NO: 27016 - DNA, 20 bp, Artificial Sequence
  chemically synthesized
caagacgactgctgcttctc

SEQ ID NO: 27017 - DNA, 20 bp, Artificial Sequence
  chemically synthesized
ccaagacgactgctgcttct

SEQ ID NO: 27018 - DNA, 20 bp, Artificial Sequence
  chemically synthesized
tcttcctgcctgagaagcag

SEQ ID NO: 27019 - DNA, 20 bp, Artificial Sequence
  chemically synthesized
ctgagaagcagcagtcgtct

SEQ ID NO: 27020 - DNA, 20 bp, Artificial Sequence
  chemically synthesized
actttggtcctgatggttcc

SEQ ID NO: 27021 - DNA, 20 bp, Artificial Sequence
  chemically synthesized
agcagtcgtcttggaaccat

SEQ ID NO: 27022 - DNA, 20 bp, Artificial Sequence
  chemically synthesized
gcagtcgtcttggaaccatc

SEQ ID NO: 27023 - DNA, 20 bp, Artificial Sequence
  chemically synthesized
acgagtgactttggtcctga

SEQ ID NO: 27024 - DNA, 20 bp, Artificial Sequence
  chemically synthesized
tcttggaaccatcaggacca

SEQ ID NO: 27025 - DNA, 20 bp, Artificial Sequence
  chemically synthesized
ccatttttaacgagtgactt

SEQ ID NO: 27026 - DNA, 20 bp, Artificial Sequence
  chemically synthesized
tctgctgtaccatttttaac

SEQ ID NO: 27027 - DNA, 20 bp, Artificial Sequence
  chemically synthesized
ccaaagtcactcgttaaaaa

SEQ ID NO: 27028 - DNA, 20 bp, Artificial Sequence
  chemically synthesized
gtcactcgttaaaaatggta

SEQ ID NO: 27029 - DNA, 20 bp, Artificial Sequence
  chemically synthesized
actcgttaaaaatggtacag

SEQ ID NO: 27030 - DNA, 20 bp, Artificial Sequence
  chemically synthesized
tggtacagcagaataaacca

SEQ ID NO: 27031 - DNA, 20 bp, Artificial Sequence
  chemically synthesized
cagcagaataaaccatggcc

SEQ ID NO: 27032 - DNA, 20 bp, Artificial Sequence
  chemically synthesized
agcagaataaaccatggccc

SEQ ID NO: 27033 - DNA, 20 bp, Artificial Sequence
  chemically synthesized
gtcatcagagacctgggcca

SEQ ID NO: 27034 - DNA, 20 bp, Artificial Sequence
  chemically synthesized
cgtgatgtcatcagagacct

SEQ ID NO: 27035 - DNA, 20 bp, Artificial Sequence
  chemically synthesized
ccgtgatgtcatcagagacc

SEQ ID NO: 27036 - DNA, 20 bp, Artificial Sequence
  chemically synthesized
agagttccgtgatgtcatca

SEQ ID NO: 27037 - DNA, 20 bp, Artificial Sequence
  chemically synthesized
gaagagttccgtgatgtcat

SEQ ID NO: 27038 - DNA, 20 bp, Artificial Sequence
  chemically synthesized
ccaggtctctgatgacatca

SEQ ID NO: 27039 - DNA, 20 bp, Artificial Sequence
  chemically synthesized
gacatcacggaactcttcca

SEQ ID NO: 27040 - DNA, 20 bp, Artificial Sequence
  chemically synthesized
ggtagttgagagctatggaa

SEQ ID NO: 27041 - DNA, 20 bp, Artificial Sequence
  chemically synthesized
caggtagttgagagctatgg

SEQ ID NO: 27042 - DNA, 20 bp, Artificial Sequence
  chemically synthesized
aggcaggtagttgagagcta

SEQ ID NO: 27043 - DNA, 20 bp, Artificial Sequence
  chemically synthesized
gtctggaggcaggtagttga

SEQ ID NO: 27044 - DNA, 20 bp, Artificial Sequence
  chemically synthesized
aagtctggaggcaggtagtt

SEQ ID NO: 27045 - DNA, 20 bp, Artificial Sequence
  chemically synthesized
acaagaagtctggaggcagg

SEQ ID NO: 27046 - DNA, 20 bp, Artificial Sequence
  chemically synthesized
agctctcaactacctgcctc

SEQ ID NO: 27047 - DNA, 20 bp, Artificial Sequence
  chemically synthesized
agaacaagaagtctggaggc

SEQ ID NO: 27048 - DNA, 20 bp, Artificial Sequence
  chemically synthesized
tagaacaagaagtctggagg

SEQ ID NO: 27049 - DNA, 20 bp, Artificial Sequence
  chemically synthesized
ttgtagaacaagaagtctgg

SEQ ID NO: 27050 - DNA, 20 bp, Artificial Sequence
  chemically synthesized
tttgtagaacaagaagtctg

SEQ ID NO: 27051 - DNA, 20 bp, Artificial Sequence
  chemically synthesized
tttttgtagaacaagaagtc

SEQ ID NO: 27052 - DNA, 20 bp, Artificial Sequence
  chemically synthesized
gatattttttgtagaacaag

SEQ ID NO: 27053 - DNA, 20 bp, Artificial Sequence
  chemically synthesized
gttgatattttttgtagaac

SEQ ID NO: 27054 - DNA, 20 bp, Artificial Sequence
  chemically synthesized
agaggagttgatattttttg

SEQ ID NO: 27055 - DNA, 20 bp, Artificial Sequence
  chemically synthesized
attgtatcttaaacacagag

SEQ ID NO: 27056 - DNA, 20 bp, Artificial Sequence
  chemically synthesized
caattgtatcttaaacacag

SEQ ID NO: 27057 - DNA, 20 bp, Artificial Sequence
  chemically synthesized
atatcaactcctctgtgttt

SEQ ID NO: 27058 - DNA, 20 bp, Artificial Sequence
  chemically synthesized
ccaattgtatcttaaacaca

SEQ ID NO: 27059 - DNA, 20 bp, Artificial Sequence
  chemically synthesized
gaccaattgtatcttaaaca

SEQ ID NO: 27060 - DNA, 20 bp, Artificial Sequence
  chemically synthesized
ctctgtgtttaagatacaat

SEQ ID NO: 27061 - DNA, 20 bp, Artificial Sequence
  chemically synthesized
gtgtttaagatacaattggt

SEQ ID NO: 27062 - DNA, 20 bp, Artificial Sequence
  chemically synthesized
attttattaactgcaaccaa

SEQ ID NO: 27063 - DNA, 20 bp, Artificial Sequence
  chemically synthesized
ttagagatgacttttggttg

SEQ ID NO: 27064 - DNA, 20 bp, Artificial Sequence
  chemically synthesized
tgtcagttagagatgacttt

SEQ ID NO: 27065 - DNA, 20 bp, Artificial Sequence
  chemically synthesized
ttcaattaacatgtcagtta

SEQ ID NO: 27066 - DNA, 20 bp, Artificial Sequence
  chemically synthesized
agttcaattaacatgtcagt

SEQ ID NO: 27067 - DNA, 20 bp, Artificial Sequence
  chemically synthesized
ttacagttcaattaacatgt

SEQ ID NO: 27068 - DNA, 20 bp, Artificial Sequence
  chemically synthesized
tgacatgttaattgaactgt

SEQ ID NO: 27069 - DNA, 20 bp, Artificial Sequence
  chemically synthesized
cttctgcattttgttgctta

SEQ ID NO: 27070 - DNA, 20 bp, Artificial Sequence
  chemically synthesized
gaactgtaagcaacaaaatg

SEQ ID NO: 27071 - DNA, 20 bp, Artificial Sequence
  chemically synthesized
ctgtaagcaacaaaatgcag

SEQ ID NO: 27072 - DNA, 20 bp, Artificial Sequence
  chemically synthesized
acaaaatgcagaagactaaa

SEQ ID NO: 27073 - DNA, 20 bp, Artificial Sequence
  chemically synthesized
caaaatgcagaagactaaat

SEQ ID NO: 27074 - DNA, 20 bp, Artificial Sequence
  chemically synthesized
aaaatgcagaagactaaata

SEQ ID NO: 27075 - DNA, 20 bp, Artificial Sequence
  chemically synthesized
aatgcagaagactaaatagg

SEQ ID NO: 27076 - DNA, 20 bp, Artificial Sequence
  chemically synthesized
ggtggacgatgctccctatt

SEQ ID NO: 27077 - DNA, 20 bp, Artificial Sequence
  chemically synthesized
cgcaaggaggattgcggggg

SEQ ID NO: 27078 - DNA, 20 bp, Artificial Sequence
  chemically synthesized
caccgcaaggaggattgcgg

SEQ ID NO: 27079 - DNA, 20 bp, Artificial Sequence
  chemically synthesized
ccaccgcaaggaggattgcg

SEQ ID NO: 27080 - DNA, 20 bp, Artificial Sequence
  chemically synthesized
tccaccgcaaggaggattgc

SEQ ID NO: 27081 - DNA, 20 bp, Artificial Sequence
  chemically synthesized
ctccaccgcaaggaggattg

SEQ ID NO: 27082 - DNA, 20 bp, Artificial Sequence
  chemically synthesized
cacccccgcaatcctccttg

SEQ ID NO: 27083 - DNA, 20 bp, Artificial Sequence
  chemically synthesized
gtcatttctccaccgcaagg

SEQ ID NO: 27084 - DNA, 20 bp, Artificial Sequence
  chemically synthesized
ccccgcaatcctccttgcgg

SEQ ID NO: 27085 - DNA, 20 bp, Artificial Sequence
  chemically synthesized
cgtcatttctccaccgcaag

SEQ ID NO: 27086 - DNA, 20 bp, Artificial Sequence
  chemically synthesized
ccgcaatcctccttgcggtg

SEQ ID NO: 27087 - DNA, 20 bp, Artificial Sequence
  chemically synthesized
cacgtcatttctccaccgca

SEQ ID NO: 27088 - DNA, 20 bp, Artificial Sequence
  chemically synthesized
tcacgtcatttctccaccgc

SEQ ID NO: 27089 - DNA, 20 bp, Artificial Sequence
  chemically synthesized
ttgcggtggagaaatgacgt

SEQ ID NO: 27090 - DNA, 20 bp, Artificial Sequence
  chemically synthesized
gagaaatgacgtgagcacta

SEQ ID NO: 27091 - DNA, 20 bp, Artificial Sequence
  chemically synthesized
gaaatgacgtgagcactaaa

SEQ ID NO: 27092 - DNA, 20 bp, Artificial Sequence
  chemically synthesized
tctgccacccaagatctctt

SEQ ID NO: 27093 - DNA, 20 bp, Artificial Sequence
  chemically synthesized
cgtgagcactaaagagatct

SEQ ID NO: 27094 - DNA, 20 bp, Artificial Sequence
  chemically synthesized
gtgagcactaaagagatctt

SEQ ID NO: 27095 - DNA, 20 bp, Artificial Sequence
  chemically synthesized
agcactaaagagatcttggg

SEQ ID NO: 27096 - DNA, 20 bp, Artificial Sequence
  chemically synthesized
actaaagagatcttgggtgg

SEQ ID NO: 27097 - DNA, 20 bp, Artificial Sequence
  chemically synthesized
gatggagatctctgccaccc

SEQ ID NO: 27098 - DNA, 20 bp, Artificial Sequence
  chemically synthesized
taaagagatcttgggtggca

SEQ ID NO: 27099 - DNA, 20 bp, Artificial Sequence
  chemically synthesized
accacctggtagcaaggatg

SEQ ID NO: 27100 - DNA, 20 bp, Artificial Sequence
  chemically synthesized
gcaccacctggtagcaagga

SEQ ID NO: 27101 - DNA, 20 bp, Artificial Sequence
  chemically synthesized
gagatctccatccttgctac

SEQ ID NO: 27102 - DNA, 20 bp, Artificial Sequence
  chemically synthesized
agatctccatccttgctacc

SEQ ID NO: 27103 - DNA, 20 bp, Artificial Sequence
  chemically synthesized
agtggcaccacctggtagca

SEQ ID NO: 27104 - DNA, 20 bp, Artificial Sequence
  chemically synthesized
cagtggcaccacctggtagc

SEQ ID NO: 27105 - DNA, 20 bp, Artificial Sequence
  chemically synthesized
tctccatccttgctaccagg

SEQ ID NO: 27106 - DNA, 20 bp, Artificial Sequence
  chemically synthesized
gcatcagtggcaccacctgg

SEQ ID NO: 27107 - DNA, 20 bp, Artificial Sequence
  chemically synthesized
tctgcatcagtggcaccacc

SEQ ID NO: 27108 - DNA, 20 bp, Artificial Sequence
  chemically synthesized
accaggtggtgccactgatg

SEQ ID NO: 27109 - DNA, 20 bp, Artificial Sequence
  chemically synthesized
gtcaagctgttctgcatcag

SEQ ID NO: 27110 - DNA, 20 bp, Artificial Sequence
  chemically synthesized
gctgtcaagctgttctgcat

SEQ ID NO: 27111 - DNA, 20 bp, Artificial Sequence
  chemically synthesized
gtggtgccactgatgcagaa

SEQ ID NO: 27112 - DNA, 20 bp, Artificial Sequence
  chemically synthesized
actgatgcagaacagcttga

SEQ ID NO: 27113 - DNA, 20 bp, Artificial Sequence
  chemically synthesized
taaacgttaaattagctgtc

SEQ ID NO: 27114 - DNA, 20 bp, Artificial Sequence
  chemically synthesized
aattgttttaaacgttaaat

SEQ ID NO: 27115 - DNA, 20 bp, Artificial Sequence
  chemically synthesized
cgtttaaaacaattttataa

SEQ ID NO: 27116 - DNA, 20 bp, Artificial Sequence
  chemically synthesized
tttaaaacaattttataaca

SEQ ID NO: 27117 - DNA, 20 bp, Artificial Sequence
  chemically synthesized
ttaaaacaattttataacag

SEQ ID NO: 27118 - DNA, 20 bp, Artificial Sequence
  chemically synthesized
taaaacaattttataacaga

SEQ ID NO: 27119 - DNA, 20 bp, Artificial Sequence
  chemically synthesized
tttataacagagggcttata

SEQ ID NO: 27120 - DNA, 20 bp, Artificial Sequence
  chemically synthesized
ttataacagagggcttatat

SEQ ID NO: 27121 - DNA, 20 bp, Artificial Sequence
  chemically synthesized
gaagagtgccttacccatat

SEQ ID NO: 27122 - DNA, 20 bp, Artificial Sequence
  chemically synthesized
aacagagggcttatatgggt

SEQ ID NO: 27123 - DNA, 20 bp, Artificial Sequence
  chemically synthesized
acagagggcttatatgggta

SEQ ID NO: 27124 - DNA, 20 bp, Artificial Sequence
  chemically synthesized
atatgggtaaggcactcttc

SEQ ID NO: 27125 - DNA, 20 bp, Artificial Sequence
  chemically synthesized
tttgcagactttgtctagaa

SEQ ID NO: 27126 - DNA, 20 bp, Artificial Sequence
  chemically synthesized
gtaaggcactcttctagaca

SEQ ID NO: 27127 - DNA, 20 bp, Artificial Sequence
  chemically synthesized
actttgcagactttgtctag

SEQ ID NO: 27128 - DNA, 20 bp, Artificial Sequence
  chemically synthesized
aacactttgcagactttgtc

SEQ ID NO: 27129 - DNA, 20 bp, Artificial Sequence
  chemically synthesized
tcttctagacaaagtctgca

SEQ ID NO: 27130 - DNA, 20 bp, Artificial Sequence
  chemically synthesized
acaaatggctaaacactttg

SEQ ID NO: 27131 - DNA, 20 bp, Artificial Sequence
  chemically synthesized
gacaaagtctgcaaagtgtt

SEQ ID NO: 27132 - DNA, 20 bp, Artificial Sequence
  chemically synthesized
aaagtgtttagccatttgtt

SEQ ID NO: 27133 - DNA, 20 bp, Artificial Sequence
  chemically synthesized
aacgtcccattccaaacaaa

SEQ ID NO: 27134 - DNA, 20 bp, Artificial Sequence
  chemically synthesized
gtttagccatttgtttggaa

SEQ ID NO: 27135 - DNA, 20 bp, Artificial Sequence
  chemically synthesized
tttagccatttgtttggaat

SEQ ID NO: 27136 - DNA, 20 bp, Artificial Sequence
  chemically synthesized
gtttggaatgggacgttcac

SEQ ID NO: 27137 - DNA, 20 bp, Artificial Sequence
  chemically synthesized
atcttacatctgggcagaat

SEQ ID NO: 27138 - DNA, 20 bp, Artificial Sequence
  chemically synthesized
ttcacaagtctgattctgcc

SEQ ID NO: 27139 - DNA, 20 bp, Artificial Sequence
  chemically synthesized
atccttatcttacatctggg

SEQ ID NO: 27140 - DNA, 20 bp, Artificial Sequence
  chemically synthesized
gtctgattctgcccagatgt

SEQ ID NO: 27141 - DNA, 20 bp, Artificial Sequence
  chemically synthesized
ccaatccttatcttacatct

SEQ ID NO: 27142 - DNA, 20 bp, Artificial Sequence
  chemically synthesized
tccaatccttatcttacatc

SEQ ID NO: 27143 - DNA, 20 bp, Artificial Sequence
  chemically synthesized
attctgcccagatgtaagat

SEQ ID NO: 27144 - DNA, 20 bp, Artificial Sequence
  chemically synthesized
ttctgcccagatgtaagata

SEQ ID NO: 27145 - DNA, 20 bp, Artificial Sequence
  chemically synthesized
cccagatgtaagataaggat

SEQ ID NO: 27146 - DNA, 20 bp, Artificial Sequence
  chemically synthesized
attggaatttaaaaacatac

SEQ ID NO: 27147 - DNA, 20 bp, Artificial Sequence
  chemically synthesized
aaacatacaagttacttctc

SEQ ID NO: 27148 - DNA, 20 bp, Artificial Sequence
  chemically synthesized
tgacacgtgaatttccagag

SEQ ID NO: 27149 - DNA, 20 bp, Artificial Sequence
  chemically synthesized
ggttgacacgtgaatttcca

SEQ ID NO: 27150 - DNA, 20 bp, Artificial Sequence
  chemically synthesized
taggttgacacgtgaatttc

SEQ ID NO: 27151 - DNA, 20 bp, Artificial Sequence
  chemically synthesized
gattatatgtgttcatttat

SEQ ID NO: 27152 - DNA, 20 bp, Artificial Sequence
  chemically synthesized
tgattatatgtgttcattta

SEQ ID NO: 27153 - DNA, 20 bp, Artificial Sequence
  chemically synthesized
aatgaacacatataatcaac

SEQ ID NO: 27154 - DNA, 20 bp, Artificial Sequence
  chemically synthesized
ctaaagagttaatgaaaaac

SEQ ID NO: 27155 - DNA, 20 bp, Artificial Sequence
  chemically synthesized
ctagtttttcattaactctt

SEQ ID NO: 27156 - DNA, 20 bp, Artificial Sequence
  chemically synthesized
agtttttcattaactcttta

SEQ ID NO: 27157 - DNA, 20 bp, Artificial Sequence
  chemically synthesized
aacatttcattaactctaaa

SEQ ID NO: 27158 - DNA, 20 bp, Artificial Sequence
  chemically synthesized
tgaacatttcattaactcta

SEQ ID NO: 27159 - DNA, 20 bp, Artificial Sequence
  chemically synthesized
aatgttcataacttcatctc

SEQ ID NO: 27160 - DNA, 20 bp, Artificial Sequence
  chemically synthesized
gaaattttgcactagagatg

SEQ ID NO: 27161 - DNA, 20 bp, Artificial Sequence
  chemically synthesized
aaagaggaaattttgcacta

SEQ ID NO: 27162 - DNA, 20 bp, Artificial Sequence
  chemically synthesized
ataaagaggaaattttgcac

SEQ ID NO: 27163 - DNA, 20 bp, Artificial Sequence
  chemically synthesized
cttaagagctataaataaag

SEQ ID NO: 27164 - DNA, 20 bp, Artificial Sequence
  chemically synthesized
tcttaagagctataaataaa

SEQ ID NO: 27165 - DNA, 20 bp, Artificial Sequence
  chemically synthesized
caaaatttcctctttattta

SEQ ID NO: 27166 - DNA, 20 bp, Artificial Sequence
  chemically synthesized
tatcttaagagctataaata

SEQ ID NO: 27167 - DNA, 20 bp, Artificial Sequence
  chemically synthesized
cctctttatttatagctctt

SEQ ID NO: 27168 - DNA, 20 bp, Artificial Sequence
  chemically synthesized
ttaaataacatttatcttaa

SEQ ID NO: 27169 - DNA, 20 bp, Artificial Sequence
  chemically synthesized
ttttaaataacatttatctt

SEQ ID NO: 27170 - DNA, 20 bp, Artificial Sequence
  chemically synthesized
ataaatgttatttaaaaaaa

SEQ ID NO: 27171 - DNA, 20 bp, Artificial Sequence
  chemically synthesized
gttatttaaaaaaatagttt

SEQ ID NO: 27172 - DNA, 20 bp, Artificial Sequence
  chemically synthesized
tcaaaacatatgattagttg

SEQ ID NO: 27173 - DNA, 20 bp, Artificial Sequence
  chemically synthesized
tgactgtcaaaacatatgat

SEQ ID NO: 27174 - DNA, 20 bp, Artificial Sequence
  chemically synthesized
caactaatcatatgttttga

SEQ ID NO: 27175 - DNA, 20 bp, Artificial Sequence
  chemically synthesized
tatgttttgacagtcaaatt

SEQ ID NO: 27176 - DNA, 20 bp, Artificial Sequence
  chemically synthesized
ctgttagataaagggtagag

SEQ ID NO: 27177 - DNA, 20 bp, Artificial Sequence
  chemically synthesized
ttactgttagataaagggta

SEQ ID NO: 27178 - DNA, 20 bp, Artificial Sequence
  chemically synthesized
gtttactgttagataaaggg

SEQ ID NO: 27179 - DNA, 20 bp, Artificial Sequence
  chemically synthesized
aatgtttactgttagataaa

SEQ ID NO: 27180 - DNA, 20 bp, Artificial Sequence
  chemically synthesized
aaatgtttactgttagataa

SEQ ID NO: 27181 - DNA, 20 bp, Artificial Sequence
  chemically synthesized
cttctctaccctttatctaa

SEQ ID NO: 27182 - DNA, 20 bp, Artificial Sequence
  chemically synthesized
aaaatgtttactgttagata

SEQ ID NO: 27183 - DNA, 20 bp, Artificial Sequence
  chemically synthesized
gaacctaaaatgtttactgt

SEQ ID NO: 27184 - DNA, 20 bp, Artificial Sequence
  chemically synthesized
ttatctaacagtaaacattt

SEQ ID NO: 27185 - DNA, 20 bp, Artificial Sequence
  chemically synthesized
tatctaacagtaaacatttt

SEQ ID NO: 27186 - DNA, 20 bp, Artificial Sequence
  chemically synthesized
cagtaaacattttaggttct

SEQ ID NO: 27187 - DNA, 20 bp, Artificial Sequence
  chemically synthesized
ggatgcaaatcattttcact

SEQ ID NO: 27188 - DNA, 20 bp, Artificial Sequence
  chemically synthesized
aaatggaaagaggcagatgg

SEQ ID NO: 27189 - DNA, 20 bp, Artificial Sequence
  chemically synthesized
gaaatggaaagaggcagatg

SEQ ID NO: 27190 - DNA, 20 bp, Artificial Sequence
  chemically synthesized
gagaaatggaaagaggcaga

SEQ ID NO: 27191 - DNA, 20 bp, Artificial Sequence
  chemically synthesized
accagagaaatggaaagagg

SEQ ID NO: 27192 - DNA, 20 bp, Artificial Sequence
  chemically synthesized
ggcaccagagaaatggaaag

SEQ ID NO: 27193 - DNA, 20 bp, Artificial Sequence
  chemically synthesized
gggcaccagagaaatggaaa

SEQ ID NO: 27194 - DNA, 20 bp, Artificial Sequence
  chemically synthesized
ttgggcaccagagaaatgga

SEQ ID NO: 27195 - DNA, 20 bp, Artificial Sequence
  chemically synthesized
tctgcctctttccatttctc

SEQ ID NO: 27196 - DNA, 20 bp, Artificial Sequence
  chemically synthesized
gatgttgggcaccagagaaa

SEQ ID NO: 27197 - DNA, 20 bp, Artificial Sequence
  chemically synthesized
tgtgttgatgttgggcacca

SEQ ID NO: 27198 - DNA, 20 bp, Artificial Sequence
  chemically synthesized
ggtgtgttgatgttgggcac

SEQ ID NO: 27199 - DNA, 20 bp, Artificial Sequence
  chemically synthesized
attgggggtgtgttgatgtt

SEQ ID NO: 27200 - DNA, 20 bp, Artificial Sequence
  chemically synthesized
tattgggggtgtgttgatgt

SEQ ID NO: 27201 - DNA, 20 bp, Artificial Sequence
  chemically synthesized
ttagagggcatggatattgg

SEQ ID NO: 27202 - DNA, 20 bp, Artificial Sequence
  chemically synthesized
attagagggcatggatattg

SEQ ID NO: 27203 - DNA, 20 bp, Artificial Sequence
  chemically synthesized
tattagagggcatggatatt

SEQ ID NO: 27204 - DNA, 20 bp, Artificial Sequence
  chemically synthesized
ttattagagggcatggatat

SEQ ID NO: 27205 - DNA, 20 bp, Artificial Sequence
  chemically synthesized
atgatgattattagagggca

SEQ ID NO: 27206 - DNA, 20 bp, Artificial Sequence
  chemically synthesized
tattcatgatgattattaga

SEQ ID NO: 27207 - DNA, 20 bp, Artificial Sequence
  chemically synthesized
ttattcatgatgattattag

SEQ ID NO: 27208 - DNA, 20 bp, Artificial Sequence
  chemically synthesized
tttattcatgatgattatta

SEQ ID NO: 27209 - DNA, 20 bp, Artificial Sequence
  chemically synthesized
attttattcatgatgattat

SEQ ID NO: 27210 - DNA, 20 bp, Artificial Sequence
  chemically synthesized
aataatcatcatgaataaaa

SEQ ID NO: 27211 - DNA, 20 bp, Artificial Sequence
  chemically synthesized
atttctactgtggttcattt

SEQ ID NO: 27212 - DNA, 20 bp, Artificial Sequence
  chemically synthesized
atggatgccaaaatgaacca

SEQ ID NO: 27213 - DNA, 20 bp, Artificial Sequence
  chemically synthesized
gatgccaaaatgaaccacag

SEQ ID NO: 27214 - DNA, 20 bp, Artificial Sequence
  chemically synthesized
actaaggttaatttctactg

SEQ ID NO: 27215 - DNA, 20 bp, Artificial Sequence
  chemically synthesized
accacagtagaaattaacct

SEQ ID NO: 27216 - DNA, 20 bp, Artificial Sequence
  chemically synthesized
tgcttttcccatggtaacta

SEQ ID NO: 27217 - DNA, 20 bp, Artificial Sequence
  chemically synthesized
ttgcttttcccatggtaact

SEQ ID NO: 27218 - DNA, 20 bp, Artificial Sequence
  chemically synthesized
gaaattaaccttagttacca

SEQ ID NO: 27219 - DNA, 20 bp, Artificial Sequence
  chemically synthesized
aaattaaccttagttaccat

SEQ ID NO: 27220 - DNA, 20 bp, Artificial Sequence
  chemically synthesized
aaccttagttaccatgggaa

SEQ ID NO: 27221 - DNA, 20 bp, Artificial Sequence
  chemically synthesized
aggtcagtttgcttttccca

SEQ ID NO: 27222 - DNA, 20 bp, Artificial Sequence
  chemically synthesized
aatgttttttgcaagaaggt

SEQ ID NO: 27223 - DNA, 20 bp, Artificial Sequence
  chemically synthesized
caaaaatgttttttgcaaga

SEQ ID NO: 27224 - DNA, 20 bp, Artificial Sequence
  chemically synthesized
gcaaaaatgttttttgcaag

SEQ ID NO: 27225 - DNA, 20 bp, Artificial Sequence
  chemically synthesized
gttgcaaaaatgttttttgc

SEQ ID NO: 27226 - DNA, 20 bp, Artificial Sequence
  chemically synthesized
tttttgcaacatttctgtct

SEQ ID NO: 27227 - DNA, 20 bp, Artificial Sequence
  chemically synthesized
ttttgcaacatttctgtctt

SEQ ID NO: 27228 - DNA, 20 bp, Artificial Sequence
  chemically synthesized
gcatgcataccagcctaaga

SEQ ID NO: 27229 - DNA, 20 bp, Artificial Sequence
  chemically synthesized
gcaacatttctgtcttaggc

SEQ ID NO: 27230 - DNA, 20 bp, Artificial Sequence
  chemically synthesized
gaaagcatgcataccagcct

SEQ ID NO: 27231 - DNA, 20 bp, Artificial Sequence
  chemically synthesized
tgaggtgaaagcatgcatac

SEQ ID NO: 27232 - DNA, 20 bp, Artificial Sequence
  chemically synthesized
tatctttcctaatgaggtga

SEQ ID NO: 27233 - DNA, 20 bp, Artificial Sequence
  chemically synthesized
tatgcatgctttcacctcat

SEQ ID NO: 27234 - DNA, 20 bp, Artificial Sequence
  chemically synthesized
atgcatgctttcacctcatt

SEQ ID NO: 27235 - DNA, 20 bp, Artificial Sequence
  chemically synthesized
acaatgtatctttcctaatg

SEQ ID NO: 27236 - DNA, 20 bp, Artificial Sequence
  chemically synthesized
atgctttcacctcattagga

SEQ ID NO: 27237 - DNA, 20 bp, Artificial Sequence
  chemically synthesized
aacaatgtatctttcctaat

SEQ ID NO: 27238 - DNA, 20 bp, Artificial Sequence
  chemically synthesized
attaggaaagatacattgtt

SEQ ID NO: 27239 - DNA, 20 bp, Artificial Sequence
  chemically synthesized
ttaggaaagatacattgttt

SEQ ID NO: 27240 - DNA, 20 bp, Artificial Sequence
  chemically synthesized
ttttgttgatgttgctgttt

SEQ ID NO: 27241 - DNA, 20 bp, Artificial Sequence
  chemically synthesized
ttgttgatgttgctgtttga

SEQ ID NO: 27242 - DNA, 20 bp, Artificial Sequence
  chemically synthesized
tgttgatgttgctgtttgag

SEQ ID NO: 27243 - DNA, 20 bp, Artificial Sequence
  chemically synthesized
ctcttcttgcacctctcaaa

SEQ ID NO: 27244 - DNA, 20 bp, Artificial Sequence
  chemically synthesized
tgttgctgtttgagaggtgc

SEQ ID NO: 27245 - DNA, 20 bp, Artificial Sequence
  chemically synthesized
tgctgtttgagaggtgcaag

SEQ ID NO: 27246 - DNA, 20 bp, Artificial Sequence
  chemically synthesized
ctgtttgagaggtgcaagaa

SEQ ID NO: 27247 - DNA, 20 bp, Artificial Sequence
  chemically synthesized
gtgcaagaagagaatctgtt

SEQ ID NO: 27248 - DNA, 20 bp, Artificial Sequence
  chemically synthesized
attcatgcataaagactcaa

SEQ ID NO: 27249 - DNA, 20 bp, Artificial Sequence
  chemically synthesized
ggactcattattcatgcata

SEQ ID NO: 27250 - DNA, 20 bp, Artificial Sequence
  chemically synthesized
agtctttatgcatgaataat

SEQ ID NO: 27251 - DNA, 20 bp, Artificial Sequence
  chemically synthesized
tatgcatgaataatgagtcc

SEQ ID NO: 27252 - DNA, 20 bp, Artificial Sequence
  chemically synthesized
catgaataatgagtccaaga

SEQ ID NO: 27253 - DNA, 20 bp, Artificial Sequence
  chemically synthesized
tcttgaattgtgttctatct

SEQ ID NO: 27254 - DNA, 20 bp, Artificial Sequence
  chemically synthesized
tccaagatagaacacaattc

SEQ ID NO: 27255 - DNA, 20 bp, Artificial Sequence
  chemically synthesized
gaacacaattcaagatattt

SEQ ID NO: 27256 - DNA, 20 bp, Artificial Sequence
  chemically synthesized
attcaagatatttaagcatc

SEQ ID NO: 27257 - DNA, 20 bp, Artificial Sequence
  chemically synthesized
ttcaagatatttaagcatct

SEQ ID NO: 27258 - DNA, 20 bp, Artificial Sequence
  chemically synthesized
tatttaagcatctaggatca

SEQ ID NO: 27259 - DNA, 20 bp, Artificial Sequence
  chemically synthesized
cgcatagtttactatgatcc

SEQ ID NO: 27260 - DNA, 20 bp, Artificial Sequence
  chemically synthesized
acaaaaagcagagatacgca

SEQ ID NO: 27261 - DNA, 20 bp, Artificial Sequence
  chemically synthesized
gctagagtatacaaaaagca

SEQ ID NO: 27262 - DNA, 20 bp, Artificial Sequence
  chemically synthesized
atgctagagtatacaaaaag

SEQ ID NO: 27263 - DNA, 20 bp, Artificial Sequence
  chemically synthesized
gttatgctagagtatacaaa

SEQ ID NO: 27264 - DNA, 20 bp, Artificial Sequence
  chemically synthesized
tctctgctttttgtatactc

SEQ ID NO: 27265 - DNA, 20 bp, Artificial Sequence
  chemically synthesized
tcccctcttctgttatgcta

SEQ ID NO: 27266 - DNA, 20 bp, Artificial Sequence
  chemically synthesized
ttttgtatactctagcataa

SEQ ID NO: 27267 - DNA, 20 bp, Artificial Sequence
  chemically synthesized
gttcccctcttctgttatgc

SEQ ID NO: 27268 - DNA, 20 bp, Artificial Sequence
  chemically synthesized
tgtatactctagcataacag

SEQ ID NO: 27269 - DNA, 20 bp, Artificial Sequence
  chemically synthesized
tatactctagcataacagaa

SEQ ID NO: 27270 - DNA, 20 bp, Artificial Sequence
  chemically synthesized
atactctagcataacagaag

SEQ ID NO: 27271 - DNA, 20 bp, Artificial Sequence
  chemically synthesized
tactctagcataacagaaga

SEQ ID NO: 27272 - DNA, 20 bp, Artificial Sequence
  chemically synthesized
actctagcataacagaagag

SEQ ID NO: 27273 - DNA, 20 bp, Artificial Sequence
  chemically synthesized
agcataacagaagaggggaa

SEQ ID NO: 27274 - DNA, 20 bp, Artificial Sequence
  chemically synthesized
gcataacagaagaggggaac

SEQ ID NO: 27275 - DNA, 20 bp, Artificial Sequence
  chemically synthesized
taacagaagaggggaacagg

SEQ ID NO: 27276 - DNA, 20 bp, Artificial Sequence
  chemically synthesized
tctgcatgcatgggcaattt

SEQ ID NO: 27277 - DNA, 20 bp, Artificial Sequence
  chemically synthesized
actcaaattgcccatgcatg

SEQ ID NO: 27278 - DNA, 20 bp, Artificial Sequence
  chemically synthesized
tcacatgcttctgcatgcat

SEQ ID NO: 27279 - DNA, 20 bp, Artificial Sequence
  chemically synthesized
atcacatgcttctgcatgca

SEQ ID NO: 27280 - DNA, 20 bp, Artificial Sequence
  chemically synthesized
caaattgcccatgcatgcag

SEQ ID NO: 27281 - DNA, 20 bp, Artificial Sequence
  chemically synthesized
atgcatgcagaagcatgtga

SEQ ID NO: 27282 - DNA, 20 bp, Artificial Sequence
  chemically synthesized
gcatgcagaagcatgtgata

SEQ ID NO: 27283 - DNA, 20 bp, Artificial Sequence
  chemically synthesized
agttaacacataacagtgaa

SEQ ID NO: 27284 - DNA, 20 bp, Artificial Sequence
  chemically synthesized
ccagaaaagttaacacataa

SEQ ID NO: 27285 - DNA, 20 bp, Artificial Sequence
  chemically synthesized
ctgttatgtgttaacttttc

SEQ ID NO: 27286 - DNA, 20 bp, Artificial Sequence
  chemically synthesized
gttatgtgttaacttttctg

SEQ ID NO: 27287 - DNA, 20 bp, Artificial Sequence
  chemically synthesized
ttagcatctagtctccagaa

SEQ ID NO: 27288 - DNA, 20 bp, Artificial Sequence
  chemically synthesized
gtgttaacttttctggagac

SEQ ID NO: 27289 - DNA, 20 bp, Artificial Sequence
  chemically synthesized
catcattagcatctagtctc

SEQ ID NO: 27290 - DNA, 20 bp, Artificial Sequence
  chemically synthesized
aggatctcatcattagcatc

SEQ ID NO: 27291 - DNA, 20 bp, Artificial Sequence
  chemically synthesized
ggagactagatgctaatgat

SEQ ID NO: 27292 - DNA, 20 bp, Artificial Sequence
  chemically synthesized
cttcagcaggatctcatcat

SEQ ID NO: 27293 - DNA, 20 bp, Artificial Sequence
  chemically synthesized
ctaatgatgagatcctgctg

SEQ ID NO: 27294 - DNA, 20 bp, Artificial Sequence
  chemically synthesized
tacatattagtgtcttcagc

SEQ ID NO: 27295 - DNA, 20 bp, Artificial Sequence
  chemically synthesized
ttacatattagtgtcttcag

SEQ ID NO: 27296 - DNA, 20 bp, Artificial Sequence
  chemically synthesized
gatttacatattagtgtctt

SEQ ID NO: 27297 - DNA, 20 bp, Artificial Sequence
  chemically synthesized
ttaaggaatgatttacatat

SEQ ID NO: 27298 - DNA, 20 bp, Artificial Sequence
  chemically synthesized
ctgctaagtaattttgttta

SEQ ID NO: 27299 - DNA, 20 bp, Artificial Sequence
  chemically synthesized
gctgctaagtaattttgttt

SEQ ID NO: 27300 - DNA, 20 bp, Artificial Sequence
  chemically synthesized
attccttaaacaaaattact

SEQ ID NO: 27301 - DNA, 20 bp, Artificial Sequence
  chemically synthesized
ccttaaacaaaattacttag

SEQ ID NO: 27302 - DNA, 20 bp, Artificial Sequence
  chemically synthesized
ttatcataactgcagctgct

SEQ ID NO: 27303 - DNA, 20 bp, Artificial Sequence
  chemically synthesized
acaaaattacttagcagctg

SEQ ID NO: 27304 - DNA, 20 bp, Artificial Sequence
  chemically synthesized
gatttattttatcataactg

SEQ ID NO: 27305 - DNA, 20 bp, Artificial Sequence
  chemically synthesized
gttatgataaaataaatcaa

SEQ ID NO: 27306 - DNA, 20 bp, Artificial Sequence
  chemically synthesized
atgataaaataaatcaatgg

SEQ ID NO: 27307 - DNA, 20 bp, Artificial Sequence
  chemically synthesized
tgataaaataaatcaatggt

SEQ ID NO: 27308 - DNA, 20 bp, Artificial Sequence
  chemically synthesized
ataaaataaatcaatggtag

SEQ ID NO: 27309 - DNA, 20 bp, Artificial Sequence
  chemically synthesized
caatggtaggagattttcat

SEQ ID NO: 27310 - DNA, 20 bp, Artificial Sequence
  chemically synthesized
aggagattttcattagataa

SEQ ID NO: 27311 - DNA, 20 bp, Artificial Sequence
  chemically synthesized
tcattagataatggactgcc

SEQ ID NO: 27312 - DNA, 20 bp, Artificial Sequence
  chemically synthesized
gtctatgtcagagggccagg

SEQ ID NO: 27313 - DNA, 20 bp, Artificial Sequence
  chemically synthesized
tcagtctatgtcagagggcc

SEQ ID NO: 27314 - DNA, 20 bp, Artificial Sequence
  chemically synthesized
ctcagtctatgtcagagggc

SEQ ID NO: 27315 - DNA, 20 bp, Artificial Sequence
  chemically synthesized
gactgcctggccctctgaca

SEQ ID NO: 27316 - DNA, 20 bp, Artificial Sequence
  chemically synthesized
gcacctcagtctatgtcaga

SEQ ID NO: 27317 - DNA, 20 bp, Artificial Sequence
  chemically synthesized
agcacctcagtctatgtcag

SEQ ID NO: 27318 - DNA, 20 bp, Artificial Sequence
  chemically synthesized
aagcacctcagtctatgtca

SEQ ID NO: 27319 - DNA, 20 bp, Artificial Sequence
  chemically synthesized
aaaagcacctcagtctatgt

SEQ ID NO: 27320 - DNA, 20 bp, Artificial Sequence
  chemically synthesized
ctggccctctgacatagact

SEQ ID NO: 27321 - DNA, 20 bp, Artificial Sequence
  chemically synthesized
tggccctctgacatagactg

SEQ ID NO: 27322 - DNA, 20 bp, Artificial Sequence
  chemically synthesized
atcctttattaaaagcacct

SEQ ID NO: 27323 - DNA, 20 bp, Artificial Sequence
  chemically synthesized
agactgaggtgcttttaata

SEQ ID NO: 27324 - DNA, 20 bp, Artificial Sequence
  chemically synthesized
gactgaggtgcttttaataa

SEQ ID NO: 27325 - DNA, 20 bp, Artificial Sequence
  chemically synthesized
cttcaggcatcctttattaa

SEQ ID NO: 27326 - DNA, 20 bp, Artificial Sequence
  chemically synthesized
cttttaataaaggatgcctg

SEQ ID NO: 27327 - DNA, 20 bp, Artificial Sequence
  chemically synthesized
agggtaaacaggaacgcttc

SEQ ID NO: 27328 - DNA, 20 bp, Artificial Sequence
  chemically synthesized
gagggtaaacaggaacgctt

SEQ ID NO: 27329 - DNA, 20 bp, Artificial Sequence
  chemically synthesized
cagatacacagagggtaaac

SEQ ID NO: 27330 - DNA, 20 bp, Artificial Sequence
  chemically synthesized
ccagatacacagagggtaaa

SEQ ID NO: 27331 - DNA, 20 bp, Artificial Sequence
  chemically synthesized
gtattgtccagatacacaga

SEQ ID NO: 27332 - DNA, 20 bp, Artificial Sequence
  chemically synthesized
tgtattgtccagatacacag

SEQ ID NO: 27333 - DNA, 20 bp, Artificial Sequence
  chemically synthesized
atgtattgtccagatacaca

SEQ ID NO: 27334 - DNA, 20 bp, Artificial Sequence
  chemically synthesized
ctgtttaccctctgtgtatc

SEQ ID NO: 27335 - DNA, 20 bp, Artificial Sequence
  chemically synthesized
aaatgtattgtccagataca

SEQ ID NO: 27336 - DNA, 20 bp, Artificial Sequence
  chemically synthesized
ccagattcaaatgtattgtc

SEQ ID NO: 27337 - DNA, 20 bp, Artificial Sequence
  chemically synthesized
ctggacaatacatttgaatc

SEQ ID NO: 27338 - DNA, 20 bp, Artificial Sequence
  chemically synthesized
agtaccggtaatattggttc

SEQ ID NO: 27339 - DNA, 20 bp, Artificial Sequence
  chemically synthesized
gaatctggaaccaatattac

SEQ ID NO: 27340 - DNA, 20 bp, Artificial Sequence
  chemically synthesized
tcccggagtaccggtaatat

SEQ ID NO: 27341 - DNA, 20 bp, Artificial Sequence
  chemically synthesized
aaccaatattaccggtactc

SEQ ID NO: 27342 - DNA, 20 bp, Artificial Sequence
  chemically synthesized
accaatattaccggtactcc

SEQ ID NO: 27343 - DNA, 20 bp, Artificial Sequence
  chemically synthesized
agagtattttcccggagtac

SEQ ID NO: 27344 - DNA, 20 bp, Artificial Sequence
  chemically synthesized
ataaaaagagtattttcccg

SEQ ID NO: 27345 - DNA, 20 bp, Artificial Sequence
  chemically synthesized
aaataaaaagagtattttcc

SEQ ID NO: 27346 - DNA, 20 bp, Artificial Sequence
  chemically synthesized
aaataaaaataaaataaaaa

SEQ ID NO: 27347 - DNA, 20 bp, Artificial Sequence
  chemically synthesized
aaaaataaaaataaaataaa

SEQ ID NO: 27348 - DNA, 20 bp, Artificial Sequence
  chemically synthesized
tattttatttttattttttt

SEQ ID NO: 27349 - DNA, 20 bp, Artificial Sequence
  chemically synthesized
ttatttttattttttttaga

SEQ ID NO: 27350 - DNA, 20 bp, Artificial Sequence
  chemically synthesized
atttttattttttttagacg

SEQ ID NO: 27351 - DNA, 20 bp, Artificial Sequence
  chemically synthesized
tccagcctgggcgagagaat

SEQ ID NO: 27352 - DNA, 20 bp, Artificial Sequence
  chemically synthesized
cggagtctcattctctcgcc

SEQ ID NO: 27353 - DNA, 20 bp, Artificial Sequence
  chemically synthesized
ggagtctcattctctcgccc

SEQ ID NO: 27354 - DNA, 20 bp, Artificial Sequence
  chemically synthesized
ctgcattccagcctgggcga

SEQ ID NO: 27355 - DNA, 20 bp, Artificial Sequence
  chemically synthesized
cactgcattccagcctgggc

SEQ ID NO: 27356 - DNA, 20 bp, Artificial Sequence
  chemically synthesized
tctcattctctcgcccaggc

SEQ ID NO: 27357 - DNA, 20 bp, Artificial Sequence
  chemically synthesized
atgccactgcattccagcct

SEQ ID NO: 27358 - DNA, 20 bp, Artificial Sequence
  chemically synthesized
catgccactgcattccagcc

SEQ ID NO: 27359 - DNA, 20 bp, Artificial Sequence
  chemically synthesized
ctctcgcccaggctggaatg

SEQ ID NO: 27360 - DNA, 20 bp, Artificial Sequence
  chemically synthesized
gagatcatgccactgcattc

SEQ ID NO: 27361 - DNA, 20 bp, Artificial Sequence
  chemically synthesized
tcgcccaggctggaatgcag

SEQ ID NO: 27362 - DNA, 20 bp, Artificial Sequence
  chemically synthesized
ggaatgcagtggcatgatct

SEQ ID NO: 27363 - DNA, 20 bp, Artificial Sequence
  chemically synthesized
ggcagaggttgcagtgagcc

SEQ ID NO: 27364 - DNA, 20 bp, Artificial Sequence
  chemically synthesized
caggaggcagaggttgcagt

SEQ ID NO: 27365 - DNA, 20 bp, Artificial Sequence
  chemically synthesized
aacccaggaggcagaggttg

SEQ ID NO: 27366 - DNA, 20 bp, Artificial Sequence
  chemically synthesized
cacttgaacccaggaggcag

SEQ ID NO: 27367 - DNA, 20 bp, Artificial Sequence
  chemically synthesized
tcactgcaacctctgcctcc

SEQ ID NO: 27368 - DNA, 20 bp, Artificial Sequence
  chemically synthesized
tcacttgaacccaggaggca

SEQ ID NO: 27369 - DNA, 20 bp, Artificial Sequence
  chemically synthesized
cactgcaacctctgcctcct

SEQ ID NO: 27370 - DNA, 20 bp, Artificial Sequence
  chemically synthesized
catcacttgaacccaggagg

SEQ ID NO: 27371 - DNA, 20 bp, Artificial Sequence
  chemically synthesized
aagcatcacttgaacccagg

SEQ ID NO: 27372 - DNA, 20 bp, Artificial Sequence
  chemically synthesized
caagcatcacttgaacccag

SEQ ID NO: 27373 - DNA, 20 bp, Artificial Sequence
  chemically synthesized
aacctctgcctcctgggttc

SEQ ID NO: 27374 - DNA, 20 bp, Artificial Sequence
  chemically synthesized
cacaagcatcacttgaaccc

SEQ ID NO: 27375 - DNA, 20 bp, Artificial Sequence
  chemically synthesized
gcacaagcatcacttgaacc

SEQ ID NO: 27376 - DNA, 20 bp, Artificial Sequence
  chemically synthesized
ttcaagtgatgcttgtgcct

SEQ ID NO: 27377 - DNA, 20 bp, Artificial Sequence
  chemically synthesized
tacttgggaggctgaggcac

SEQ ID NO: 27378 - DNA, 20 bp, Artificial Sequence
  chemically synthesized
accagctacttgggaggctg

SEQ ID NO: 27379 - DNA, 20 bp, Artificial Sequence
  chemically synthesized
taccagctacttgggaggct

SEQ ID NO: 27380 - DNA, 20 bp, Artificial Sequence
  chemically synthesized
tgcttgtgcctcagcctccc

SEQ ID NO: 27381 - DNA, 20 bp, Artificial Sequence
  chemically synthesized
ttgtgcctcagcctcccaag

SEQ ID NO: 27382 - DNA, 20 bp, Artificial Sequence
  chemically synthesized
tgtaataccagctacttggg

SEQ ID NO: 27383 - DNA, 20 bp, Artificial Sequence
  chemically synthesized
ctgtaataccagctacttgg

SEQ ID NO: 27384 - DNA, 20 bp, Artificial Sequence
  chemically synthesized
gcctcagcctcccaagtagc

SEQ ID NO: 27385 - DNA, 20 bp, Artificial Sequence
  chemically synthesized
acctgtaataccagctactt

SEQ ID NO: 27386 - DNA, 20 bp, Artificial Sequence
  chemically synthesized
cacctgtaataccagctact

SEQ ID NO: 27387 - DNA, 20 bp, Artificial Sequence
  chemically synthesized
ctcccaagtagctggtatta

SEQ ID NO: 27388 - DNA, 20 bp, Artificial Sequence
  chemically synthesized
tcccaagtagctggtattac

SEQ ID NO: 27389 - DNA, 20 bp, Artificial Sequence
  chemically synthesized
gtggtgggcacctgtaatac

SEQ ID NO: 27390 - DNA, 20 bp, Artificial Sequence
  chemically synthesized
aattagctgggcgtggtggt

SEQ ID NO: 27391 - DNA, 20 bp, Artificial Sequence
  chemically synthesized
aaattagctgggcgtggtgg

SEQ ID NO: 27392 - DNA, 20 bp, Artificial Sequence
  chemically synthesized
caggtgcccaccaccacgcc

SEQ ID NO: 27393 - DNA, 20 bp, Artificial Sequence
  chemically synthesized
tgaaaattagctgggcgtgg

SEQ ID NO: 27394 - DNA, 20 bp, Artificial Sequence
  chemically synthesized
atatgaaaattagctgggcg

SEQ ID NO: 27395 - DNA, 20 bp, Artificial Sequence
  chemically synthesized
taaaaatatgaaaattagct

SEQ ID NO: 27396 - DNA, 20 bp, Artificial Sequence
  chemically synthesized
ctaaaaatatgaaaattagc

SEQ ID NO: 27397 - DNA, 20 bp, Artificial Sequence
  chemically synthesized
tctactaaaaatatgaaaat

SEQ ID NO: 27398 - DNA, 20 bp, Artificial Sequence
  chemically synthesized
ccagctaattttcatatttt

SEQ ID NO: 27399 - DNA, 20 bp, Artificial Sequence
  chemically synthesized
gctaattttcatatttttag

SEQ ID NO: 27400 - DNA, 20 bp, Artificial Sequence
  chemically synthesized
taattttcatatttttagta

SEQ ID NO: 27401 - DNA, 20 bp, Artificial Sequence
  chemically synthesized
ttcatatttttagtagagat

SEQ ID NO: 27402 - DNA, 20 bp, Artificial Sequence
  chemically synthesized
tcatatttttagtagagatg

SEQ ID NO: 27403 - DNA, 20 bp, Artificial Sequence
  chemically synthesized
gagatgaggtttcaccatgc

SEQ ID NO: 27404 - DNA, 20 bp, Artificial Sequence
  chemically synthesized
tgaggtttcaccatgctggc

SEQ ID NO: 27405 - DNA, 20 bp, Artificial Sequence
  chemically synthesized
cgagaccagcctggccagca

SEQ ID NO: 27406 - DNA, 20 bp, Artificial Sequence
  chemically synthesized
gaggtttcaccatgctggcc

SEQ ID NO: 27407 - DNA, 20 bp, Artificial Sequence
  chemically synthesized
tttcaccatgctggccaggc

SEQ ID NO: 27408 - DNA, 20 bp, Artificial Sequence
  chemically synthesized
gagttcgagaccagcctggc

SEQ ID NO: 27409 - DNA, 20 bp, Artificial Sequence
  chemically synthesized
tcgggagttcgagaccagcc

SEQ ID NO: 27410 - DNA, 20 bp, Artificial Sequence
  chemically synthesized
tgaggtcgggagttcgagac

SEQ ID NO: 27411 - DNA, 20 bp, Artificial Sequence
  chemically synthesized
tcacttgaggtcgggagttc

SEQ ID NO: 27412 - DNA, 20 bp, Artificial Sequence
  chemically synthesized
ggcagatcacttgaggtcgg

SEQ ID NO: 27413 - DNA, 20 bp, Artificial Sequence
  chemically synthesized
ggtctcgaactcccgacctc

SEQ ID NO: 27414 - DNA, 20 bp, Artificial Sequence
  chemically synthesized
caggcagatcacttgaggtc

SEQ ID NO: 27415 - DNA, 20 bp, Artificial Sequence
  chemically synthesized
gcaggcagatcacttgaggt

SEQ ID NO: 27416 - DNA, 20 bp, Artificial Sequence
  chemically synthesized
caaggcaggcagatcacttg

SEQ ID NO: 27417 - DNA, 20 bp, Artificial Sequence
  chemically synthesized
ccaaggcaggcagatcactt

SEQ ID NO: 27418 - DNA, 20 bp, Artificial Sequence
  chemically synthesized
ctcaagtgatctgcctgcct

SEQ ID NO: 27419 - DNA, 20 bp, Artificial Sequence
  chemically synthesized
ctttgggaggccaaggcagg

SEQ ID NO: 27420 - DNA, 20 bp, Artificial Sequence
  chemically synthesized
gcactttgggaggccaaggc

SEQ ID NO: 27421 - DNA, 20 bp, Artificial Sequence
  chemically synthesized
agcactttgggaggccaagg

SEQ ID NO: 27422 - DNA, 20 bp, Artificial Sequence
  chemically synthesized
ctcagcactttgggaggcca

SEQ ID NO: 27423 - DNA, 20 bp, Artificial Sequence
  chemically synthesized
tctcagcactttgggaggcc

SEQ ID NO: 27424 - DNA, 20 bp, Artificial Sequence
  chemically synthesized
ctgcctgccttggcctccca

SEQ ID NO: 27425 - DNA, 20 bp, Artificial Sequence
  chemically synthesized
tgtaatctcagcactttggg

SEQ ID NO: 27426 - DNA, 20 bp, Artificial Sequence
  chemically synthesized
ctgtaatctcagcactttgg

SEQ ID NO: 27427 - DNA, 20 bp, Artificial Sequence
  chemically synthesized
gcctgtaatctcagcacttt

SEQ ID NO: 27428 - DNA, 20 bp, Artificial Sequence
  chemically synthesized
ccttggcctcccaaagtgct

SEQ ID NO: 27429 - DNA, 20 bp, Artificial Sequence
  chemically synthesized
cgcctgtaatctcagcactt

SEQ ID NO: 27430 - DNA, 20 bp, Artificial Sequence
  chemically synthesized
ctcccaaagtgctgagatta

SEQ ID NO: 27431 - DNA, 20 bp, Artificial Sequence
  chemically synthesized
tcccaaagtgctgagattac

SEQ ID NO: 27432 - DNA, 20 bp, Artificial Sequence
  chemically synthesized
atagttcacgcctgtaatct

SEQ ID NO: 27433 - DNA, 20 bp, Artificial Sequence
  chemically synthesized
caggcgtgaactattgtgcc

SEQ ID NO: 27434 - DNA, 20 bp, Artificial Sequence
  chemically synthesized
cttttcaaggctgggcacaa

SEQ ID NO: 27435 - DNA, 20 bp, Artificial Sequence
  chemically synthesized
agaagagtcttttcaaggct

SEQ ID NO: 27436 - DNA, 20 bp, Artificial Sequence
  chemically synthesized
aagaagagtcttttcaaggc

SEQ ID NO: 27437 - DNA, 20 bp, Artificial Sequence
  chemically synthesized
ctattgtgcccagccttgaa

SEQ ID NO: 27438 - DNA, 20 bp, Artificial Sequence
  chemically synthesized
gataaagaagagtcttttca

SEQ ID NO: 27439 - DNA, 20 bp, Artificial Sequence
  chemically synthesized
tgataaagaagagtcttttc

SEQ ID NO: 27440 - DNA, 20 bp, Artificial Sequence
  chemically synthesized
agttttgaggtgataaagaa

SEQ ID NO: 27441 - DNA, 20 bp, Artificial Sequence
  chemically synthesized
atagttttgaggtgataaag

SEQ ID NO: 27442 - DNA, 20 bp, Artificial Sequence
  chemically synthesized
agcatagttttgaggtgata

SEQ ID NO: 27443 - DNA, 20 bp, Artificial Sequence
  chemically synthesized
ccaaatgcagcatagttttg

SEQ ID NO: 27444 - DNA, 20 bp, Artificial Sequence
  chemically synthesized
cccaaatgcagcatagtttt

SEQ ID NO: 27445 - DNA, 20 bp, Artificial Sequence
  chemically synthesized
agcaactcccaaatgcagca

SEQ ID NO: 27446 - DNA, 20 bp, Artificial Sequence
  chemically synthesized
cctcaaaactatgctgcatt

SEQ ID NO: 27447 - DNA, 20 bp, Artificial Sequence
  chemically synthesized
ctcaaaactatgctgcattt

SEQ ID NO: 27448 - DNA, 20 bp, Artificial Sequence
  chemically synthesized
caaaactatgctgcatttgg

SEQ ID NO: 27449 - DNA, 20 bp, Artificial Sequence
  chemically synthesized
tatcaagcaactcccaaatg

SEQ ID NO: 27450 - DNA, 20 bp, Artificial Sequence
  chemically synthesized
tttgggagttgcttgatata

SEQ ID NO: 27451 - DNA, 20 bp, Artificial Sequence
  chemically synthesized
aattggtaaagctttatatc

SEQ ID NO: 27452 - DNA, 20 bp, Artificial Sequence
  chemically synthesized
attgaatcttcaaattggta

SEQ ID NO: 27453 - DNA, 20 bp, Artificial Sequence
  chemically synthesized
tataaagctttaccaatttg

SEQ ID NO: 27454 - DNA, 20 bp, Artificial Sequence
  chemically synthesized
cttggattgaatcttcaaat

SEQ ID NO: 27455 - DNA, 20 bp, Artificial Sequence
  chemically synthesized
ccaatttgaagattcaatcc

SEQ ID NO: 27456 - DNA, 20 bp, Artificial Sequence
  chemically synthesized
tgaagattcaatccaagaat

SEQ ID NO: 27457 - DNA, 20 bp, Artificial Sequence
  chemically synthesized
gaagattcaatccaagaatc

SEQ ID NO: 27458 - DNA, 20 bp, Artificial Sequence
  chemically synthesized
ctcagagtctgcccgattct

SEQ ID NO: 27459 - DNA, 20 bp, Artificial Sequence
  chemically synthesized
gattcaatccaagaatcggg

SEQ ID NO: 27460 - DNA, 20 bp, Artificial Sequence
  chemically synthesized
ccaagaatcgggcagactct

SEQ ID NO: 27461 - DNA, 20 bp, Artificial Sequence
  chemically synthesized
gaggtgggcagaggaactca

SEQ ID NO: 27462 - DNA, 20 bp, Artificial Sequence
  chemically synthesized
atgaggtgggcagaggaact

SEQ ID NO: 27463 - DNA, 20 bp, Artificial Sequence
  chemically synthesized
gccatccatgaggtgggcag

SEQ ID NO: 27464 - DNA, 20 bp, Artificial Sequence
  chemically synthesized
ggccatccatgaggtgggca

SEQ ID NO: 27465 - DNA, 20 bp, Artificial Sequence
  chemically synthesized
agggccatccatgaggtggg

SEQ ID NO: 27466 - DNA, 20 bp, Artificial Sequence
  chemically synthesized
gagttcctctgcccacctca

SEQ ID NO: 27467 - DNA, 20 bp, Artificial Sequence
  chemically synthesized
ttcagggccatccatgaggt

SEQ ID NO: 27468 - DNA, 20 bp, Artificial Sequence
  chemically synthesized
cttcagggccatccatgagg

SEQ ID NO: 27469 - DNA, 20 bp, Artificial Sequence
  chemically synthesized
tcctctgcccacctcatgga

SEQ ID NO: 27470 - DNA, 20 bp, Artificial Sequence
  chemically synthesized
tgacttcagggccatccatg

SEQ ID NO: 27471 - DNA, 20 bp, Artificial Sequence
  chemically synthesized
gtgacttcagggccatccat

SEQ ID NO: 27472 - DNA, 20 bp, Artificial Sequence
  chemically synthesized
ccacctcatggatggccctg

SEQ ID NO: 27473 - DNA, 20 bp, Artificial Sequence
  chemically synthesized
aactcactcctgtgacttca

SEQ ID NO: 27474 - DNA, 20 bp, Artificial Sequence
  chemically synthesized
catggatggccctgaagtca

SEQ ID NO: 27475 - DNA, 20 bp, Artificial Sequence
  chemically synthesized
aaactcactcctgtgacttc

SEQ ID NO: 27476 - DNA, 20 bp, Artificial Sequence
  chemically synthesized
atggatggccctgaagtcac

SEQ ID NO: 27477 - DNA, 20 bp, Artificial Sequence
  chemically synthesized
caaactcactcctgtgactt

SEQ ID NO: 27478 - DNA, 20 bp, Artificial Sequence
  chemically synthesized
ggatggccctgaagtcacag

SEQ ID NO: 27479 - DNA, 20 bp, Artificial Sequence
  chemically synthesized
ggccctgaagtcacaggagt

SEQ ID NO: 27480 - DNA, 20 bp, Artificial Sequence
  chemically synthesized
tgccactgagaggagaaaga

SEQ ID NO: 27481 - DNA, 20 bp, Artificial Sequence
  chemically synthesized
ttgccactgagaggagaaag

SEQ ID NO: 27482 - DNA, 20 bp, Artificial Sequence
  chemically synthesized
tcattgccactgagaggaga

SEQ ID NO: 27483 - DNA, 20 bp, Artificial Sequence
  chemically synthesized
gtttgccttctttctcctct

SEQ ID NO: 27484 - DNA, 20 bp, Artificial Sequence
  chemically synthesized
tgccttctttctcctctcag

SEQ ID NO: 27485 - DNA, 20 bp, Artificial Sequence
  chemically synthesized
gtggtcattgccactgagag

SEQ ID NO: 27486 - DNA, 20 bp, Artificial Sequence
  chemically synthesized
ccgtggtcattgccactgag

SEQ ID NO: 27487 - DNA, 20 bp, Artificial Sequence
  chemically synthesized
tccgtggtcattgccactga

SEQ ID NO: 27488 - DNA, 20 bp, Artificial Sequence
  chemically synthesized
aatccgtggtcattgccact

SEQ ID NO: 27489 - DNA, 20 bp, Artificial Sequence
  chemically synthesized
cctctcagtggcaatgacca

SEQ ID NO: 27490 - DNA, 20 bp, Artificial Sequence
  chemically synthesized
tccaaaagacaaggaatccg

SEQ ID NO: 27491 - DNA, 20 bp, Artificial Sequence
  chemically synthesized
accacggattccttgtcttt

SEQ ID NO: 27492 - DNA, 20 bp, Artificial Sequence
  chemically synthesized
aggaggcaatccaaaagaca

SEQ ID NO: 27493 - DNA, 20 bp, Artificial Sequence
  chemically synthesized
taggaggcaatccaaaagac

SEQ ID NO: 27494 - DNA, 20 bp, Artificial Sequence
  chemically synthesized
tgaagtaggaggcaatccaa

SEQ ID NO: 27495 - DNA, 20 bp, Artificial Sequence
  chemically synthesized
cctgtctgctatgaagtagg

SEQ ID NO: 27496 - DNA, 20 bp, Artificial Sequence
  chemically synthesized
ccctgtctgctatgaagtag

SEQ ID NO: 27497 - DNA, 20 bp, Artificial Sequence
  chemically synthesized
ttggattgcctcctacttca

SEQ ID NO: 27498 - DNA, 20 bp, Artificial Sequence
  chemically synthesized
agccctgtctgctatgaagt

SEQ ID NO: 27499 - DNA, 20 bp, Artificial Sequence
  chemically synthesized
gagccctgtctgctatgaag

SEQ ID NO: 27500 - DNA, 20 bp, Artificial Sequence
  chemically synthesized
gattgcctcctacttcatag

SEQ ID NO: 27501 - DNA, 20 bp, Artificial Sequence
  chemically synthesized
aatgagccctgtctgctatg

SEQ ID NO: 27502 - DNA, 20 bp, Artificial Sequence
  chemically synthesized
gcctcctacttcatagcaga

SEQ ID NO: 27503 - DNA, 20 bp, Artificial Sequence
  chemically synthesized
cctcctacttcatagcagac

SEQ ID NO: 27504 - DNA, 20 bp, Artificial Sequence
  chemically synthesized
ctcctacttcatagcagaca

SEQ ID NO: 27505 - DNA, 20 bp, Artificial Sequence
  chemically synthesized
gaggcagagaaagggggaat

SEQ ID NO: 27506 - DNA, 20 bp, Artificial Sequence
  chemically synthesized
aacagagaggcagagaaagg

SEQ ID NO: 27507 - DNA, 20 bp, Artificial Sequence
  chemically synthesized
aaacagagaggcagagaaag

SEQ ID NO: 27508 - DNA, 20 bp, Artificial Sequence
  chemically synthesized
gaaacagagaggcagagaaa

SEQ ID NO: 27509 - DNA, 20 bp, Artificial Sequence
  chemically synthesized
agaaacagagaggcagagaa

SEQ ID NO: 27510 - DNA, 20 bp, Artificial Sequence
  chemically synthesized
gagaaacagagaggcagaga

SEQ ID NO: 27511 - DNA, 20 bp, Artificial Sequence
  chemically synthesized
gtgagagaaacagagaggca

SEQ ID NO: 27512 - DNA, 20 bp, Artificial Sequence
  chemically synthesized
aagtgagagaaacagagagg

SEQ ID NO: 27513 - DNA, 20 bp, Artificial Sequence
  chemically synthesized
gagaagtgagagaaacagag

SEQ ID NO: 27514 - DNA, 20 bp, Artificial Sequence
  chemically synthesized
tgagaagtgagagaaacaga

SEQ ID NO: 27515 - DNA, 20 bp, Artificial Sequence
  chemically synthesized
ggtgagaagtgagagaaaca

SEQ ID NO: 27516 - DNA, 20 bp, Artificial Sequence
  chemically synthesized
gaggtgagaagtgagagaaa

SEQ ID NO: 27517 - DNA, 20 bp, Artificial Sequence
  chemically synthesized
aaagctgaggtgagaagtga

SEQ ID NO: 27518 - DNA, 20 bp, Artificial Sequence
  chemically synthesized
agaaagctgaggtgagaagt

SEQ ID NO: 27519 - DNA, 20 bp, Artificial Sequence
  chemically synthesized
gtttctctcacttctcacct

SEQ ID NO: 27520 - DNA, 20 bp, Artificial Sequence
  chemically synthesized
gaaaagaaagctgaggtgag

SEQ ID NO: 27521 - DNA, 20 bp, Artificial Sequence
  chemically synthesized
gttgaaaagaaagctgaggt

SEQ ID NO: 27522 - DNA, 20 bp, Artificial Sequence
  chemically synthesized
gtgtgttgaaaagaaagctg

SEQ ID NO: 27523 - DNA, 20 bp, Artificial Sequence
  chemically synthesized
agtgtgttgaaaagaaagct

SEQ ID NO: 27524 - DNA, 20 bp, Artificial Sequence
  chemically synthesized
gatccagtgtgttgaaaaga

SEQ ID NO: 27525 - DNA, 20 bp, Artificial Sequence
  chemically synthesized
gtcagatccagtgtgttgaa

SEQ ID NO: 27526 - DNA, 20 bp, Artificial Sequence
  chemically synthesized
cagctttcttttcaacacac

SEQ ID NO: 27527 - DNA, 20 bp, Artificial Sequence
  chemically synthesized
aataaaagctgggtcagatc

SEQ ID NO: 27528 - DNA, 20 bp, Artificial Sequence
  chemically synthesized
tcaacacactggatctgacc

SEQ ID NO: 27529 - DNA, 20 bp, Artificial Sequence
  chemically synthesized
gaggagaataaaagctgggt

SEQ ID NO: 27530 - DNA, 20 bp, Artificial Sequence
  chemically synthesized
ttctgaggagaataaaagct

SEQ ID NO: 27531 - DNA, 20 bp, Artificial Sequence
  chemically synthesized
attctgaggagaataaaagc

SEQ ID NO: 27532 - DNA, 20 bp, Artificial Sequence
  chemically synthesized
caggattctgaggagaataa

SEQ ID NO: 27533 - DNA, 20 bp, Artificial Sequence
  chemically synthesized
gacccagcttttattctcct

SEQ ID NO: 27534 - DNA, 20 bp, Artificial Sequence
  chemically synthesized
gttttgtccaggattctgag

SEQ ID NO: 27535 - DNA, 20 bp, Artificial Sequence
  chemically synthesized
tagttttgtccaggattctg

SEQ ID NO: 27536 - DNA, 20 bp, Artificial Sequence
  chemically synthesized
ttttattctcctcagaatcc

SEQ ID NO: 27537 - DNA, 20 bp, Artificial Sequence
  chemically synthesized
gtagttttgtccaggattct

SEQ ID NO: 27538 - DNA, 20 bp, Artificial Sequence
  chemically synthesized
atcctcaagtagttttgtcc

SEQ ID NO: 27539 - DNA, 20 bp, Artificial Sequence
  chemically synthesized
tatcctcaagtagttttgtc

SEQ ID NO: 27540 - DNA, 20 bp, Artificial Sequence
  chemically synthesized
aatcctggacaaaactactt

SEQ ID NO: 27541 - DNA, 20 bp, Artificial Sequence
  chemically synthesized
atcctggacaaaactacttg

SEQ ID NO: 27542 - DNA, 20 bp, Artificial Sequence
  chemically synthesized
gctttaggtttatcctcaag

SEQ ID NO: 27543 - DNA, 20 bp, Artificial Sequence
  chemically synthesized
gctgctttaggtttatcctc

SEQ ID NO: 27544 - DNA, 20 bp, Artificial Sequence
  chemically synthesized
actacttgaggataaaccta

SEQ ID NO: 27545 - DNA, 20 bp, Artificial Sequence
  chemically synthesized
acttgaggataaacctaaag

SEQ ID NO: 27546 - DNA, 20 bp, Artificial Sequence
  chemically synthesized
taggaaaaaagggctgcttt

SEQ ID NO: 27547 - DNA, 20 bp, Artificial Sequence
  chemically synthesized
ttaggaaaaaagggctgctt

SEQ ID NO: 27548 - DNA, 20 bp, Artificial Sequence
  chemically synthesized
acctacatcttaggaaaaaa

SEQ ID NO: 27549 - DNA, 20 bp, Artificial Sequence
  chemically synthesized
cacctacatcttaggaaaaa

SEQ ID NO: 27550 - DNA, 20 bp, Artificial Sequence
  chemically synthesized
taaagcagcccttttttcct

SEQ ID NO: 27551 - DNA, 20 bp, Artificial Sequence
  chemically synthesized
tcacctacatcttaggaaaa

SEQ ID NO: 27552 - DNA, 20 bp, Artificial Sequence
  chemically synthesized
agcccttttttcctaagatg

SEQ ID NO: 27553 - DNA, 20 bp, Artificial Sequence
  chemically synthesized
gcccttttttcctaagatgt

SEQ ID NO: 27554 - DNA, 20 bp, Artificial Sequence
  chemically synthesized
gtaagagtcacctacatctt

SEQ ID NO: 27555 - DNA, 20 bp, Artificial Sequence
  chemically synthesized
agtaagagtcacctacatct

SEQ ID NO: 27556 - DNA, 20 bp, Artificial Sequence
  chemically synthesized
gatgtaggtgactcttactt

SEQ ID NO: 27557 - DNA, 20 bp, Artificial Sequence
  chemically synthesized
tacaaaaagagctgaagtaa

SEQ ID NO: 27558 - DNA, 20 bp, Artificial Sequence
  chemically synthesized
catacaaaaagagctgaagt

SEQ ID NO: 27559 - DNA, 20 bp, Artificial Sequence
  chemically synthesized
cttgcatacaaaaagagctg

SEQ ID NO: 27560 - DNA, 20 bp, Artificial Sequence
  chemically synthesized
ggaatacttgcatacaaaaa

SEQ ID NO: 27561 - DNA, 20 bp, Artificial Sequence
  chemically synthesized
agggaatacttgcatacaaa

SEQ ID NO: 27562 - DNA, 20 bp, Artificial Sequence
  chemically synthesized
cttcagctctttttgtatgc

SEQ ID NO: 27563 - DNA, 20 bp, Artificial Sequence
  chemically synthesized
ttgtatgcaagtattccctg

SEQ ID NO: 27564 - DNA, 20 bp, Artificial Sequence
  chemically synthesized
gtatgcaagtattccctgta

SEQ ID NO: 27565 - DNA, 20 bp, Artificial Sequence
  chemically synthesized
tttttctctttggctctaca

SEQ ID NO: 27566 - DNA, 20 bp, Artificial Sequence
  chemically synthesized
gtttttctctttggctctac

SEQ ID NO: 27567 - DNA, 20 bp, Artificial Sequence
  chemically synthesized
cgtttttctctttggctcta

SEQ ID NO: 27568 - DNA, 20 bp, Artificial Sequence
  chemically synthesized
aagtattccctgtagagcca

SEQ ID NO: 27569 - DNA, 20 bp, Artificial Sequence
  chemically synthesized
gtattccctgtagagccaaa

SEQ ID NO: 27570 - DNA, 20 bp, Artificial Sequence
  chemically synthesized
gtcacttccgtttttctctt

SEQ ID NO: 27571 - DNA, 20 bp, Artificial Sequence
  chemically synthesized
tgtagagccaaagagaaaaa

SEQ ID NO: 27572 - DNA, 20 bp, Artificial Sequence
  chemically synthesized
agagccaaagagaaaaacgg

SEQ ID NO: 27573 - DNA, 20 bp, Artificial Sequence
  chemically synthesized
aaagagaaaaacggaagtga

SEQ ID NO: 27574 - DNA, 20 bp, Artificial Sequence
  chemically synthesized
aagagaaaaacggaagtgac

SEQ ID NO: 27575 - DNA, 20 bp, Artificial Sequence
  chemically synthesized
aaacggaagtgacaggccga

SEQ ID NO: 27576 - DNA, 20 bp, Artificial Sequence
  chemically synthesized
cggaagtgacaggccgatgg

SEQ ID NO: 27577 - DNA, 20 bp, Artificial Sequence
  chemically synthesized
aagtgacaggccgatggcag

SEQ ID NO: 27578 - DNA, 20 bp, Artificial Sequence
  chemically synthesized
gttagtattccttctgccat

SEQ ID NO: 27579 - DNA, 20 bp, Artificial Sequence
  chemically synthesized
agtgacaggccgatggcaga

SEQ ID NO: 27580 - DNA, 20 bp, Artificial Sequence
  chemically synthesized
cttgagtgctcagcgaatgt

SEQ ID NO: 27581 - DNA, 20 bp, Artificial Sequence
  chemically synthesized
aaggaatactaacattcgct

SEQ ID NO: 27582 - DNA, 20 bp, Artificial Sequence
  chemically synthesized
ctaacattcgctgagcactc

SEQ ID NO: 27583 - DNA, 20 bp, Artificial Sequence
  chemically synthesized
gacatttgcccttgagtgct

SEQ ID NO: 27584 - DNA, 20 bp, Artificial Sequence
  chemically synthesized
taacattcgctgagcactca

SEQ ID NO: 27585 - DNA, 20 bp, Artificial Sequence
  chemically synthesized
aacattcgctgagcactcaa

SEQ ID NO: 27586 - DNA, 20 bp, Artificial Sequence
  chemically synthesized
tacacacgacatttgccctt

SEQ ID NO: 27587 - DNA, 20 bp, Artificial Sequence
  chemically synthesized
tgtaaggactcgatggtatc

SEQ ID NO: 27588 - DNA, 20 bp, Artificial Sequence
  chemically synthesized
ttgtaaggactcgatggtat

SEQ ID NO: 27589 - DNA, 20 bp, Artificial Sequence
  chemically synthesized
cgtgtgtacctgataccatc

SEQ ID NO: 27590 - DNA, 20 bp, Artificial Sequence
  chemically synthesized
agggccttgtaaggactcga

SEQ ID NO: 27591 - DNA, 20 bp, Artificial Sequence
  chemically synthesized
tgataccatcgagtccttac

SEQ ID NO: 27592 - DNA, 20 bp, Artificial Sequence
  chemically synthesized
gataccatcgagtccttaca

SEQ ID NO: 27593 - DNA, 20 bp, Artificial Sequence
  chemically synthesized
acagaactcagggccttgta

SEQ ID NO: 27594 - DNA, 20 bp, Artificial Sequence
  chemically synthesized
tacagaactcagggccttgt

SEQ ID NO: 27595 - DNA, 20 bp, Artificial Sequence
  chemically synthesized
tcgagtccttacaaggccct

SEQ ID NO: 27596 - DNA, 20 bp, Artificial Sequence
  chemically synthesized
agctgataatacagaactca

SEQ ID NO: 27597 - DNA, 20 bp, Artificial Sequence
  chemically synthesized
aagctgataatacagaactc

SEQ ID NO: 27598 - DNA, 20 bp, Artificial Sequence
  chemically synthesized
aaagctgataatacagaact

SEQ ID NO: 27599 - DNA, 20 bp, Artificial Sequence
  chemically synthesized
ggccctgagttctgtattat

SEQ ID NO: 27600 - DNA, 20 bp, Artificial Sequence
  chemically synthesized
ctttaacaaagctgataata

SEQ ID NO: 27601 - DNA, 20 bp, Artificial Sequence
  chemically synthesized
ctgtattatcagctttgtta

SEQ ID NO: 27602 - DNA, 20 bp, Artificial Sequence
  chemically synthesized
gcctcattttatctttaaca

SEQ ID NO: 27603 - DNA, 20 bp, Artificial Sequence
  chemically synthesized
agctttgttaaagataaaat

SEQ ID NO: 27604 - DNA, 20 bp, Artificial Sequence
  chemically synthesized
gctttgttaaagataaaatg

SEQ ID NO: 27605 - DNA, 20 bp, Artificial Sequence
  chemically synthesized
ggaagttaccaaacatttgt

SEQ ID NO: 27606 - DNA, 20 bp, Artificial Sequence
  chemically synthesized
aaatgaggctcacaaatgtt

SEQ ID NO: 27607 - DNA, 20 bp, Artificial Sequence
  chemically synthesized
aatgtttggtaacttcccta

SEQ ID NO: 27608 - DNA, 20 bp, Artificial Sequence
  chemically synthesized
tctgggatgcaaccgtaggg

SEQ ID NO: 27609 - DNA, 20 bp, Artificial Sequence
  chemically synthesized
ggctctgggatgcaaccgta

SEQ ID NO: 27610 - DNA, 20 bp, Artificial Sequence
  chemically synthesized
aggctctgggatgcaaccgt

SEQ ID NO: 27611 - DNA, 20 bp, Artificial Sequence
  chemically synthesized
caggctctgggatgcaaccg

SEQ ID NO: 27612 - DNA, 20 bp, Artificial Sequence
  chemically synthesized
acttccctacggttgcatcc

SEQ ID NO: 27613 - DNA, 20 bp, Artificial Sequence
  chemically synthesized
ttccctacggttgcatccca

SEQ ID NO: 27614 - DNA, 20 bp, Artificial Sequence
  chemically synthesized
tggtcttgaatgcaggctct

SEQ ID NO: 27615 - DNA, 20 bp, Artificial Sequence
  chemically synthesized
ttggtcttgaatgcaggctc

SEQ ID NO: 27616 - DNA, 20 bp, Artificial Sequence
  chemically synthesized
gcatcccagagcctgcattc

SEQ ID NO: 27617 - DNA, 20 bp, Artificial Sequence
  chemically synthesized
aaagatttggtcttgaatgc

SEQ ID NO: 27618 - DNA, 20 bp, Artificial Sequence
  chemically synthesized
gaaagatttggtcttgaatg

SEQ ID NO: 27619 - DNA, 20 bp, Artificial Sequence
  chemically synthesized
ctttgagtgtcagaaagatt

SEQ ID NO: 27620 - DNA, 20 bp, Artificial Sequence
  chemically synthesized
cagaggctttgagtgtcaga

SEQ ID NO: 27621 - DNA, 20 bp, Artificial Sequence
  chemically synthesized
ccaaatctttctgacactca

SEQ ID NO: 27622 - DNA, 20 bp, Artificial Sequence
  chemically synthesized
ccatcagaggctttgagtgt

SEQ ID NO: 27623 - DNA, 20 bp, Artificial Sequence
  chemically synthesized
ggaaggccatcagaggcttt

SEQ ID NO: 27624 - DNA, 20 bp, Artificial Sequence
  chemically synthesized
ctgacactcaaagcctctga

SEQ ID NO: 27625 - DNA, 20 bp, Artificial Sequence
  chemically synthesized
gaagcggggaaggccatcag

SEQ ID NO: 27626 - DNA, 20 bp, Artificial Sequence
  chemically synthesized
agaagcggggaaggccatca

SEQ ID NO: 27627 - DNA, 20 bp, Artificial Sequence
  chemically synthesized
ggagaagcggggaaggccat

SEQ ID NO: 27628 - DNA, 20 bp, Artificial Sequence
  chemically synthesized
ctgtagcggagaagcgggga

SEQ ID NO: 27629 - DNA, 20 bp, Artificial Sequence
  chemically synthesized
tctgtagcggagaagcgggg

SEQ ID NO: 27630 - DNA, 20 bp, Artificial Sequence
  chemically synthesized
tgttctgtagcggagaagcg

SEQ ID NO: 27631 - DNA, 20 bp, Artificial Sequence
  chemically synthesized
ttgttctgtagcggagaagc

SEQ ID NO: 27632 - DNA, 20 bp, Artificial Sequence
  chemically synthesized
tttgttctgtagcggagaag

SEQ ID NO: 27633 - DNA, 20 bp, Artificial Sequence
  chemically synthesized
acatttgttctgtagcggag

SEQ ID NO: 27634 - DNA, 20 bp, Artificial Sequence
  chemically synthesized
ccttccccgcttctccgcta

SEQ ID NO: 27635 - DNA, 20 bp, Artificial Sequence
  chemically synthesized
aagacatttgttctgtagcg

SEQ ID NO: 27636 - DNA, 20 bp, Artificial Sequence
  chemically synthesized
gaaagacatttgttctgtag

SEQ ID NO: 27637 - DNA, 20 bp, Artificial Sequence
  chemically synthesized
aaggaaagacatttgttctg

SEQ ID NO: 27638 - DNA, 20 bp, Artificial Sequence
  chemically synthesized
aggattacactgggtaagga

SEQ ID NO: 27639 - DNA, 20 bp, Artificial Sequence
  chemically synthesized
aacaaatgtctttccttacc

SEQ ID NO: 27640 - DNA, 20 bp, Artificial Sequence
  chemically synthesized
aattaggattacactgggta

SEQ ID NO: 27641 - DNA, 20 bp, Artificial Sequence
  chemically synthesized
taattaggattacactgggt

SEQ ID NO: 27642 - DNA, 20 bp, Artificial Sequence
  chemically synthesized
gtgctaattaggattacact

SEQ ID NO: 27643 - DNA, 20 bp, Artificial Sequence
  chemically synthesized
tgtgctaattaggattacac

SEQ ID NO: 27644 - DNA, 20 bp, Artificial Sequence
  chemically synthesized
ttacccagtgtaatcctaat

SEQ ID NO: 27645 - DNA, 20 bp, Artificial Sequence
  chemically synthesized
cattcacccttgtgctaatt

SEQ ID NO: 27646 - DNA, 20 bp, Artificial Sequence
  chemically synthesized
ccattcacccttgtgctaat

SEQ ID NO: 27647 - DNA, 20 bp, Artificial Sequence
  chemically synthesized
agtgtaatcctaattagcac

SEQ ID NO: 27648 - DNA, 20 bp, Artificial Sequence
  chemically synthesized
gtgtaatcctaattagcaca

SEQ ID NO: 27649 - DNA, 20 bp, Artificial Sequence
  chemically synthesized
tgtaatcctaattagcacaa

SEQ ID NO: 27650 - DNA, 20 bp, Artificial Sequence
  chemically synthesized
ctaattagcacaagggtgaa

SEQ ID NO: 27651 - DNA, 20 bp, Artificial Sequence
  chemically synthesized
taattagcacaagggtgaat

SEQ ID NO: 27652 - DNA, 20 bp, Artificial Sequence
  chemically synthesized
ttagcacaagggtgaatggg

SEQ ID NO: 27653 - DNA, 20 bp, Artificial Sequence
  chemically synthesized
gcacaagggtgaatgggcag

SEQ ID NO: 27654 - DNA, 20 bp, Artificial Sequence
  chemically synthesized
tgaatgggcagtagtaccct

SEQ ID NO: 27655 - DNA, 20 bp, Artificial Sequence
  chemically synthesized
atgggcagtagtaccctcag

SEQ ID NO: 27656 - DNA, 20 bp, Artificial Sequence
  chemically synthesized
cggtatcatggttcttctga

SEQ ID NO: 27657 - DNA, 20 bp, Artificial Sequence
  chemically synthesized
ccggtatcatggttcttctg

SEQ ID NO: 27658 - DNA, 20 bp, Artificial Sequence
  chemically synthesized
cccggtatcatggttcttct

SEQ ID NO: 27659 - DNA, 20 bp, Artificial Sequence
  chemically synthesized
cctcagaagaaccatgatac

SEQ ID NO: 27660 - DNA, 20 bp, Artificial Sequence
  chemically synthesized
ctcagaagaaccatgatacc

SEQ ID NO: 27661 - DNA, 20 bp, Artificial Sequence
  chemically synthesized
ctgctccttgcccggtatca

SEQ ID NO: 27662 - DNA, 20 bp, Artificial Sequence
  chemically synthesized
gaagaaccatgataccgggc

SEQ ID NO: 27663 - DNA, 20 bp, Artificial Sequence
  chemically synthesized
aagaaccatgataccgggca

SEQ ID NO: 27664 - DNA, 20 bp, Artificial Sequence
  chemically synthesized
gaaccatgataccgggcaag

SEQ ID NO: 27665 - DNA, 20 bp, Artificial Sequence
  chemically synthesized
cataccctctgctccttgcc

SEQ ID NO: 27666 - DNA, 20 bp, Artificial Sequence
  chemically synthesized
ccatgataccgggcaaggag

SEQ ID NO: 27667 - DNA, 20 bp, Artificial Sequence
  chemically synthesized
atgataccgggcaaggagca

SEQ ID NO: 27668 - DNA, 20 bp, Artificial Sequence
  chemically synthesized
tgataccgggcaaggagcag

SEQ ID NO: 27669 - DNA, 20 bp, Artificial Sequence
  chemically synthesized
gataccgggcaaggagcaga

SEQ ID NO: 27670 - DNA, 20 bp, Artificial Sequence
  chemically synthesized
cgggcaaggagcagagggta

SEQ ID NO: 27671 - DNA, 20 bp, Artificial Sequence
  chemically synthesized
gggcaaggagcagagggtat

SEQ ID NO: 27672 - DNA, 20 bp, Artificial Sequence
  chemically synthesized
ggcaaggagcagagggtatg

SEQ ID NO: 27673 - DNA, 20 bp, Artificial Sequence
  chemically synthesized
aggagcagagggtatggggt

SEQ ID NO: 27674 - DNA, 20 bp, Artificial Sequence
  chemically synthesized
ggagcagagggtatggggtg

SEQ ID NO: 27675 - DNA, 20 bp, Artificial Sequence
  chemically synthesized
gcagagggtatggggtgagg

SEQ ID NO: 27676 - DNA, 20 bp, Artificial Sequence
  chemically synthesized
tgaggcagaaacccttgcac

SEQ ID NO: 27677 - DNA, 20 bp, Artificial Sequence
  chemically synthesized
gaggcagaaacccttgcaca

SEQ ID NO: 27678 - DNA, 20 bp, Artificial Sequence
  chemically synthesized
tccctgtggtccttgtgcaa

SEQ ID NO: 27679 - DNA, 20 bp, Artificial Sequence
  chemically synthesized
ctccctgtggtccttgtgca

SEQ ID NO: 27680 - DNA, 20 bp, Artificial Sequence
  chemically synthesized
cctccctgtggtccttgtgc

SEQ ID NO: 27681 - DNA, 20 bp, Artificial Sequence
  chemically synthesized
aaacccttgcacaaggacca

SEQ ID NO: 27682 - DNA, 20 bp, Artificial Sequence
  chemically synthesized
aacccttgcacaaggaccac

SEQ ID NO: 27683 - DNA, 20 bp, Artificial Sequence
  chemically synthesized
acccttgcacaaggaccaca

SEQ ID NO: 27684 - DNA, 20 bp, Artificial Sequence
  chemically synthesized
ccttgcacaaggaccacagg

SEQ ID NO: 27685 - DNA, 20 bp, Artificial Sequence
  chemically synthesized
cttgcacaaggaccacaggg

SEQ ID NO: 27686 - DNA, 20 bp, Artificial Sequence
  chemically synthesized
ttgcacaaggaccacaggga

SEQ ID NO: 27687 - DNA, 20 bp, Artificial Sequence
  chemically synthesized
ctggtcagtttccctccctg

SEQ ID NO: 27688 - DNA, 20 bp, Artificial Sequence
  chemically synthesized
ccacagggagggaaactgac

SEQ ID NO: 27689 - DNA, 20 bp, Artificial Sequence
  chemically synthesized
ccctcatcccattgactggt

SEQ ID NO: 27690 - DNA, 20 bp, Artificial Sequence
  chemically synthesized
gagggaaactgaccagtcaa

SEQ ID NO: 27691 - DNA, 20 bp, Artificial Sequence
  chemically synthesized
agggaaactgaccagtcaat

SEQ ID NO: 27692 - DNA, 20 bp, Artificial Sequence
  chemically synthesized
cactccctcatcccattgac

SEQ ID NO: 27693 - DNA, 20 bp, Artificial Sequence
  chemically synthesized
aactgaccagtcaatgggat

SEQ ID NO: 27694 - DNA, 20 bp, Artificial Sequence
  chemically synthesized
actgaccagtcaatgggatg

SEQ ID NO: 27695 - DNA, 20 bp, Artificial Sequence
  chemically synthesized
ctgaccagtcaatgggatga

SEQ ID NO: 27696 - DNA, 20 bp, Artificial Sequence
  chemically synthesized
gaccagtcaatgggatgagg

SEQ ID NO: 27697 - DNA, 20 bp, Artificial Sequence
  chemically synthesized
caatgggatgagggagtgac

SEQ ID NO: 27698 - DNA, 20 bp, Artificial Sequence
  chemically synthesized
aatgggatgagggagtgacc

SEQ ID NO: 27699 - DNA, 20 bp, Artificial Sequence
  chemically synthesized
tattggtctagttacattcc

SEQ ID NO: 27700 - DNA, 20 bp, Artificial Sequence
  chemically synthesized
ggagtgaccaggaatgtaac

SEQ ID NO: 27701 - DNA, 20 bp, Artificial Sequence
  chemically synthesized
gaacttcatcattattggtc

SEQ ID NO: 27702 - DNA, 20 bp, Artificial Sequence
  chemically synthesized
actgggaacttcatcattat

SEQ ID NO: 27703 - DNA, 20 bp, Artificial Sequence
  chemically synthesized
taactagaccaataatgatg

SEQ ID NO: 27704 - DNA, 20 bp, Artificial Sequence
  chemically synthesized
accaataatgatgaagttcc

SEQ ID NO: 27705 - DNA, 20 bp, Artificial Sequence
  chemically synthesized
ttctctagataaggaggact

SEQ ID NO: 27706 - DNA, 20 bp, Artificial Sequence
  chemically synthesized
cttctctagataaggaggac

SEQ ID NO: 27707 - DNA, 20 bp, Artificial Sequence
  chemically synthesized
agttcccagtcctccttatc

SEQ ID NO: 27708 - DNA, 20 bp, Artificial Sequence
  chemically synthesized
gcaaacttctctagataagg

SEQ ID NO: 27709 - DNA, 20 bp, Artificial Sequence
  chemically synthesized
agcaaacttctctagataag

SEQ ID NO: 27710 - DNA, 20 bp, Artificial Sequence
  chemically synthesized
ttcccagtcctccttatcta

SEQ ID NO: 27711 - DNA, 20 bp, Artificial Sequence
  chemically synthesized
tcagcaaacttctctagata

SEQ ID NO: 27712 - DNA, 20 bp, Artificial Sequence
  chemically synthesized
ttcagcaaacttctctagat

SEQ ID NO: 27713 - DNA, 20 bp, Artificial Sequence
  chemically synthesized
ccagtcctccttatctagag

SEQ ID NO: 27714 - DNA, 20 bp, Artificial Sequence
  chemically synthesized
gattattcagcaaacttctc

SEQ ID NO: 27715 - DNA, 20 bp, Artificial Sequence
  chemically synthesized
tactgcaggtgttgattatt

SEQ ID NO: 27716 - DNA, 20 bp, Artificial Sequence
  chemically synthesized
tgctgaataatcaacacctg

SEQ ID NO: 27717 - DNA, 20 bp, Artificial Sequence
  chemically synthesized
ataatcaacacctgcagtac

SEQ ID NO: 27718 - DNA, 20 bp, Artificial Sequence
  chemically synthesized
atggtagaaactcgtactgc

SEQ ID NO: 27719 - DNA, 20 bp, Artificial Sequence
  chemically synthesized
aatggtagaaactcgtactg

SEQ ID NO: 27720 - DNA, 20 bp, Artificial Sequence
  chemically synthesized
aacttttgtaggaaaaatgg

SEQ ID NO: 27721 - DNA, 20 bp, Artificial Sequence
  chemically synthesized
aaaaacttttgtaggaaaaa

SEQ ID NO: 27722 - DNA, 20 bp, Artificial Sequence
  chemically synthesized
ttctaccatttttcctacaa

SEQ ID NO: 27723 - DNA, 20 bp, Artificial Sequence
  chemically synthesized
tgggagcaaaaaacttttgt

SEQ ID NO: 27724 - DNA, 20 bp, Artificial Sequence
  chemically synthesized
atgggagcaaaaaacttttg

SEQ ID NO: 27725 - DNA, 20 bp, Artificial Sequence
  chemically synthesized
acaaaagttttttgctccca

SEQ ID NO: 27726 - DNA, 20 bp, Artificial Sequence
  chemically synthesized
gcagctgtatgtttctatgg

SEQ ID NO: 27727 - DNA, 20 bp, Artificial Sequence
  chemically synthesized
aagcagctgtatgtttctat

SEQ ID NO: 27728 - DNA, 20 bp, Artificial Sequence
  chemically synthesized
aaagcagctgtatgtttcta

SEQ ID NO: 27729 - DNA, 20 bp, Artificial Sequence
  chemically synthesized
tttgctcccatagaaacata

SEQ ID NO: 27730 - DNA, 20 bp, Artificial Sequence
  chemically synthesized
tgcaccatgtaaatagaaag

SEQ ID NO: 27731 - DNA, 20 bp, Artificial Sequence
  chemically synthesized
tactgcaccatgtaaataga

SEQ ID NO: 27732 - DNA, 20 bp, Artificial Sequence
  chemically synthesized
acagctgctttctatttaca

SEQ ID NO: 27733 - DNA, 20 bp, Artificial Sequence
  chemically synthesized
gatatactgcaccatgtaaa

SEQ ID NO: 27734 - DNA, 20 bp, Artificial Sequence
  chemically synthesized
tgctttctatttacatggtg

SEQ ID NO: 27735 - DNA, 20 bp, Artificial Sequence
  chemically synthesized
atttacatggtgcagtatat

SEQ ID NO: 27736 - DNA, 20 bp, Artificial Sequence
  chemically synthesized
tttacatggtgcagtatatc

SEQ ID NO: 27737 - DNA, 20 bp, Artificial Sequence
  chemically synthesized
tgcagtatatcaggcactct

SEQ ID NO: 27738 - DNA, 20 bp, Artificial Sequence
  chemically synthesized
gcagtatatcaggcactctg

SEQ ID NO: 27739 - DNA, 20 bp, Artificial Sequence
  chemically synthesized
cagtatatcaggcactctga

SEQ ID NO: 27740 - DNA, 20 bp, Artificial Sequence
  chemically synthesized
agaatcttagttaaccctca

SEQ ID NO: 27741 - DNA, 20 bp, Artificial Sequence
  chemically synthesized
acagaatcttagttaaccct

SEQ ID NO: 27742 - DNA, 20 bp, Artificial Sequence
  chemically synthesized
aggcactctgagggttaact

SEQ ID NO: 27743 - DNA, 20 bp, Artificial Sequence
  chemically synthesized
gtccctaagtcacagaatct

SEQ ID NO: 27744 - DNA, 20 bp, Artificial Sequence
  chemically synthesized
ttaactaagattctgtgact

SEQ ID NO: 27745 - DNA, 20 bp, Artificial Sequence
  chemically synthesized
taactaagattctgtgactt

SEQ ID NO: 27746 - DNA, 20 bp, Artificial Sequence
  chemically synthesized
aactaagattctgtgactta

SEQ ID NO: 27747 - DNA, 20 bp, Artificial Sequence
  chemically synthesized
gtggttaggtccctaagtca

SEQ ID NO: 27748 - DNA, 20 bp, Artificial Sequence
  chemically synthesized
taaatggtggttaggtccct

SEQ ID NO: 27749 - DNA, 20 bp, Artificial Sequence
  chemically synthesized
atgtgttataaatggtggtt

SEQ ID NO: 27750 - DNA, 20 bp, Artificial Sequence
  chemically synthesized
aatgtgttataaatggtggt

SEQ ID NO: 27751 - DNA, 20 bp, Artificial Sequence
  chemically synthesized
atgaaatgtgttataaatgg

SEQ ID NO: 27752 - DNA, 20 bp, Artificial Sequence
  chemically synthesized
ggaatgaaatgtgttataaa

SEQ ID NO: 27753 - DNA, 20 bp, Artificial Sequence
  chemically synthesized
taagtcagttgcatacaatt

SEQ ID NO: 27754 - DNA, 20 bp, Artificial Sequence
  chemically synthesized
ttccaagtttatttgtaagt

SEQ ID NO: 27755 - DNA, 20 bp, Artificial Sequence
  chemically synthesized
tctgttccaagtttatttgt

SEQ ID NO: 27756 - DNA, 20 bp, Artificial Sequence
  chemically synthesized
aactgacttacaaataaact

SEQ ID NO: 27757 - DNA, 20 bp, Artificial Sequence
  chemically synthesized
acttacaaataaacttggaa

SEQ ID NO: 27758 - DNA, 20 bp, Artificial Sequence
  chemically synthesized
ttacaaataaacttggaaca

SEQ ID NO: 27759 - DNA, 20 bp, Artificial Sequence
  chemically synthesized
ttaccctcgggctctgttcc

SEQ ID NO: 27760 - DNA, 20 bp, Artificial Sequence
  chemically synthesized
ataaacttggaacagagccc

SEQ ID NO: 27761 - DNA, 20 bp, Artificial Sequence
  chemically synthesized
taaacttggaacagagcccg

SEQ ID NO: 27762 - DNA, 20 bp, Artificial Sequence
  chemically synthesized
aaacttggaacagagcccga

SEQ ID NO: 27763 - DNA, 20 bp, Artificial Sequence
  chemically synthesized
ttggaacagagcccgagggt

SEQ ID NO: 27764 - DNA, 20 bp, Artificial Sequence
  chemically synthesized
gcctttccaaacttaccctc

SEQ ID NO: 27765 - DNA, 20 bp, Artificial Sequence
  chemically synthesized
ggcctttccaaacttaccct

SEQ ID NO: 27766 - DNA, 20 bp, Artificial Sequence
  chemically synthesized
acagagcccgagggtaagtt

SEQ ID NO: 27767 - DNA, 20 bp, Artificial Sequence
  chemically synthesized
agcccgagggtaagtttgga

SEQ ID NO: 27768 - DNA, 20 bp, Artificial Sequence
  chemically synthesized
gcccgagggtaagtttggaa

SEQ ID NO: 27769 - DNA, 20 bp, Artificial Sequence
  chemically synthesized
cccaccttgagacaagattt

SEQ ID NO: 27770 - DNA, 20 bp, Artificial Sequence
  chemically synthesized
tcccaccttgagacaagatt

SEQ ID NO: 27771 - DNA, 20 bp, Artificial Sequence
  chemically synthesized
aaaggcctaaatcttgtctc

SEQ ID NO: 27772 - DNA, 20 bp, Artificial Sequence
  chemically synthesized
aaggcctaaatcttgtctca

SEQ ID NO: 27773 - DNA, 20 bp, Artificial Sequence
  chemically synthesized
ccacattcccaccttgagac

SEQ ID NO: 27774 - DNA, 20 bp, Artificial Sequence
  chemically synthesized
gcctaaatcttgtctcaagg

SEQ ID NO: 27775 - DNA, 20 bp, Artificial Sequence
  chemically synthesized
cctaaatcttgtctcaaggt

SEQ ID NO: 27776 - DNA, 20 bp, Artificial Sequence
  chemically synthesized
aagaaccacattcccacctt

SEQ ID NO: 27777 - DNA, 20 bp, Artificial Sequence
  chemically synthesized
cttgtctcaaggtgggaatg

SEQ ID NO: 27778 - DNA, 20 bp, Artificial Sequence
  chemically synthesized
aaatttctcagcagtcaggc

SEQ ID NO: 27779 - DNA, 20 bp, Artificial Sequence
  chemically synthesized
gtggttcttgcctgactgct

SEQ ID NO: 27780 - DNA, 20 bp, Artificial Sequence
  chemically synthesized
cattaaatttctcagcagtc

SEQ ID NO: 27781 - DNA, 20 bp, Artificial Sequence
  chemically synthesized
ccattaaatttctcagcagt

SEQ ID NO: 27782 - DNA, 20 bp, Artificial Sequence
  chemically synthesized
gtaaccattaaatttctcag

SEQ ID NO: 27783 - DNA, 20 bp, Artificial Sequence
  chemically synthesized
ccagtaaccattaaatttct

SEQ ID NO: 27784 - DNA, 20 bp, Artificial Sequence
  chemically synthesized
ctgactgctgagaaatttaa

SEQ ID NO: 27785 - DNA, 20 bp, Artificial Sequence
  chemically synthesized
ctgagaaatttaatggttac

SEQ ID NO: 27786 - DNA, 20 bp, Artificial Sequence
  chemically synthesized
tgagaaatttaatggttact

SEQ ID NO: 27787 - DNA, 20 bp, Artificial Sequence
  chemically synthesized
tttaatggttactgggcaac

SEQ ID NO: 27788 - DNA, 20 bp, Artificial Sequence
  chemically synthesized
ttaatggttactgggcaacc

SEQ ID NO: 27789 - DNA, 20 bp, Artificial Sequence
  chemically synthesized
ttatttaattcctggttgcc

SEQ ID NO: 27790 - DNA, 20 bp, Artificial Sequence
  chemically synthesized
ttcccaaattatttaattcc

SEQ ID NO: 27791 - DNA, 20 bp, Artificial Sequence
  chemically synthesized
caaccaggaattaaataatt

SEQ ID NO: 27792 - DNA, 20 bp, Artificial Sequence
  chemically synthesized
aaccaggaattaaataattt

SEQ ID NO: 27793 - DNA, 20 bp, Artificial Sequence
  chemically synthesized
atactcataagaaaaaggta

SEQ ID NO: 27794 - DNA, 20 bp, Artificial Sequence
  chemically synthesized
gaatactcataagaaaaagg

SEQ ID NO: 27795 - DNA, 20 bp, Artificial Sequence
  chemically synthesized
aaagaatactcataagaaaa

SEQ ID NO: 27796 - DNA, 20 bp, Artificial Sequence
  chemically synthesized
taaagaatactcataagaaa

SEQ ID NO: 27797 - DNA, 20 bp, Artificial Sequence
  chemically synthesized
taactctacctttttcttat

SEQ ID NO: 27798 - DNA, 20 bp, Artificial Sequence
  chemically synthesized
ttcccctaaagaatactcat

SEQ ID NO: 27799 - DNA, 20 bp, Artificial Sequence
  chemically synthesized
tttttcttatgagtattctt

SEQ ID NO: 27800 - DNA, 20 bp, Artificial Sequence
  chemically synthesized
ttttcttatgagtattcttt

SEQ ID NO: 27801 - DNA, 20 bp, Artificial Sequence
  chemically synthesized
tttcttatgagtattcttta

SEQ ID NO: 27802 - DNA, 20 bp, Artificial Sequence
  chemically synthesized
ttcttatgagtattctttag

SEQ ID NO: 27803 - DNA, 20 bp, Artificial Sequence
  chemically synthesized
aaagtatatatattccccta

SEQ ID NO: 27804 - DNA, 20 bp, Artificial Sequence
  chemically synthesized
gaatatatatactttttatt

SEQ ID NO: 27805 - DNA, 20 bp, Artificial Sequence
  chemically synthesized
tatttcattttcttaataaa

SEQ ID NO: 27806 - DNA, 20 bp, Artificial Sequence
  chemically synthesized
tattaagaaaatgaaataca

SEQ ID NO: 27807 - DNA, 20 bp, Artificial Sequence
  chemically synthesized
aaatgaaatacatggtgcct

SEQ ID NO: 27808 - DNA, 20 bp, Artificial Sequence
  chemically synthesized
aatacatggtgccttagaaa

SEQ ID NO: 27809 - DNA, 20 bp, Artificial Sequence
  chemically synthesized
aattagagattctatttcta

SEQ ID NO: 27810 - DNA, 20 bp, Artificial Sequence
  chemically synthesized
aaattagagattctatttct

SEQ ID NO: 27811 - DNA, 20 bp, Artificial Sequence
  chemically synthesized
aaaatgaaaattttaaatta

SEQ ID NO: 27812 - DNA, 20 bp, Artificial Sequence
  chemically synthesized
ggaaaatgaaaattttaaat

SEQ ID NO: 27813 - DNA, 20 bp, Artificial Sequence
  chemically synthesized
aaaattttcattttccaaat

SEQ ID NO: 27814 - DNA, 20 bp, Artificial Sequence
  chemically synthesized
aattttcattttccaaatga

SEQ ID NO: 27815 - DNA, 20 bp, Artificial Sequence
  chemically synthesized
tagtccttagttctctcatt

SEQ ID NO: 27816 - DNA, 20 bp, Artificial Sequence
  chemically synthesized
attttccaaatgagagaact

SEQ ID NO: 27817 - DNA, 20 bp, Artificial Sequence
  chemically synthesized
ttttccaaatgagagaacta

SEQ ID NO: 27818 - DNA, 20 bp, Artificial Sequence
  chemically synthesized
caaatgagagaactaaggac

SEQ ID NO: 27819 - DNA, 20 bp, Artificial Sequence
  chemically synthesized
actaagagctttctagtcct

SEQ ID NO: 27820 - DNA, 20 bp, Artificial Sequence
  chemically synthesized
tgagagaactaaggactaga

SEQ ID NO: 27821 - DNA, 20 bp, Artificial Sequence
  chemically synthesized
acaagttactaagagctttc

SEQ ID NO: 27822 - DNA, 20 bp, Artificial Sequence
  chemically synthesized
actaaggactagaaagctct

SEQ ID NO: 27823 - DNA, 20 bp, Artificial Sequence
  chemically synthesized
aattcagaacaagttactaa

SEQ ID NO: 27824 - DNA, 20 bp, Artificial Sequence
  chemically synthesized
ggaattcagaacaagttact

SEQ ID NO: 27825 - DNA, 20 bp, Artificial Sequence
  chemically synthesized
ctgactagggaattcagaac

SEQ ID NO: 27826 - DNA, 20 bp, Artificial Sequence
  chemically synthesized
gtaacttgttctgaattccc

SEQ ID NO: 27827 - DNA, 20 bp, Artificial Sequence
  chemically synthesized
tcctagctgactagggaatt

SEQ ID NO: 27828 - DNA, 20 bp, Artificial Sequence
  chemically synthesized
cttgttctgaattccctagt

SEQ ID NO: 27829 - DNA, 20 bp, Artificial Sequence
  chemically synthesized
gtttttctcctagctgacta

SEQ ID NO: 27830 - DNA, 20 bp, Artificial Sequence
  chemically synthesized
ttctgaattccctagtcagc

SEQ ID NO: 27831 - DNA, 20 bp, Artificial Sequence
  chemically synthesized
tgtttttctcctagctgact

SEQ ID NO: 27832 - DNA, 20 bp, Artificial Sequence
  chemically synthesized
tctgaattccctagtcagct

SEQ ID NO: 27833 - DNA, 20 bp, Artificial Sequence
  chemically synthesized
atgtttttctcctagctgac

SEQ ID NO: 27834 - DNA, 20 bp, Artificial Sequence
  chemically synthesized
tgaattccctagtcagctag

SEQ ID NO: 27835 - DNA, 20 bp, Artificial Sequence
  chemically synthesized
tctagttgatgtttttctcc

SEQ ID NO: 27836 - DNA, 20 bp, Artificial Sequence
  chemically synthesized
gctaggagaaaaacatcaac

SEQ ID NO: 27837 - DNA, 20 bp, Artificial Sequence
  chemically synthesized
aaaaacatcaactagaatcc

SEQ ID NO: 27838 - DNA, 20 bp, Artificial Sequence
  chemically synthesized
ggagaaaaagacttggattc

SEQ ID NO: 27839 - DNA, 20 bp, Artificial Sequence
  chemically synthesized
cacttggggagaaaaagact

SEQ ID NO: 27840 - DNA, 20 bp, Artificial Sequence
  chemically synthesized
gatacacacttggggagaaa

SEQ ID NO: 27841 - DNA, 20 bp, Artificial Sequence
  chemically synthesized
atccaagtctttttctcccc

SEQ ID NO: 27842 - DNA, 20 bp, Artificial Sequence
  chemically synthesized
ggaagggatacacacttggg

SEQ ID NO: 27843 - DNA, 20 bp, Artificial Sequence
  chemically synthesized
agggaagggatacacacttg

SEQ ID NO: 27844 - DNA, 20 bp, Artificial Sequence
  chemically synthesized
cagggaagggatacacactt

SEQ ID NO: 27845 - DNA, 20 bp, Artificial Sequence
  chemically synthesized
tcagggaagggatacacact

SEQ ID NO: 27846 - DNA, 20 bp, Artificial Sequence
  chemically synthesized
caagtgtgtatcccttccct

SEQ ID NO: 27847 - DNA, 20 bp, Artificial Sequence
  chemically synthesized
tctgtggcttgctcagggaa

SEQ ID NO: 27848 - DNA, 20 bp, Artificial Sequence
  chemically synthesized
ttctgtggcttgctcaggga

SEQ ID NO: 27849 - DNA, 20 bp, Artificial Sequence
  chemically synthesized
gttctgtggcttgctcaggg

SEQ ID NO: 27850 - DNA, 20 bp, Artificial Sequence
  chemically synthesized
tgtgtatcccttccctgagc

SEQ ID NO: 27851 - DNA, 20 bp, Artificial Sequence
  chemically synthesized
tttgttctgtggcttgctca

SEQ ID NO: 27852 - DNA, 20 bp, Artificial Sequence
  chemically synthesized
ttttgttctgtggcttgctc

SEQ ID NO: 27853 - DNA, 20 bp, Artificial Sequence
  chemically synthesized
tttttgttctgtggcttgct

SEQ ID NO: 27854 - DNA, 20 bp, Artificial Sequence
  chemically synthesized
tcccttccctgagcaagcca

SEQ ID NO: 27855 - DNA, 20 bp, Artificial Sequence
  chemically synthesized
gcctttatatttttgttctg

SEQ ID NO: 27856 - DNA, 20 bp, Artificial Sequence
  chemically synthesized
agccacagaacaaaaatata

SEQ ID NO: 27857 - DNA, 20 bp, Artificial Sequence
  chemically synthesized
gccacagaacaaaaatataa

SEQ ID NO: 27858 - DNA, 20 bp, Artificial Sequence
  chemically synthesized
aaaatataaaggctcattct

SEQ ID NO: 27859 - DNA, 20 bp, Artificial Sequence
  chemically synthesized
cttgaagtcccacttagaat

SEQ ID NO: 27860 - DNA, 20 bp, Artificial Sequence
  chemically synthesized
atataaaggctcattctaag

SEQ ID NO: 27861 - DNA, 20 bp, Artificial Sequence
  chemically synthesized
tataaaggctcattctaagt

SEQ ID NO: 27862 - DNA, 20 bp, Artificial Sequence
  chemically synthesized
agtagacttgaagtcccact

SEQ ID NO: 27863 - DNA, 20 bp, Artificial Sequence
  chemically synthesized
ctcattctaagtgggacttc

SEQ ID NO: 27864 - DNA, 20 bp, Artificial Sequence
  chemically synthesized
aagctgaatgagtagacttg

SEQ ID NO: 27865 - DNA, 20 bp, Artificial Sequence
  chemically synthesized
ggacttcaagtctactcatt

SEQ ID NO: 27866 - DNA, 20 bp, Artificial Sequence
  chemically synthesized
gagcccttaagctgaatgag

SEQ ID NO: 27867 - DNA, 20 bp, Artificial Sequence
  chemically synthesized
tgggagcccttaagctgaat

SEQ ID NO: 27868 - DNA, 20 bp, Artificial Sequence
  chemically synthesized
caagtctactcattcagctt

SEQ ID NO: 27869 - DNA, 20 bp, Artificial Sequence
  chemically synthesized
aagtctactcattcagctta

SEQ ID NO: 27870 - DNA, 20 bp, Artificial Sequence
  chemically synthesized
agtctactcattcagcttaa

SEQ ID NO: 27871 - DNA, 20 bp, Artificial Sequence
  chemically synthesized
gggagcaattgggagccctt

SEQ ID NO: 27872 - DNA, 20 bp, Artificial Sequence
  chemically synthesized
ttcgaattgggagcaattgg

SEQ ID NO: 27873 - DNA, 20 bp, Artificial Sequence
  chemically synthesized
tgttcgaattgggagcaatt

SEQ ID NO: 27874 - DNA, 20 bp, Artificial Sequence
  chemically synthesized
ctgttcgaattgggagcaat

SEQ ID NO: 27875 - DNA, 20 bp, Artificial Sequence
  chemically synthesized
gggccctctgttcgaattgg

SEQ ID NO: 27876 - DNA, 20 bp, Artificial Sequence
  chemically synthesized
acgggccctctgttcgaatt

SEQ ID NO: 27877 - DNA, 20 bp, Artificial Sequence
  chemically synthesized
ccaattgctcccaattcgaa

SEQ ID NO: 27878 - DNA, 20 bp, Artificial Sequence
  chemically synthesized
cacgggccctctgttcgaat

SEQ ID NO: 27879 - DNA, 20 bp, Artificial Sequence
  chemically synthesized
aattgctcccaattcgaaca

SEQ ID NO: 27880 - DNA, 20 bp, Artificial Sequence
  chemically synthesized
attgctcccaattcgaacag

SEQ ID NO: 27881 - DNA, 20 bp, Artificial Sequence
  chemically synthesized
ttgctcccaattcgaacaga

SEQ ID NO: 27882 - DNA, 20 bp, Artificial Sequence
  chemically synthesized
tcaaggttaaagaaattcac

SEQ ID NO: 27883 - DNA, 20 bp, Artificial Sequence
  chemically synthesized
gtcaaggttaaagaaattca

SEQ ID NO: 27884 - DNA, 20 bp, Artificial Sequence
  chemically synthesized
tcagatgtttgtcaaggtta

SEQ ID NO: 27885 - DNA, 20 bp, Artificial Sequence
  chemically synthesized
ttccagtcagatgtttgtca

SEQ ID NO: 27886 - DNA, 20 bp, Artificial Sequence
  chemically synthesized
tttccagtcagatgtttgtc

SEQ ID NO: 27887 - DNA, 20 bp, Artificial Sequence
  chemically synthesized
aaccttgacaaacatctgac

SEQ ID NO: 27888 - DNA, 20 bp, Artificial Sequence
  chemically synthesized
gggaaaatttgttttccagt

SEQ ID NO: 27889 - DNA, 20 bp, Artificial Sequence
  chemically synthesized
ttttgggaaaatttgttttc

SEQ ID NO: 27890 - DNA, 20 bp, Artificial Sequence
  chemically synthesized
tggaaaacaaattttcccaa

SEQ ID NO: 27891 - DNA, 20 bp, Artificial Sequence
  chemically synthesized
aaacaaattttcccaaaagc

SEQ ID NO: 27892 - DNA, 20 bp, Artificial Sequence
  chemically synthesized
attagaccctgcttgctttt

SEQ ID NO: 27893 - DNA, 20 bp, Artificial Sequence
  chemically synthesized
aattagaccctgcttgcttt

SEQ ID NO: 27894 - DNA, 20 bp, Artificial Sequence
  chemically synthesized
caaattttcccaaaagcaag

SEQ ID NO: 27895 - DNA, 20 bp, Artificial Sequence
  chemically synthesized
aaattttcccaaaagcaagc

SEQ ID NO: 27896 - DNA, 20 bp, Artificial Sequence
  chemically synthesized
aattttcccaaaagcaagca

SEQ ID NO: 27897 - DNA, 20 bp, Artificial Sequence
  chemically synthesized
cactcttaacaggggaaaat

SEQ ID NO: 27898 - DNA, 20 bp, Artificial Sequence
  chemically synthesized
gggtctaattttcccctgtt

SEQ ID NO: 27899 - DNA, 20 bp, Artificial Sequence
  chemically synthesized
gtctaattttcccctgttaa

SEQ ID NO: 27900 - DNA, 20 bp, Artificial Sequence
  chemically synthesized
ctagaaaccactcttaacag

SEQ ID NO: 27901 - DNA, 20 bp, Artificial Sequence
  chemically synthesized
tctagaaaccactcttaaca

SEQ ID NO: 27902 - DNA, 20 bp, Artificial Sequence
  chemically synthesized
gtctagaaaccactcttaac

SEQ ID NO: 27903 - DNA, 20 bp, Artificial Sequence
  chemically synthesized
taattttcccctgttaagag

SEQ ID NO: 27904 - DNA, 20 bp, Artificial Sequence
  chemically synthesized
ggtctagaaaccactcttaa

SEQ ID NO: 27905 - DNA, 20 bp, Artificial Sequence
  chemically synthesized
cccctgttaagagtggtttc

SEQ ID NO: 27906 - DNA, 20 bp, Artificial Sequence
  chemically synthesized
taagagtggtttctagacct

SEQ ID NO: 27907 - DNA, 20 bp, Artificial Sequence
  chemically synthesized
tttaagaagatgccaaggtc

SEQ ID NO: 27908 - DNA, 20 bp, Artificial Sequence
  chemically synthesized
aaaaatttaagaagatgcca

SEQ ID NO: 27909 - DNA, 20 bp, Artificial Sequence
  chemically synthesized
taaaaatttaagaagatgcc

SEQ ID NO: 27910 - DNA, 20 bp, Artificial Sequence
  chemically synthesized
ctgaatcttaaaaatttaag

SEQ ID NO: 27911 - DNA, 20 bp, Artificial Sequence
  chemically synthesized
gagctgaatcttaaaaattt

SEQ ID NO: 27912 - DNA, 20 bp, Artificial Sequence
  chemically synthesized
tggcatcttcttaaattttt

SEQ ID NO: 27913 - DNA, 20 bp, Artificial Sequence
  chemically synthesized
cttcttaaatttttaagatt

SEQ ID NO: 27914 - DNA, 20 bp, Artificial Sequence
  chemically synthesized
atgtcagagcgggttaggag

SEQ ID NO: 27915 - DNA, 20 bp, Artificial Sequence
  chemically synthesized
atatgtcagagcgggttagg

SEQ ID NO: 27916 - DNA, 20 bp, Artificial Sequence
  chemically synthesized
tatatgtcagagcgggttag

SEQ ID NO: 27917 - DNA, 20 bp, Artificial Sequence
  chemically synthesized
tttatatgtcagagcgggtt

SEQ ID NO: 27918 - DNA, 20 bp, Artificial Sequence
  chemically synthesized
ctttatatgtcagagcgggt

SEQ ID NO: 27919 - DNA, 20 bp, Artificial Sequence
  chemically synthesized
atgactttatatgtcagagc

SEQ ID NO: 27920 - DNA, 20 bp, Artificial Sequence
  chemically synthesized
tatgactttatatgtcagag

SEQ ID NO: 27921 - DNA, 20 bp, Artificial Sequence
  chemically synthesized
cactatgactttatatgtca

SEQ ID NO: 27922 - DNA, 20 bp, Artificial Sequence
  chemically synthesized
ctaacccgctctgacatata

SEQ ID NO: 27923 - DNA, 20 bp, Artificial Sequence
  chemically synthesized
aacactatgactttatatgt

SEQ ID NO: 27924 - DNA, 20 bp, Artificial Sequence
  chemically synthesized
cgctctgacatataaagtca

SEQ ID NO: 27925 - DNA, 20 bp, Artificial Sequence
  chemically synthesized
tataaagtcatagtgttgtg

SEQ ID NO: 27926 - DNA, 20 bp, Artificial Sequence
  chemically synthesized
aaagtcatagtgttgtgaag

SEQ ID NO: 27927 - DNA, 20 bp, Artificial Sequence
  chemically synthesized
ttgtgaagcagactgtgtta

SEQ ID NO: 27928 - DNA, 20 bp, Artificial Sequence
  chemically synthesized
cctgacttccttctataaca

SEQ ID NO: 27929 - DNA, 20 bp, Artificial Sequence
  chemically synthesized
tgaagcagactgtgttatag

SEQ ID NO: 27930 - DNA, 20 bp, Artificial Sequence
  chemically synthesized
gaagcagactgtgttataga

SEQ ID NO: 27931 - DNA, 20 bp, Artificial Sequence
  chemically synthesized
gcagactgtgttatagaagg

SEQ ID NO: 27932 - DNA, 20 bp, Artificial Sequence
  chemically synthesized
actgtgttatagaaggaagt

SEQ ID NO: 27933 - DNA, 20 bp, Artificial Sequence
  chemically synthesized
ctgtgttatagaaggaagtc

SEQ ID NO: 27934 - DNA, 20 bp, Artificial Sequence
  chemically synthesized
tgttatagaaggaagtcagg

SEQ ID NO: 27935 - DNA, 20 bp, Artificial Sequence
  chemically synthesized
atagaaggaagtcaggaagt

SEQ ID NO: 27936 - DNA, 20 bp, Artificial Sequence
  chemically synthesized
tagaaggaagtcaggaagta

SEQ ID NO: 27937 - DNA, 20 bp, Artificial Sequence
  chemically synthesized
ggatgtgaacatttctttta

SEQ ID NO: 27938 - DNA, 20 bp, Artificial Sequence
  chemically synthesized
atgtgaacatttcttttaaa

SEQ ID NO: 27939 - DNA, 20 bp, Artificial Sequence
  chemically synthesized
aggctgctgctactctttaa

SEQ ID NO: 27940 - DNA, 20 bp, Artificial Sequence
  chemically synthesized
tgaacatttcttttaaagag

SEQ ID NO: 27941 - DNA, 20 bp, Artificial Sequence
  chemically synthesized
acatttcttttaaagagtag

SEQ ID NO: 27942 - DNA, 20 bp, Artificial Sequence
  chemically synthesized
tttcttttaaagagtagcag

SEQ ID NO: 27943 - DNA, 20 bp, Artificial Sequence
  chemically synthesized
ggcttcttcattcaggatgg

SEQ ID NO: 27944 - DNA, 20 bp, Artificial Sequence
  chemically synthesized
tggcttcttcattcaggatg

SEQ ID NO: 27945 - DNA, 20 bp, Artificial Sequence
  chemically synthesized
cctggcttcttcattcagga

SEQ ID NO: 27946 - DNA, 20 bp, Artificial Sequence
  chemically synthesized
agcagcctccatcctgaatg

SEQ ID NO: 27947 - DNA, 20 bp, Artificial Sequence
  chemically synthesized
gagacctggcttcttcattc

SEQ ID NO: 27948 - DNA, 20 bp, Artificial Sequence
  chemically synthesized
agcctccatcctgaatgaag

SEQ ID NO: 27949 - DNA, 20 bp, Artificial Sequence
  chemically synthesized
tgagacctggcttcttcatt

SEQ ID NO: 27950 - DNA, 20 bp, Artificial Sequence
  chemically synthesized
tccatcctgaatgaagaagc

SEQ ID NO: 27951 - DNA, 20 bp, Artificial Sequence
  chemically synthesized
ccatcctgaatgaagaagcc

SEQ ID NO: 27952 - DNA, 20 bp, Artificial Sequence
  chemically synthesized
tgaatgaagaagccaggtct

SEQ ID NO: 27953 - DNA, 20 bp, Artificial Sequence
  chemically synthesized
ctaagggagtgtctgagacc

SEQ ID NO: 27954 - DNA, 20 bp, Artificial Sequence
  chemically synthesized
gcacgtctaagggagtgtct

SEQ ID NO: 27955 - DNA, 20 bp, Artificial Sequence
  chemically synthesized
ccaggtctcagacactccct

SEQ ID NO: 27956 - DNA, 20 bp, Artificial Sequence
  chemically synthesized
taaaggcggcacgtctaagg

SEQ ID NO: 27957 - DNA, 20 bp, Artificial Sequence
  chemically synthesized
cttaaaggcggcacgtctaa

SEQ ID NO: 27958 - DNA, 20 bp, Artificial Sequence
  chemically synthesized
tcttaaaggcggcacgtcta

SEQ ID NO: 27959 - DNA, 20 bp, Artificial Sequence
  chemically synthesized
ttcttaaaggcggcacgtct

SEQ ID NO: 27960 - DNA, 20 bp, Artificial Sequence
  chemically synthesized
cccttagacgtgccgccttt

SEQ ID NO: 27961 - DNA, 20 bp, Artificial Sequence
  chemically synthesized
aggatgtcctttcttaaagg

SEQ ID NO: 27962 - DNA, 20 bp, Artificial Sequence
  chemically synthesized
tagacgtgccgcctttaaga

SEQ ID NO: 27963 - DNA, 20 bp, Artificial Sequence
  chemically synthesized
agacgtgccgcctttaagaa

SEQ ID NO: 27964 - DNA, 20 bp, Artificial Sequence
  chemically synthesized
gagaggatgtcctttcttaa

SEQ ID NO: 27965 - DNA, 20 bp, Artificial Sequence
  chemically synthesized
agagaggatgtcctttctta

SEQ ID NO: 27966 - DNA, 20 bp, Artificial Sequence
  chemically synthesized
tgatcatcagaagtacagag

SEQ ID NO: 27967 - DNA, 20 bp, Artificial Sequence
  chemically synthesized
ctgatcatcagaagtacaga

SEQ ID NO: 27968 - DNA, 20 bp, Artificial Sequence
  chemically synthesized
agctgatcatcagaagtaca

SEQ ID NO: 27969 - DNA, 20 bp, Artificial Sequence
  chemically synthesized
taagctgatcatcagaagta

SEQ ID NO: 27970 - DNA, 20 bp, Artificial Sequence
  chemically synthesized
gaaattaagctgatcatcag

SEQ ID NO: 27971 - DNA, 20 bp, Artificial Sequence
  chemically synthesized
ctctctgtacttctgatgat

SEQ ID NO: 27972 - DNA, 20 bp, Artificial Sequence
  chemically synthesized
tgggaaattaagctgatcat

SEQ ID NO: 27973 - DNA, 20 bp, Artificial Sequence
  chemically synthesized
cattattcaaatgggaaatt

SEQ ID NO: 27974 - DNA, 20 bp, Artificial Sequence
  chemically synthesized
aaaaaaatcattattcaaat

SEQ ID NO: 27975 - DNA, 20 bp, Artificial Sequence
  chemically synthesized
caaaaaaatcattattcaaa

SEQ ID NO: 27976 - DNA, 20 bp, Artificial Sequence
  chemically synthesized
gatttttttgtttgcttctg

SEQ ID NO: 27977 - DNA, 20 bp, Artificial Sequence
  chemically synthesized
actgcttctcatgacttcag

SEQ ID NO: 27978 - DNA, 20 bp, Artificial Sequence
  chemically synthesized
ttgtttgcttctgaagtcat

SEQ ID NO: 27979 - DNA, 20 bp, Artificial Sequence
  chemically synthesized
ctaactgcttctcatgactt

SEQ ID NO: 27980 - DNA, 20 bp, Artificial Sequence
  chemically synthesized
tttgcttctgaagtcatgag

SEQ ID NO: 27981 - DNA, 20 bp, Artificial Sequence
  chemically synthesized
gcttctgaagtcatgagaag

SEQ ID NO: 27982 - DNA, 20 bp, Artificial Sequence
  chemically synthesized
ctgaagtcatgagaagcagt

SEQ ID NO: 27983 - DNA, 20 bp, Artificial Sequence
  chemically synthesized
agaagcagttagcatttatg

SEQ ID NO: 27984 - DNA, 20 bp, Artificial Sequence
  chemically synthesized
agcatttatgaagctttgaa

SEQ ID NO: 27985 - DNA, 20 bp, Artificial Sequence
  chemically synthesized
tcaaattggacaaccattca

SEQ ID NO: 27986 - DNA, 20 bp, Artificial Sequence
  chemically synthesized
tcgtggcctttaagtcaaat

SEQ ID NO: 27987 - DNA, 20 bp, Artificial Sequence
  chemically synthesized
tggttgtccaatttgactta

SEQ ID NO: 27988 - DNA, 20 bp, Artificial Sequence
  chemically synthesized
ggttgtccaatttgacttaa

SEQ ID NO: 27989 - DNA, 20 bp, Artificial Sequence
  chemically synthesized
atcagcatctcgtggccttt

SEQ ID NO: 27990 - DNA, 20 bp, Artificial Sequence
  chemically synthesized
caatttgacttaaaggccac

SEQ ID NO: 27991 - DNA, 20 bp, Artificial Sequence
  chemically synthesized
agtttaacatcagcatctcg

SEQ ID NO: 27992 - DNA, 20 bp, Artificial Sequence
  chemically synthesized
aaatgtacgaagtttaacat

SEQ ID NO: 27993 - DNA, 20 bp, Artificial Sequence
  chemically synthesized
aacccagaaataaatgtacg

SEQ ID NO: 27994 - DNA, 20 bp, Artificial Sequence
  chemically synthesized
aaacttcgtacatttatttc

SEQ ID NO: 27995 - DNA, 20 bp, Artificial Sequence
  chemically synthesized
aacttcgtacatttatttct

SEQ ID NO: 27996 - DNA, 20 bp, Artificial Sequence
  chemically synthesized
gttttaataagacaggaacc

SEQ ID NO: 27997 - DNA, 20 bp, Artificial Sequence
  chemically synthesized
tgtcagtgttttaataagac

SEQ ID NO: 27998 - DNA, 20 bp, Artificial Sequence
  chemically synthesized
atgtcagtgttttaataaga

SEQ ID NO: 27999 - DNA, 20 bp, Artificial Sequence
  chemically synthesized
agttatgtcagtgttttaat

SEQ ID NO: 28000 - DNA, 20 bp, Artificial Sequence
  chemically synthesized
tgcactatggagagttatgt

SEQ ID NO: 28001 - DNA, 20 bp, Artificial Sequence
  chemically synthesized
aacactgacataactctcca

SEQ ID NO: 28002 - DNA, 20 bp, Artificial Sequence
  chemically synthesized
atgaaaacttgcactatgga

SEQ ID NO: 28003 - DNA, 20 bp, Artificial Sequence
  chemically synthesized
gaatgaaaacttgcactatg

SEQ ID NO: 28004 - DNA, 20 bp, Artificial Sequence
  chemically synthesized
gacataactctccatagtgc

SEQ ID NO: 28005 - DNA, 20 bp, Artificial Sequence
  chemically synthesized
gtgaatgaaaacttgcacta

SEQ ID NO: 28006 - DNA, 20 bp, Artificial Sequence
  chemically synthesized
agttttcattcaccatctgt

SEQ ID NO: 28007 - DNA, 20 bp, Artificial Sequence
  chemically synthesized
tagcgcaatagactgacaga

SEQ ID NO: 28008 - DNA, 20 bp, Artificial Sequence
  chemically synthesized
cctgtagcgcaatagactga

SEQ ID NO: 28009 - DNA, 20 bp, Artificial Sequence
  chemically synthesized
ttttttttcctgtagcgcaa

SEQ ID NO: 28010 - DNA, 20 bp, Artificial Sequence
  chemically synthesized
tctgtcagtctattgcgcta

SEQ ID NO: 28011 - DNA, 20 bp, Artificial Sequence
  chemically synthesized
ctgtcagtctattgcgctac

SEQ ID NO: 28012 - DNA, 20 bp, Artificial Sequence
  chemically synthesized
ctggagttttttttttcctg

SEQ ID NO: 28013 - DNA, 20 bp, Artificial Sequence
  chemically synthesized
ctacaggaaaaaaaaaactc

SEQ ID NO: 28014 - DNA, 20 bp, Artificial Sequence
  chemically synthesized
tacaggaaaaaaaaaactcc

SEQ ID NO: 28015 - DNA, 20 bp, Artificial Sequence
  chemically synthesized
ccttttacataattaacctg

SEQ ID NO: 28016 - DNA, 20 bp, Artificial Sequence
  chemically synthesized
taccttttacataattaacc

SEQ ID NO: 28017 - DNA, 20 bp, Artificial Sequence
  chemically synthesized
actccaggttaattatgtaa

SEQ ID NO: 28018 - DNA, 20 bp, Artificial Sequence
  chemically synthesized
ctccaggttaattatgtaaa

SEQ ID NO: 28019 - DNA, 20 bp, Artificial Sequence
  chemically synthesized
gttaattatgtaaaaggtaa

SEQ ID NO: 28020 - DNA, 20 bp, Artificial Sequence
  chemically synthesized
tgtaaaaggtaatagcatca

SEQ ID NO: 28021 - DNA, 20 bp, Artificial Sequence
  chemically synthesized
aaggtaatagcatcaaagaa

SEQ ID NO: 28022 - DNA, 20 bp, Artificial Sequence
  chemically synthesized
ttgcacattgagagtataat

SEQ ID NO: 28023 - DNA, 20 bp, Artificial Sequence
  chemically synthesized
tttgcacattgagagtataa

SEQ ID NO: 28024 - DNA, 20 bp, Artificial Sequence
  chemically synthesized
tgcccatttttgcacattga

SEQ ID NO: 28025 - DNA, 20 bp, Artificial Sequence
  chemically synthesized
tatgcccatttttgcacatt

SEQ ID NO: 28026 - DNA, 20 bp, Artificial Sequence
  chemically synthesized
atactctcaatgtgcaaaaa

SEQ ID NO: 28027 - DNA, 20 bp, Artificial Sequence
  chemically synthesized
tactctcaatgtgcaaaaat

SEQ ID NO: 28028 - DNA, 20 bp, Artificial Sequence
  chemically synthesized
tgtatatgcaaaaatattta

SEQ ID NO: 28029 - DNA, 20 bp, Artificial Sequence
  chemically synthesized
atatgcaaaaatatttacag

SEQ ID NO: 28030 - DNA, 20 bp, Artificial Sequence
  chemically synthesized
cctagagacaattaacagta

SEQ ID NO: 28031 - DNA, 20 bp, Artificial Sequence
  chemically synthesized
tacttcctagagacaattaa

SEQ ID NO: 28032 - DNA, 20 bp, Artificial Sequence
  chemically synthesized
actatactgttaattgtctc

SEQ ID NO: 28033 - DNA, 20 bp, Artificial Sequence
  chemically synthesized
ctatactgttaattgtctct

SEQ ID NO: 28034 - DNA, 20 bp, Artificial Sequence
  chemically synthesized
tactgttaattgtctctagg

SEQ ID NO: 28035 - DNA, 20 bp, Artificial Sequence
  chemically synthesized
tcccctaattttacttccta

SEQ ID NO: 28036 - DNA, 20 bp, Artificial Sequence
  chemically synthesized
aatcccctaattttacttcc

SEQ ID NO: 28037 - DNA, 20 bp, Artificial Sequence
  chemically synthesized
ttgtctctaggaagtaaaat

SEQ ID NO: 28038 - DNA, 20 bp, Artificial Sequence
  chemically synthesized
tgtctctaggaagtaaaatt

SEQ ID NO: 28039 - DNA, 20 bp, Artificial Sequence
  chemically synthesized
gtctctaggaagtaaaatta

SEQ ID NO: 28040 - DNA, 20 bp, Artificial Sequence
  chemically synthesized
tctctaggaagtaaaattag

SEQ ID NO: 28041 - DNA, 20 bp, Artificial Sequence
  chemically synthesized
aaaattaggggattgatacc

SEQ ID NO: 28042 - DNA, 20 bp, Artificial Sequence
  chemically synthesized
aattaggggattgataccaa

SEQ ID NO: 28043 - DNA, 20 bp, Artificial Sequence
  chemically synthesized
taggggattgataccaagag

SEQ ID NO: 28044 - DNA, 20 bp, Artificial Sequence
  chemically synthesized
agtaagtctccaaccactct

SEQ ID NO: 28045 - DNA, 20 bp, Artificial Sequence
  chemically synthesized
ggattgataccaagagtggt

SEQ ID NO: 28046 - DNA, 20 bp, Artificial Sequence
  chemically synthesized
attgataccaagagtggttg

SEQ ID NO: 28047 - DNA, 20 bp, Artificial Sequence
  chemically synthesized
agaggatagtattgaaaagt

SEQ ID NO: 28048 - DNA, 20 bp, Artificial Sequence
  chemically synthesized
tgtaagaggatagtattgaa

SEQ ID NO: 28049 - DNA, 20 bp, Artificial Sequence
  chemically synthesized
aatcaaacattgtaagagga

SEQ ID NO: 28050 - DNA, 20 bp, Artificial Sequence
  chemically synthesized
aagaaatcaaacattgtaag

SEQ ID NO: 28051 - DNA, 20 bp, Artificial Sequence
  chemically synthesized
taagaaatcaaacattgtaa

SEQ ID NO: 28052 - DNA, 20 bp, Artificial Sequence
  chemically synthesized
tttaagaaatcaaacattgt

SEQ ID NO: 28053 - DNA, 20 bp, Artificial Sequence
  chemically synthesized
ttacaatgtttgatttctta

SEQ ID NO: 28054 - DNA, 20 bp, Artificial Sequence
  chemically synthesized
aaaaaagtgcacatgacttt

SEQ ID NO: 28055 - DNA, 20 bp, Artificial Sequence
  chemically synthesized
taatactcaatcattaaaaa

SEQ ID NO: 28056 - DNA, 20 bp, Artificial Sequence
  chemically synthesized
gtgcactttttttaatgatt

SEQ ID NO: 28057 - DNA, 20 bp, Artificial Sequence
  chemically synthesized
aatcttgaaaagaagataga

SEQ ID NO: 28058 - DNA, 20 bp, Artificial Sequence
  chemically synthesized
gagaaatcttgaaaagaaga

SEQ ID NO: 28059 - DNA, 20 bp, Artificial Sequence
  chemically synthesized
aatctatctatcttcttttc

SEQ ID NO: 28060 - DNA, 20 bp, Artificial Sequence
  chemically synthesized
gatagagaaatcttgaaaag

SEQ ID NO: 28061 - DNA, 20 bp, Artificial Sequence
  chemically synthesized
ccagatagagaaatcttgaa

SEQ ID NO: 28062 - DNA, 20 bp, Artificial Sequence
  chemically synthesized
cttttcaagatttctctatc

SEQ ID NO: 28063 - DNA, 20 bp, Artificial Sequence
  chemically synthesized
ttttcaagatttctctatct

SEQ ID NO: 28064 - DNA, 20 bp, Artificial Sequence
  chemically synthesized
tttggaagaaatcccagata

SEQ ID NO: 28065 - DNA, 20 bp, Artificial Sequence
  chemically synthesized
aatttggaagaaatcccaga

SEQ ID NO: 28066 - DNA, 20 bp, Artificial Sequence
  chemically synthesized
taagaatttggaagaaatcc

SEQ ID NO: 28067 - DNA, 20 bp, Artificial Sequence
  chemically synthesized
gggtgaagctaagaatttgg

SEQ ID NO: 28068 - DNA, 20 bp, Artificial Sequence
  chemically synthesized
tgggatttcttccaaattct

SEQ ID NO: 28069 - DNA, 20 bp, Artificial Sequence
  chemically synthesized
agcgggtgaagctaagaatt

SEQ ID NO: 28070 - DNA, 20 bp, Artificial Sequence
  chemically synthesized
gaaggacagcgggtgaagct

SEQ ID NO: 28071 - DNA, 20 bp, Artificial Sequence
  chemically synthesized
ctcctgaaggacagcgggtg

SEQ ID NO: 28072 - DNA, 20 bp, Artificial Sequence
  chemically synthesized
gtactctcctgaaggacagc

SEQ ID NO: 28073 - DNA, 20 bp, Artificial Sequence
  chemically synthesized
agtactctcctgaaggacag

SEQ ID NO: 28074 - DNA, 20 bp, Artificial Sequence
  chemically synthesized
tagcttcacccgctgtcctt

SEQ ID NO: 28075 - DNA, 20 bp, Artificial Sequence
  chemically synthesized
agcttcacccgctgtccttc

SEQ ID NO: 28076 - DNA, 20 bp, Artificial Sequence
  chemically synthesized
aatagtactctcctgaagga

SEQ ID NO: 28077 - DNA, 20 bp, Artificial Sequence
  chemically synthesized
cttcacccgctgtccttcag

SEQ ID NO: 28078 - DNA, 20 bp, Artificial Sequence
  chemically synthesized
tcacccgctgtccttcagga

SEQ ID NO: 28079 - DNA, 20 bp, Artificial Sequence
  chemically synthesized
gtacaatagtactctcctga

SEQ ID NO: 28080 - DNA, 20 bp, Artificial Sequence
  chemically synthesized
tgtacaatagtactctcctg

SEQ ID NO: 28081 - DNA, 20 bp, Artificial Sequence
  chemically synthesized
gtagtttttccattgtacaa

SEQ ID NO: 28082 - DNA, 20 bp, Artificial Sequence
  chemically synthesized
aggagagtactattgtacaa

SEQ ID NO: 28083 - DNA, 20 bp, Artificial Sequence
  chemically synthesized
ttgtacaatggaaaaactac

SEQ ID NO: 28084 - DNA, 20 bp, Artificial Sequence
  chemically synthesized
tgtacaatggaaaaactact

SEQ ID NO: 28085 - DNA, 20 bp, Artificial Sequence
  chemically synthesized
acaatggaaaaactactggg

SEQ ID NO: 28086 - DNA, 20 bp, Artificial Sequence
  chemically synthesized
aatggaaaaactactgggta

SEQ ID NO: 28087 - DNA, 20 bp, Artificial Sequence
  chemically synthesized
aagttttcttctctacccag

SEQ ID NO: 28088 - DNA, 20 bp, Artificial Sequence
  chemically synthesized
ggaaaaactactgggtagag

SEQ ID NO: 28089 - DNA, 20 bp, Artificial Sequence
  chemically synthesized
attaagttttcttctctacc

SEQ ID NO: 28090 - DNA, 20 bp, Artificial Sequence
  chemically synthesized
gggtagagaagaaaacttaa

SEQ ID NO: 28091 - DNA, 20 bp, Artificial Sequence
  chemically synthesized
ggtagagaagaaaacttaat

SEQ ID NO: 28092 - DNA, 20 bp, Artificial Sequence
  chemically synthesized
agacataaatagagcccatt

SEQ ID NO: 28093 - DNA, 20 bp, Artificial Sequence
  chemically synthesized
ttacagcaaagacataaata

SEQ ID NO: 28094 - DNA, 20 bp, Artificial Sequence
  chemically synthesized
ttttacagcaaagacataaa

SEQ ID NO: 28095 - DNA, 20 bp, Artificial Sequence
  chemically synthesized
attactattattttacagca

SEQ ID NO: 28096 - DNA, 20 bp, Artificial Sequence
  chemically synthesized
ccattattactattatttta

SEQ ID NO: 28097 - DNA, 20 bp, Artificial Sequence
  chemically synthesized
atgtctttgctgtaaaataa

SEQ ID NO: 28098 - DNA, 20 bp, Artificial Sequence
  chemically synthesized
ctgtaaaataatagtaataa

SEQ ID NO: 28099 - DNA, 20 bp, Artificial Sequence
  chemically synthesized
taataatggttatcatttat

SEQ ID NO: 28100 - DNA, 20 bp, Artificial Sequence
  chemically synthesized
aataatggttatcatttatt

SEQ ID NO: 28101 - DNA, 20 bp, Artificial Sequence
  chemically synthesized
atttattgcaaacatagggt

SEQ ID NO: 28102 - DNA, 20 bp, Artificial Sequence
  chemically synthesized
tgttatttattgcaaacata

SEQ ID NO: 28103 - DNA, 20 bp, Artificial Sequence
  chemically synthesized
atgttatttattgcaaacat

SEQ ID NO: 28104 - DNA, 20 bp, Artificial Sequence
  chemically synthesized
tatgttatttattgcaaaca

SEQ ID NO: 28105 - DNA, 20 bp, Artificial Sequence
  chemically synthesized
caataaataacataaattct

SEQ ID NO: 28106 - DNA, 20 bp, Artificial Sequence
  chemically synthesized
aataaataacataaattctc

SEQ ID NO: 28107 - DNA, 20 bp, Artificial Sequence
  chemically synthesized
cacctaataaatgataacct

SEQ ID NO: 28108 - DNA, 20 bp, Artificial Sequence
  chemically synthesized
attctcaggttatcatttat

SEQ ID NO: 28109 - DNA, 20 bp, Artificial Sequence
  chemically synthesized
ttctcaggttatcatttatt

SEQ ID NO: 28110 - DNA, 20 bp, Artificial Sequence
  chemically synthesized
atttattgcaaacatagggt

SEQ ID NO: 28111 - DNA, 20 bp, Artificial Sequence
  chemically synthesized
tgttatttattgcaaacata

SEQ ID NO: 28112 - DNA, 20 bp, Artificial Sequence
  chemically synthesized
atgttatttattgcaaacat

SEQ ID NO: 28113 - DNA, 20 bp, Artificial Sequence
  chemically synthesized
tatgttatttattgcaaaca

SEQ ID NO: 28114 - DNA, 20 bp, Artificial Sequence
  chemically synthesized
acagttgaaggtaattatat

SEQ ID NO: 28115 - DNA, 20 bp, Artificial Sequence
  chemically synthesized
aataatgatatcacagttga

SEQ ID NO: 28116 - DNA, 20 bp, Artificial Sequence
  chemically synthesized
aaataatgatatcacagttg

SEQ ID NO: 28117 - DNA, 20 bp, Artificial Sequence
  chemically synthesized
ggattgaaataatgatatca

SEQ ID NO: 28118 - DNA, 20 bp, Artificial Sequence
  chemically synthesized
ggtttccttatttataaaat

SEQ ID NO: 28119 - DNA, 20 bp, Artificial Sequence
  chemically synthesized
tggtttccttatttataaaa

SEQ ID NO: 28120 - DNA, 20 bp, Artificial Sequence
  chemically synthesized
ttcaatcccattttataaat

SEQ ID NO: 28121 - DNA, 20 bp, Artificial Sequence
  chemically synthesized
tcaatcccattttataaata

SEQ ID NO: 28122 - DNA, 20 bp, Artificial Sequence
  chemically synthesized
ttttataaataaggaaacca

SEQ ID NO: 28123 - DNA, 20 bp, Artificial Sequence
  chemically synthesized
tttataaataaggaaaccaa

SEQ ID NO: 28124 - DNA, 20 bp, Artificial Sequence
  chemically synthesized
aataaggaaaccaaaggcct

SEQ ID NO: 28125 - DNA, 20 bp, Artificial Sequence
  chemically synthesized
aattttacttcttaggcctt

SEQ ID NO: 28126 - DNA, 20 bp, Artificial Sequence
  chemically synthesized
aaggaaaccaaaggcctaag

SEQ ID NO: 28127 - DNA, 20 bp, Artificial Sequence
  chemically synthesized
ggatttgaattttacttctt

SEQ ID NO: 28128 - DNA, 20 bp, Artificial Sequence
  chemically synthesized
tggatttgaattttacttct

SEQ ID NO: 28129 - DNA, 20 bp, Artificial Sequence
  chemically synthesized
ggaagggctttagggtcaaa

SEQ ID NO: 28130 - DNA, 20 bp, Artificial Sequence
  chemically synthesized
ttcaaatccatttgacccta

SEQ ID NO: 28131 - DNA, 20 bp, Artificial Sequence
  chemically synthesized
gatgaagaggaagggcttta

SEQ ID NO: 28132 - DNA, 20 bp, Artificial Sequence
  chemically synthesized
tgatgaagaggaagggcttt

SEQ ID NO: 28133 - DNA, 20 bp, Artificial Sequence
  chemically synthesized
gtgatgaagaggaagggctt

SEQ ID NO: 28134 - DNA, 20 bp, Artificial Sequence
  chemically synthesized
accatagtgatgaagaggaa

SEQ ID NO: 28135 - DNA, 20 bp, Artificial Sequence
  chemically synthesized
gaccatagtgatgaagagga

SEQ ID NO: 28136 - DNA, 20 bp, Artificial Sequence
  chemically synthesized
agaccatagtgatgaagagg

SEQ ID NO: 28137 - DNA, 20 bp, Artificial Sequence
  chemically synthesized
gggagaccatagtgatgaag

SEQ ID NO: 28138 - DNA, 20 bp, Artificial Sequence
  chemically synthesized
tgggagaccatagtgatgaa

SEQ ID NO: 28139 - DNA, 20 bp, Artificial Sequence
  chemically synthesized
attgggagaccatagtgatg

SEQ ID NO: 28140 - DNA, 20 bp, Artificial Sequence
  chemically synthesized
gcccttcctcttcatcacta

SEQ ID NO: 28141 - DNA, 20 bp, Artificial Sequence
  chemically synthesized
ccaagcttattgggagacca

SEQ ID NO: 28142 - DNA, 20 bp, Artificial Sequence
  chemically synthesized
catcactatggtctcccaat

SEQ ID NO: 28143 - DNA, 20 bp, Artificial Sequence
  chemically synthesized
tactagaccaagcttattgg

SEQ ID NO: 28144 - DNA, 20 bp, Artificial Sequence
  chemically synthesized
gttactagaccaagcttatt

SEQ ID NO: 28145 - DNA, 20 bp, Artificial Sequence
  chemically synthesized
ctatggtctcccaataagct

SEQ ID NO: 28146 - DNA, 20 bp, Artificial Sequence
  chemically synthesized
ggttactagaccaagcttat

SEQ ID NO: 28147 - DNA, 20 bp, Artificial Sequence
  chemically synthesized
gtctcccaataagcttggtc

SEQ ID NO: 28148 - DNA, 20 bp, Artificial Sequence
  chemically synthesized
aaagttaaggttactagacc

SEQ ID NO: 28149 - DNA, 20 bp, Artificial Sequence
  chemically synthesized
cttaggaaagttaaggttac

SEQ ID NO: 28150 - DNA, 20 bp, Artificial Sequence
  chemically synthesized
aatgaagcttaggaaagtta

SEQ ID NO: 28151 - DNA, 20 bp, Artificial Sequence
  chemically synthesized
aaatgaagcttaggaaagtt

SEQ ID NO: 28152 - DNA, 20 bp, Artificial Sequence
  chemically synthesized
ctagtaaccttaactttcct

SEQ ID NO: 28153 - DNA, 20 bp, Artificial Sequence
  chemically synthesized
aaaaaaaatgaagcttagga

SEQ ID NO: 28154 - DNA, 20 bp, Artificial Sequence
  chemically synthesized
acaaaaaaaaaatgaagctt

SEQ ID NO: 28155 - DNA, 20 bp, Artificial Sequence
  chemically synthesized
aacaaaaaaaaaatgaagct

SEQ ID NO: 28156 - DNA, 20 bp, Artificial Sequence
  chemically synthesized
aaatgaacaaaaaaaaaatg

SEQ ID NO: 28157 - DNA, 20 bp, Artificial Sequence
  chemically synthesized
tttttttttgttcattttta

SEQ ID NO: 28158 - DNA, 20 bp, Artificial Sequence
  chemically synthesized
ttttttttgttcatttttaa

SEQ ID NO: 28159 - DNA, 20 bp, Artificial Sequence
  chemically synthesized
tttttttgttcatttttaaa

SEQ ID NO: 28160 - DNA, 20 bp, Artificial Sequence
  chemically synthesized
ttgttcatttttaaagggaa

SEQ ID NO: 28161 - DNA, 20 bp, Artificial Sequence
  chemically synthesized
atttttaaagggaacagtaa

SEQ ID NO: 28162 - DNA, 20 bp, Artificial Sequence
  chemically synthesized
acagtaatagtacctattcc

SEQ ID NO: 28163 - DNA, 20 bp, Artificial Sequence
  chemically synthesized
cagtaatagtacctattcct

SEQ ID NO: 28164 - DNA, 20 bp, Artificial Sequence
  chemically synthesized
agtaatagtacctattccta

SEQ ID NO: 28165 - DNA, 20 bp, Artificial Sequence
  chemically synthesized
tttgcaacagccctaggaat

SEQ ID NO: 28166 - DNA, 20 bp, Artificial Sequence
  chemically synthesized
ttttgcaacagccctaggaa

SEQ ID NO: 28167 - DNA, 20 bp, Artificial Sequence
  chemically synthesized
cttagttttgcaacagccct

SEQ ID NO: 28168 - DNA, 20 bp, Artificial Sequence
  chemically synthesized
tcttagttttgcaacagccc

SEQ ID NO: 28169 - DNA, 20 bp, Artificial Sequence
  chemically synthesized
tatctctcttagttttgcaa

SEQ ID NO: 28170 - DNA, 20 bp, Artificial Sequence
  chemically synthesized
cctagggctgttgcaaaact

SEQ ID NO: 28171 - DNA, 20 bp, Artificial Sequence
  chemically synthesized
tagggctgttgcaaaactaa

SEQ ID NO: 28172 - DNA, 20 bp, Artificial Sequence
  chemically synthesized
gggctgttgcaaaactaaga

SEQ ID NO: 28173 - DNA, 20 bp, Artificial Sequence
  chemically synthesized
tgttgcaaaactaagagaga

SEQ ID NO: 28174 - DNA, 20 bp, Artificial Sequence
  chemically synthesized
ttgagatacactatctctct

SEQ ID NO: 28175 - DNA, 20 bp, Artificial Sequence
  chemically synthesized
agagagatagtgtatctcaa

SEQ ID NO: 28176 - DNA, 20 bp, Artificial Sequence
  chemically synthesized
atctcctctttggagctttt

SEQ ID NO: 28177 - DNA, 20 bp, Artificial Sequence
  chemically synthesized
agtgtatctcaaaagctcca

SEQ ID NO: 28178 - DNA, 20 bp, Artificial Sequence
  chemically synthesized
tgtatctcaaaagctccaaa

SEQ ID NO: 28179 - DNA, 20 bp, Artificial Sequence
  chemically synthesized
gtatctcaaaagctccaaag

SEQ ID NO: 28180 - DNA, 20 bp, Artificial Sequence
  chemically synthesized
atctcaaaagctccaaagag

SEQ ID NO: 28181 - DNA, 20 bp, Artificial Sequence
  chemically synthesized
caagatacatctcctctttg

SEQ ID NO: 28182 - DNA, 20 bp, Artificial Sequence
  chemically synthesized
tccaagatacatctcctctt

SEQ ID NO: 28183 - DNA, 20 bp, Artificial Sequence
  chemically synthesized
tccaaagaggagatgtatct

SEQ ID NO: 28184 - DNA, 20 bp, Artificial Sequence
  chemically synthesized
tactgagcaagtatatatcc

SEQ ID NO: 28185 - DNA, 20 bp, Artificial Sequence
  chemically synthesized
atcttggatatatacttgct

SEQ ID NO: 28186 - DNA, 20 bp, Artificial Sequence
  chemically synthesized
gttcctaacttttactgagc

SEQ ID NO: 28187 - DNA, 20 bp, Artificial Sequence
  chemically synthesized
gatatatacttgctcagtaa

SEQ ID NO: 28188 - DNA, 20 bp, Artificial Sequence
  chemically synthesized
aaaggttcctaacttttact

SEQ ID NO: 28189 - DNA, 20 bp, Artificial Sequence
  chemically synthesized
tatacttgctcagtaaaagt

SEQ ID NO: 28190 - DNA, 20 bp, Artificial Sequence
  chemically synthesized
atacttgctcagtaaaagtt

SEQ ID NO: 28191 - DNA, 20 bp, Artificial Sequence
  chemically synthesized
agaagtacaggggcagagaa

SEQ ID NO: 28192 - DNA, 20 bp, Artificial Sequence
  chemically synthesized
aagaagtacaggggcagaga

SEQ ID NO: 28193 - DNA, 20 bp, Artificial Sequence
  chemically synthesized
taacaagaagtacaggggca

SEQ ID NO: 28194 - DNA, 20 bp, Artificial Sequence
  chemically synthesized
tataacaagaagtacagggg

SEQ ID NO: 28195 - DNA, 20 bp, Artificial Sequence
  chemically synthesized
ctttataacaagaagtacag

SEQ ID NO: 28196 - DNA, 20 bp, Artificial Sequence
  chemically synthesized
actttataacaagaagtaca

SEQ ID NO: 28197 - DNA, 20 bp, Artificial Sequence
  chemically synthesized
tactttataacaagaagtac

SEQ ID NO: 28198 - DNA, 20 bp, Artificial Sequence
  chemically synthesized
atactttataacaagaagta

SEQ ID NO: 28199 - DNA, 20 bp, Artificial Sequence
  chemically synthesized
ttattatactttataacaag

SEQ ID NO: 28200 - DNA, 20 bp, Artificial Sequence
  chemically synthesized
cccctgtacttcttgttata

SEQ ID NO: 28201 - DNA, 20 bp, Artificial Sequence
  chemically synthesized
cttttattatactttataac

SEQ ID NO: 28202 - DNA, 20 bp, Artificial Sequence
  chemically synthesized
cttgttataaagtataataa

SEQ ID NO: 28203 - DNA, 20 bp, Artificial Sequence
  chemically synthesized
ataaagtataataaaagtgc

SEQ ID NO: 28204 - DNA, 20 bp, Artificial Sequence
  chemically synthesized
gtaatatttttatcatgctg

SEQ ID NO: 28205 - DNA, 20 bp, Artificial Sequence
  chemically synthesized
cgaagaaagagtttggtcca

SEQ ID NO: 28206 - DNA, 20 bp, Artificial Sequence
  chemically synthesized
ggggaaccgaagaaagagtt

SEQ ID NO: 28207 - DNA, 20 bp, Artificial Sequence
  chemically synthesized
tgtggaccaaactctttctt

SEQ ID NO: 28208 - DNA, 20 bp, Artificial Sequence
  chemically synthesized
gaaaaggggaaccgaagaaa

SEQ ID NO: 28209 - DNA, 20 bp, Artificial Sequence
  chemically synthesized
ttgaaaaggggaaccgaaga

SEQ ID NO: 28210 - DNA, 20 bp, Artificial Sequence
  chemically synthesized
ccatttgaaaaggggaaccg

SEQ ID NO: 28211 - DNA, 20 bp, Artificial Sequence
  chemically synthesized
ctctaaagccatttgaaaag

SEQ ID NO: 28212 - DNA, 20 bp, Artificial Sequence
  chemically synthesized
actctaaagccatttgaaaa

SEQ ID NO: 28213 - DNA, 20 bp, Artificial Sequence
  chemically synthesized
cttcggttccccttttcaaa

SEQ ID NO: 28214 - DNA, 20 bp, Artificial Sequence
  chemically synthesized
tactctaaagccatttgaaa

SEQ ID NO: 28215 - DNA, 20 bp, Artificial Sequence
  chemically synthesized
atactctaaagccatttgaa

SEQ ID NO: 28216 - DNA, 20 bp, Artificial Sequence
  chemically synthesized
ttccccttttcaaatggctt

SEQ ID NO: 28217 - DNA, 20 bp, Artificial Sequence
  chemically synthesized
ccccttttcaaatggcttta

SEQ ID NO: 28218 - DNA, 20 bp, Artificial Sequence
  chemically synthesized
tttgaagaggaaatactcta

SEQ ID NO: 28219 - DNA, 20 bp, Artificial Sequence
  chemically synthesized
gggacagtggcattttgaag

SEQ ID NO: 28220 - DNA, 20 bp, Artificial Sequence
  chemically synthesized
ggggacagtggcattttgaa

SEQ ID NO: 28221 - DNA, 20 bp, Artificial Sequence
  chemically synthesized
gaggggacagtggcattttg

SEQ ID NO: 28222 - DNA, 20 bp, Artificial Sequence
  chemically synthesized
ttcttcctgagaggggacag

SEQ ID NO: 28223 - DNA, 20 bp, Artificial Sequence
  chemically synthesized
actttcttcctgagagggga

SEQ ID NO: 28224 - DNA, 20 bp, Artificial Sequence
  chemically synthesized
aaaatgccactgtcccctct

SEQ ID NO: 28225 - DNA, 20 bp, Artificial Sequence
  chemically synthesized
aaatgccactgtcccctctc

SEQ ID NO: 28226 - DNA, 20 bp, Artificial Sequence
  chemically synthesized
ctatactttcttcctgagag

SEQ ID NO: 28227 - DNA, 20 bp, Artificial Sequence
  chemically synthesized
tgccactgtcccctctcagg

SEQ ID NO: 28228 - DNA, 20 bp, Artificial Sequence
  chemically synthesized
gctatactttcttcctgaga

SEQ ID NO: 28229 - DNA, 20 bp, Artificial Sequence
  chemically synthesized
agctatactttcttcctgag

SEQ ID NO: 28230 - DNA, 20 bp, Artificial Sequence
  chemically synthesized
cagctatactttcttcctga

SEQ ID NO: 28231 - DNA, 20 bp, Artificial Sequence
  chemically synthesized
actgtcccctctcaggaaga

SEQ ID NO: 28232 - DNA, 20 bp, Artificial Sequence
  chemically synthesized
ctcagctatactttcttcct

SEQ ID NO: 28233 - DNA, 20 bp, Artificial Sequence
  chemically synthesized
cccctctcaggaagaaagta

SEQ ID NO: 28234 - DNA, 20 bp, Artificial Sequence
  chemically synthesized
ctcaggaagaaagtatagct

SEQ ID NO: 28235 - DNA, 20 bp, Artificial Sequence
  chemically synthesized
tcaggaagaaagtatagctg

SEQ ID NO: 28236 - DNA, 20 bp, Artificial Sequence
  chemically synthesized
caggaagaaagtatagctga

SEQ ID NO: 28237 - DNA, 20 bp, Artificial Sequence
  chemically synthesized
aggaagaaagtatagctgag

SEQ ID NO: 28238 - DNA, 20 bp, Artificial Sequence
  chemically synthesized
aaaccagcgatttagcccct

SEQ ID NO: 28239 - DNA, 20 bp, Artificial Sequence
  chemically synthesized
tagctgaggggctaaatcgc

SEQ ID NO: 28240 - DNA, 20 bp, Artificial Sequence
  chemically synthesized
taactcctaaaccagcgatt

SEQ ID NO: 28241 - DNA, 20 bp, Artificial Sequence
  chemically synthesized
gaggggctaaatcgctggtt

SEQ ID NO: 28242 - DNA, 20 bp, Artificial Sequence
  chemically synthesized
aggggctaaatcgctggttt

SEQ ID NO: 28243 - DNA, 20 bp, Artificial Sequence
  chemically synthesized
gggctaaatcgctggtttag

SEQ ID NO: 28244 - DNA, 20 bp, Artificial Sequence
  chemically synthesized
tgtacttttaactcctaaac

SEQ ID NO: 28245 - DNA, 20 bp, Artificial Sequence
  chemically synthesized
atcgctggtttaggagttaa

SEQ ID NO: 28246 - DNA, 20 bp, Artificial Sequence
  chemically synthesized
ttttctcacattgcaaagca

SEQ ID NO: 28247 - DNA, 20 bp, Artificial Sequence
  chemically synthesized
attttctcacattgcaaagc

SEQ ID NO: 28248 - DNA, 20 bp, Artificial Sequence
  chemically synthesized
aattttctcacattgcaaag

SEQ ID NO: 28249 - DNA, 20 bp, Artificial Sequence
  chemically synthesized
ggtaattttctcacattgca

SEQ ID NO: 28250 - DNA, 20 bp, Artificial Sequence
  chemically synthesized
aaatccctgctttgcaatgt

SEQ ID NO: 28251 - DNA, 20 bp, Artificial Sequence
  chemically synthesized
agatgaggctcagagaaaat

SEQ ID NO: 28252 - DNA, 20 bp, Artificial Sequence
  chemically synthesized
cagatgaggctcagagaaaa

SEQ ID NO: 28253 - DNA, 20 bp, Artificial Sequence
  chemically synthesized
gaaaattacctattttctct

SEQ ID NO: 28254 - DNA, 20 bp, Artificial Sequence
  chemically synthesized
cattgtgcagatgaggctca

SEQ ID NO: 28255 - DNA, 20 bp, Artificial Sequence
  chemically synthesized
tccattgtgcagatgaggct

SEQ ID NO: 28256 - DNA, 20 bp, Artificial Sequence
  chemically synthesized
gtatctccattgtgcagatg

SEQ ID NO: 28257 - DNA, 20 bp, Artificial Sequence
  chemically synthesized
tgtatctccattgtgcagat

SEQ ID NO: 28258 - DNA, 20 bp, Artificial Sequence
  chemically synthesized
tctgagcctcatctgcacaa

SEQ ID NO: 28259 - DNA, 20 bp, Artificial Sequence
  chemically synthesized
tgagcctcatctgcacaatg

SEQ ID NO: 28260 - DNA, 20 bp, Artificial Sequence
  chemically synthesized
atatttgtatctccattgtg

SEQ ID NO: 28261 - DNA, 20 bp, Artificial Sequence
  chemically synthesized
ggagatacaaatatctttta

SEQ ID NO: 28262 - DNA, 20 bp, Artificial Sequence
  chemically synthesized
gagatacaaatatcttttac

SEQ ID NO: 28263 - DNA, 20 bp, Artificial Sequence
  chemically synthesized
agatacaaatatcttttaca

SEQ ID NO: 28264 - DNA, 20 bp, Artificial Sequence
  chemically synthesized
tcctttcaaaaaccctgtaa

SEQ ID NO: 28265 - DNA, 20 bp, Artificial Sequence
  chemically synthesized
atcttttacagggtttttga

SEQ ID NO: 28266 - DNA, 20 bp, Artificial Sequence
  chemically synthesized
tcttttacagggtttttgaa

SEQ ID NO: 28267 - DNA, 20 bp, Artificial Sequence
  chemically synthesized
gggtttttgaaaggattaat

SEQ ID NO: 28268 - DNA, 20 bp, Artificial Sequence
  chemically synthesized
taatgagaaatatatgctta

SEQ ID NO: 28269 - DNA, 20 bp, Artificial Sequence
  chemically synthesized
agaaatatatgcttatggta

SEQ ID NO: 28270 - DNA, 20 bp, Artificial Sequence
  chemically synthesized
tgtatgtgctgccataccat

SEQ ID NO: 28271 - DNA, 20 bp, Artificial Sequence
  chemically synthesized
aatatatgcttatggtatgg

SEQ ID NO: 28272 - DNA, 20 bp, Artificial Sequence
  chemically synthesized
ggcagcacatacatttatat

SEQ ID NO: 28273 - DNA, 20 bp, Artificial Sequence
  chemically synthesized
ttagaaaaatttatttttgg

SEQ ID NO: 28274 - DNA, 20 bp, Artificial Sequence
  chemically synthesized
ttcttagaaaaatttatttt

SEQ ID NO: 28275 - DNA, 20 bp, Artificial Sequence
  chemically synthesized
caccaaaaataaatttttct

SEQ ID NO: 28276 - DNA, 20 bp, Artificial Sequence
  chemically synthesized
caaaaataaatttttctaag

SEQ ID NO: 28277 - DNA, 20 bp, Artificial Sequence
  chemically synthesized
aaaataaatttttctaagaa

SEQ ID NO: 28278 - DNA, 20 bp, Artificial Sequence
  chemically synthesized
ttatttacaatttctcttct

SEQ ID NO: 28279 - DNA, 20 bp, Artificial Sequence
  chemically synthesized
gaaattgtaaataaacccat

SEQ ID NO: 28280 - DNA, 20 bp, Artificial Sequence
  chemically synthesized
tgattgaattacatacttat

SEQ ID NO: 28281 - DNA, 20 bp, Artificial Sequence
  chemically synthesized
ttgattgaattacatactta

SEQ ID NO: 28282 - DNA, 20 bp, Artificial Sequence
  chemically synthesized
ctgagcggagcaacagggaa

SEQ ID NO: 28283 - DNA, 20 bp, Artificial Sequence
  chemically synthesized
gcaaactgagcggagcaaca

SEQ ID NO: 28284 - DNA, 20 bp, Artificial Sequence
  chemically synthesized
tgcaaactgagcggagcaac

SEQ ID NO: 28285 - DNA, 20 bp, Artificial Sequence
  chemically synthesized
ttgcaaactgagcggagcaa

SEQ ID NO: 28286 - DNA, 20 bp, Artificial Sequence
  chemically synthesized
ctattccctgttgctccgct

SEQ ID NO: 28287 - DNA, 20 bp, Artificial Sequence
  chemically synthesized
aggaaattgcaaactgagcg

SEQ ID NO: 28288 - DNA, 20 bp, Artificial Sequence
  chemically synthesized
agaggaaattgcaaactgag

SEQ ID NO: 28289 - DNA, 20 bp, Artificial Sequence
  chemically synthesized
aaaagaggaaattgcaaact

SEQ ID NO: 28290 - DNA, 20 bp, Artificial Sequence
  chemically synthesized
gtgataccattgaggaaaag

SEQ ID NO: 28291 - DNA, 20 bp, Artificial Sequence
  chemically synthesized
ggtgataccattgaggaaaa

SEQ ID NO: 28292 - DNA, 20 bp, Artificial Sequence
  chemically synthesized
atggtgataccattgaggaa

SEQ ID NO: 28293 - DNA, 20 bp, Artificial Sequence
  chemically synthesized
caatttcctcttttcctcaa

SEQ ID NO: 28294 - DNA, 20 bp, Artificial Sequence
  chemically synthesized
agagaatggtgataccattg

SEQ ID NO: 28295 - DNA, 20 bp, Artificial Sequence
  chemically synthesized
cagagaatggtgataccatt

SEQ ID NO: 28296 - DNA, 20 bp, Artificial Sequence
  chemically synthesized
aggcgtggtgacacagagaa

SEQ ID NO: 28297 - DNA, 20 bp, Artificial Sequence
  chemically synthesized
tttgaaggcgtggtgacaca

SEQ ID NO: 28298 - DNA, 20 bp, Artificial Sequence
  chemically synthesized
aatttgaaggcgtggtgaca

SEQ ID NO: 28299 - DNA, 20 bp, Artificial Sequence
  chemically synthesized
gtcttcaaaatttgaaggcg

SEQ ID NO: 28300 - DNA, 20 bp, Artificial Sequence
  chemically synthesized
tatatgtcttcaaaatttga

SEQ ID NO: 28301 - DNA, 20 bp, Artificial Sequence
  chemically synthesized
ttatatgtcttcaaaatttg

SEQ ID NO: 28302 - DNA, 20 bp, Artificial Sequence
  chemically synthesized
caccacgccttcaaattttg

SEQ ID NO: 28303 - DNA, 20 bp, Artificial Sequence
  chemically synthesized
acaggttttaaagaaaaagg

SEQ ID NO: 28304 - DNA, 20 bp, Artificial Sequence
  chemically synthesized
ggacaggttttaaagaaaaa

SEQ ID NO: 28305 - DNA, 20 bp, Artificial Sequence
  chemically synthesized
tggacaggttttaaagaaaa

SEQ ID NO: 28306 - DNA, 20 bp, Artificial Sequence
  chemically synthesized
ttggacaggttttaaagaaa

SEQ ID NO: 28307 - DNA, 20 bp, Artificial Sequence
  chemically synthesized
cacagattggacaggtttta

SEQ ID NO: 28308 - DNA, 20 bp, Artificial Sequence
  chemically synthesized
aaggtaatcacagattggac

SEQ ID NO: 28309 - DNA, 20 bp, Artificial Sequence
  chemically synthesized
gaaggtaatcacagattgga

SEQ ID NO: 28310 - DNA, 20 bp, Artificial Sequence
  chemically synthesized
gccagaaggtaatcacagat

SEQ ID NO: 28311 - DNA, 20 bp, Artificial Sequence
  chemically synthesized
gaattgccagaaggtaatca

SEQ ID NO: 28312 - DNA, 20 bp, Artificial Sequence
  chemically synthesized
tccaatctgtgattaccttc

SEQ ID NO: 28313 - DNA, 20 bp, Artificial Sequence
  chemically synthesized
aacaaggtagaattgccaga

SEQ ID NO: 28314 - DNA, 20 bp, Artificial Sequence
  chemically synthesized
taacaaggtagaattgccag

SEQ ID NO: 28315 - DNA, 20 bp, Artificial Sequence
  chemically synthesized
tcttaacaaggtagaattgc

SEQ ID NO: 28316 - DNA, 20 bp, Artificial Sequence
  chemically synthesized
tctggcaattctaccttgtt

SEQ ID NO: 28317 - DNA, 20 bp, Artificial Sequence
  chemically synthesized
agaggtttttcttaacaagg

SEQ ID NO: 28318 - DNA, 20 bp, Artificial Sequence
  chemically synthesized
tccagaggtttttcttaaca

SEQ ID NO: 28319 - DNA, 20 bp, Artificial Sequence
  chemically synthesized
ctccagaggtttttcttaac

SEQ ID NO: 28320 - DNA, 20 bp, Artificial Sequence
  chemically synthesized
accttgttaagaaaaacctc

SEQ ID NO: 28321 - DNA, 20 bp, Artificial Sequence
  chemically synthesized
cttgttaagaaaaacctctg

SEQ ID NO: 28322 - DNA, 20 bp, Artificial Sequence
  chemically synthesized
aaaagggaacgtgactccag

SEQ ID NO: 28323 - DNA, 20 bp, Artificial Sequence
  chemically synthesized
gaaaagggaacgtgactcca

SEQ ID NO: 28324 - DNA, 20 bp, Artificial Sequence
  chemically synthesized
aggaaaagggaacgtgactc

SEQ ID NO: 28325 - DNA, 20 bp, Artificial Sequence
  chemically synthesized
tagcaatgggggaaggaaaa

SEQ ID NO: 28326 - DNA, 20 bp, Artificial Sequence
  chemically synthesized
atagcaatgggggaaggaaa

SEQ ID NO: 28327 - DNA, 20 bp, Artificial Sequence
  chemically synthesized
gatagcaatgggggaaggaa

SEQ ID NO: 28328 - DNA, 20 bp, Artificial Sequence
  chemically synthesized
cttaggatagcaatggggga

SEQ ID NO: 28329 - DNA, 20 bp, Artificial Sequence
  chemically synthesized
tcttaggatagcaatggggg

SEQ ID NO: 28330 - DNA, 20 bp, Artificial Sequence
  chemically synthesized
gggtcttaggatagcaatgg

SEQ ID NO: 28331 - DNA, 20 bp, Artificial Sequence
  chemically synthesized
agggtcttaggatagcaatg

SEQ ID NO: 28332 - DNA, 20 bp, Artificial Sequence
  chemically synthesized
gagggtcttaggatagcaat

SEQ ID NO: 28333 - DNA, 20 bp, Artificial Sequence
  chemically synthesized
tgagggtcttaggatagcaa

SEQ ID NO: 28334 - DNA, 20 bp, Artificial Sequence
  chemically synthesized
ccttcccccattgctatcct

SEQ ID NO: 28335 - DNA, 20 bp, Artificial Sequence
  chemically synthesized
acatgatgagggtcttagga

SEQ ID NO: 28336 - DNA, 20 bp, Artificial Sequence
  chemically synthesized
attgacatgatgagggtctt

SEQ ID NO: 28337 - DNA, 20 bp, Artificial Sequence
  chemically synthesized
aattgacatgatgagggtct

SEQ ID NO: 28338 - DNA, 20 bp, Artificial Sequence
  chemically synthesized
tgaggtaattgacatgatga

SEQ ID NO: 28339 - DNA, 20 bp, Artificial Sequence
  chemically synthesized
ttgaggtaattgacatgatg

SEQ ID NO: 28340 - DNA, 20 bp, Artificial Sequence
  chemically synthesized
tttgaggtaattgacatgat

SEQ ID NO: 28341 - DNA, 20 bp, Artificial Sequence
  chemically synthesized
gattatttcgttttgttttg

SEQ ID NO: 28342 - DNA, 20 bp, Artificial Sequence
  chemically synthesized
agattatttcgttttgtttt

SEQ ID NO: 28343 - DNA, 20 bp, Artificial Sequence
  chemically synthesized
aaggacagttagagagggga

SEQ ID NO: 28344 - DNA, 20 bp, Artificial Sequence
  chemically synthesized
ttaaggacagttagagaggg

SEQ ID NO: 28345 - DNA, 20 bp, Artificial Sequence
  chemically synthesized
gtttaaggacagttagagag

SEQ ID NO: 28346 - DNA, 20 bp, Artificial Sequence
  chemically synthesized
agtttaaggacagttagaga

SEQ ID NO: 28347 - DNA, 20 bp, Artificial Sequence
  chemically synthesized
gagtttaaggacagttagag

SEQ ID NO: 28348 - DNA, 20 bp, Artificial Sequence
  chemically synthesized
tgagtttaaggacagttaga

SEQ ID NO: 28349 - DNA, 20 bp, Artificial Sequence
  chemically synthesized
ggtgagtttaaggacagtta

SEQ ID NO: 28350 - DNA, 20 bp, Artificial Sequence
  chemically synthesized
tgggtgagtttaaggacagt

SEQ ID NO: 28351 - DNA, 20 bp, Artificial Sequence
  chemically synthesized
ttggtgggtgagtttaagga

SEQ ID NO: 28352 - DNA, 20 bp, Artificial Sequence
  chemically synthesized
gaatttggtgggtgagttta

SEQ ID NO: 28353 - DNA, 20 bp, Artificial Sequence
  chemically synthesized
ggaatttggtgggtgagttt

SEQ ID NO: 28354 - DNA, 20 bp, Artificial Sequence
  chemically synthesized
ggaataggaatttggtgggt

SEQ ID NO: 28355 - DNA, 20 bp, Artificial Sequence
  chemically synthesized
ttttggaataggaatttggt

SEQ ID NO: 28356 - DNA, 20 bp, Artificial Sequence
  chemically synthesized
gttttggaataggaatttgg

SEQ ID NO: 28357 - DNA, 20 bp, Artificial Sequence
  chemically synthesized
tgtgttttggaataggaatt

SEQ ID NO: 28358 - DNA, 20 bp, Artificial Sequence
  chemically synthesized
cgtcttctgtgttttggaat

SEQ ID NO: 28359 - DNA, 20 bp, Artificial Sequence
  chemically synthesized
ccgtcttctgtgttttggaa

SEQ ID NO: 28360 - DNA, 20 bp, Artificial Sequence
  chemically synthesized
caaattcctattccaaaaca

SEQ ID NO: 28361 - DNA, 20 bp, Artificial Sequence
  chemically synthesized
gaagtccgtcttctgtgttt

SEQ ID NO: 28362 - DNA, 20 bp, Artificial Sequence
  chemically synthesized
attcctattccaaaacacag

SEQ ID NO: 28363 - DNA, 20 bp, Artificial Sequence
  chemically synthesized
ctattccaaaacacagaaga

SEQ ID NO: 28364 - DNA, 20 bp, Artificial Sequence
  chemically synthesized
ttcagaaaagagaaataatg

SEQ ID NO: 28365 - DNA, 20 bp, Artificial Sequence
  chemically synthesized
ttcattatttctcttttctg

SEQ ID NO: 28366 - DNA, 20 bp, Artificial Sequence
  chemically synthesized
attgttaaatcttcagaaaa

SEQ ID NO: 28367 - DNA, 20 bp, Artificial Sequence
  chemically synthesized
acattgttaaatcttcagaa

SEQ ID NO: 28368 - DNA, 20 bp, Artificial Sequence
  chemically synthesized
gaaaaacattgttaaatctt

SEQ ID NO: 28369 - DNA, 20 bp, Artificial Sequence
  chemically synthesized
cattgcatttgattggcaat

SEQ ID NO: 28370 - DNA, 20 bp, Artificial Sequence
  chemically synthesized
acattgcatttgattggcaa

SEQ ID NO: 28371 - DNA, 20 bp, Artificial Sequence
  chemically synthesized
aaatttacattgcatttgat

SEQ ID NO: 28372 - DNA, 20 bp, Artificial Sequence
  chemically synthesized
agtgccttaaattatagagt

SEQ ID NO: 28373 - DNA, 20 bp, Artificial Sequence
  chemically synthesized
actaagtgccttaaattata

SEQ ID NO: 28374 - DNA, 20 bp, Artificial Sequence
  chemically synthesized
aatttctcactctataattt

SEQ ID NO: 28375 - DNA, 20 bp, Artificial Sequence
  chemically synthesized
atttctcactctataattta

SEQ ID NO: 28376 - DNA, 20 bp, Artificial Sequence
  chemically synthesized
gaactaagtgccttaaatta

SEQ ID NO: 28377 - DNA, 20 bp, Artificial Sequence
  chemically synthesized
actctataatttaaggcact

SEQ ID NO: 28378 - DNA, 20 bp, Artificial Sequence
  chemically synthesized
cagtgcccctggggtgaact

SEQ ID NO: 28379 - DNA, 20 bp, Artificial Sequence
  chemically synthesized
ttaaggcacttagttcaccc

SEQ ID NO: 28380 - DNA, 20 bp, Artificial Sequence
  chemically synthesized
taaggcacttagttcacccc

SEQ ID NO: 28381 - DNA, 20 bp, Artificial Sequence
  chemically synthesized
aaggcacttagttcacccca

SEQ ID NO: 28382 - DNA, 20 bp, Artificial Sequence
  chemically synthesized
aggcacttagttcaccccag

SEQ ID NO: 28383 - DNA, 20 bp, Artificial Sequence
  chemically synthesized
aatctgattcagtgcccctg

SEQ ID NO: 28384 - DNA, 20 bp, Artificial Sequence
  chemically synthesized
aaatctgattcagtgcccct

SEQ ID NO: 28385 - DNA, 20 bp, Artificial Sequence
  chemically synthesized
gaaatctgattcagtgcccc

SEQ ID NO: 28386 - DNA, 20 bp, Artificial Sequence
  chemically synthesized
tcaccccaggggcactgaat

SEQ ID NO: 28387 - DNA, 20 bp, Artificial Sequence
  chemically synthesized
tttaaaagggaaatctgatt

SEQ ID NO: 28388 - DNA, 20 bp, Artificial Sequence
  chemically synthesized
gccactccagatttttaaaa

SEQ ID NO: 28389 - DNA, 20 bp, Artificial Sequence
  chemically synthesized
ggccactccagatttttaaa

SEQ ID NO: 28390 - DNA, 20 bp, Artificial Sequence
  chemically synthesized
tggccactccagatttttaa

SEQ ID NO: 28391 - DNA, 20 bp, Artificial Sequence
  chemically synthesized
agatttcccttttaaaaatc

SEQ ID NO: 28392 - DNA, 20 bp, Artificial Sequence
  chemically synthesized
atttcccttttaaaaatctg

SEQ ID NO: 28393 - DNA, 20 bp, Artificial Sequence
  chemically synthesized
tcccttttaaaaatctggag

SEQ ID NO: 28394 - DNA, 20 bp, Artificial Sequence
  chemically synthesized
ttttaaaaatctggagtggc

SEQ ID NO: 28395 - DNA, 20 bp, Artificial Sequence
  chemically synthesized
gccaccgcgcctggccactc

SEQ ID NO: 28396 - DNA, 20 bp, Artificial Sequence
  chemically synthesized
tttaaaaatctggagtggcc

SEQ ID NO: 28397 - DNA, 20 bp, Artificial Sequence
  chemically synthesized
aaatctggagtggccaggcg

SEQ ID NO: 28398 - DNA, 20 bp, Artificial Sequence
  chemically synthesized
tctggagtggccaggcgcgg

SEQ ID NO: 28399 - DNA, 20 bp, Artificial Sequence
  chemically synthesized
caagaatgagccaccgcgcc

SEQ ID NO: 28400 - DNA, 20 bp, Artificial Sequence
  chemically synthesized
agtgctgggattacaagaat

SEQ ID NO: 28401 - DNA, 20 bp, Artificial Sequence
  chemically synthesized
gtggctcattcttgtaatcc

SEQ ID NO: 28402 - DNA, 20 bp, Artificial Sequence
  chemically synthesized
tcctaaagtgctgggattac

SEQ ID NO: 28403 - DNA, 20 bp, Artificial Sequence
  chemically synthesized
ttcttgtaatcccagcactt

SEQ ID NO: 28404 - DNA, 20 bp, Artificial Sequence
  chemically synthesized
tctcggcttcctaaagtgct

SEQ ID NO: 28405 - DNA, 20 bp, Artificial Sequence
  chemically synthesized
tcttgtaatcccagcacttt

SEQ ID NO: 28406 - DNA, 20 bp, Artificial Sequence
  chemically synthesized
atctcggcttcctaaagtgc

SEQ ID NO: 28407 - DNA, 20 bp, Artificial Sequence
  chemically synthesized
tgtaatcccagcactttagg

SEQ ID NO: 28408 - DNA, 20 bp, Artificial Sequence
  chemically synthesized
ctgcccatctcggcttccta

SEQ ID NO: 28409 - DNA, 20 bp, Artificial Sequence
  chemically synthesized
tcccagcactttaggaagcc

SEQ ID NO: 28410 - DNA, 20 bp, Artificial Sequence
  chemically synthesized
agcactttaggaagccgaga

SEQ ID NO: 28411 - DNA, 20 bp, Artificial Sequence
  chemically synthesized
gcactttaggaagccgagat

SEQ ID NO: 28412 - DNA, 20 bp, Artificial Sequence
  chemically synthesized
ctttaggaagccgagatggg

SEQ ID NO: 28413 - DNA, 20 bp, Artificial Sequence
  chemically synthesized
ctcaagccatctgcccatct

SEQ ID NO: 28414 - DNA, 20 bp, Artificial Sequence
  chemically synthesized
aggaagccgagatgggcaga

SEQ ID NO: 28415 - DNA, 20 bp, Artificial Sequence
  chemically synthesized
ccgagatgggcagatggctt

SEQ ID NO: 28416 - DNA, 20 bp, Artificial Sequence
  chemically synthesized
tgggcagatggcttgagctc

SEQ ID NO: 28417 - DNA, 20 bp, Artificial Sequence
  chemically synthesized
tgttctcaactcttgagctc

SEQ ID NO: 28418 - DNA, 20 bp, Artificial Sequence
  chemically synthesized
ggcagatggcttgagctcaa

SEQ ID NO: 28419 - DNA, 20 bp, Artificial Sequence
  chemically synthesized
atggcttgagctcaagagtt

SEQ ID NO: 28420 - DNA, 20 bp, Artificial Sequence
  chemically synthesized
ccaggctgttctcaactctt

SEQ ID NO: 28421 - DNA, 20 bp, Artificial Sequence
  chemically synthesized
ttgagctcaagagttgagaa

SEQ ID NO: 28422 - DNA, 20 bp, Artificial Sequence
  chemically synthesized
ctcaagagttgagaacagcc

SEQ ID NO: 28423 - DNA, 20 bp, Artificial Sequence
  chemically synthesized
agggttttgccatgttatcc

SEQ ID NO: 28424 - DNA, 20 bp, Artificial Sequence
  chemically synthesized
tgagaacagcctggataaca

SEQ ID NO: 28425 - DNA, 20 bp, Artificial Sequence
  chemically synthesized
cagggttttgccatgttatc

SEQ ID NO: 28426 - DNA, 20 bp, Artificial Sequence
  chemically synthesized
ttgtatttttggtagagaca

SEQ ID NO: 28427 - DNA, 20 bp, Artificial Sequence
  chemically synthesized
tttgtatttttggtagagac

SEQ ID NO: 28428 - DNA, 20 bp, Artificial Sequence
  chemically synthesized
ttttgtatttttggtagaga

SEQ ID NO: 28429 - DNA, 20 bp, Artificial Sequence
  chemically synthesized
taatttttgtatttttggta

SEQ ID NO: 28430 - DNA, 20 bp, Artificial Sequence
  chemically synthesized
gctaatttttgtatttttgg

SEQ ID NO: 28431 - DNA, 20 bp, Artificial Sequence
  chemically synthesized
ctggctaatttttgtatttt

SEQ ID NO: 28432 - DNA, 20 bp, Artificial Sequence
  chemically synthesized
tctaccaaaaatacaaaaat

SEQ ID NO: 28433 - DNA, 20 bp, Artificial Sequence
  chemically synthesized
ccaaaaatacaaaaattagc

SEQ ID NO: 28434 - DNA, 20 bp, Artificial Sequence
  chemically synthesized
caaaaatacaaaaattagcc

SEQ ID NO: 28435 - DNA, 20 bp, Artificial Sequence
  chemically synthesized
atacaaaaattagccaggta

SEQ ID NO: 28436 - DNA, 20 bp, Artificial Sequence
  chemically synthesized
caaaaattagccaggtatgg

SEQ ID NO: 28437 - DNA, 20 bp, Artificial Sequence
  chemically synthesized
caggcacacaccgccatacc

SEQ ID NO: 28438 - DNA, 20 bp, Artificial Sequence
  chemically synthesized
ggtatggcggtgtgtgcctg

SEQ ID NO: 28439 - DNA, 20 bp, Artificial Sequence
  chemically synthesized
gcggtgtgtgcctgtagtcc

SEQ ID NO: 28440 - DNA, 20 bp, Artificial Sequence
  chemically synthesized
ccccaggcagctgggactac

SEQ ID NO: 28441 - DNA, 20 bp, Artificial Sequence
  chemically synthesized
cccccaggcagctgggacta

SEQ ID NO: 28442 - DNA, 20 bp, Artificial Sequence
  chemically synthesized
tgcctgtagtcccagctgcc

SEQ ID NO: 28443 - DNA, 20 bp, Artificial Sequence
  chemically synthesized
cctcagccccccaggcagct

SEQ ID NO: 28444 - DNA, 20 bp, Artificial Sequence
  chemically synthesized
gcctgtagtcccagctgcct

SEQ ID NO: 28445 - DNA, 20 bp, Artificial Sequence
  chemically synthesized
gcctcagccccccaggcagc

SEQ ID NO: 28446 - DNA, 20 bp, Artificial Sequence
  chemically synthesized
cctgtagtcccagctgcctg

SEQ ID NO: 28447 - DNA, 20 bp, Artificial Sequence
  chemically synthesized
ctgtagtcccagctgcctgg

SEQ ID NO: 28448 - DNA, 20 bp, Artificial Sequence
  chemically synthesized
tgtagtcccagctgcctggg

SEQ ID NO: 28449 - DNA, 20 bp, Artificial Sequence
  chemically synthesized
tcctgcctcagccccccagg

SEQ ID NO: 28450 - DNA, 20 bp, Artificial Sequence
  chemically synthesized
ttctcctgcctcagcccccc

SEQ ID NO: 28451 - DNA, 20 bp, Artificial Sequence
  chemically synthesized
tcccagctgcctggggggct

SEQ ID NO: 28452 - DNA, 20 bp, Artificial Sequence
  chemically synthesized
attctcctgcctcagccccc

SEQ ID NO: 28453 - DNA, 20 bp, Artificial Sequence
  chemically synthesized
cccagctgcctggggggctg

SEQ ID NO: 28454 - DNA, 20 bp, Artificial Sequence
  chemically synthesized
agctgcctggggggctgagg

SEQ ID NO: 28455 - DNA, 20 bp, Artificial Sequence
  chemically synthesized
gctgcctggggggctgaggc

SEQ ID NO: 28456 - DNA, 20 bp, Artificial Sequence
  chemically synthesized
tgcctggggggctgaggcag

SEQ ID NO: 28457 - DNA, 20 bp, Artificial Sequence
  chemically synthesized
ctcaagtgattctcctgcct

SEQ ID NO: 28458 - DNA, 20 bp, Artificial Sequence
  chemically synthesized
ctgaggcaggagaatcactt

SEQ ID NO: 28459 - DNA, 20 bp, Artificial Sequence
  chemically synthesized
gcaggagaatcacttgagcc

SEQ ID NO: 28460 - DNA, 20 bp, Artificial Sequence
  chemically synthesized
caggagaatcacttgagccc

SEQ ID NO: 28461 - DNA, 20 bp, Artificial Sequence
  chemically synthesized
tgccacaacctcctgggctc

SEQ ID NO: 28462 - DNA, 20 bp, Artificial Sequence
  chemically synthesized
ggagaatcacttgagcccag

SEQ ID NO: 28463 - DNA, 20 bp, Artificial Sequence
  chemically synthesized
gagaatcacttgagcccagg

SEQ ID NO: 28464 - DNA, 20 bp, Artificial Sequence
  chemically synthesized
cactggtgccacaacctcct

SEQ ID NO: 28465 - DNA, 20 bp, Artificial Sequence
  chemically synthesized
tcactggtgccacaacctcc

SEQ ID NO: 28466 - DNA, 20 bp, Artificial Sequence
  chemically synthesized
cacttgagcccaggaggttg

SEQ ID NO: 28467 - DNA, 20 bp, Artificial Sequence
  chemically synthesized
agcccaggaggttgtggcac

SEQ ID NO: 28468 - DNA, 20 bp, Artificial Sequence
  chemically synthesized
caggaggttgtggcaccagt

SEQ ID NO: 28469 - DNA, 20 bp, Artificial Sequence
  chemically synthesized
gtggtgcgaacatggctcac

SEQ ID NO: 28470 - DNA, 20 bp, Artificial Sequence
  chemically synthesized
ggggtgcagtggtgcgaaca

SEQ ID NO: 28471 - DNA, 20 bp, Artificial Sequence
  chemically synthesized
tcgcccaggctggggtgcag

SEQ ID NO: 28472 - DNA, 20 bp, Artificial Sequence
  chemically synthesized
atgttcgcaccactgcaccc

SEQ ID NO: 28473 - DNA, 20 bp, Artificial Sequence
  chemically synthesized
ttgtcgcccaggctggggtg

SEQ ID NO: 28474 - DNA, 20 bp, Artificial Sequence
  chemically synthesized
cgcaccactgcaccccagcc

SEQ ID NO: 28475 - DNA, 20 bp, Artificial Sequence
  chemically synthesized
gcaccactgcaccccagcct

SEQ ID NO: 28476 - DNA, 20 bp, Artificial Sequence
  chemically synthesized
tcactttgtcgcccaggctg

SEQ ID NO: 28477 - DNA, 20 bp, Artificial Sequence
  chemically synthesized
ctcactttgtcgcccaggct

SEQ ID NO: 28478 - DNA, 20 bp, Artificial Sequence
  chemically synthesized
tctcactttgtcgcccaggc

SEQ ID NO: 28479 - DNA, 20 bp, Artificial Sequence
  chemically synthesized
agggtctcactttgtcgccc

SEQ ID NO: 28480 - DNA, 20 bp, Artificial Sequence
  chemically synthesized
gcaccccagcctgggcgaca

SEQ ID NO: 28481 - DNA, 20 bp, Artificial Sequence
  chemically synthesized
cagggtctcactttgtcgcc

SEQ ID NO: 28482 - DNA, 20 bp, Artificial Sequence
  chemically synthesized
cccagcctgggcgacaaagt

SEQ ID NO: 28483 - DNA, 20 bp, Artificial Sequence
  chemically synthesized
tttttttgctttttgagaca

SEQ ID NO: 28484 - DNA, 20 bp, Artificial Sequence
  chemically synthesized
ttttttttgctttttgagac

SEQ ID NO: 28485 - DNA, 20 bp, Artificial Sequence
  chemically synthesized
aagtgagaccctgtctcaaa

SEQ ID NO: 28486 - DNA, 20 bp, Artificial Sequence
  chemically synthesized
tttttttttgctttttgaga

SEQ ID NO: 28487 - DNA, 20 bp, Artificial Sequence
  chemically synthesized
tttttttttttttgcttttt

SEQ ID NO: 28488 - DNA, 20 bp, Artificial Sequence
  chemically synthesized
aaaaaaaaaaaaaaaaaatc

SEQ ID NO: 28489 - DNA, 20 bp, Artificial Sequence
  chemically synthesized
aaaaaaaaaaaaaaaatctg

SEQ ID NO: 28490 - DNA, 20 bp, Artificial Sequence
  chemically synthesized
aaaaaaaaaaaaatctggag

SEQ ID NO: 28491 - DNA, 20 bp, Artificial Sequence
  chemically synthesized
tgttctctgagaatctactc

SEQ ID NO: 28492 - DNA, 20 bp, Artificial Sequence
  chemically synthesized
aaaaatctggagtagattct

SEQ ID NO: 28493 - DNA, 20 bp, Artificial Sequence
  chemically synthesized
aaatctggagtagattctca

SEQ ID NO: 28494 - DNA, 20 bp, Artificial Sequence
  chemically synthesized
cagtgaagacattgttctct

SEQ ID NO: 28495 - DNA, 20 bp, Artificial Sequence
  chemically synthesized
ggcttgtttgcgagtcagtg

SEQ ID NO: 28496 - DNA, 20 bp, Artificial Sequence
  chemically synthesized
agactggcttgtttgcgagt

SEQ ID NO: 28497 - DNA, 20 bp, Artificial Sequence
  chemically synthesized
gtcttcactgactcgcaaac

SEQ ID NO: 28498 - DNA, 20 bp, Artificial Sequence
  chemically synthesized
tgaaagactggcttgtttgc

SEQ ID NO: 28499 - DNA, 20 bp, Artificial Sequence
  chemically synthesized
tcactgactcgcaaacaagc

SEQ ID NO: 28500 - DNA, 20 bp, Artificial Sequence
  chemically synthesized
taaacaaaggtatgaaagac

SEQ ID NO: 28501 - DNA, 20 bp, Artificial Sequence
  chemically synthesized
cagcataaacaaaggtatga

SEQ ID NO: 28502 - DNA, 20 bp, Artificial Sequence
  chemically synthesized
tagtgtagcagcataaacaa

SEQ ID NO: 28503 - DNA, 20 bp, Artificial Sequence
  chemically synthesized
atagtgtagcagcataaaca

SEQ ID NO: 28504 - DNA, 20 bp, Artificial Sequence
  chemically synthesized
agatattccagatagtgtag

SEQ ID NO: 28505 - DNA, 20 bp, Artificial Sequence
  chemically synthesized
gtttatgctgctacactatc

SEQ ID NO: 28506 - DNA, 20 bp, Artificial Sequence
  chemically synthesized
ccaagatattccagatagtg

SEQ ID NO: 28507 - DNA, 20 bp, Artificial Sequence
  chemically synthesized
tagggccaagatattccaga

SEQ ID NO: 28508 - DNA, 20 bp, Artificial Sequence
  chemically synthesized
aatgtagggccaagatattc

SEQ ID NO: 28509 - DNA, 20 bp, Artificial Sequence
  chemically synthesized
ctacactatctggaatatct

SEQ ID NO: 28510 - DNA, 20 bp, Artificial Sequence
  chemically synthesized
gtaaagtaaaatgtagggcc

SEQ ID NO: 28511 - DNA, 20 bp, Artificial Sequence
  chemically synthesized
ctcaggtaaagtaaaatgta

SEQ ID NO: 28512 - DNA, 20 bp, Artificial Sequence
  chemically synthesized
actcaggtaaagtaaaatgt

SEQ ID NO: 28513 - DNA, 20 bp, Artificial Sequence
  chemically synthesized
tactcaggtaaagtaaaatg

SEQ ID NO: 28514 - DNA, 20 bp, Artificial Sequence
  chemically synthesized
ccctacattttactttacct

SEQ ID NO: 28515 - DNA, 20 bp, Artificial Sequence
  chemically synthesized
aattttgtaatactcaggta

SEQ ID NO: 28516 - DNA, 20 bp, Artificial Sequence
  chemically synthesized
gaagaaattttgtaatactc

SEQ ID NO: 28517 - DNA, 20 bp, Artificial Sequence
  chemically synthesized
ggaagaaattttgtaatact

SEQ ID NO: 28518 - DNA, 20 bp, Artificial Sequence
  chemically synthesized
agtattacaaaatttcttcc

SEQ ID NO: 28519 - DNA, 20 bp, Artificial Sequence
  chemically synthesized
gaaaaaaacattgttctagg

SEQ ID NO: 28520 - DNA, 20 bp, Artificial Sequence
  chemically synthesized
gtggaaaaaaacattgttct

SEQ ID NO: 28521 - DNA, 20 bp, Artificial Sequence
  chemically synthesized
agtggaaaaaaacattgttc

SEQ ID NO: 28522 - DNA, 20 bp, Artificial Sequence
  chemically synthesized
agggagagttgtttggagag

SEQ ID NO: 28523 - DNA, 20 bp, Artificial Sequence
  chemically synthesized
attagggagagttgtttgga

SEQ ID NO: 28524 - DNA, 20 bp, Artificial Sequence
  chemically synthesized
taattagggagagttgtttg

SEQ ID NO: 28525 - DNA, 20 bp, Artificial Sequence
  chemically synthesized
aataattagggagagttgtt

SEQ ID NO: 28526 - DNA, 20 bp, Artificial Sequence
  chemically synthesized
ttaattagaataattaggga

SEQ ID NO: 28527 - DNA, 20 bp, Artificial Sequence
  chemically synthesized
tattaattagaataattagg

SEQ ID NO: 28528 - DNA, 20 bp, Artificial Sequence
  chemically synthesized
agtattaattagaataatta

SEQ ID NO: 28529 - DNA, 20 bp, Artificial Sequence
  chemically synthesized
cagtattaattagaataatt

SEQ ID NO: 28530 - DNA, 20 bp, Artificial Sequence
  chemically synthesized
gcagtattaattagaataat

SEQ ID NO: 28531 - DNA, 20 bp, Artificial Sequence
  chemically synthesized
gtaggaagagcagtattaat

SEQ ID NO: 28532 - DNA, 20 bp, Artificial Sequence
  chemically synthesized
ccttatataggtaggaagag

SEQ ID NO: 28533 - DNA, 20 bp, Artificial Sequence
  chemically synthesized
gtaccttatataggtaggaa

SEQ ID NO: 28534 - DNA, 20 bp, Artificial Sequence
  chemically synthesized
tggtaccttatataggtagg

SEQ ID NO: 28535 - DNA, 20 bp, Artificial Sequence
  chemically synthesized
gtatggtaccttatataggt

SEQ ID NO: 28536 - DNA, 20 bp, Artificial Sequence
  chemically synthesized
actgctcttcctacctatat

SEQ ID NO: 28537 - DNA, 20 bp, Artificial Sequence
  chemically synthesized
cgtatggtaccttatatagg

SEQ ID NO: 28538 - DNA, 20 bp, Artificial Sequence
  chemically synthesized
ctgctcttcctacctatata

SEQ ID NO: 28539 - DNA, 20 bp, Artificial Sequence
  chemically synthesized
aaacgtatggtaccttatat

SEQ ID NO: 28540 - DNA, 20 bp, Artificial Sequence
  chemically synthesized
caaacgtatggtaccttata

SEQ ID NO: 28541 - DNA, 20 bp, Artificial Sequence
  chemically synthesized
taagattaaggtcaaacgta

SEQ ID NO: 28542 - DNA, 20 bp, Artificial Sequence
  chemically synthesized
caccaacttaaataagatta

SEQ ID NO: 28543 - DNA, 20 bp, Artificial Sequence
  chemically synthesized
acaccaacttaaataagatt

SEQ ID NO: 28544 - DNA, 20 bp, Artificial Sequence
  chemically synthesized
gtttgaccttaatcttattt

SEQ ID NO: 28545 - DNA, 20 bp, Artificial Sequence
  chemically synthesized
ccgtgtacaccaacttaaat

SEQ ID NO: 28546 - DNA, 20 bp, Artificial Sequence
  chemically synthesized
gaccttaatcttatttaagt

SEQ ID NO: 28547 - DNA, 20 bp, Artificial Sequence
  chemically synthesized
cttatttaagttggtgtaca

SEQ ID NO: 28548 - DNA, 20 bp, Artificial Sequence
  chemically synthesized
aaacagttaataaatgttac

SEQ ID NO: 28549 - DNA, 20 bp, Artificial Sequence
  chemically synthesized
aaaattgggaagtaataaaa

SEQ ID NO: 28550 - DNA, 20 bp, Artificial Sequence
  chemically synthesized
ttgggggaaataaaattggg

SEQ ID NO: 28551 - DNA, 20 bp, Artificial Sequence
  chemically synthesized
gttttgggggaaataaaatt

SEQ ID NO: 28552 - DNA, 20 bp, Artificial Sequence
  chemically synthesized
tgttttgggggaaataaaat

SEQ ID NO: 28553 - DNA, 20 bp, Artificial Sequence
  chemically synthesized
aagatgttactgtgttttgg

SEQ ID NO: 28554 - DNA, 20 bp, Artificial Sequence
  chemically synthesized
attttatttcccccaaaaca

SEQ ID NO: 28555 - DNA, 20 bp, Artificial Sequence
  chemically synthesized
aaagatgttactgtgttttg

SEQ ID NO: 28556 - DNA, 20 bp, Artificial Sequence
  chemically synthesized
aaaagatgttactgtgtttt

SEQ ID NO: 28557 - DNA, 20 bp, Artificial Sequence
  chemically synthesized
caaaagatgttactgtgttt

SEQ ID NO: 28558 - DNA, 20 bp, Artificial Sequence
  chemically synthesized
acacagtaacatcttttgtg

SEQ ID NO: 28559 - DNA, 20 bp, Artificial Sequence
  chemically synthesized
agcctatgtcagcttcacaa

SEQ ID NO: 28560 - DNA, 20 bp, Artificial Sequence
  chemically synthesized
catcttttgtgaagctgaca

SEQ ID NO: 28561 - DNA, 20 bp, Artificial Sequence
  chemically synthesized
atcttttgtgaagctgacat

SEQ ID NO: 28562 - DNA, 20 bp, Artificial Sequence
  chemically synthesized
cctttgaaaaaagcctatgt

SEQ ID NO: 28563 - DNA, 20 bp, Artificial Sequence
  chemically synthesized
gctgacataggcttttttca

SEQ ID NO: 28564 - DNA, 20 bp, Artificial Sequence
  chemically synthesized
ctgacataggcttttttcaa

SEQ ID NO: 28565 - DNA, 20 bp, Artificial Sequence
  chemically synthesized
tataagaaatcctttgaaaa

SEQ ID NO: 28566 - DNA, 20 bp, Artificial Sequence
  chemically synthesized
tcaaaggatttcttatacaa

SEQ ID NO: 28567 - DNA, 20 bp, Artificial Sequence
  chemically synthesized
caaaggatttcttatacaac

SEQ ID NO: 28568 - DNA, 20 bp, Artificial Sequence
  chemically synthesized
tatctttctacctgttgtat

SEQ ID NO: 28569 - DNA, 20 bp, Artificial Sequence
  chemically synthesized
aggatttcttatacaacagg

SEQ ID NO: 28570 - DNA, 20 bp, Artificial Sequence
  chemically synthesized
tttcttatacaacaggtaga

SEQ ID NO: 28571 - DNA, 20 bp, Artificial Sequence
  chemically synthesized
ttatacaacaggtagaaaga

SEQ ID NO: 28572 - DNA, 20 bp, Artificial Sequence
  chemically synthesized
tacaacaggtagaaagatag

SEQ ID NO: 28573 - DNA, 20 bp, Artificial Sequence
  chemically synthesized
acaacaggtagaaagatagc

SEQ ID NO: 28574 - DNA, 20 bp, Artificial Sequence
  chemically synthesized
gaaagatagcaggcaacaat

SEQ ID NO: 28575 - DNA, 20 bp, Artificial Sequence
  chemically synthesized
atatataaatttgaatgtat

SEQ ID NO: 28576 - DNA, 20 bp, Artificial Sequence
  chemically synthesized
aatttgaatgtataagcctt

SEQ ID NO: 28577 - DNA, 20 bp, Artificial Sequence
  chemically synthesized
tcttaggttggaatgactga

SEQ ID NO: 28578 - DNA, 20 bp, Artificial Sequence
  chemically synthesized
gtcttaggttggaatgactg

SEQ ID NO: 28579 - DNA, 20 bp, Artificial Sequence
  chemically synthesized
gccttcagtcattccaacct

SEQ ID NO: 28580 - DNA, 20 bp, Artificial Sequence
  chemically synthesized
ttactttagatgtcttaggt

SEQ ID NO: 28581 - DNA, 20 bp, Artificial Sequence
  chemically synthesized
aaggttactttagatgtctt

SEQ ID NO: 28582 - DNA, 20 bp, Artificial Sequence
  chemically synthesized
caaggttactttagatgtct

SEQ ID NO: 28583 - DNA, 20 bp, Artificial Sequence
  chemically synthesized
attccaacctaagacatcta

SEQ ID NO: 28584 - DNA, 20 bp, Artificial Sequence
  chemically synthesized
tttgcttttcaaggttactt

SEQ ID NO: 28585 - DNA, 20 bp, Artificial Sequence
  chemically synthesized
acatctaaagtaaccttgaa

SEQ ID NO: 28586 - DNA, 20 bp, Artificial Sequence
  chemically synthesized
tatacccattttgcttttca

SEQ ID NO: 28587 - DNA, 20 bp, Artificial Sequence
  chemically synthesized
gtatacccattttgcttttc

SEQ ID NO: 28588 - DNA, 20 bp, Artificial Sequence
  chemically synthesized
agtaaccttgaaaagcaaaa

SEQ ID NO: 28589 - DNA, 20 bp, Artificial Sequence
  chemically synthesized
gtaaccttgaaaagcaaaat

SEQ ID NO: 28590 - DNA, 20 bp, Artificial Sequence
  chemically synthesized
aaagcaaaatgggtatacgt

SEQ ID NO: 28591 - DNA, 20 bp, Artificial Sequence
  chemically synthesized
gcattaataaacgataccac

SEQ ID NO: 28592 - DNA, 20 bp, Artificial Sequence
  chemically synthesized
ttatcttctcttattgctag

SEQ ID NO: 28593 - DNA, 20 bp, Artificial Sequence
  chemically synthesized
taaacgataccactagcaat

SEQ ID NO: 28594 - DNA, 20 bp, Artificial Sequence
  chemically synthesized
aacgataccactagcaataa

SEQ ID NO: 28595 - DNA, 20 bp, Artificial Sequence
  chemically synthesized
attttatcttctcttattgc

SEQ ID NO: 28596 - DNA, 20 bp, Artificial Sequence
  chemically synthesized
gataccactagcaataagag

SEQ ID NO: 28597 - DNA, 20 bp, Artificial Sequence
  chemically synthesized
taagagaagataaaataata

SEQ ID NO: 28598 - DNA, 20 bp, Artificial Sequence
  chemically synthesized
aaaataatatggttgtcatt

SEQ ID NO: 28599 - DNA, 20 bp, Artificial Sequence
  chemically synthesized
aaataatatggttgtcattt

SEQ ID NO: 28600 - DNA, 20 bp, Artificial Sequence
  chemically synthesized
tggttgtcatttgggttcta

SEQ ID NO: 28601 - DNA, 20 bp, Artificial Sequence
  chemically synthesized
tgtcatttgggttctacaga

SEQ ID NO: 28602 - DNA, 20 bp, Artificial Sequence
  chemically synthesized
ttctaagtcctttctgtctg

SEQ ID NO: 28603 - DNA, 20 bp, Artificial Sequence
  chemically synthesized
atttgggttctacagacaga

SEQ ID NO: 28604 - DNA, 20 bp, Artificial Sequence
  chemically synthesized
tttgggttctacagacagaa

SEQ ID NO: 28605 - DNA, 20 bp, Artificial Sequence
  chemically synthesized
ttctacagacagaaaggact

SEQ ID NO: 28606 - DNA, 20 bp, Artificial Sequence
  chemically synthesized
tggaacacttacattattct

SEQ ID NO: 28607 - DNA, 20 bp, Artificial Sequence
  chemically synthesized
gaaaggacttagaataatgt

SEQ ID NO: 28608 - DNA, 20 bp, Artificial Sequence
  chemically synthesized
taatgtaagtgttccaccac

SEQ ID NO: 28609 - DNA, 20 bp, Artificial Sequence
  chemically synthesized
ggtctacttgtggccggtgg

SEQ ID NO: 28610 - DNA, 20 bp, Artificial Sequence
  chemically synthesized
ccaggtctacttgtggccgg

SEQ ID NO: 28611 - DNA, 20 bp, Artificial Sequence
  chemically synthesized
agtgttccaccaccggccac

SEQ ID NO: 28612 - DNA, 20 bp, Artificial Sequence
  chemically synthesized
gtaccaggtctacttgtggc

SEQ ID NO: 28613 - DNA, 20 bp, Artificial Sequence
  chemically synthesized
gttccaccaccggccacaag

SEQ ID NO: 28614 - DNA, 20 bp, Artificial Sequence
  chemically synthesized
gatggtaccaggtctacttg

SEQ ID NO: 28615 - DNA, 20 bp, Artificial Sequence
  chemically synthesized
ccaccggccacaagtagacc

SEQ ID NO: 28616 - DNA, 20 bp, Artificial Sequence
  chemically synthesized
agagtgaaggagatggtacc

SEQ ID NO: 28617 - DNA, 20 bp, Artificial Sequence
  chemically synthesized
gagagtgaaggagatggtac

SEQ ID NO: 28618 - DNA, 20 bp, Artificial Sequence
  chemically synthesized
gcctatgagagtgaaggaga

SEQ ID NO: 28619 - DNA, 20 bp, Artificial Sequence
  chemically synthesized
ccttgcctatgagagtgaag

SEQ ID NO: 28620 - DNA, 20 bp, Artificial Sequence
  chemically synthesized
ttccttgcctatgagagtga

SEQ ID NO: 28621 - DNA, 20 bp, Artificial Sequence
  chemically synthesized
attccttgcctatgagagtg

SEQ ID NO: 28622 - DNA, 20 bp, Artificial Sequence
  chemically synthesized
taccatctccttcactctca

SEQ ID NO: 28623 - DNA, 20 bp, Artificial Sequence
  chemically synthesized
accatctccttcactctcat

SEQ ID NO: 28624 - DNA, 20 bp, Artificial Sequence
  chemically synthesized
atagaattccttgcctatga

SEQ ID NO: 28625 - DNA, 20 bp, Artificial Sequence
  chemically synthesized
tctccttcactctcataggc

SEQ ID NO: 28626 - DNA, 20 bp, Artificial Sequence
  chemically synthesized
ctccttcactctcataggca

SEQ ID NO: 28627 - DNA, 20 bp, Artificial Sequence
  chemically synthesized
tgatagaattccttgcctat

SEQ ID NO: 28628 - DNA, 20 bp, Artificial Sequence
  chemically synthesized
cagcggacttcatgatgtga

SEQ ID NO: 28629 - DNA, 20 bp, Artificial Sequence
  chemically synthesized
aggaattctatcacatcatg

SEQ ID NO: 28630 - DNA, 20 bp, Artificial Sequence
  chemically synthesized
gcgtgactctggtcatgcag

SEQ ID NO: 28631 - DNA, 20 bp, Artificial Sequence
  chemically synthesized
catgaagtccgctgcatgac

SEQ ID NO: 28632 - DNA, 20 bp, Artificial Sequence
  chemically synthesized
ctggcgtgactctggtcatg

SEQ ID NO: 28633 - DNA, 20 bp, Artificial Sequence
  chemically synthesized
tgaagtccgctgcatgacca

SEQ ID NO: 28634 - DNA, 20 bp, Artificial Sequence
  chemically synthesized
tgcccaagctggcgtgactc

SEQ ID NO: 28635 - DNA, 20 bp, Artificial Sequence
  chemically synthesized
ctgcatgaccagagtcacgc

SEQ ID NO: 28636 - DNA, 20 bp, Artificial Sequence
  chemically synthesized
tgaccagagtcacgccagct

SEQ ID NO: 28637 - DNA, 20 bp, Artificial Sequence
  chemically synthesized
gaccagagtcacgccagctt

SEQ ID NO: 28638 - DNA, 20 bp, Artificial Sequence
  chemically synthesized
tccctgttcattgcccaagc

SEQ ID NO: 28639 - DNA, 20 bp, Artificial Sequence
  chemically synthesized
atgatccctgttcattgccc

SEQ ID NO: 28640 - DNA, 20 bp, Artificial Sequence
  chemically synthesized
acgccagcttgggcaatgaa

SEQ ID NO: 28641 - DNA, 20 bp, Artificial Sequence
  chemically synthesized
cgccagcttgggcaatgaac

SEQ ID NO: 28642 - DNA, 20 bp, Artificial Sequence
  chemically synthesized
gccagcttgggcaatgaaca

SEQ ID NO: 28643 - DNA, 20 bp, Artificial Sequence
  chemically synthesized
atagaatgcacaaaagtata

SEQ ID NO: 28644 - DNA, 20 bp, Artificial Sequence
  chemically synthesized
aatagaatgcacaaaagtat

SEQ ID NO: 28645 - DNA, 20 bp, Artificial Sequence
  chemically synthesized
ctgggtaatagaatgcacaa

SEQ ID NO: 28646 - DNA, 20 bp, Artificial Sequence
  chemically synthesized
cttttgtgcattctattacc

SEQ ID NO: 28647 - DNA, 20 bp, Artificial Sequence
  chemically synthesized
tttgtgcattctattaccca

SEQ ID NO: 28648 - DNA, 20 bp, Artificial Sequence
  chemically synthesized
caaaacctttctctgggtaa

SEQ ID NO: 28649 - DNA, 20 bp, Artificial Sequence
  chemically synthesized
tgcattctattacccagaga

SEQ ID NO: 28650 - DNA, 20 bp, Artificial Sequence
  chemically synthesized
gcattctattacccagagaa

SEQ ID NO: 28651 - DNA, 20 bp, Artificial Sequence
  chemically synthesized
aatgttcaaaacctttctct

SEQ ID NO: 28652 - DNA, 20 bp, Artificial Sequence
  chemically synthesized
gaatgttcaaaacctttctc

SEQ ID NO: 28653 - DNA, 20 bp, Artificial Sequence
  chemically synthesized
agaaaggttttgaacattct

SEQ ID NO: 28654 - DNA, 20 bp, Artificial Sequence
  chemically synthesized
ccccataaatatggagtact

SEQ ID NO: 28655 - DNA, 20 bp, Artificial Sequence
  chemically synthesized
ttttttcccccataaatatg

SEQ ID NO: 28656 - DNA, 20 bp, Artificial Sequence
  chemically synthesized
ttctaagtactccatattta

SEQ ID NO: 28657 - DNA, 20 bp, Artificial Sequence
  chemically synthesized
tctaagtactccatatttat

SEQ ID NO: 28658 - DNA, 20 bp, Artificial Sequence
  chemically synthesized
atttttttcccccataaata

SEQ ID NO: 28659 - DNA, 20 bp, Artificial Sequence
  chemically synthesized
ctaagtactccatatttatg

SEQ ID NO: 28660 - DNA, 20 bp, Artificial Sequence
  chemically synthesized
taagtactccatatttatgg

SEQ ID NO: 28661 - DNA, 20 bp, Artificial Sequence
  chemically synthesized
ggaaaaaaatcaatgcctca

SEQ ID NO: 28662 - DNA, 20 bp, Artificial Sequence
  chemically synthesized
tacatttacagttttctgtg

SEQ ID NO: 28663 - DNA, 20 bp, Artificial Sequence
  chemically synthesized
ttacatttacagttttctgt

SEQ ID NO: 28664 - DNA, 20 bp, Artificial Sequence
  chemically synthesized
atatggtcagtttacattta

SEQ ID NO: 28665 - DNA, 20 bp, Artificial Sequence
  chemically synthesized
atgtataccatagatatggt

SEQ ID NO: 28666 - DNA, 20 bp, Artificial Sequence
  chemically synthesized
atgtaaactgaccatatcta

SEQ ID NO: 28667 - DNA, 20 bp, Artificial Sequence
  chemically synthesized
actcatgtataccatagata

SEQ ID NO: 28668 - DNA, 20 bp, Artificial Sequence
  chemically synthesized
aggaagactcatgtatacca

SEQ ID NO: 28669 - DNA, 20 bp, Artificial Sequence
  chemically synthesized
accatatctatggtatacat

SEQ ID NO: 28670 - DNA, 20 bp, Artificial Sequence
  chemically synthesized
ttcctgcctcttgggtgagg

SEQ ID NO: 28671 - DNA, 20 bp, Artificial Sequence
  chemically synthesized
tacatgagtcttcctcaccc

SEQ ID NO: 28672 - DNA, 20 bp, Artificial Sequence
  chemically synthesized
catgagtcttcctcacccaa

SEQ ID NO: 28673 - DNA, 20 bp, Artificial Sequence
  chemically synthesized
tgcttcctgcctcttgggtg

SEQ ID NO: 28674 - DNA, 20 bp, Artificial Sequence
  chemically synthesized
atgagtcttcctcacccaag

SEQ ID NO: 28675 - DNA, 20 bp, Artificial Sequence
  chemically synthesized
ttgcttcctgcctcttgggt

SEQ ID NO: 28676 - DNA, 20 bp, Artificial Sequence
  chemically synthesized
agtcttcctcacccaagagg

SEQ ID NO: 28677 - DNA, 20 bp, Artificial Sequence
  chemically synthesized
gtcttcctcacccaagaggc

SEQ ID NO: 28678 - DNA, 20 bp, Artificial Sequence
  chemically synthesized
aagattgcttcctgcctctt

SEQ ID NO: 28679 - DNA, 20 bp, Artificial Sequence
  chemically synthesized
gaagattgcttcctgcctct

SEQ ID NO: 28680 - DNA, 20 bp, Artificial Sequence
  chemically synthesized
ttcctcacccaagaggcagg

SEQ ID NO: 28681 - DNA, 20 bp, Artificial Sequence
  chemically synthesized
tcagttattaacagaaaagg

SEQ ID NO: 28682 - DNA, 20 bp, Artificial Sequence
  chemically synthesized
tattcagttattaacagaaa

SEQ ID NO: 28683 - DNA, 20 bp, Artificial Sequence
  chemically synthesized
ctattcagttattaacagaa

SEQ ID NO: 28684 - DNA, 20 bp, Artificial Sequence
  chemically synthesized
aaaggctattcagttattaa

SEQ ID NO: 28685 - DNA, 20 bp, Artificial Sequence
  chemically synthesized
cttttctgttaataactgaa

SEQ ID NO: 28686 - DNA, 20 bp, Artificial Sequence
  chemically synthesized
tgtcctaataaaaggctatt

SEQ ID NO: 28687 - DNA, 20 bp, Artificial Sequence
  chemically synthesized
ataactgaatagccttttat

SEQ ID NO: 28688 - DNA, 20 bp, Artificial Sequence
  chemically synthesized
taactgaatagccttttatt

SEQ ID NO: 28689 - DNA, 20 bp, Artificial Sequence
  chemically synthesized
acagtggctgtcctaataaa

SEQ ID NO: 28690 - DNA, 20 bp, Artificial Sequence
  chemically synthesized
tacagtggctgtcctaataa

SEQ ID NO: 28691 - DNA, 20 bp, Artificial Sequence
  chemically synthesized
tgaatagccttttattagga

SEQ ID NO: 28692 - DNA, 20 bp, Artificial Sequence
  chemically synthesized
tgcagagccctaaattacag

SEQ ID NO: 28693 - DNA, 20 bp, Artificial Sequence
  chemically synthesized
ttaggacagccactgtaatt

SEQ ID NO: 28694 - DNA, 20 bp, Artificial Sequence
  chemically synthesized
taggacagccactgtaattt

SEQ ID NO: 28695 - DNA, 20 bp, Artificial Sequence
  chemically synthesized
aggacagccactgtaattta

SEQ ID NO: 28696 - DNA, 20 bp, Artificial Sequence
  chemically synthesized
atatgcagagccctaaatta

SEQ ID NO: 28697 - DNA, 20 bp, Artificial Sequence
  chemically synthesized
acattttttaaatatatgca

SEQ ID NO: 28698 - DNA, 20 bp, Artificial Sequence
  chemically synthesized
tcacattttttaaatatatg

SEQ ID NO: 28699 - DNA, 20 bp, Artificial Sequence
  chemically synthesized
gcatatatttaaaaaatgtg

SEQ ID NO: 28700 - DNA, 20 bp, Artificial Sequence
  chemically synthesized
atttaaaaaatgtgaagaaa

SEQ ID NO: 28701 - DNA, 20 bp, Artificial Sequence
  chemically synthesized
tttaaaaaatgtgaagaaac

SEQ ID NO: 28702 - DNA, 20 bp, Artificial Sequence
  chemically synthesized
taaaaaatgtgaagaaacag

SEQ ID NO: 28703 - DNA, 20 bp, Artificial Sequence
  chemically synthesized
aaatgtgaagaaacaggagt

SEQ ID NO: 28704 - DNA, 20 bp, Artificial Sequence
  chemically synthesized
tgaagaaacaggagttggta

SEQ ID NO: 28705 - DNA, 20 bp, Artificial Sequence
  chemically synthesized
aagaaacaggagttggtata

SEQ ID NO: 28706 - DNA, 20 bp, Artificial Sequence
  chemically synthesized
gagaataaaatttaatttaa

SEQ ID NO: 28707 - DNA, 20 bp, Artificial Sequence
  chemically synthesized
agaataaaatttaatttaat

SEQ ID NO: 28708 - DNA, 20 bp, Artificial Sequence
  chemically synthesized
ataaaatttaatttaatggg

SEQ ID NO: 28709 - DNA, 20 bp, Artificial Sequence
  chemically synthesized
ttaatttaatgggtagataa

SEQ ID NO: 28710 - DNA, 20 bp, Artificial Sequence
  chemically synthesized
gggtagataatagatccact

SEQ ID NO: 28711 - DNA, 20 bp, Artificial Sequence
  chemically synthesized
ggtagataatagatccacta

SEQ ID NO: 28712 - DNA, 20 bp, Artificial Sequence
  chemically synthesized
gataatagatccactaagga

SEQ ID NO: 28713 - DNA, 20 bp, Artificial Sequence
  chemically synthesized
atccctttatccatccttag

SEQ ID NO: 28714 - DNA, 20 bp, Artificial Sequence
  chemically synthesized
cttatccctttatccatcct

SEQ ID NO: 28715 - DNA, 20 bp, Artificial Sequence
  chemically synthesized
agatccactaaggatggata

SEQ ID NO: 28716 - DNA, 20 bp, Artificial Sequence
  chemically synthesized
gatccactaaggatggataa

SEQ ID NO: 28717 - DNA, 20 bp, Artificial Sequence
  chemically synthesized
atccactaaggatggataaa

SEQ ID NO: 28718 - DNA, 20 bp, Artificial Sequence
  chemically synthesized
ctaaggatggataaagggat

SEQ ID NO: 28719 - DNA, 20 bp, Artificial Sequence
  chemically synthesized
taaggatggataaagggata

SEQ ID NO: 28720 - DNA, 20 bp, Artificial Sequence
  chemically synthesized
ataaagggataaggcttatt

SEQ ID NO: 28721 - DNA, 20 bp, Artificial Sequence
  chemically synthesized
taattttttttcagctaaat

SEQ ID NO: 28722 - DNA, 20 bp, Artificial Sequence
  chemically synthesized
tgtacagtttaatttttttt

SEQ ID NO: 28723 - DNA, 20 bp, Artificial Sequence
  chemically synthesized
tgaaaaaaaattaaactgta

SEQ ID NO: 28724 - DNA, 20 bp, Artificial Sequence
  chemically synthesized
ctggttacataaatactgta

SEQ ID NO: 28725 - DNA, 20 bp, Artificial Sequence
  chemically synthesized
ctgtacagtatttatgtaac

SEQ ID NO: 28726 - DNA, 20 bp, Artificial Sequence
  chemically synthesized
tgtacagtatttatgtaacc

SEQ ID NO: 28727 - DNA, 20 bp, Artificial Sequence
  chemically synthesized
tacagtatttatgtaaccag

SEQ ID NO: 28728 - DNA, 20 bp, Artificial Sequence
  chemically synthesized
acagtatttatgtaaccagg

SEQ ID NO: 28729 - DNA, 20 bp, Artificial Sequence
  chemically synthesized
tctagttggtaacagcctcc

SEQ ID NO: 28730 - DNA, 20 bp, Artificial Sequence
  chemically synthesized
tgaggggctctagttggtaa

SEQ ID NO: 28731 - DNA, 20 bp, Artificial Sequence
  chemically synthesized
accaggaggctgttaccaac

SEQ ID NO: 28732 - DNA, 20 bp, Artificial Sequence
  chemically synthesized
caggaggctgttaccaacta

SEQ ID NO: 28733 - DNA, 20 bp, Artificial Sequence
  chemically synthesized
ttatgttgaggggctctagt

SEQ ID NO: 28734 - DNA, 20 bp, Artificial Sequence
  chemically synthesized
tgtgttatgttgaggggctc

SEQ ID NO: 28735 - DNA, 20 bp, Artificial Sequence
  chemically synthesized
tttttgtgtgttatgttgag

SEQ ID NO: 28736 - DNA, 20 bp, Artificial Sequence
  chemically synthesized
ttttttgtgtgttatgttga

SEQ ID NO: 28737 - DNA, 20 bp, Artificial Sequence
  chemically synthesized
cttttttgtgtgttatgttg

SEQ ID NO: 28738 - DNA, 20 bp, Artificial Sequence
  chemically synthesized
acttttttgtgtgttatgtt

SEQ ID NO: 28739 - DNA, 20 bp, Artificial Sequence
  chemically synthesized
cctcaacataacacacaaaa

SEQ ID NO: 28740 - DNA, 20 bp, Artificial Sequence
  chemically synthesized
caaaaaagtgtgtattatat

SEQ ID NO: 28741 - DNA, 20 bp, Artificial Sequence
  chemically synthesized
aagtgtgtattatatcagaa

SEQ ID NO: 28742 - DNA, 20 bp, Artificial Sequence
  chemically synthesized
tgtattatatcagaaaagtt

SEQ ID NO: 28743 - DNA, 20 bp, Artificial Sequence
  chemically synthesized
attatatcagaaaagtttgg

SEQ ID NO: 28744 - DNA, 20 bp, Artificial Sequence
  chemically synthesized
tatatcagaaaagtttggaa

SEQ ID NO: 28745 - DNA, 20 bp, Artificial Sequence
  chemically synthesized
aagtttggaagagttgtgtt

SEQ ID NO: 28746 - DNA, 20 bp, Artificial Sequence
  chemically synthesized
agtaatgtgaaaacaaaacg

SEQ ID NO: 28747 - DNA, 20 bp, Artificial Sequence
  chemically synthesized
tgttttcacattactcaaaa

SEQ ID NO: 28748 - DNA, 20 bp, Artificial Sequence
  chemically synthesized
tttcacattactcaaaaaag

SEQ ID NO: 28749 - DNA, 20 bp, Artificial Sequence
  chemically synthesized
gggtgtttttcttctttttt

SEQ ID NO: 28750 - DNA, 20 bp, Artificial Sequence
  chemically synthesized
caaaaaagaagaaaaacacc

SEQ ID NO: 28751 - DNA, 20 bp, Artificial Sequence
  chemically synthesized
aaaagaagaaaaacacccag

SEQ ID NO: 28752 - DNA, 20 bp, Artificial Sequence
  chemically synthesized
ttttcttttaaatatctgct

SEQ ID NO: 28753 - DNA, 20 bp, Artificial Sequence
  chemically synthesized
gttttcttttaaatatctgc

SEQ ID NO: 28754 - DNA, 20 bp, Artificial Sequence
  chemically synthesized
aacacccagcagatatttaa

SEQ ID NO: 28755 - DNA, 20 bp, Artificial Sequence
  chemically synthesized
tatttaaaagaaaacatttg

SEQ ID NO: 28756 - DNA, 20 bp, Artificial Sequence
  chemically synthesized
aagaaaacatttgtggtcac

SEQ ID NO: 28757 - DNA, 20 bp, Artificial Sequence
  chemically synthesized
atttgtgtattttttatttc

SEQ ID NO: 28758 - DNA, 20 bp, Artificial Sequence
  chemically synthesized
aatacacaaatattaacaat

SEQ ID NO: 28759 - DNA, 20 bp, Artificial Sequence
  chemically synthesized
cacaaatattaacaatgaga

SEQ ID NO: 28760 - DNA, 20 bp, Artificial Sequence
  chemically synthesized
ttacttttgctattgtaaca

SEQ ID NO: 28761 - DNA, 20 bp, Artificial Sequence
  chemically synthesized
tttaattttccttgttacaa

SEQ ID NO: 28762 - DNA, 20 bp, Artificial Sequence
  chemically synthesized
tttacttttgctattgtaac

SEQ ID NO: 28763 - DNA, 20 bp, Artificial Sequence
  chemically synthesized
tttccttgttacaatagcaa

SEQ ID NO: 28764 - DNA, 20 bp, Artificial Sequence
  chemically synthesized
gtaaaaataatactccatgc

SEQ ID NO: 28765 - DNA, 20 bp, Artificial Sequence
  chemically synthesized
taaaaataatactccatgct

SEQ ID NO: 28766 - DNA, 20 bp, Artificial Sequence
  chemically synthesized
accatgtccttcccagcatg

SEQ ID NO: 28767 - DNA, 20 bp, Artificial Sequence
  chemically synthesized
aaataatactccatgctggg

SEQ ID NO: 28768 - DNA, 20 bp, Artificial Sequence
  chemically synthesized
taaccatgtccttcccagca

SEQ ID NO: 28769 - DNA, 20 bp, Artificial Sequence
  chemically synthesized
aataatactccatgctggga

SEQ ID NO: 28770 - DNA, 20 bp, Artificial Sequence
  chemically synthesized
caatctaaccatgtccttcc

SEQ ID NO: 28771 - DNA, 20 bp, Artificial Sequence
  chemically synthesized
actccatgctgggaaggaca

SEQ ID NO: 28772 - DNA, 20 bp, Artificial Sequence
  chemically synthesized
catgctgggaaggacatggt

SEQ ID NO: 28773 - DNA, 20 bp, Artificial Sequence
  chemically synthesized
tgggaaggacatggttagat

SEQ ID NO: 28774 - DNA, 20 bp, Artificial Sequence
  chemically synthesized
atggttagattggcactttg

SEQ ID NO: 28775 - DNA, 20 bp, Artificial Sequence
  chemically synthesized
tttacactcataatacttca

SEQ ID NO: 28776 - DNA, 20 bp, Artificial Sequence
  chemically synthesized
ttggcactttgaagtattat

SEQ ID NO: 28777 - DNA, 20 bp, Artificial Sequence
  chemically synthesized
tgaagtattatgagtgtaaa

SEQ ID NO: 28778 - DNA, 20 bp, Artificial Sequence
  chemically synthesized
attatgagtgtaaatggcta

SEQ ID NO: 28779 - DNA, 20 bp, Artificial Sequence
  chemically synthesized
gaaactttctcaaaaggctg

SEQ ID NO: 28780 - DNA, 20 bp, Artificial Sequence
  chemically synthesized
gtaaatggctacagcctttt

SEQ ID NO: 28781 - DNA, 20 bp, Artificial Sequence
  chemically synthesized
atggctacagccttttgaga

SEQ ID NO: 28782 - DNA, 20 bp, Artificial Sequence
  chemically synthesized
ctgcctgaaactttctcaaa

SEQ ID NO: 28783 - DNA, 20 bp, Artificial Sequence
  chemically synthesized
actgcctgaaactttctcaa

SEQ ID NO: 28784 - DNA, 20 bp, Artificial Sequence
  chemically synthesized
acagccttttgagaaagttt

SEQ ID NO: 28785 - DNA, 20 bp, Artificial Sequence
  chemically synthesized
cagccttttgagaaagtttc

SEQ ID NO: 28786 - DNA, 20 bp, Artificial Sequence
  chemically synthesized
ccttttgagaaagtttcagg

SEQ ID NO: 28787 - DNA, 20 bp, Artificial Sequence
  chemically synthesized
agtttcaggcagtgcattcc

SEQ ID NO: 28788 - DNA, 20 bp, Artificial Sequence
  chemically synthesized
ttcaggcagtgcattccaag

SEQ ID NO: 28789 - DNA, 20 bp, Artificial Sequence
  chemically synthesized
gcagtgcattccaagaagct

SEQ ID NO: 28790 - DNA, 20 bp, Artificial Sequence
  chemically synthesized
gttaatgtttctaagcttct

SEQ ID NO: 28791 - DNA, 20 bp, Artificial Sequence
  chemically synthesized
caaatggtgttaatgtttct

SEQ ID NO: 28792 - DNA, 20 bp, Artificial Sequence
  chemically synthesized
aacattaacaccatttgact

SEQ ID NO: 28793 - DNA, 20 bp, Artificial Sequence
  chemically synthesized
agtggaatcactgagtcaaa

SEQ ID NO: 28794 - DNA, 20 bp, Artificial Sequence
  chemically synthesized
ttcatgtaagtggaatcact

SEQ ID NO: 28795 - DNA, 20 bp, Artificial Sequence
  chemically synthesized
ctacatttgattcatgtaag

SEQ ID NO: 28796 - DNA, 20 bp, Artificial Sequence
  chemically synthesized
tttctacatttgattcatgt

SEQ ID NO: 28797 - DNA, 20 bp, Artificial Sequence
  chemically synthesized
ccacttacatgaatcaaatg

SEQ ID NO: 28798 - DNA, 20 bp, Artificial Sequence
  chemically synthesized
ttacatgaatcaaatgtaga

SEQ ID NO: 28799 - DNA, 20 bp, Artificial Sequence
  chemically synthesized
tacatgaatcaaatgtagaa

SEQ ID NO: 28800 - DNA, 20 bp, Artificial Sequence
  chemically synthesized
gtagaaaggtgttatgcata

SEQ ID NO: 28801 - DNA, 20 bp, Artificial Sequence
  chemically synthesized
tagaaaggtgttatgcataa

SEQ ID NO: 28802 - DNA, 20 bp, Artificial Sequence
  chemically synthesized
atgcataaaggtgttcctca

SEQ ID NO: 28803 - DNA, 20 bp, Artificial Sequence
  chemically synthesized
ctgttccacgtaagactttg

SEQ ID NO: 28804 - DNA, 20 bp, Artificial Sequence
  chemically synthesized
actgttccacgtaagacttt

SEQ ID NO: 28805 - DNA, 20 bp, Artificial Sequence
  chemically synthesized
gtgttcctcaaagtcttacg

SEQ ID NO: 28806 - DNA, 20 bp, Artificial Sequence
  chemically synthesized
atttttctactgttccacgt

SEQ ID NO: 28807 - DNA, 20 bp, Artificial Sequence
  chemically synthesized
cctcaaagtcttacgtggaa

SEQ ID NO: 28808 - DNA, 20 bp, Artificial Sequence
  chemically synthesized
caaagtcttacgtggaacag

SEQ ID NO: 28809 - DNA, 20 bp, Artificial Sequence
  chemically synthesized
acgtggaacagtagaaaaat

SEQ ID NO: 28810 - DNA, 20 bp, Artificial Sequence
  chemically synthesized
agaaaaattggaaacgacta

SEQ ID NO: 28811 - DNA, 20 bp, Artificial Sequence
  chemically synthesized
agagctgataattatttcca

SEQ ID NO: 28812 - DNA, 20 bp, Artificial Sequence
  chemically synthesized
acgactatggaaataattat

SEQ ID NO: 28813 - DNA, 20 bp, Artificial Sequence
  chemically synthesized
agacgcaattaaagaatata

SEQ ID NO: 28814 - DNA, 20 bp, Artificial Sequence
  chemically synthesized
caagacgcaattaaagaata

SEQ ID NO: 28815 - DNA, 20 bp, Artificial Sequence
  chemically synthesized
ttctggccaagacgcaatta

SEQ ID NO: 28816 - DNA, 20 bp, Artificial Sequence
  chemically synthesized
tatattctttaattgcgtct

SEQ ID NO: 28817 - DNA, 20 bp, Artificial Sequence
  chemically synthesized
ttctttaattgcgtcttggc

SEQ ID NO: 28818 - DNA, 20 bp, Artificial Sequence
  chemically synthesized
ttcagttacattttctggcc

SEQ ID NO: 28819 - DNA, 20 bp, Artificial Sequence
  chemically synthesized
cttacttcagttacattttc

SEQ ID NO: 28820 - DNA, 20 bp, Artificial Sequence
  chemically synthesized
ttggccagaaaatgtaactg

SEQ ID NO: 28821 - DNA, 20 bp, Artificial Sequence
  chemically synthesized
ccagaaaatgtaactgaagt

SEQ ID NO: 28822 - DNA, 20 bp, Artificial Sequence
  chemically synthesized
agaaaatgtaactgaagtaa

SEQ ID NO: 28823 - DNA, 20 bp, Artificial Sequence
  chemically synthesized
gaaaatgtaactgaagtaag

SEQ ID NO: 28824 - DNA, 20 bp, Artificial Sequence
  chemically synthesized
gcttttgtagcctcttactt

SEQ ID NO: 28825 - DNA, 20 bp, Artificial Sequence
  chemically synthesized
actgaagtaagaggctacaa

SEQ ID NO: 28826 - DNA, 20 bp, Artificial Sequence
  chemically synthesized
actgtcagttaaggcttttg

SEQ ID NO: 28827 - DNA, 20 bp, Artificial Sequence
  chemically synthesized
gctacaaaagccttaactga

SEQ ID NO: 28828 - DNA, 20 bp, Artificial Sequence
  chemically synthesized
ttgcttctaactgtcagtta

SEQ ID NO: 28829 - DNA, 20 bp, Artificial Sequence
  chemically synthesized
cttgcttctaactgtcagtt

SEQ ID NO: 28830 - DNA, 20 bp, Artificial Sequence
  chemically synthesized
caaaagccttaactgacagt

SEQ ID NO: 28831 - DNA, 20 bp, Artificial Sequence
  chemically synthesized
aggttcttgcttctaactgt

SEQ ID NO: 28832 - DNA, 20 bp, Artificial Sequence
  chemically synthesized
aagccttaactgacagttag

SEQ ID NO: 28833 - DNA, 20 bp, Artificial Sequence
  chemically synthesized
cttaactgacagttagaagc

SEQ ID NO: 28834 - DNA, 20 bp, Artificial Sequence
  chemically synthesized
ttagaagcaagaaccttgaa

SEQ ID NO: 28835 - DNA, 20 bp, Artificial Sequence
  chemically synthesized
cagttcccatgttcttttca

SEQ ID NO: 28836 - DNA, 20 bp, Artificial Sequence
  chemically synthesized
acagttcccatgttcttttc

SEQ ID NO: 28837 - DNA, 20 bp, Artificial Sequence
  chemically synthesized
caagaaccttgaaaagaaca

SEQ ID NO: 28838 - DNA, 20 bp, Artificial Sequence
  chemically synthesized
aagaaccttgaaaagaacat

SEQ ID NO: 28839 - DNA, 20 bp, Artificial Sequence
  chemically synthesized
tctcaaaacatttgtgtgta

SEQ ID NO: 28840 - DNA, 20 bp, Artificial Sequence
  chemically synthesized
actgtacacacaaatgtttt

SEQ ID NO: 28841 - DNA, 20 bp, Artificial Sequence
  chemically synthesized
gtacacacaaatgttttgag

SEQ ID NO: 28842 - DNA, 20 bp, Artificial Sequence
  chemically synthesized
aatgttttgagaagataaaa

SEQ ID NO: 28843 - DNA, 20 bp, Artificial Sequence
  chemically synthesized
gagaagataaaacagtctgc

SEQ ID NO: 28844 - DNA, 20 bp, Artificial Sequence
  chemically synthesized
tctccaggtagaatggctag

SEQ ID NO: 28845 - DNA, 20 bp, Artificial Sequence
  chemically synthesized
atctctccaggtagaatggc

SEQ ID NO: 28846 - DNA, 20 bp, Artificial Sequence
  chemically synthesized
agtctgctagccattctacc

SEQ ID NO: 28847 - DNA, 20 bp, Artificial Sequence
  chemically synthesized
acttatctctccaggtagaa

SEQ ID NO: 28848 - DNA, 20 bp, Artificial Sequence
  chemically synthesized
tctgctagccattctacctg

SEQ ID NO: 28849 - DNA, 20 bp, Artificial Sequence
  chemically synthesized
tgctagccattctacctgga

SEQ ID NO: 28850 - DNA, 20 bp, Artificial Sequence
  chemically synthesized
ctttaacttatctctccagg

SEQ ID NO: 28851 - DNA, 20 bp, Artificial Sequence
  chemically synthesized
tacctttaacttatctctcc

SEQ ID NO: 28852 - DNA, 20 bp, Artificial Sequence
  chemically synthesized
gccattctacctggagagat

SEQ ID NO: 28853 - DNA, 20 bp, Artificial Sequence
  chemically synthesized
ttacctttaacttatctctc

SEQ ID NO: 28854 - DNA, 20 bp, Artificial Sequence
  chemically synthesized
ctacctggagagataagtta

SEQ ID NO: 28855 - DNA, 20 bp, Artificial Sequence
  chemically synthesized
tacctggagagataagttaa

SEQ ID NO: 28856 - DNA, 20 bp, Artificial Sequence
  chemically synthesized
ataactgatatgtaaatatt

SEQ ID NO: 28857 - DNA, 20 bp, Artificial Sequence
  chemically synthesized
gtaactaaatatttacatat

SEQ ID NO: 28858 - DNA, 20 bp, Artificial Sequence
  chemically synthesized
attataaaaattaaaactta

SEQ ID NO: 28859 - DNA, 20 bp, Artificial Sequence
  chemically synthesized
actttatgatgggtttctgt

SEQ ID NO: 28860 - DNA, 20 bp, Artificial Sequence
  chemically synthesized
acttacagaaacccatcata

SEQ ID NO: 28861 - DNA, 20 bp, Artificial Sequence
  chemically synthesized
cagaaactcaactttatgat

SEQ ID NO: 28862 - DNA, 20 bp, Artificial Sequence
  chemically synthesized
acagaaactcaactttatga

SEQ ID NO: 28863 - DNA, 20 bp, Artificial Sequence
  chemically synthesized
cagaaacccatcataaagtt

SEQ ID NO: 28864 - DNA, 20 bp, Artificial Sequence
  chemically synthesized
tcttagcaagcaattttata

SEQ ID NO: 28865 - DNA, 20 bp, Artificial Sequence
  chemically synthesized
tctgtataaaattgcttgct

SEQ ID NO: 28866 - DNA, 20 bp, Artificial Sequence
  chemically synthesized
gtataaaattgcttgctaag

SEQ ID NO: 28867 - DNA, 20 bp, Artificial Sequence
  chemically synthesized
tataaaattgcttgctaaga

SEQ ID NO: 28868 - DNA, 20 bp, Artificial Sequence
  chemically synthesized
acaactttgcccttcttagc

SEQ ID NO: 28869 - DNA, 20 bp, Artificial Sequence
  chemically synthesized
ataaaattgcttgctaagaa

SEQ ID NO: 28870 - DNA, 20 bp, Artificial Sequence
  chemically synthesized
aggaacaactttgcccttct

SEQ ID NO: 28871 - DNA, 20 bp, Artificial Sequence
  chemically synthesized
attgcttgctaagaagggca

SEQ ID NO: 28872 - DNA, 20 bp, Artificial Sequence
  chemically synthesized
gcaaagttgttcctgtaatt

SEQ ID NO: 28873 - DNA, 20 bp, Artificial Sequence
  chemically synthesized
ttgtaaactttccgaattac

SEQ ID NO: 28874 - DNA, 20 bp, Artificial Sequence
  chemically synthesized
cttgtaaactttccgaatta

SEQ ID NO: 28875 - DNA, 20 bp, Artificial Sequence
  chemically synthesized
agttgttcctgtaattcgga

SEQ ID NO: 28876 - DNA, 20 bp, Artificial Sequence
  chemically synthesized
ctgtaattcggaaagtttac

SEQ ID NO: 28877 - DNA, 20 bp, Artificial Sequence
  chemically synthesized
tgtaattcggaaagtttaca

SEQ ID NO: 28878 - DNA, 20 bp, Artificial Sequence
  chemically synthesized
tggtgtcaaggtgacaaggc

SEQ ID NO: 28879 - DNA, 20 bp, Artificial Sequence
  chemically synthesized
tgtatggtgtcaaggtgaca

SEQ ID NO: 28880 - DNA, 20 bp, Artificial Sequence
  chemically synthesized
atgtatggtgtcaaggtgac

SEQ ID NO: 28881 - DNA, 20 bp, Artificial Sequence
  chemically synthesized
accaaatatgtatggtgtca

SEQ ID NO: 28882 - DNA, 20 bp, Artificial Sequence
  chemically synthesized
taccaaatatgtatggtgtc

SEQ ID NO: 28883 - DNA, 20 bp, Artificial Sequence
  chemically synthesized
ttttctttaccaaatatgta

SEQ ID NO: 28884 - DNA, 20 bp, Artificial Sequence
  chemically synthesized
accttgacaccatacatatt

SEQ ID NO: 28885 - DNA, 20 bp, Artificial Sequence
  chemically synthesized
gacaccatacatatttggta

SEQ ID NO: 28886 - DNA, 20 bp, Artificial Sequence
  chemically synthesized
taaagaaaattttatccatt

SEQ ID NO: 28887 - DNA, 20 bp, Artificial Sequence
  chemically synthesized
ttctaccacaaatatcttaa

SEQ ID NO: 28888 - DNA, 20 bp, Artificial Sequence
  chemically synthesized
tttatccattaagatatttg

SEQ ID NO: 28889 - DNA, 20 bp, Artificial Sequence
  chemically synthesized
atccattaagatatttgtgg

SEQ ID NO: 28890 - DNA, 20 bp, Artificial Sequence
  chemically synthesized
tagctatgaatttaaatcaa

SEQ ID NO: 28891 - DNA, 20 bp, Artificial Sequence
  chemically synthesized
aaactattgatttaaattca

SEQ ID NO: 28892 - DNA, 20 bp, Artificial Sequence
  chemically synthesized
catttatcctatgaaaaata

SEQ ID NO: 28893 - DNA, 20 bp, Artificial Sequence
  chemically synthesized
attcatagctatatttttca

SEQ ID NO: 28894 - DNA, 20 bp, Artificial Sequence
  chemically synthesized
ttcatagctatatttttcat

SEQ ID NO: 28895 - DNA, 20 bp, Artificial Sequence
  chemically synthesized
tcagttatcagaaagttgat

SEQ ID NO: 28896 - DNA, 20 bp, Artificial Sequence
  chemically synthesized
acagacagtcagttatcaga

SEQ ID NO: 28897 - DNA, 20 bp, Artificial Sequence
  chemically synthesized
aaaaacagacagtcagttat

SEQ ID NO: 28898 - DNA, 20 bp, Artificial Sequence
  chemically synthesized
tgtggtcaaaaacagacagt

SEQ ID NO: 28899 - DNA, 20 bp, Artificial Sequence
  chemically synthesized
tcagtgtggtcaaaaacaga

SEQ ID NO: 28900 - DNA, 20 bp, Artificial Sequence
  chemically synthesized
aaagtcagtgtggtcaaaaa

SEQ ID NO: 28901 - DNA, 20 bp, Artificial Sequence
  chemically synthesized
gttacagaataaagtcagtg

SEQ ID NO: 28902 - DNA, 20 bp, Artificial Sequence
  chemically synthesized
gtgatgttacagaataaagt

SEQ ID NO: 28903 - DNA, 20 bp, Artificial Sequence
  chemically synthesized
ataagtgatgttacagaata

SEQ ID NO: 28904 - DNA, 20 bp, Artificial Sequence
  chemically synthesized
cttatgtataagtgatgtta

SEQ ID NO: 28905 - DNA, 20 bp, Artificial Sequence
  chemically synthesized
ctgtaacatcacttatacat

SEQ ID NO: 28906 - DNA, 20 bp, Artificial Sequence
  chemically synthesized
ccaacaagctacttatgtat

SEQ ID NO: 28907 - DNA, 20 bp, Artificial Sequence
  chemically synthesized
taacatcacttatacataag

SEQ ID NO: 28908 - DNA, 20 bp, Artificial Sequence
  chemically synthesized
cttatacataagtagcttgt

SEQ ID NO: 28909 - DNA, 20 bp, Artificial Sequence
  chemically synthesized
tacataagtagcttgttgga

SEQ ID NO: 28910 - DNA, 20 bp, Artificial Sequence
  chemically synthesized
tataataccttctgtccaac

SEQ ID NO: 28911 - DNA, 20 bp, Artificial Sequence
  chemically synthesized
ataagtagcttgttggacag

SEQ ID NO: 28912 - DNA, 20 bp, Artificial Sequence
  chemically synthesized
taagtagcttgttggacaga

SEQ ID NO: 28913 - DNA, 20 bp, Artificial Sequence
  chemically synthesized
aggtattataacactttact

SEQ ID NO: 28914 - DNA, 20 bp, Artificial Sequence
  chemically synthesized
tctgagaagaaagccaagta

SEQ ID NO: 28915 - DNA, 20 bp, Artificial Sequence
  chemically synthesized
aagcttctgagaagaaagcc

SEQ ID NO: 28916 - DNA, 20 bp, Artificial Sequence
  chemically synthesized
actttacttggctttcttct

SEQ ID NO: 28917 - DNA, 20 bp, Artificial Sequence
  chemically synthesized
ctaacaagcttctgagaaga

SEQ ID NO: 28918 - DNA, 20 bp, Artificial Sequence
  chemically synthesized
ttacttggctttcttctcag

SEQ ID NO: 28919 - DNA, 20 bp, Artificial Sequence
  chemically synthesized
attactaacaagcttctgag

SEQ ID NO: 28920 - DNA, 20 bp, Artificial Sequence
  chemically synthesized
cttattactaacaagcttct

SEQ ID NO: 28921 - DNA, 20 bp, Artificial Sequence
  chemically synthesized
ctttcttctcagaagcttgt

SEQ ID NO: 28922 - DNA, 20 bp, Artificial Sequence
  chemically synthesized
tctggaggcttattactaac

SEQ ID NO: 28923 - DNA, 20 bp, Artificial Sequence
  chemically synthesized
ctcagaagcttgttagtaat

SEQ ID NO: 28924 - DNA, 20 bp, Artificial Sequence
  chemically synthesized
gcttgttagtaataagcctc

SEQ ID NO: 28925 - DNA, 20 bp, Artificial Sequence
  chemically synthesized
ggaaatctttaagaatctgg

SEQ ID NO: 28926 - DNA, 20 bp, Artificial Sequence
  chemically synthesized
aggaaatctttaagaatctg

SEQ ID NO: 28927 - DNA, 20 bp, Artificial Sequence
  chemically synthesized
gaaggaaatctttaagaatc

SEQ ID NO: 28928 - DNA, 20 bp, Artificial Sequence
  chemically synthesized
aataagcctccagattctta

SEQ ID NO: 28929 - DNA, 20 bp, Artificial Sequence
  chemically synthesized
atttatggaaggaaatcttt

SEQ ID NO: 28930 - DNA, 20 bp, Artificial Sequence
  chemically synthesized
attcgtgttgaatttatgga

SEQ ID NO: 28931 - DNA, 20 bp, Artificial Sequence
  chemically synthesized
aattcgtgttgaatttatgg

SEQ ID NO: 28932 - DNA, 20 bp, Artificial Sequence
  chemically synthesized
tcaaattcgtgttgaattta

SEQ ID NO: 28933 - DNA, 20 bp, Artificial Sequence
  chemically synthesized
ttgaaaattgtgacaaagaa

SEQ ID NO: 28934 - DNA, 20 bp, Artificial Sequence
  chemically synthesized
aatttttgaaaattgtgaca

SEQ ID NO: 28935 - DNA, 20 bp, Artificial Sequence
  chemically synthesized
ttgtcacaattttcaaaaat

SEQ ID NO: 28936 - DNA, 20 bp, Artificial Sequence
  chemically synthesized
tgtcacaattttcaaaaatt

SEQ ID NO: 28937 - DNA, 20 bp, Artificial Sequence
  chemically synthesized
tgggaaatatttttttacaa

SEQ ID NO: 28938 - DNA, 20 bp, Artificial Sequence
  chemically synthesized
gaaatatttttttacaaaag

SEQ ID NO: 28939 - DNA, 20 bp, Artificial Sequence
  chemically synthesized
tcgctagttgcagtttattg

SEQ ID NO: 28940 - DNA, 20 bp, Artificial Sequence
  chemically synthesized
ttcgctagttgcagtttatt

SEQ ID NO: 28941 - DNA, 20 bp, Artificial Sequence
  chemically synthesized
tttcgctagttgcagtttat

SEQ ID NO: 28942 - DNA, 20 bp, Artificial Sequence
  chemically synthesized
gtaccccaataaactgcaac

SEQ ID NO: 28943 - DNA, 20 bp, Artificial Sequence
  chemically synthesized
atgttatttttcgctagttg

SEQ ID NO: 28944 - DNA, 20 bp, Artificial Sequence
  chemically synthesized
tcagagatgttatttttcgc

SEQ ID NO: 28945 - DNA, 20 bp, Artificial Sequence
  chemically synthesized
tagcgaaaaataacatctct

SEQ ID NO: 28946 - DNA, 20 bp, Artificial Sequence
  chemically synthesized
agcgaaaaataacatctctg

SEQ ID NO: 28947 - DNA, 20 bp, Artificial Sequence
  chemically synthesized
ctcttattcttagttcctca

SEQ ID NO: 28948 - DNA, 20 bp, Artificial Sequence
  chemically synthesized
aataacatctctgaggaact

SEQ ID NO: 28949 - DNA, 20 bp, Artificial Sequence
  chemically synthesized
ttctcttattcttagttcct

SEQ ID NO: 28950 - DNA, 20 bp, Artificial Sequence
  chemically synthesized
atctctgaggaactaagaat

SEQ ID NO: 28951 - DNA, 20 bp, Artificial Sequence
  chemically synthesized
ctctgaggaactaagaataa

SEQ ID NO: 28952 - DNA, 20 bp, Artificial Sequence
  chemically synthesized
cataagtcttctcttattct

SEQ ID NO: 28953 - DNA, 20 bp, Artificial Sequence
  chemically synthesized
tgaggaactaagaataagag

SEQ ID NO: 28954 - DNA, 20 bp, Artificial Sequence
  chemically synthesized
taagagaagacttatgatta

SEQ ID NO: 28955 - DNA, 20 bp, Artificial Sequence
  chemically synthesized
ttgtatcctactgtaatcat

SEQ ID NO: 28956 - DNA, 20 bp, Artificial Sequence
  chemically synthesized
gagaagacttatgattacag

SEQ ID NO: 28957 - DNA, 20 bp, Artificial Sequence
  chemically synthesized
agaagacttatgattacagt

SEQ ID NO: 28958 - DNA, 20 bp, Artificial Sequence
  chemically synthesized
ttgagataatagaatgttta

SEQ ID NO: 28959 - DNA, 20 bp, Artificial Sequence
  chemically synthesized
tatatagttgtttgagataa

SEQ ID NO: 28960 - DNA, 20 bp, Artificial Sequence
  chemically synthesized
gcatttttatatagttgttt

SEQ ID NO: 28961 - DNA, 20 bp, Artificial Sequence
  chemically synthesized
ctttcctatgcatttttata

SEQ ID NO: 28962 - DNA, 20 bp, Artificial Sequence
  chemically synthesized
aacaactatataaaaatgca

SEQ ID NO: 28963 - DNA, 20 bp, Artificial Sequence
  chemically synthesized
acaactatataaaaatgcat

SEQ ID NO: 28964 - DNA, 20 bp, Artificial Sequence
  chemically synthesized
ctatataaaaatgcatagga

SEQ ID NO: 28965 - DNA, 20 bp, Artificial Sequence
  chemically synthesized
tataaaaatgcataggaaag

SEQ ID NO: 28966 - DNA, 20 bp, Artificial Sequence
  chemically synthesized
aaatgcataggaaagaagac

SEQ ID NO: 28967 - DNA, 20 bp, Artificial Sequence
  chemically synthesized
tgcataggaaagaagaccgg

SEQ ID NO: 28968 - DNA, 20 bp, Artificial Sequence
  chemically synthesized
acattttaaaagattgcttc

SEQ ID NO: 28969 - DNA, 20 bp, Artificial Sequence
  chemically synthesized
agccactatttacattttaa

SEQ ID NO: 28970 - DNA, 20 bp, Artificial Sequence
  chemically synthesized
gcaatcttttaaaatgtaaa

SEQ ID NO: 28971 - DNA, 20 bp, Artificial Sequence
  chemically synthesized
atcttttaaaatgtaaatag

SEQ ID NO: 28972 - DNA, 20 bp, Artificial Sequence
  chemically synthesized
atgtaaatagtggctatttc

SEQ ID NO: 28973 - DNA, 20 bp, Artificial Sequence
  chemically synthesized
tgtaaatagtggctatttct

SEQ ID NO: 28974 - DNA, 20 bp, Artificial Sequence
  chemically synthesized
cacatctcagtacccagaaa

SEQ ID NO: 28975 - DNA, 20 bp, Artificial Sequence
  chemically synthesized
agtggctatttctgggtact

SEQ ID NO: 28976 - DNA, 20 bp, Artificial Sequence
  chemically synthesized
tcacctcacatctcagtacc

SEQ ID NO: 28977 - DNA, 20 bp, Artificial Sequence
  chemically synthesized
atttctgggtactgagatgt

SEQ ID NO: 28978 - DNA, 20 bp, Artificial Sequence
  chemically synthesized
tttctgggtactgagatgtg

SEQ ID NO: 28979 - DNA, 20 bp, Artificial Sequence
  chemically synthesized
atgaaaatcacctcacatct

SEQ ID NO: 28980 - DNA, 20 bp, Artificial Sequence
  chemically synthesized
tctagaaattttagaaggtg

SEQ ID NO: 28981 - DNA, 20 bp, Artificial Sequence
  chemically synthesized
ttcattctagaaattttaga

SEQ ID NO: 28982 - DNA, 20 bp, Artificial Sequence
  chemically synthesized
gttcattctagaaattttag

SEQ ID NO: 28983 - DNA, 20 bp, Artificial Sequence
  chemically synthesized
acttcaccttctaaaatttc

SEQ ID NO: 28984 - DNA, 20 bp, Artificial Sequence
  chemically synthesized
gatgttcattctagaaattt

SEQ ID NO: 28985 - DNA, 20 bp, Artificial Sequence
  chemically synthesized
taaaacatggatgttcattc

SEQ ID NO: 28986 - DNA, 20 bp, Artificial Sequence
  chemically synthesized
ttttattgaacattaaaaca

SEQ ID NO: 28987 - DNA, 20 bp, Artificial Sequence
  chemically synthesized
catgttttaatgttcaataa

SEQ ID NO: 28988 - DNA, 20 bp, Artificial Sequence
  chemically synthesized
ttttaatgttcaataaaagt

SEQ ID NO: 28989 - DNA, 20 bp, Artificial Sequence
  chemically synthesized
aacgtttactgagggtatag

SEQ ID NO: 28990 - DNA, 20 bp, Artificial Sequence
  chemically synthesized
cataaaaacttctataccct

SEQ ID NO: 28991 - DNA, 20 bp, Artificial Sequence
  chemically synthesized
aaaaacgtttactgagggta

SEQ ID NO: 28992 - DNA, 20 bp, Artificial Sequence
  chemically synthesized
aggagaaaaacgtttactga

SEQ ID NO: 28993 - DNA, 20 bp, Artificial Sequence
  chemically synthesized
aaggagaaaaacgtttactg

SEQ ID NO: 28994 - DNA, 20 bp, Artificial Sequence
  chemically synthesized
caaggagaaaaacgtttact

SEQ ID NO: 28995 - DNA, 20 bp, Artificial Sequence
  chemically synthesized
aacaggctaaaaatatcaag

SEQ ID NO: 28996 - DNA, 20 bp, Artificial Sequence
  chemically synthesized
gcaacaggctaaaaatatca

SEQ ID NO: 28997 - DNA, 20 bp, Artificial Sequence
  chemically synthesized
ggcaacaggctaaaaatatc

SEQ ID NO: 28998 - DNA, 20 bp, Artificial Sequence
  chemically synthesized
gtttttctccttgatatttt

SEQ ID NO: 28999 - DNA, 20 bp, Artificial Sequence
  chemically synthesized
ttttcaaactttagggcaac

SEQ ID NO: 29000 - DNA, 20 bp, Artificial Sequence
  chemically synthesized
attttcaaactttagggcaa

SEQ ID NO: 29001 - DNA, 20 bp, Artificial Sequence
  chemically synthesized
atttttagcctgttgcccta

SEQ ID NO: 29002 - DNA, 20 bp, Artificial Sequence
  chemically synthesized
ccatgtattttcaaacttta

SEQ ID NO: 29003 - DNA, 20 bp, Artificial Sequence
  chemically synthesized
gccatgtattttcaaacttt

SEQ ID NO: 29004 - DNA, 20 bp, Artificial Sequence
  chemically synthesized
tgccatgtattttcaaactt

SEQ ID NO: 29005 - DNA, 20 bp, Artificial Sequence
  chemically synthesized
ccctaaagtttgaaaataca

SEQ ID NO: 29006 - DNA, 20 bp, Artificial Sequence
  chemically synthesized
ctgcttcagtaaacatttaa

SEQ ID NO: 29007 - DNA, 20 bp, Artificial Sequence
  chemically synthesized
tcctgcttcagtaaacattt

SEQ ID NO: 29008 - DNA, 20 bp, Artificial Sequence
  chemically synthesized
acgctcttaaatgtttactg

SEQ ID NO: 29009 - DNA, 20 bp, Artificial Sequence
  chemically synthesized
ctcttaaatgtttactgaag

SEQ ID NO: 29010 - DNA, 20 bp, Artificial Sequence
  chemically synthesized
tcttaaatgtttactgaagc

SEQ ID NO: 29011 - DNA, 20 bp, Artificial Sequence
  chemically synthesized
cgttcattggtttcctgctt

SEQ ID NO: 29012 - DNA, 20 bp, Artificial Sequence
  chemically synthesized
tgatggcctcgttcgttcat

SEQ ID NO: 29013 - DNA, 20 bp, Artificial Sequence
  chemically synthesized
caggaaaccaatgaacgaac

SEQ ID NO: 29014 - DNA, 20 bp, Artificial Sequence
  chemically synthesized
aggaaaccaatgaacgaacg

SEQ ID NO: 29015 - DNA, 20 bp, Artificial Sequence
  chemically synthesized
caatgaacgaacgaggccat

SEQ ID NO: 29016 - DNA, 20 bp, Artificial Sequence
  chemically synthesized
aacacaatttgatgtgctga

SEQ ID NO: 29017 - DNA, 20 bp, Artificial Sequence
  chemically synthesized
tcagcacatcaaattgtgtt

SEQ ID NO: 29018 - DNA, 20 bp, Artificial Sequence
  chemically synthesized
agaatttatatgacaaagaa

SEQ ID NO: 29019 - DNA, 20 bp, Artificial Sequence
  chemically synthesized
cagaatttatatgacaaaga

SEQ ID NO: 29020 - DNA, 20 bp, Artificial Sequence
  chemically synthesized
gattcagaatttatatgaca

SEQ ID NO: 29021 - DNA, 20 bp, Artificial Sequence
  chemically synthesized
tcatataaattctgaatcca

SEQ ID NO: 29022 - DNA, 20 bp, Artificial Sequence
  chemically synthesized
aaaaagtgtcactatggatt

SEQ ID NO: 29023 - DNA, 20 bp, Artificial Sequence
  chemically synthesized
acccgtaaaaagtgtcacta

SEQ ID NO: 29024 - DNA, 20 bp, Artificial Sequence
  chemically synthesized
atccatagtgacacttttta

SEQ ID NO: 29025 - DNA, 20 bp, Artificial Sequence
  chemically synthesized
tccatagtgacactttttac

SEQ ID NO: 29026 - DNA, 20 bp, Artificial Sequence
  chemically synthesized
ggagaaataagacccgtaaa

SEQ ID NO: 29027 - DNA, 20 bp, Artificial Sequence
  chemically synthesized
attaattgataaggagaaat

SEQ ID NO: 29028 - DNA, 20 bp, Artificial Sequence
  chemically synthesized
aggaataattaattgataag

SEQ ID NO: 29029 - DNA, 20 bp, Artificial Sequence
  chemically synthesized
aaaggaataattaattgata

SEQ ID NO: 29030 - DNA, 20 bp, Artificial Sequence
  chemically synthesized
aaaaggaataattaattgat

SEQ ID NO: 29031 - DNA, 20 bp, Artificial Sequence
  chemically synthesized
tatcaattaattattccttt

SEQ ID NO: 29032 - DNA, 20 bp, Artificial Sequence
  chemically synthesized
atcaattaattattcctttt

SEQ ID NO: 29033 - DNA, 20 bp, Artificial Sequence
  chemically synthesized
tcaattaattattcctttta

SEQ ID NO: 29034 - DNA, 20 bp, Artificial Sequence
  chemically synthesized
ggaattaattttgccctaaa

SEQ ID NO: 29035 - DNA, 20 bp, Artificial Sequence
  chemically synthesized
tggaattaattttgccctaa

SEQ ID NO: 29036 - DNA, 20 bp, Artificial Sequence
  chemically synthesized
ttttagggcaaaattaattc

SEQ ID NO: 29037 - DNA, 20 bp, Artificial Sequence
  chemically synthesized
gggcaaaattaattccagaa

SEQ ID NO: 29038 - DNA, 20 bp, Artificial Sequence
  chemically synthesized
caaaattaattccagaatag

SEQ ID NO: 29039 - DNA, 20 bp, Artificial Sequence
  chemically synthesized
aaccaagtgaactgctattc

SEQ ID NO: 29040 - DNA, 20 bp, Artificial Sequence
  chemically synthesized
ttccagaatagcagttcact

SEQ ID NO: 29041 - DNA, 20 bp, Artificial Sequence
  chemically synthesized
tttgttatcttagcaaaacc

SEQ ID NO: 29042 - DNA, 20 bp, Artificial Sequence
  chemically synthesized
gcagttcacttggttttgct

SEQ ID NO: 29043 - DNA, 20 bp, Artificial Sequence
  chemically synthesized
ttattggcaatttgttatct

SEQ ID NO: 29044 - DNA, 20 bp, Artificial Sequence
  chemically synthesized
agttaagttgtagattttat

SEQ ID NO: 29045 - DNA, 20 bp, Artificial Sequence
  chemically synthesized
agggaatatcagttaagttg

SEQ ID NO: 29046 - DNA, 20 bp, Artificial Sequence
  chemically synthesized
taaaatagggaatatcagtt

SEQ ID NO: 29047 - DNA, 20 bp, Artificial Sequence
  chemically synthesized
gtaattaaaatagggaatat

SEQ ID NO: 29048 - DNA, 20 bp, Artificial Sequence
  chemically synthesized
gcctcaaagtaattaaaata

SEQ ID NO: 29049 - DNA, 20 bp, Artificial Sequence
  chemically synthesized
agcctcaaagtaattaaaat

SEQ ID NO: 29050 - DNA, 20 bp, Artificial Sequence
  chemically synthesized
aagcctcaaagtaattaaaa

SEQ ID NO: 29051 - DNA, 20 bp, Artificial Sequence
  chemically synthesized
ttccctattttaattacttt

SEQ ID NO: 29052 - DNA, 20 bp, Artificial Sequence
  chemically synthesized
tccctattttaattactttg

SEQ ID NO: 29053 - DNA, 20 bp, Artificial Sequence
  chemically synthesized
aagtagaagataaagcctca

SEQ ID NO: 29054 - DNA, 20 bp, Artificial Sequence
  chemically synthesized
tttccagaaagtagaagata

SEQ ID NO: 29055 - DNA, 20 bp, Artificial Sequence
  chemically synthesized
gagttctttccagaaagtag

SEQ ID NO: 29056 - DNA, 20 bp, Artificial Sequence
  chemically synthesized
aggctttatcttctactttc

SEQ ID NO: 29057 - DNA, 20 bp, Artificial Sequence
  chemically synthesized
atggagttctttccagaaag

SEQ ID NO: 29058 - DNA, 20 bp, Artificial Sequence
  chemically synthesized
tttatcttctactttctgga

SEQ ID NO: 29059 - DNA, 20 bp, Artificial Sequence
  chemically synthesized
gagatggagttctttccaga

SEQ ID NO: 29060 - DNA, 20 bp, Artificial Sequence
  chemically synthesized
tggagagatggagttctttc

SEQ ID NO: 29061 - DNA, 20 bp, Artificial Sequence
  chemically synthesized
gatggaactctggagagatg

SEQ ID NO: 29062 - DNA, 20 bp, Artificial Sequence
  chemically synthesized
tggaaagaactccatctctc

SEQ ID NO: 29063 - DNA, 20 bp, Artificial Sequence
  chemically synthesized
aagatggaactctggagaga

SEQ ID NO: 29064 - DNA, 20 bp, Artificial Sequence
  chemically synthesized
gaaagaactccatctctcca

SEQ ID NO: 29065 - DNA, 20 bp, Artificial Sequence
  chemically synthesized
tggcaagatggaactctgga

SEQ ID NO: 29066 - DNA, 20 bp, Artificial Sequence
  chemically synthesized
actggcaagatggaactctg

SEQ ID NO: 29067 - DNA, 20 bp, Artificial Sequence
  chemically synthesized
aaactggcaagatggaactc

SEQ ID NO: 29068 - DNA, 20 bp, Artificial Sequence
  chemically synthesized
tctccagagttccatcttgc

SEQ ID NO: 29069 - DNA, 20 bp, Artificial Sequence
  chemically synthesized
ggattattaaactggcaaga

SEQ ID NO: 29070 - DNA, 20 bp, Artificial Sequence
  chemically synthesized
aggcggattattaaactggc

SEQ ID NO: 29071 - DNA, 20 bp, Artificial Sequence
  chemically synthesized
tctaaggcggattattaaac

SEQ ID NO: 29072 - DNA, 20 bp, Artificial Sequence
  chemically synthesized
gccagtttaataatccgcct

SEQ ID NO: 29073 - DNA, 20 bp, Artificial Sequence
  chemically synthesized
cagatgagggttttctaagg

SEQ ID NO: 29074 - DNA, 20 bp, Artificial Sequence
  chemically synthesized
atacagatgagggttttcta

SEQ ID NO: 29075 - DNA, 20 bp, Artificial Sequence
  chemically synthesized
gatacagatgagggttttct

SEQ ID NO: 29076 - DNA, 20 bp, Artificial Sequence
  chemically synthesized
agatggaaagatacagatga

SEQ ID NO: 29077 - DNA, 20 bp, Artificial Sequence
  chemically synthesized
aagatggaaagatacagatg

SEQ ID NO: 29078 - DNA, 20 bp, Artificial Sequence
  chemically synthesized
gaagatggaaagatacagat

SEQ ID NO: 29079 - DNA, 20 bp, Artificial Sequence
  chemically synthesized
ctcaagaagatggaaagata

SEQ ID NO: 29080 - DNA, 20 bp, Artificial Sequence
  chemically synthesized
ataccactcaagaagatgga

SEQ ID NO: 29081 - DNA, 20 bp, Artificial Sequence
  chemically synthesized
ctgtatctttccatcttctt

SEQ ID NO: 29082 - DNA, 20 bp, Artificial Sequence
  chemically synthesized
acaaataccactcaagaaga

SEQ ID NO: 29083 - DNA, 20 bp, Artificial Sequence
  chemically synthesized
tatctttccatcttcttgag

SEQ ID NO: 29084 - DNA, 20 bp, Artificial Sequence
  chemically synthesized
gaaaacaaataccactcaag

SEQ ID NO: 29085 - DNA, 20 bp, Artificial Sequence
  chemically synthesized
gaggaaaacaaataccactc

SEQ ID NO: 29086 - DNA, 20 bp, Artificial Sequence
  chemically synthesized
gtggtatttgttttcctccc

SEQ ID NO: 29087 - DNA, 20 bp, Artificial Sequence
  chemically synthesized
ggagagtgattttgctcggg

SEQ ID NO: 29088 - DNA, 20 bp, Artificial Sequence
  chemically synthesized
gggagagtgattttgctcgg

SEQ ID NO: 29089 - DNA, 20 bp, Artificial Sequence
  chemically synthesized
aagggagagtgattttgctc

SEQ ID NO: 29090 - DNA, 20 bp, Artificial Sequence
  chemically synthesized
caagggagagtgattttgct

SEQ ID NO: 29091 - DNA, 20 bp, Artificial Sequence
  chemically synthesized
aagcacagtagagcaaggga

SEQ ID NO: 29092 - DNA, 20 bp, Artificial Sequence
  chemically synthesized
tgaagcacagtagagcaagg

SEQ ID NO: 29093 - DNA, 20 bp, Artificial Sequence
  chemically synthesized
aatgaagcacagtagagcaa

SEQ ID NO: 29094 - DNA, 20 bp, Artificial Sequence
  chemically synthesized
gaatgaagcacagtagagca

SEQ ID NO: 29095 - DNA, 20 bp, Artificial Sequence
  chemically synthesized
tgaatgaagcacagtagagc

SEQ ID NO: 29096 - DNA, 20 bp, Artificial Sequence
  chemically synthesized
tcattgaatgaagcacagta

SEQ ID NO: 29097 - DNA, 20 bp, Artificial Sequence
  chemically synthesized
gttcattgaatgaagcacag

SEQ ID NO: 29098 - DNA, 20 bp, Artificial Sequence
  chemically synthesized
attgttcattgaatgaagca

SEQ ID NO: 29099 - DNA, 20 bp, Artificial Sequence
  chemically synthesized
aaataattgttcattgaatg

SEQ ID NO: 29100 - DNA, 20 bp, Artificial Sequence
  chemically synthesized
tcaatgaacaattatttttt

SEQ ID NO: 29101 - DNA, 20 bp, Artificial Sequence
  chemically synthesized
aatgaacaattattttttca

SEQ ID NO: 29102 - DNA, 20 bp, Artificial Sequence
  chemically synthesized
atgaacaattattttttcag

SEQ ID NO: 29103 - DNA, 20 bp, Artificial Sequence
  chemically synthesized
caccagtgcctggtgcatgg

SEQ ID NO: 29104 - DNA, 20 bp, Artificial Sequence
  chemically synthesized
tttcagaggctaccatgcac

SEQ ID NO: 29105 - DNA, 20 bp, Artificial Sequence
  chemically synthesized
ttcagaggctaccatgcacc

SEQ ID NO: 29106 - DNA, 20 bp, Artificial Sequence
  chemically synthesized
tgtcaccagtgcctggtgca

SEQ ID NO: 29107 - DNA, 20 bp, Artificial Sequence
  chemically synthesized
ggctaccatgcaccaggcac

SEQ ID NO: 29108 - DNA, 20 bp, Artificial Sequence
  chemically synthesized
tcatctttgtcaccagtgcc

SEQ ID NO: 29109 - DNA, 20 bp, Artificial Sequence
  chemically synthesized
tgcaccaggcactggtgaca

SEQ ID NO: 29110 - DNA, 20 bp, Artificial Sequence
  chemically synthesized
gtcttcctcatctttgtcac

SEQ ID NO: 29111 - DNA, 20 bp, Artificial Sequence
  chemically synthesized
caggcactggtgacaaagat

SEQ ID NO: 29112 - DNA, 20 bp, Artificial Sequence
  chemically synthesized
aggcactggtgacaaagatg

SEQ ID NO: 29113 - DNA, 20 bp, Artificial Sequence
  chemically synthesized
cactggtgacaaagatgagg

SEQ ID NO: 29114 - DNA, 20 bp, Artificial Sequence
  chemically synthesized
ggtgacaaagatgaggaaga

SEQ ID NO: 29115 - DNA, 20 bp, Artificial Sequence
  chemically synthesized
ggaagacagttcctgcttta

SEQ ID NO: 29116 - DNA, 20 bp, Artificial Sequence
  chemically synthesized
gtaatgagcctctttaaagc

SEQ ID NO: 29117 - DNA, 20 bp, Artificial Sequence
  chemically synthesized
aagacagttcctgctttaaa

SEQ ID NO: 29118 - DNA, 20 bp, Artificial Sequence
  chemically synthesized
tgtaatgagcctctttaaag

SEQ ID NO: 29119 - DNA, 20 bp, Artificial Sequence
  chemically synthesized
agacagttcctgctttaaag

SEQ ID NO: 29120 - DNA, 20 bp, Artificial Sequence
  chemically synthesized
gcctgtaatgagcctcttta

SEQ ID NO: 29121 - DNA, 20 bp, Artificial Sequence
  chemically synthesized
tgctttaaagaggctcatta

SEQ ID NO: 29122 - DNA, 20 bp, Artificial Sequence
  chemically synthesized
gctttaaagaggctcattac

SEQ ID NO: 29123 - DNA, 20 bp, Artificial Sequence
  chemically synthesized
taatgagatgagcctgtaat

SEQ ID NO: 29124 - DNA, 20 bp, Artificial Sequence
  chemically synthesized
aaagtgcaatttaatgagat

SEQ ID NO: 29125 - DNA, 20 bp, Artificial Sequence
  chemically synthesized
acagcaaagtgcaatttaat

SEQ ID NO: 29126 - DNA, 20 bp, Artificial Sequence
  chemically synthesized
tcacaaagtgcaatacagca

SEQ ID NO: 29127 - DNA, 20 bp, Artificial Sequence
  chemically synthesized
aattttcacaaagtgcaata

SEQ ID NO: 29128 - DNA, 20 bp, Artificial Sequence
  chemically synthesized
taaacaatgcaattttcaca

SEQ ID NO: 29129 - DNA, 20 bp, Artificial Sequence
  chemically synthesized
attgcattgtttacaaactg

SEQ ID NO: 29130 - DNA, 20 bp, Artificial Sequence
  chemically synthesized
ttgcattgtttacaaactga

SEQ ID NO: 29131 - DNA, 20 bp, Artificial Sequence
  chemically synthesized
acaggattgccacaaacctt

SEQ ID NO: 29132 - DNA, 20 bp, Artificial Sequence
  chemically synthesized
gtttacaaactgaaggtttg

SEQ ID NO: 29133 - DNA, 20 bp, Artificial Sequence
  chemically synthesized
gtttgtggcaatcctgtgtt

SEQ ID NO: 29134 - DNA, 20 bp, Artificial Sequence
  chemically synthesized
tccatagacatgctcaacac

SEQ ID NO: 29135 - DNA, 20 bp, Artificial Sequence
  chemically synthesized
gtccatagacatgctcaaca

SEQ ID NO: 29136 - DNA, 20 bp, Artificial Sequence
  chemically synthesized
tcctgtgttgagcatgtcta

SEQ ID NO: 29137 - DNA, 20 bp, Artificial Sequence
  chemically synthesized
tgctgctggaaaaatgtcca

SEQ ID NO: 29138 - DNA, 20 bp, Artificial Sequence
  chemically synthesized
catgtctatggacatttttc

SEQ ID NO: 29139 - DNA, 20 bp, Artificial Sequence
  chemically synthesized
gtctatggacatttttccag

SEQ ID NO: 29140 - DNA, 20 bp, Artificial Sequence
  chemically synthesized
ccaaagtgagcacatgctgc

SEQ ID NO: 29141 - DNA, 20 bp, Artificial Sequence
  chemically synthesized
ccagcagcatgtgctcactt

SEQ ID NO: 29142 - DNA, 20 bp, Artificial Sequence
  chemically synthesized
cagcagcatgtgctcacttt

SEQ ID NO: 29143 - DNA, 20 bp, Artificial Sequence
  chemically synthesized
acgagacacagacccaaagt

SEQ ID NO: 29144 - DNA, 20 bp, Artificial Sequence
  chemically synthesized
caaaacgagacacagaccca

SEQ ID NO: 29145 - DNA, 20 bp, Artificial Sequence
  chemically synthesized
ggaattttcaaaacgagaca

SEQ ID NO: 29146 - DNA, 20 bp, Artificial Sequence
  chemically synthesized
attgagggaattttcaaaac

SEQ ID NO: 29147 - DNA, 20 bp, Artificial Sequence
  chemically synthesized
tgacaaatttgaaatattga

SEQ ID NO: 29148 - DNA, 20 bp, Artificial Sequence
  chemically synthesized
atgacaaatttgaaatattg

SEQ ID NO: 29149 - DNA, 20 bp, Artificial Sequence
  chemically synthesized
aatgacaaatttgaaatatt

SEQ ID NO: 29150 - DNA, 20 bp, Artificial Sequence
  chemically synthesized
cattatttttatatctatta

SEQ ID NO: 29151 - DNA, 20 bp, Artificial Sequence
  chemically synthesized
ctgatcacgattcaccataa

SEQ ID NO: 29152 - DNA, 20 bp, Artificial Sequence
  chemically synthesized
ctattatggtgaatcgtgat

SEQ ID NO: 29153 - DNA, 20 bp, Artificial Sequence
  chemically synthesized
gcaccccaaaacaatttcag

SEQ ID NO: 29154 - DNA, 20 bp, Artificial Sequence
  chemically synthesized
gttgcaccccaaaacaattt

SEQ ID NO: 29155 - DNA, 20 bp, Artificial Sequence
  chemically synthesized
tgttactactgaaattgttt

SEQ ID NO: 29156 - DNA, 20 bp, Artificial Sequence
  chemically synthesized
gttactactgaaattgtttt

SEQ ID NO: 29157 - DNA, 20 bp, Artificial Sequence
  chemically synthesized
ttactactgaaattgttttg

SEQ ID NO: 29158 - DNA, 20 bp, Artificial Sequence
  chemically synthesized
ccatcttatgtgggtgtggt

SEQ ID NO: 29159 - DNA, 20 bp, Artificial Sequence
  chemically synthesized
tttgccatcttatgtgggtg

SEQ ID NO: 29160 - DNA, 20 bp, Artificial Sequence
  chemically synthesized
gcaactaaccacacccacat

SEQ ID NO: 29161 - DNA, 20 bp, Artificial Sequence
  chemically synthesized
ttaagtttgccatcttatgt

SEQ ID NO: 29162 - DNA, 20 bp, Artificial Sequence
  chemically synthesized
ctaaccacacccacataaga

SEQ ID NO: 29163 - DNA, 20 bp, Artificial Sequence
  chemically synthesized
attaagtttgccatcttatg

SEQ ID NO: 29164 - DNA, 20 bp, Artificial Sequence
  chemically synthesized
acgtatgacgttgatcaatt

SEQ ID NO: 29165 - DNA, 20 bp, Artificial Sequence
  chemically synthesized
cagctggtcggtggagcagt

SEQ ID NO: 29166 - DNA, 20 bp, Artificial Sequence
  chemically synthesized
ggaacagctggtcggtggag

SEQ ID NO: 29167 - DNA, 20 bp, Artificial Sequence
  chemically synthesized
gttctgactgctccaccgac

SEQ ID NO: 29168 - DNA, 20 bp, Artificial Sequence
  chemically synthesized
gggggaacagctggtcggtg

SEQ ID NO: 29169 - DNA, 20 bp, Artificial Sequence
  chemically synthesized
atgggggaacagctggtcgg

SEQ ID NO: 29170 - DNA, 20 bp, Artificial Sequence
  chemically synthesized
gagatgggggaacagctggt

SEQ ID NO: 29171 - DNA, 20 bp, Artificial Sequence
  chemically synthesized
gaaagagatgggggaacagc

SEQ ID NO: 29172 - DNA, 20 bp, Artificial Sequence
  chemically synthesized
gagggaaagagatgggggaa

SEQ ID NO: 29173 - DNA, 20 bp, Artificial Sequence
  chemically synthesized
gaggagagggaaagagatgg

SEQ ID NO: 29174 - DNA, 20 bp, Artificial Sequence
  chemically synthesized
agaggagagggaaagagatg

SEQ ID NO: 29175 - DNA, 20 bp, Artificial Sequence
  chemically synthesized
cagaggagagggaaagagat

SEQ ID NO: 29176 - DNA, 20 bp, Artificial Sequence
  chemically synthesized
ccagaggagagggaaagaga

SEQ ID NO: 29177 - DNA, 20 bp, Artificial Sequence
  chemically synthesized
aaggccagaggagagggaaa

SEQ ID NO: 29178 - DNA, 20 bp, Artificial Sequence
  chemically synthesized
ggaaggccagaggagaggga

SEQ ID NO: 29179 - DNA, 20 bp, Artificial Sequence
  chemically synthesized
ccatctctttccctctcctc

SEQ ID NO: 29180 - DNA, 20 bp, Artificial Sequence
  chemically synthesized
aacaggaaggccagaggaga

SEQ ID NO: 29181 - DNA, 20 bp, Artificial Sequence
  chemically synthesized
gaacaggaaggccagaggag

SEQ ID NO: 29182 - DNA, 20 bp, Artificial Sequence
  chemically synthesized
agaacaggaaggccagagga

SEQ ID NO: 29183 - DNA, 20 bp, Artificial Sequence
  chemically synthesized
tcagaacaggaaggccagag

SEQ ID NO: 29184 - DNA, 20 bp, Artificial Sequence
  chemically synthesized
tctcagaacaggaaggccag

SEQ ID NO: 29185 - DNA, 20 bp, Artificial Sequence
  chemically synthesized
gtctcagaacaggaaggcca

SEQ ID NO: 29186 - DNA, 20 bp, Artificial Sequence
  chemically synthesized
gtgtctcagaacaggaaggc

SEQ ID NO: 29187 - DNA, 20 bp, Artificial Sequence
  chemically synthesized
tgttgtgtctcagaacagga

SEQ ID NO: 29188 - DNA, 20 bp, Artificial Sequence
  chemically synthesized
ttgttgtgtctcagaacagg

SEQ ID NO: 29189 - DNA, 20 bp, Artificial Sequence
  chemically synthesized
tcctctggccttcctgttct

SEQ ID NO: 29190 - DNA, 20 bp, Artificial Sequence
  chemically synthesized
atattgttgtgtctcagaac

SEQ ID NO: 29191 - DNA, 20 bp, Artificial Sequence
  chemically synthesized
aatattgttgtgtctcagaa

SEQ ID NO: 29192 - DNA, 20 bp, Artificial Sequence
  chemically synthesized
attttaatattgttgtgtct

SEQ ID NO: 29193 - DNA, 20 bp, Artificial Sequence
  chemically synthesized
agacacaacaatattaaaat

SEQ ID NO: 29194 - DNA, 20 bp, Artificial Sequence
  chemically synthesized
gacacaacaatattaaaatc

SEQ ID NO: 29195 - DNA, 20 bp, Artificial Sequence
  chemically synthesized
acacaacaatattaaaatca

SEQ ID NO: 29196 - DNA, 20 bp, Artificial Sequence
  chemically synthesized
ggtaattaataaccctacaa

SEQ ID NO: 29197 - DNA, 20 bp, Artificial Sequence
  chemically synthesized
aacacttagaggccattgta

SEQ ID NO: 29198 - DNA, 20 bp, Artificial Sequence
  chemically synthesized
gaacacttagaggccattgt

SEQ ID NO: 29199 - DNA, 20 bp, Artificial Sequence
  chemically synthesized
tgaacacttagaggccattg

SEQ ID NO: 29200 - DNA, 20 bp, Artificial Sequence
  chemically synthesized
ataaccctacaatggcctct

SEQ ID NO: 29201 - DNA, 20 bp, Artificial Sequence
  chemically synthesized
ttcttcccttgaacacttag

SEQ ID NO: 29202 - DNA, 20 bp, Artificial Sequence
  chemically synthesized
tttcttcccttgaacactta

SEQ ID NO: 29203 - DNA, 20 bp, Artificial Sequence
  chemically synthesized
acaatggcctctaagtgttc

SEQ ID NO: 29204 - DNA, 20 bp, Artificial Sequence
  chemically synthesized
tctttcttcccttgaacact

SEQ ID NO: 29205 - DNA, 20 bp, Artificial Sequence
  chemically synthesized
caatggcctctaagtgttca

SEQ ID NO: 29206 - DNA, 20 bp, Artificial Sequence
  chemically synthesized
aatggcctctaagtgttcaa

SEQ ID NO: 29207 - DNA, 20 bp, Artificial Sequence
  chemically synthesized
ggcctctaagtgttcaaggg

SEQ ID NO: 29208 - DNA, 20 bp, Artificial Sequence
  chemically synthesized
tctaagtgttcaagggaaga

SEQ ID NO: 29209 - DNA, 20 bp, Artificial Sequence
  chemically synthesized
taagtgttcaagggaagaaa

SEQ ID NO: 29210 - DNA, 20 bp, Artificial Sequence
  chemically synthesized
gatgtaaagtgacagaggta

SEQ ID NO: 29211 - DNA, 20 bp, Artificial Sequence
  chemically synthesized
cttctgatgtaaagtgacag

SEQ ID NO: 29212 - DNA, 20 bp, Artificial Sequence
  chemically synthesized
gcttctgatgtaaagtgaca

SEQ ID NO: 29213 - DNA, 20 bp, Artificial Sequence
  chemically synthesized
tagcttctgatgtaaagtga

SEQ ID NO: 29214 - DNA, 20 bp, Artificial Sequence
  chemically synthesized
atacctctgtcactttacat

SEQ ID NO: 29215 - DNA, 20 bp, Artificial Sequence
  chemically synthesized
cattaatagcttctgatgta

SEQ ID NO: 29216 - DNA, 20 bp, Artificial Sequence
  chemically synthesized
cctctgtcactttacatcag

SEQ ID NO: 29217 - DNA, 20 bp, Artificial Sequence
  chemically synthesized
tcactaagctcaatcattaa

SEQ ID NO: 29218 - DNA, 20 bp, Artificial Sequence
  chemically synthesized
atcagaagctattaatgatt

SEQ ID NO: 29219 - DNA, 20 bp, Artificial Sequence
  chemically synthesized
aagctattaatgattgagct

SEQ ID NO: 29220 - DNA, 20 bp, Artificial Sequence
  chemically synthesized
tattaatgattgagcttagt

SEQ ID NO: 29221 - DNA, 20 bp, Artificial Sequence
  chemically synthesized
attaatgattgagcttagtg

SEQ ID NO: 29222 - DNA, 20 bp, Artificial Sequence
  chemically synthesized
ttcaacatgctttcctcact

SEQ ID NO: 29223 - DNA, 20 bp, Artificial Sequence
  chemically synthesized
atgattgagcttagtgagga

SEQ ID NO: 29224 - DNA, 20 bp, Artificial Sequence
  chemically synthesized
tagtgaggaaagcatgttga

SEQ ID NO: 29225 - DNA, 20 bp, Artificial Sequence
  chemically synthesized
aggaaagcatgttgaaagat

SEQ ID NO: 29226 - DNA, 20 bp, Artificial Sequence
  chemically synthesized
aagcatgttgaaagatgaga

SEQ ID NO: 29227 - DNA, 20 bp, Artificial Sequence
  chemically synthesized
tgaaagatgagacagactga

SEQ ID NO: 29228 - DNA, 20 bp, Artificial Sequence
  chemically synthesized
agatgagacagactgaaagc

SEQ ID NO: 29229 - DNA, 20 bp, Artificial Sequence
  chemically synthesized
gatgagacagactgaaagct

SEQ ID NO: 29230 - DNA, 20 bp, Artificial Sequence
  chemically synthesized
ggcatgagaggcctagcttt

SEQ ID NO: 29231 - DNA, 20 bp, Artificial Sequence
  chemically synthesized
actgtttggcatgagaggcc

SEQ ID NO: 29232 - DNA, 20 bp, Artificial Sequence
  chemically synthesized
acttgactgtttggcatgag

SEQ ID NO: 29233 - DNA, 20 bp, Artificial Sequence
  chemically synthesized
aacttgactgtttggcatga

SEQ ID NO: 29234 - DNA, 20 bp, Artificial Sequence
  chemically synthesized
acaacttgactgtttggcat

SEQ ID NO: 29235 - DNA, 20 bp, Artificial Sequence
  chemically synthesized
gctaggcctctcatgccaaa

SEQ ID NO: 29236 - DNA, 20 bp, Artificial Sequence
  chemically synthesized
gcctctcatgccaaacagtc

SEQ ID NO: 29237 - DNA, 20 bp, Artificial Sequence
  chemically synthesized
gcattcacaacttgactgtt

SEQ ID NO: 29238 - DNA, 20 bp, Artificial Sequence
  chemically synthesized
acagtcaagttgtgaatgca

SEQ ID NO: 29239 - DNA, 20 bp, Artificial Sequence
  chemically synthesized
cagtcaagttgtgaatgcaa

SEQ ID NO: 29240 - DNA, 20 bp, Artificial Sequence
  chemically synthesized
aagttgtgaatgcaaaggaa

SEQ ID NO: 29241 - DNA, 20 bp, Artificial Sequence
  chemically synthesized
atgcaaaggaaaagttaatg

SEQ ID NO: 29242 - DNA, 20 bp, Artificial Sequence
  chemically synthesized
tgcaaaggaaaagttaatga

SEQ ID NO: 29243 - DNA, 20 bp, Artificial Sequence
  chemically synthesized
aagttaatgaaggaaattaa

SEQ ID NO: 29244 - DNA, 20 bp, Artificial Sequence
  chemically synthesized
aattaaaagtactaccctgc

SEQ ID NO: 29245 - DNA, 20 bp, Artificial Sequence
  chemically synthesized
tcatttgtgtgctcgcaggg

SEQ ID NO: 29246 - DNA, 20 bp, Artificial Sequence
  chemically synthesized
ttatcatttgtgtgctcgca

SEQ ID NO: 29247 - DNA, 20 bp, Artificial Sequence
  chemically synthesized
cttatcatttgtgtgctcgc

SEQ ID NO: 29248 - DNA, 20 bp, Artificial Sequence
  chemically synthesized
tcttatcatttgtgtgctcg

SEQ ID NO: 29249 - DNA, 20 bp, Artificial Sequence
  chemically synthesized
cctgcgagcacacaaatgat

SEQ ID NO: 29250 - DNA, 20 bp, Artificial Sequence
  chemically synthesized
cgagcacacaaatgataaga

SEQ ID NO: 29251 - DNA, 20 bp, Artificial Sequence
  chemically synthesized
caaatgataagaaagtaaaa

SEQ ID NO: 29252 - DNA, 20 bp, Artificial Sequence
  chemically synthesized
ctttctccatatcaggaata

SEQ ID NO: 29253 - DNA, 20 bp, Artificial Sequence
  chemically synthesized
actttctccatatcaggaat

SEQ ID NO: 29254 - DNA, 20 bp, Artificial Sequence
  chemically synthesized
aaacagccttattcctgata

SEQ ID NO: 29255 - DNA, 20 bp, Artificial Sequence
  chemically synthesized
acagccttattcctgatatg

SEQ ID NO: 29256 - DNA, 20 bp, Artificial Sequence
  chemically synthesized
actcaaactttctccatatc

SEQ ID NO: 29257 - DNA, 20 bp, Artificial Sequence
  chemically synthesized
cactcaaactttctccatat

SEQ ID NO: 29258 - DNA, 20 bp, Artificial Sequence
  chemically synthesized
ccttattcctgatatggaga

SEQ ID NO: 29259 - DNA, 20 bp, Artificial Sequence
  chemically synthesized
tcctgatatggagaaagttt

SEQ ID NO: 29260 - DNA, 20 bp, Artificial Sequence
  chemically synthesized
gaaagtttgagtgctctgaa

SEQ ID NO: 29261 - DNA, 20 bp, Artificial Sequence
  chemically synthesized
agtttgagtgctctgaatag

SEQ ID NO: 29262 - DNA, 20 bp, Artificial Sequence
  chemically synthesized
ctagtttgatcttctattca

SEQ ID NO: 29263 - DNA, 20 bp, Artificial Sequence
  chemically synthesized
ggctagtttgatcttctatt

SEQ ID NO: 29264 - DNA, 20 bp, Artificial Sequence
  chemically synthesized
ctctgaatagaagatcaaac

SEQ ID NO: 29265 - DNA, 20 bp, Artificial Sequence
  chemically synthesized
gcttaaagaaatgttgtggc

SEQ ID NO: 29266 - DNA, 20 bp, Artificial Sequence
  chemically synthesized
tttggcttaaagaaatgttg

SEQ ID NO: 29267 - DNA, 20 bp, Artificial Sequence
  chemically synthesized
actagccacaacatttcttt

SEQ ID NO: 29268 - DNA, 20 bp, Artificial Sequence
  chemically synthesized
cacaacatttctttaagcca

SEQ ID NO: 29269 - DNA, 20 bp, Artificial Sequence
  chemically synthesized
ctggattaggctttggctta

SEQ ID NO: 29270 - DNA, 20 bp, Artificial Sequence
  chemically synthesized
ttttgctctggattaggctt

SEQ ID NO: 29271 - DNA, 20 bp, Artificial Sequence
  chemically synthesized
ctttaagccaaagcctaatc

SEQ ID NO: 29272 - DNA, 20 bp, Artificial Sequence
  chemically synthesized
ttaagccaaagcctaatcca

SEQ ID NO: 29273 - DNA, 20 bp, Artificial Sequence
  chemically synthesized
ttaaggttttgctctggatt

SEQ ID NO: 29274 - DNA, 20 bp, Artificial Sequence
  chemically synthesized
gttaaggttttgctctggat

SEQ ID NO: 29275 - DNA, 20 bp, Artificial Sequence
  chemically synthesized
agggagttaaggttttgctc

SEQ ID NO: 29276 - DNA, 20 bp, Artificial Sequence
  chemically synthesized
catagaattgaagggagtta

SEQ ID NO: 29277 - DNA, 20 bp, Artificial Sequence
  chemically synthesized
tcatagaattgaagggagtt

SEQ ID NO: 29278 - DNA, 20 bp, Artificial Sequence
  chemically synthesized
agccttcatagaattgaagg

SEQ ID NO: 29279 - DNA, 20 bp, Artificial Sequence
  chemically synthesized
ttagccttcatagaattgaa

SEQ ID NO: 29280 - DNA, 20 bp, Artificial Sequence
  chemically synthesized
tttagccttcatagaattga

SEQ ID NO: 29281 - DNA, 20 bp, Artificial Sequence
  chemically synthesized
ttttagccttcatagaattg

SEQ ID NO: 29282 - DNA, 20 bp, Artificial Sequence
  chemically synthesized
taactcccttcaattctatg

SEQ ID NO: 29283 - DNA, 20 bp, Artificial Sequence
  chemically synthesized
aactcccttcaattctatga

SEQ ID NO: 29284 - DNA, 20 bp, Artificial Sequence
  chemically synthesized
ctcatctcttttagccttca

SEQ ID NO: 29285 - DNA, 20 bp, Artificial Sequence
  chemically synthesized
ttcaattctatgaaggctaa

SEQ ID NO: 29286 - DNA, 20 bp, Artificial Sequence
  chemically synthesized
caattctatgaaggctaaaa

SEQ ID NO: 29287 - DNA, 20 bp, Artificial Sequence
  chemically synthesized
tgcagcttcctcatctcttt

SEQ ID NO: 29288 - DNA, 20 bp, Artificial Sequence
  chemically synthesized
ctatgaaggctaaaagagat

SEQ ID NO: 29289 - DNA, 20 bp, Artificial Sequence
  chemically synthesized
tatgaaggctaaaagagatg

SEQ ID NO: 29290 - DNA, 20 bp, Artificial Sequence
  chemically synthesized
gaaggctaaaagagatgagg

SEQ ID NO: 29291 - DNA, 20 bp, Artificial Sequence
  chemically synthesized
taaaagagatgaggaagctg

SEQ ID NO: 29292 - DNA, 20 bp, Artificial Sequence
  chemically synthesized
aagagatgaggaagctgcag

SEQ ID NO: 29293 - DNA, 20 bp, Artificial Sequence
  chemically synthesized
agcttccaacttttcttctg

SEQ ID NO: 29294 - DNA, 20 bp, Artificial Sequence
  chemically synthesized
atgaggaagctgcagaagaa

SEQ ID NO: 29295 - DNA, 20 bp, Artificial Sequence
  chemically synthesized
ggaagctgcagaagaaaagt

SEQ ID NO: 29296 - DNA, 20 bp, Artificial Sequence
  chemically synthesized
agctgcagaagaaaagttgg

SEQ ID NO: 29297 - DNA, 20 bp, Artificial Sequence
  chemically synthesized
gcagaagaaaagttggaagc

SEQ ID NO: 29298 - DNA, 20 bp, Artificial Sequence
  chemically synthesized
gaagaaaagttggaagctag

SEQ ID NO: 29299 - DNA, 20 bp, Artificial Sequence
  chemically synthesized
agaaaagttggaagctagta

SEQ ID NO: 29300 - DNA, 20 bp, Artificial Sequence
  chemically synthesized
gaaaagttggaagctagtag

SEQ ID NO: 29301 - DNA, 20 bp, Artificial Sequence
  chemically synthesized
cttcttgaagcaacctctac

SEQ ID NO: 29302 - DNA, 20 bp, Artificial Sequence
  chemically synthesized
aagctagtagaggttgcttc

SEQ ID NO: 29303 - DNA, 20 bp, Artificial Sequence
  chemically synthesized
ctagtagaggttgcttcaag

SEQ ID NO: 29304 - DNA, 20 bp, Artificial Sequence
  chemically synthesized
ttgtttccttaagcttcttg

SEQ ID NO: 29305 - DNA, 20 bp, Artificial Sequence
  chemically synthesized
gaggttgcttcaagaagctt

SEQ ID NO: 29306 - DNA, 20 bp, Artificial Sequence
  chemically synthesized
aggttgcttcaagaagctta

SEQ ID NO: 29307 - DNA, 20 bp, Artificial Sequence
  chemically synthesized
tggatatggcttgtttcctt

SEQ ID NO: 29308 - DNA, 20 bp, Artificial Sequence
  chemically synthesized
ttcaagaagcttaaggaaac

SEQ ID NO: 29309 - DNA, 20 bp, Artificial Sequence
  chemically synthesized
gcaccttaatgttatggata

SEQ ID NO: 29310 - DNA, 20 bp, Artificial Sequence
  chemically synthesized
caagccatatccataacatt

SEQ ID NO: 29311 - DNA, 20 bp, Artificial Sequence
  chemically synthesized
catcttgcaccttaatgtta

SEQ ID NO: 29312 - DNA, 20 bp, Artificial Sequence
  chemically synthesized
aagccatatccataacatta

SEQ ID NO: 29313 - DNA, 20 bp, Artificial Sequence
  chemically synthesized
tatccataacattaaggtgc

SEQ ID NO: 29314 - DNA, 20 bp, Artificial Sequence
  chemically synthesized
taacattaaggtgcaagatg

SEQ ID NO: 29315 - DNA, 20 bp, Artificial Sequence
  chemically synthesized
cattaaggtgcaagatgaag

SEQ ID NO: 29316 - DNA, 20 bp, Artificial Sequence
  chemically synthesized
aaggtgcaagatgaagcagc

SEQ ID NO: 29317 - DNA, 20 bp, Artificial Sequence
  chemically synthesized
tgaagcagcaagcattgatg

SEQ ID NO: 29318 - DNA, 20 bp, Artificial Sequence
  chemically synthesized
agcagcaagcattgatgcag

SEQ ID NO: 29319 - DNA, 20 bp, Artificial Sequence
  chemically synthesized
aagcattgatgcagaagctg

SEQ ID NO: 29320 - DNA, 20 bp, Artificial Sequence
  chemically synthesized
ttgatgcagaagctgcagcc

SEQ ID NO: 29321 - DNA, 20 bp, Artificial Sequence
  chemically synthesized
tcatctggaaaacttggctg

SEQ ID NO: 29322 - DNA, 20 bp, Artificial Sequence
  chemically synthesized
gaagctgcagccaagttttc

SEQ ID NO: 29323 - DNA, 20 bp, Artificial Sequence
  chemically synthesized
ttagcttcatctggaaaact

SEQ ID NO: 29324 - DNA, 20 bp, Artificial Sequence
  chemically synthesized
gcagccaagttttccagatg

SEQ ID NO: 29325 - DNA, 20 bp, Artificial Sequence
  chemically synthesized
tccatgaccttagcttcatc

SEQ ID NO: 29326 - DNA, 20 bp, Artificial Sequence
  chemically synthesized
caagttttccagatgaagct

SEQ ID NO: 29327 - DNA, 20 bp, Artificial Sequence
  chemically synthesized
aagttttccagatgaagcta

SEQ ID NO: 29328 - DNA, 20 bp, Artificial Sequence
  chemically synthesized
tccagatgaagctaaggtca

SEQ ID NO: 29329 - DNA, 20 bp, Artificial Sequence
  chemically synthesized
gccaccttcatccatgacct

SEQ ID NO: 29330 - DNA, 20 bp, Artificial Sequence
  chemically synthesized
tgaagctaaggtcatggatg

SEQ ID NO: 29331 - DNA, 20 bp, Artificial Sequence
  chemically synthesized
gaagctaaggtcatggatga

SEQ ID NO: 29332 - DNA, 20 bp, Artificial Sequence
  chemically synthesized
gctaaggtcatggatgaagg

SEQ ID NO: 29333 - DNA, 20 bp, Artificial Sequence
  chemically synthesized
tgaaaatctgttgttcgttg

SEQ ID NO: 29334 - DNA, 20 bp, Artificial Sequence
  chemically synthesized
aaggtggctacaacgaacaa

SEQ ID NO: 29335 - DNA, 20 bp, Artificial Sequence
  chemically synthesized
cgaacaacagattttcaaca

SEQ ID NO: 29336 - DNA, 20 bp, Artificial Sequence
  chemically synthesized
gattttcaacatagatgaaa

SEQ ID NO: 29337 - DNA, 20 bp, Artificial Sequence
  chemically synthesized
tagtatcacctttaaataga

SEQ ID NO: 29338 - DNA, 20 bp, Artificial Sequence
  chemically synthesized
atgaaacagccttctattta

SEQ ID NO: 29339 - DNA, 20 bp, Artificial Sequence
  chemically synthesized
atagtatcacctttaaatag

SEQ ID NO: 29340 - DNA, 20 bp, Artificial Sequence
  chemically synthesized
tgaaacagccttctatttaa

SEQ ID NO: 29341 - DNA, 20 bp, Artificial Sequence
  chemically synthesized
tagatagtatcacctttaaa

SEQ ID NO: 29342 - DNA, 20 bp, Artificial Sequence
  chemically synthesized
tatttaaaggtgatactatc

SEQ ID NO: 29343 - DNA, 20 bp, Artificial Sequence
  chemically synthesized
atttaaaggtgatactatct

SEQ ID NO: 29344 - DNA, 20 bp, Artificial Sequence
  chemically synthesized
agagctatgaaagtcctaga

SEQ ID NO: 29345 - DNA, 20 bp, Artificial Sequence
  chemically synthesized
ctctagagctatgaaagtcc

SEQ ID NO: 29346 - DNA, 20 bp, Artificial Sequence
  chemically synthesized
gatactatctaggactttca

SEQ ID NO: 29347 - DNA, 20 bp, Artificial Sequence
  chemically synthesized
tttctcctctagagctatga

SEQ ID NO: 29348 - DNA, 20 bp, Artificial Sequence
  chemically synthesized
atctaggactttcatagctc

SEQ ID NO: 29349 - DNA, 20 bp, Artificial Sequence
  chemically synthesized
ctaggactttcatagctcta

SEQ ID NO: 29350 - DNA, 20 bp, Artificial Sequence
  chemically synthesized
taggactttcatagctctag

SEQ ID NO: 29351 - DNA, 20 bp, Artificial Sequence
  chemically synthesized
ggactttcatagctctagag

SEQ ID NO: 29352 - DNA, 20 bp, Artificial Sequence
  chemically synthesized
agtcattgatttctcctcta

SEQ ID NO: 29353 - DNA, 20 bp, Artificial Sequence
  chemically synthesized
gcagtcattgatttctcctc

SEQ ID NO: 29354 - DNA, 20 bp, Artificial Sequence
  chemically synthesized
gaaatcaatgactgccttca

SEQ ID NO: 29355 - DNA, 20 bp, Artificial Sequence
  chemically synthesized
gtccattgaagctttgaagg

SEQ ID NO: 29356 - DNA, 20 bp, Artificial Sequence
  chemically synthesized
cctgtccattgaagctttga

SEQ ID NO: 29357 - DNA, 20 bp, Artificial Sequence
  chemically synthesized
gcctgtccattgaagctttg

SEQ ID NO: 29358 - DNA, 20 bp, Artificial Sequence
  chemically synthesized
gactgccttcaaagcttcaa

SEQ ID NO: 29359 - DNA, 20 bp, Artificial Sequence
  chemically synthesized
gccttcaaagcttcaatgga

SEQ ID NO: 29360 - DNA, 20 bp, Artificial Sequence
  chemically synthesized
gagatacagcctgtccattg

SEQ ID NO: 29361 - DNA, 20 bp, Artificial Sequence
  chemically synthesized
ccttcaaagcttcaatggac

SEQ ID NO: 29362 - DNA, 20 bp, Artificial Sequence
  chemically synthesized
aatggacaggctgtatctct

SEQ ID NO: 29363 - DNA, 20 bp, Artificial Sequence
  chemically synthesized
ttaggccctactaagagata

SEQ ID NO: 29364 - DNA, 20 bp, Artificial Sequence
  chemically synthesized
ggacaggctgtatctcttag

SEQ ID NO: 29365 - DNA, 20 bp, Artificial Sequence
  chemically synthesized
gacaggctgtatctcttagt

SEQ ID NO: 29366 - DNA, 20 bp, Artificial Sequence
  chemically synthesized
acaggctgtatctcttagta

SEQ ID NO: 29367 - DNA, 20 bp, Artificial Sequence
  chemically synthesized
gctgcattaggccctactaa

SEQ ID NO: 29368 - DNA, 20 bp, Artificial Sequence
  chemically synthesized
cagctgcattaggccctact

SEQ ID NO: 29369 - DNA, 20 bp, Artificial Sequence
  chemically synthesized
tctcttagtagggcctaatg

SEQ ID NO: 29370 - DNA, 20 bp, Artificial Sequence
  chemically synthesized
acttagtcaccagctgcatt

SEQ ID NO: 29371 - DNA, 20 bp, Artificial Sequence
  chemically synthesized
ttagtagggcctaatgcagc

SEQ ID NO: 29372 - DNA, 20 bp, Artificial Sequence
  chemically synthesized
aacttagtcaccagctgcat

SEQ ID NO: 29373 - DNA, 20 bp, Artificial Sequence
  chemically synthesized
gcctaatgcagctggtgact

SEQ ID NO: 29374 - DNA, 20 bp, Artificial Sequence
  chemically synthesized
attggcttcaacttagtcac

SEQ ID NO: 29375 - DNA, 20 bp, Artificial Sequence
  chemically synthesized
tgcagctggtgactaagttg

SEQ ID NO: 29376 - DNA, 20 bp, Artificial Sequence
  chemically synthesized
gatgagcattggcttcaact

SEQ ID NO: 29377 - DNA, 20 bp, Artificial Sequence
  chemically synthesized
tcagaatggtagatgagcat

SEQ ID NO: 29378 - DNA, 20 bp, Artificial Sequence
  chemically synthesized
gtgatttcagaatggtagat

SEQ ID NO: 29379 - DNA, 20 bp, Artificial Sequence
  chemically synthesized
gccctgtgatttcagaatgg

SEQ ID NO: 29380 - DNA, 20 bp, Artificial Sequence
  chemically synthesized
agggccctgtgatttcagaa

SEQ ID NO: 29381 - DNA, 20 bp, Artificial Sequence
  chemically synthesized
catctaccattctgaaatca

SEQ ID NO: 29382 - DNA, 20 bp, Artificial Sequence
  chemically synthesized
atctaccattctgaaatcac

SEQ ID NO: 29383 - DNA, 20 bp, Artificial Sequence
  chemically synthesized
tcttaagggccctgtgattt

SEQ ID NO: 29384 - DNA, 20 bp, Artificial Sequence
  chemically synthesized
tctaccattctgaaatcaca

SEQ ID NO: 29385 - DNA, 20 bp, Artificial Sequence
  chemically synthesized
tctgaaatcacagggccctt

SEQ ID NO: 29386 - DNA, 20 bp, Artificial Sequence
  chemically synthesized
tgatttcacataattcttaa

SEQ ID NO: 29387 - DNA, 20 bp, Artificial Sequence
  chemically synthesized
ctgatttcacataattctta

SEQ ID NO: 29388 - DNA, 20 bp, Artificial Sequence
  chemically synthesized
cctgatttcacataattctt

SEQ ID NO: 29389 - DNA, 20 bp, Artificial Sequence
  chemically synthesized
ccttaagaattatgtgaaat

SEQ ID NO: 29390 - DNA, 20 bp, Artificial Sequence
  chemically synthesized
cttaagaattatgtgaaatc

SEQ ID NO: 29391 - DNA, 20 bp, Artificial Sequence
  chemically synthesized
agaattatgtgaaatcaggc

SEQ ID NO: 29392 - DNA, 20 bp, Artificial Sequence
  chemically synthesized
gaattatgtgaaatcaggcc

SEQ ID NO: 29393 - DNA, 20 bp, Artificial Sequence
  chemically synthesized
atgtgaaatcaggccgggca

SEQ ID NO: 29394 - DNA, 20 bp, Artificial Sequence
  chemically synthesized
tgaaatcaggccgggcacag

SEQ ID NO: 29395 - DNA, 20 bp, Artificial Sequence
  chemically synthesized
caggcatgagccactgtgcc

SEQ ID NO: 29396 - DNA, 20 bp, Artificial Sequence
  chemically synthesized
agtgctgggattacaggcat

SEQ ID NO: 29397 - DNA, 20 bp, Artificial Sequence
  chemically synthesized
gtggctcatgcctgtaatcc

SEQ ID NO: 29398 - DNA, 20 bp, Artificial Sequence
  chemically synthesized
tcccaaagtgctgggattac

SEQ ID NO: 29399 - DNA, 20 bp, Artificial Sequence
  chemically synthesized
ctcccaaagtgctgggatta

SEQ ID NO: 29400 - DNA, 20 bp, Artificial Sequence
  chemically synthesized
tgcctgtaatcccagcactt

SEQ ID NO: 29401 - DNA, 20 bp, Artificial Sequence
  chemically synthesized
cctcagcctcccaaagtgct

SEQ ID NO: 29402 - DNA, 20 bp, Artificial Sequence
  chemically synthesized
gcctgtaatcccagcacttt

SEQ ID NO: 29403 - DNA, 20 bp, Artificial Sequence
  chemically synthesized
gcctcagcctcccaaagtgc

SEQ ID NO: 29404 - DNA, 20 bp, Artificial Sequence
  chemically synthesized
ctgtaatcccagcactttgg

SEQ ID NO: 29405 - DNA, 20 bp, Artificial Sequence
  chemically synthesized
tgtaatcccagcactttggg

SEQ ID NO: 29406 - DNA, 20 bp, Artificial Sequence
  chemically synthesized
ctgcccgcctcagcctccca

SEQ ID NO: 29407 - DNA, 20 bp, Artificial Sequence
  chemically synthesized
tcccagcactttgggaggct

SEQ ID NO: 29408 - DNA, 20 bp, Artificial Sequence
  chemically synthesized
cccagcactttgggaggctg

SEQ ID NO: 29409 - DNA, 20 bp, Artificial Sequence
  chemically synthesized
agcactttgggaggctgagg

SEQ ID NO: 29410 - DNA, 20 bp, Artificial Sequence
  chemically synthesized
gcactttgggaggctgaggc

SEQ ID NO: 29411 - DNA, 20 bp, Artificial Sequence
  chemically synthesized
ctttgggaggctgaggcggg

SEQ ID NO: 29412 - DNA, 20 bp, Artificial Sequence
  chemically synthesized
acctcgtgatctgcccgcct

SEQ ID NO: 29413 - DNA, 20 bp, Artificial Sequence
  chemically synthesized
ggctgaggcgggcagatcac

SEQ ID NO: 29414 - DNA, 20 bp, Artificial Sequence
  chemically synthesized
gctgaggcgggcagatcacg

SEQ ID NO: 29415 - DNA, 20 bp, Artificial Sequence
  chemically synthesized
aggcgggcagatcacgaggt

SEQ ID NO: 29416 - DNA, 20 bp, Artificial Sequence
  chemically synthesized
ggcgggcagatcacgaggtc

SEQ ID NO: 29417 - DNA, 20 bp, Artificial Sequence
  chemically synthesized
cgggcagatcacgaggtcag

SEQ ID NO: 29418 - DNA, 20 bp, Artificial Sequence
  chemically synthesized
cagatcacgaggtcaggagt

SEQ ID NO: 29419 - DNA, 20 bp, Artificial Sequence
  chemically synthesized
gatcacgaggtcaggagttg

SEQ ID NO: 29420 - DNA, 20 bp, Artificial Sequence
  chemically synthesized
cgaggtcaggagttggagac

SEQ ID NO: 29421 - DNA, 20 bp, Artificial Sequence
  chemically synthesized
tcaggagttggagaccagcc

SEQ ID NO: 29422 - DNA, 20 bp, Artificial Sequence
  chemically synthesized
tttcaccatgttggccaggc

SEQ ID NO: 29423 - DNA, 20 bp, Artificial Sequence
  chemically synthesized
ggggtttcaccatgttggcc

SEQ ID NO: 29424 - DNA, 20 bp, Artificial Sequence
  chemically synthesized
ggagaccagcctggccaaca

SEQ ID NO: 29425 - DNA, 20 bp, Artificial Sequence
  chemically synthesized
cggggtttcaccatgttggc

SEQ ID NO: 29426 - DNA, 20 bp, Artificial Sequence
  chemically synthesized
gagacggggtttcaccatgt

SEQ ID NO: 29427 - DNA, 20 bp, Artificial Sequence
  chemically synthesized
ttgtatttttagtggagacg

SEQ ID NO: 29428 - DNA, 20 bp, Artificial Sequence
  chemically synthesized
tttgtatttttagtggagac

SEQ ID NO: 29429 - DNA, 20 bp, Artificial Sequence
  chemically synthesized
ttttgtatttttagtggaga

SEQ ID NO: 29430 - DNA, 20 bp, Artificial Sequence
  chemically synthesized
taatttttgtatttttagtg

SEQ ID NO: 29431 - DNA, 20 bp, Artificial Sequence
  chemically synthesized
gttaatttttgtatttttag

SEQ ID NO: 29432 - DNA, 20 bp, Artificial Sequence
  chemically synthesized
ctggttaatttttgtatttt

SEQ ID NO: 29433 - DNA, 20 bp, Artificial Sequence
  chemically synthesized
ctaaaaatacaaaaattaac

SEQ ID NO: 29434 - DNA, 20 bp, Artificial Sequence
  chemically synthesized
taaaaatacaaaaattaacc

SEQ ID NO: 29435 - DNA, 20 bp, Artificial Sequence
  chemically synthesized
atacaaaaattaaccaggtg

SEQ ID NO: 29436 - DNA, 20 bp, Artificial Sequence
  chemically synthesized
caaaaattaaccaggtgtgg

SEQ ID NO: 29437 - DNA, 20 bp, Artificial Sequence
  chemically synthesized
caggcgtctgccaccacacc

SEQ ID NO: 29438 - DNA, 20 bp, Artificial Sequence
  chemically synthesized
aaattaaccaggtgtggtgg

SEQ ID NO: 29439 - DNA, 20 bp, Artificial Sequence
  chemically synthesized
gtggcagacgcctgtaatcc

SEQ ID NO: 29440 - DNA, 20 bp, Artificial Sequence
  chemically synthesized
tcctgagtagctgggattac

SEQ ID NO: 29441 - DNA, 20 bp, Artificial Sequence
  chemically synthesized
ctcctgagtagctgggatta

SEQ ID NO: 29442 - DNA, 20 bp, Artificial Sequence
  chemically synthesized
cgcctgtaatcccagctact

SEQ ID NO: 29443 - DNA, 20 bp, Artificial Sequence
  chemically synthesized
cctcagcctcctgagtagct

SEQ ID NO: 29444 - DNA, 20 bp, Artificial Sequence
  chemically synthesized
gcctgtaatcccagctactc

SEQ ID NO: 29445 - DNA, 20 bp, Artificial Sequence
  chemically synthesized
gcctcagcctcctgagtagc

SEQ ID NO: 29446 - DNA, 20 bp, Artificial Sequence
  chemically synthesized
ctgtaatcccagctactcag

SEQ ID NO: 29447 - DNA, 20 bp, Artificial Sequence
  chemically synthesized
tgtaatcccagctactcagg

SEQ ID NO: 29448 - DNA, 20 bp, Artificial Sequence
  chemically synthesized
tcctgcctcagcctcctgag

SEQ ID NO: 29449 - DNA, 20 bp, Artificial Sequence
  chemically synthesized
ttctcctgcctcagcctcct

SEQ ID NO: 29450 - DNA, 20 bp, Artificial Sequence
  chemically synthesized
tcccagctactcaggaggct

SEQ ID NO: 29451 - DNA, 20 bp, Artificial Sequence
  chemically synthesized
cccagctactcaggaggctg

SEQ ID NO: 29452 - DNA, 20 bp, Artificial Sequence
  chemically synthesized
agctactcaggaggctgagg

SEQ ID NO: 29453 - DNA, 20 bp, Artificial Sequence
  chemically synthesized
gctactcaggaggctgaggc

SEQ ID NO: 29454 - DNA, 20 bp, Artificial Sequence
  chemically synthesized
tactcaggaggctgaggcag

SEQ ID NO: 29455 - DNA, 20 bp, Artificial Sequence
  chemically synthesized
ttcaagcaattctcctgcct

SEQ ID NO: 29456 - DNA, 20 bp, Artificial Sequence
  chemically synthesized
gcaggagaattgcttgaacc

SEQ ID NO: 29457 - DNA, 20 bp, Artificial Sequence
  chemically synthesized
caggagaattgcttgaaccc

SEQ ID NO: 29458 - DNA, 20 bp, Artificial Sequence
  chemically synthesized
aacctccacctcccgggttc

SEQ ID NO: 29459 - DNA, 20 bp, Artificial Sequence
  chemically synthesized
ggagaattgcttgaacccgg

SEQ ID NO: 29460 - DNA, 20 bp, Artificial Sequence
  chemically synthesized
gagaattgcttgaacccggg

SEQ ID NO: 29461 - DNA, 20 bp, Artificial Sequence
  chemically synthesized
aattgcttgaacccgggagg

SEQ ID NO: 29462 - DNA, 20 bp, Artificial Sequence
  chemically synthesized
cactgcaacctccacctccc

SEQ ID NO: 29463 - DNA, 20 bp, Artificial Sequence
  chemically synthesized
ttgcttgaacccgggaggtg

SEQ ID NO: 29464 - DNA, 20 bp, Artificial Sequence
  chemically synthesized
tcactgcaacctccacctcc

SEQ ID NO: 29465 - DNA, 20 bp, Artificial Sequence
  chemically synthesized
tgcttgaacccgggaggtgg

SEQ ID NO: 29466 - DNA, 20 bp, Artificial Sequence
  chemically synthesized
aacccgggaggtggaggttg

SEQ ID NO: 29467 - DNA, 20 bp, Artificial Sequence
  chemically synthesized
cgggaggtggaggttgcagt

SEQ ID NO: 29468 - DNA, 20 bp, Artificial Sequence
  chemically synthesized
ggtggaggttgcagtgagcc

SEQ ID NO: 29469 - DNA, 20 bp, Artificial Sequence
  chemically synthesized
ggagtgcagtggtacgatct

SEQ ID NO: 29470 - DNA, 20 bp, Artificial Sequence
  chemically synthesized
tcacccaggctggagtgcag

SEQ ID NO: 29471 - DNA, 20 bp, Artificial Sequence
  chemically synthesized
aagatcgtaccactgcactc

SEQ ID NO: 29472 - DNA, 20 bp, Artificial Sequence
  chemically synthesized
ctgtcacccaggctggagtg

SEQ ID NO: 29473 - DNA, 20 bp, Artificial Sequence
  chemically synthesized
cgtaccactgcactccagcc

SEQ ID NO: 29474 - DNA, 20 bp, Artificial Sequence
  chemically synthesized
gtaccactgcactccagcct

SEQ ID NO: 29475 - DNA, 20 bp, Artificial Sequence
  chemically synthesized
ttgctctgtcacccaggctg

SEQ ID NO: 29476 - DNA, 20 bp, Artificial Sequence
  chemically synthesized
tcttgctctgtcacccaggc

SEQ ID NO: 29477 - DNA, 20 bp, Artificial Sequence
  chemically synthesized
ctgcactccagcctgggtga

SEQ ID NO: 29478 - DNA, 20 bp, Artificial Sequence
  chemically synthesized
ggagtcttgctctgtcaccc

SEQ ID NO: 29479 - DNA, 20 bp, Artificial Sequence
  chemically synthesized
gcactccagcctgggtgaca

SEQ ID NO: 29480 - DNA, 20 bp, Artificial Sequence
  chemically synthesized
cggagtcttgctctgtcacc

SEQ ID NO: 29481 - DNA, 20 bp, Artificial Sequence
  chemically synthesized
tccagcctgggtgacagagc

SEQ ID NO: 29482 - DNA, 20 bp, Artificial Sequence
  chemically synthesized
gacagagcaagactccgtct

SEQ ID NO: 29483 - DNA, 20 bp, Artificial Sequence
  chemically synthesized
ttttttttccttccaagacg

SEQ ID NO: 29484 - DNA, 20 bp, Artificial Sequence
  chemically synthesized
agagcaagactccgtcttgg

SEQ ID NO: 29485 - DNA, 20 bp, Artificial Sequence
  chemically synthesized
gagcaagactccgtcttgga

SEQ ID NO: 29486 - DNA, 20 bp, Artificial Sequence
  chemically synthesized
ttttttttttccttccaaga

SEQ ID NO: 29487 - DNA, 20 bp, Artificial Sequence
  chemically synthesized
ccttttttttttttccttcc

SEQ ID NO: 29488 - DNA, 20 bp, Artificial Sequence
  chemically synthesized
tcttggaaggaaaaaaaaaa

SEQ ID NO: 29489 - DNA, 20 bp, Artificial Sequence
  chemically synthesized
cttggaaggaaaaaaaaaaa

SEQ ID NO: 29490 - DNA, 20 bp, Artificial Sequence
  chemically synthesized
tttatacagcacaggcaaag

SEQ ID NO: 29491 - DNA, 20 bp, Artificial Sequence
  chemically synthesized
ccatttatacagcacaggca

SEQ ID NO: 29492 - DNA, 20 bp, Artificial Sequence
  chemically synthesized
tttttccatttatacagcac

SEQ ID NO: 29493 - DNA, 20 bp, Artificial Sequence
  chemically synthesized
gtttttccatttatacagca

SEQ ID NO: 29494 - DNA, 20 bp, Artificial Sequence
  chemically synthesized
ctttgcctgtgctgtataaa

SEQ ID NO: 29495 - DNA, 20 bp, Artificial Sequence
  chemically synthesized
gctttgtttttccatttata

SEQ ID NO: 29496 - DNA, 20 bp, Artificial Sequence
  chemically synthesized
gctgtataaatggaaaaaca

SEQ ID NO: 29497 - DNA, 20 bp, Artificial Sequence
  chemically synthesized
ataaatggaaaaacaaagct

SEQ ID NO: 29498 - DNA, 20 bp, Artificial Sequence
  chemically synthesized
gaaaaacaaagcttggatga

SEQ ID NO: 29499 - DNA, 20 bp, Artificial Sequence
  chemically synthesized
aaacagatacgctgtcatcc

SEQ ID NO: 29500 - DNA, 20 bp, Artificial Sequence
  chemically synthesized
gatgacagcgtatctgttta

SEQ ID NO: 29501 - DNA, 20 bp, Artificial Sequence
  chemically synthesized
tcagtaaaccatgccgtaaa

SEQ ID NO: 29502 - DNA, 20 bp, Artificial Sequence
  chemically synthesized
cagcgtatctgtttacggca

SEQ ID NO: 29503 - DNA, 20 bp, Artificial Sequence
  chemically synthesized
tacagtgagcttgaaatatt

SEQ ID NO: 29504 - DNA, 20 bp, Artificial Sequence
  chemically synthesized
catggtttactgaatatttc

SEQ ID NO: 29505 - DNA, 20 bp, Artificial Sequence
  chemically synthesized
gaatatttcaagctcactgt

SEQ ID NO: 29506 - DNA, 20 bp, Artificial Sequence
  chemically synthesized
tgaacactaggtcttacagt

SEQ ID NO: 29507 - DNA, 20 bp, Artificial Sequence
  chemically synthesized
ttcaagctcactgtaagacc

SEQ ID NO: 29508 - DNA, 20 bp, Artificial Sequence
  chemically synthesized
attttgaacactaggtctta

SEQ ID NO: 29509 - DNA, 20 bp, Artificial Sequence
  chemically synthesized
ggaaacctattttgaacact

SEQ ID NO: 29510 - DNA, 20 bp, Artificial Sequence
  chemically synthesized
aggaaacctattttgaacac

SEQ ID NO: 29511 - DNA, 20 bp, Artificial Sequence
  chemically synthesized
gtaagacctagtgttcaaaa

SEQ ID NO: 29512 - DNA, 20 bp, Artificial Sequence
  chemically synthesized
taagacctagtgttcaaaat

SEQ ID NO: 29513 - DNA, 20 bp, Artificial Sequence
  chemically synthesized
gtgagcagttatattttgaa

SEQ ID NO: 29514 - DNA, 20 bp, Artificial Sequence
  chemically synthesized
agtgagcagttatattttga

SEQ ID NO: 29515 - DNA, 20 bp, Artificial Sequence
  chemically synthesized
caaggtgcattgtcagtgag

SEQ ID NO: 29516 - DNA, 20 bp, Artificial Sequence
  chemically synthesized
tgacaaggtgcattgtcagt

SEQ ID NO: 29517 - DNA, 20 bp, Artificial Sequence
  chemically synthesized
tgggtgacaaggtgcattgt

SEQ ID NO: 29518 - DNA, 20 bp, Artificial Sequence
  chemically synthesized
atccaagcttttgggtgaca

SEQ ID NO: 29519 - DNA, 20 bp, Artificial Sequence
  chemically synthesized
catccaagcttttgggtgac

SEQ ID NO: 29520 - DNA, 20 bp, Artificial Sequence
  chemically synthesized
caatgcaccttgtcacccaa

SEQ ID NO: 29521 - DNA, 20 bp, Artificial Sequence
  chemically synthesized
caccttgtcacccaaaagct

SEQ ID NO: 29522 - DNA, 20 bp, Artificial Sequence
  chemically synthesized
acatctccatccaagctttt

SEQ ID NO: 29523 - DNA, 20 bp, Artificial Sequence
  chemically synthesized
tacatctccatccaagcttt

SEQ ID NO: 29524 - DNA, 20 bp, Artificial Sequence
  chemically synthesized
ttgtcacccaaaagcttgga

SEQ ID NO: 29525 - DNA, 20 bp, Artificial Sequence
  chemically synthesized
gtcacccaaaagcttggatg

SEQ ID NO: 29526 - DNA, 20 bp, Artificial Sequence
  chemically synthesized
ctctttgtacatctccatcc

SEQ ID NO: 29527 - DNA, 20 bp, Artificial Sequence
  chemically synthesized
agcttggatggagatgtaca

SEQ ID NO: 29528 - DNA, 20 bp, Artificial Sequence
  chemically synthesized
cttggatggagatgtacaaa

SEQ ID NO: 29529 - DNA, 20 bp, Artificial Sequence
  chemically synthesized
agaatggatgttgtgtaagc

SEQ ID NO: 29530 - DNA, 20 bp, Artificial Sequence
  chemically synthesized
cagaatggatgttgtgtaag

SEQ ID NO: 29531 - DNA, 20 bp, Artificial Sequence
  chemically synthesized
ctacagaatggatgttgtgt

SEQ ID NO: 29532 - DNA, 20 bp, Artificial Sequence
  chemically synthesized
cttacacaacatccattctg

SEQ ID NO: 29533 - DNA, 20 bp, Artificial Sequence
  chemically synthesized
ttaatccttgggctacagaa

SEQ ID NO: 29534 - DNA, 20 bp, Artificial Sequence
  chemically synthesized
caacatccattctgtagccc

SEQ ID NO: 29535 - DNA, 20 bp, Artificial Sequence
  chemically synthesized
aacatccattctgtagccca

SEQ ID NO: 29536 - DNA, 20 bp, Artificial Sequence
  chemically synthesized
ttttcttaatccttgggcta

SEQ ID NO: 29537 - DNA, 20 bp, Artificial Sequence
  chemically synthesized
cattctgtagcccaaggatt

SEQ ID NO: 29538 - DNA, 20 bp, Artificial Sequence
  chemically synthesized
acaattttttcttaatcctt

SEQ ID NO: 29539 - DNA, 20 bp, Artificial Sequence
  chemically synthesized
cacaattttttcttaatcct

SEQ ID NO: 29540 - DNA, 20 bp, Artificial Sequence
  chemically synthesized
tctcaactaataagagttga

SEQ ID NO: 29541 - DNA, 20 bp, Artificial Sequence
  chemically synthesized
ttgtgactttcaactcttat

SEQ ID NO: 29542 - DNA, 20 bp, Artificial Sequence
  chemically synthesized
aaatatttctcaactaataa

SEQ ID NO: 29543 - DNA, 20 bp, Artificial Sequence
  chemically synthesized
actttcaactcttattagtt

SEQ ID NO: 29544 - DNA, 20 bp, Artificial Sequence
  chemically synthesized
caaaatatttctcaactaat

SEQ ID NO: 29545 - DNA, 20 bp, Artificial Sequence
  chemically synthesized
ttagttgagaaatattttgt

SEQ ID NO: 29546 - DNA, 20 bp, Artificial Sequence
  chemically synthesized
tagttgagaaatattttgta

SEQ ID NO: 29547 - DNA, 20 bp, Artificial Sequence
  chemically synthesized
agaaatattttgtaaggcta

SEQ ID NO: 29548 - DNA, 20 bp, Artificial Sequence
  chemically synthesized
tcactgtctatgtcaagcta

SEQ ID NO: 29549 - DNA, 20 bp, Artificial Sequence
  chemically synthesized
tgtaaggctatagcttgaca

SEQ ID NO: 29550 - DNA, 20 bp, Artificial Sequence
  chemically synthesized
gaggaatcactgtctatgtc

SEQ ID NO: 29551 - DNA, 20 bp, Artificial Sequence
  chemically synthesized
aggctatagcttgacataga

SEQ ID NO: 29552 - DNA, 20 bp, Artificial Sequence
  chemically synthesized
atagacagtgattcctctga

SEQ ID NO: 29553 - DNA, 20 bp, Artificial Sequence
  chemically synthesized
actttgcccagatccatcag

SEQ ID NO: 29554 - DNA, 20 bp, Artificial Sequence
  chemically synthesized
tactttgcccagatccatca

SEQ ID NO: 29555 - DNA, 20 bp, Artificial Sequence
  chemically synthesized
agtgattcctctgatggatc

SEQ ID NO: 29556 - DNA, 20 bp, Artificial Sequence
  chemically synthesized
tttactttgcccagatccat

SEQ ID NO: 29557 - DNA, 20 bp, Artificial Sequence
  chemically synthesized
gtgattcctctgatggatct

SEQ ID NO: 29558 - DNA, 20 bp, Artificial Sequence
  chemically synthesized
tcctctgatggatctgggca

SEQ ID NO: 29559 - DNA, 20 bp, Artificial Sequence
  chemically synthesized
gattttccatttactttgcc

SEQ ID NO: 29560 - DNA, 20 bp, Artificial Sequence
  chemically synthesized
atggatctgggcaaagtaaa

SEQ ID NO: 29561 - DNA, 20 bp, Artificial Sequence
  chemically synthesized
caaagtaaatggaaaatctc

SEQ ID NO: 29562 - DNA, 20 bp, Artificial Sequence
  chemically synthesized
agtaaatggaaaatctctgg

SEQ ID NO: 29563 - DNA, 20 bp, Artificial Sequence
  chemically synthesized
aatggaaaatctctggaagt

SEQ ID NO: 29564 - DNA, 20 bp, Artificial Sequence
  chemically synthesized
gccaccacacctgacttcca

SEQ ID NO: 29565 - DNA, 20 bp, Artificial Sequence
  chemically synthesized
atggaaaatctctggaagtc

SEQ ID NO: 29566 - DNA, 20 bp, Artificial Sequence
  chemically synthesized
gagccaccacacctgacttc

SEQ ID NO: 29567 - DNA, 20 bp, Artificial Sequence
  chemically synthesized
aaatctctggaagtcaggtg

SEQ ID NO: 29568 - DNA, 20 bp, Artificial Sequence
  chemically synthesized
tctctggaagtcaggtgtgg

SEQ ID NO: 29569 - DNA, 20 bp, Artificial Sequence
  chemically synthesized
aagtcaggtgtggtggctca

SEQ ID NO: 29570 - DNA, 20 bp, Artificial Sequence
  chemically synthesized
agtgctgggattacagccgt

SEQ ID NO: 29571 - DNA, 20 bp, Artificial Sequence
  chemically synthesized
gtggctcacggctgtaatcc

SEQ ID NO: 29572 - DNA, 20 bp, Artificial Sequence
  chemically synthesized
ctcccaaagtgctgggatta

SEQ ID NO: 29573 - DNA, 20 bp, Artificial Sequence
  chemically synthesized
cggctgtaatcccagcactt

SEQ ID NO: 29574 - DNA, 20 bp, Artificial Sequence
  chemically synthesized
cctcggcctcccaaagtgct

SEQ ID NO: 29575 - DNA, 20 bp, Artificial Sequence
  chemically synthesized
ggctgtaatcccagcacttt

SEQ ID NO: 29576 - DNA, 20 bp, Artificial Sequence
  chemically synthesized
gcctcggcctcccaaagtgc

SEQ ID NO: 29577 - DNA, 20 bp, Artificial Sequence
  chemically synthesized
ctgtaatcccagcactttgg

SEQ ID NO: 29578 - DNA, 20 bp, Artificial Sequence
  chemically synthesized
tgtaatcccagcactttggg

SEQ ID NO: 29579 - DNA, 20 bp, Artificial Sequence
  chemically synthesized
ccacctgcctcggcctccca

SEQ ID NO: 29580 - DNA, 20 bp, Artificial Sequence
  chemically synthesized
tcccagcactttgggaggcc

SEQ ID NO: 29581 - DNA, 20 bp, Artificial Sequence
  chemically synthesized
cccagcactttgggaggccg

SEQ ID NO: 29582 - DNA, 20 bp, Artificial Sequence
  chemically synthesized
agcactttgggaggccgagg

SEQ ID NO: 29583 - DNA, 20 bp, Artificial Sequence
  chemically synthesized
gcactttgggaggccgaggc

SEQ ID NO: 29584 - DNA, 20 bp, Artificial Sequence
  chemically synthesized
ctttgggaggccgaggcagg

SEQ ID NO: 29585 - DNA, 20 bp, Artificial Sequence
  chemically synthesized
acctcatgatccacctgcct

SEQ ID NO: 29586 - DNA, 20 bp, Artificial Sequence
  chemically synthesized
ggccgaggcaggtggatcat

SEQ ID NO: 29587 - DNA, 20 bp, Artificial Sequence
  chemically synthesized
gccgaggcaggtggatcatg

SEQ ID NO: 29588 - DNA, 20 bp, Artificial Sequence
  chemically synthesized
aggcaggtggatcatgaggt

SEQ ID NO: 29589 - DNA, 20 bp, Artificial Sequence
  chemically synthesized
ggcaggtggatcatgaggtc

SEQ ID NO: 29590 - DNA, 20 bp, Artificial Sequence
  chemically synthesized
caggtggatcatgaggtcag

SEQ ID NO: 29591 - DNA, 20 bp, Artificial Sequence
  chemically synthesized
gatcatgaggtcaggagttt

SEQ ID NO: 29592 - DNA, 20 bp, Artificial Sequence
  chemically synthesized
tgaggtcaggagtttgagac

SEQ ID NO: 29593 - DNA, 20 bp, Artificial Sequence
  chemically synthesized
tcaggagtttgagaccagcc

SEQ ID NO: 29594 - DNA, 20 bp, Artificial Sequence
  chemically synthesized
tttcaccattttggccaggc

SEQ ID NO: 29595 - DNA, 20 bp, Artificial Sequence
  chemically synthesized
ggggtttcaccattttggcc

SEQ ID NO: 29596 - DNA, 20 bp, Artificial Sequence
  chemically synthesized
tgagaccagcctggccaaaa

SEQ ID NO: 29597 - DNA, 20 bp, Artificial Sequence
  chemically synthesized
cggggtttcaccattttggc

SEQ ID NO: 29598 - DNA, 20 bp, Artificial Sequence
  chemically synthesized
gagacggggtttcaccattt

SEQ ID NO: 29599 - DNA, 20 bp, Artificial Sequence
  chemically synthesized
ttgtatttttagtagagacg

SEQ ID NO: 29600 - DNA, 20 bp, Artificial Sequence
  chemically synthesized
tttgtatttttagtagagac

SEQ ID NO: 29601 - DNA, 20 bp, Artificial Sequence
  chemically synthesized
ttttgtatttttagtagaga

SEQ ID NO: 29602 - DNA, 20 bp, Artificial Sequence
  chemically synthesized
taatttttgtatttttagta

SEQ ID NO: 29603 - DNA, 20 bp, Artificial Sequence
  chemically synthesized
gctaatttttgtatttttag

SEQ ID NO: 29604 - DNA, 20 bp, Artificial Sequence
  chemically synthesized
ccggctaatttttgtatttt

SEQ ID NO: 29605 - DNA, 20 bp, Artificial Sequence
  chemically synthesized
tctactaaaaatacaaaaat

SEQ ID NO: 29606 - DNA, 20 bp, Artificial Sequence
  chemically synthesized
ctaaaaatacaaaaattagc

SEQ ID NO: 29607 - DNA, 20 bp, Artificial Sequence
  chemically synthesized
taaaaatacaaaaattagcc

SEQ ID NO: 29608 - DNA, 20 bp, Artificial Sequence
  chemically synthesized
atacaaaaattagccgggcg

SEQ ID NO: 29609 - DNA, 20 bp, Artificial Sequence
  chemically synthesized
caaaaattagccgggcgtag

SEQ ID NO: 29610 - DNA, 20 bp, Artificial Sequence
  chemically synthesized
caggcgtgtgccactacgcc

SEQ ID NO: 29611 - DNA, 20 bp, Artificial Sequence
  chemically synthesized
ggcgtagtggcacacgcctg

SEQ ID NO: 29612 - DNA, 20 bp, Artificial Sequence
  chemically synthesized
gtggcacacgcctgtagtcc

SEQ ID NO: 29613 - DNA, 20 bp, Artificial Sequence
  chemically synthesized
tcccgagtagctgggactac

SEQ ID NO: 29614 - DNA, 20 bp, Artificial Sequence
  chemically synthesized
ttcccgagtagctgggacta

SEQ ID NO: 29615 - DNA, 20 bp, Artificial Sequence
  chemically synthesized
cgcctgtagtcccagctact

SEQ ID NO: 29616 - DNA, 20 bp, Artificial Sequence
  chemically synthesized
cctcagcttcccgagtagct

SEQ ID NO: 29617 - DNA, 20 bp, Artificial Sequence
  chemically synthesized
gcctgtagtcccagctactc

SEQ ID NO: 29618 - DNA, 20 bp, Artificial Sequence
  chemically synthesized
gcctcagcttcccgagtagc

SEQ ID NO: 29619 - DNA, 20 bp, Artificial Sequence
  chemically synthesized
tgtagtcccagctactcggg

SEQ ID NO: 29620 - DNA, 20 bp, Artificial Sequence
  chemically synthesized
ttctgcctcagcttcccgag

SEQ ID NO: 29621 - DNA, 20 bp, Artificial Sequence
  chemically synthesized
ttcttctgcctcagcttccc

SEQ ID NO: 29622 - DNA, 20 bp, Artificial Sequence
  chemically synthesized
tcccagctactcgggaagct

SEQ ID NO: 29623 - DNA, 20 bp, Artificial Sequence
  chemically synthesized
cccagctactcgggaagctg

SEQ ID NO: 29624 - DNA, 20 bp, Artificial Sequence
  chemically synthesized
agctactcgggaagctgagg

SEQ ID NO: 29625 - DNA, 20 bp, Artificial Sequence
  chemically synthesized
tactcgggaagctgaggcag

SEQ ID NO: 29626 - DNA, 20 bp, Artificial Sequence
  chemically synthesized
ttcaagtgattcttctgcct

SEQ ID NO: 29627 - DNA, 20 bp, Artificial Sequence
  chemically synthesized
gcagaagaatcacttgaacc

SEQ ID NO: 29628 - DNA, 20 bp, Artificial Sequence
  chemically synthesized
cagaagaatcacttgaaccc

SEQ ID NO: 29629 - DNA, 20 bp, Artificial Sequence
  chemically synthesized
acctctgccttcctgggttc

SEQ ID NO: 29630 - DNA, 20 bp, Artificial Sequence
  chemically synthesized
aagaatcacttgaacccagg

SEQ ID NO: 29631 - DNA, 20 bp, Artificial Sequence
  chemically synthesized
agaatcacttgaacccagga

SEQ ID NO: 29632 - DNA, 20 bp, Artificial Sequence
  chemically synthesized
atcacttgaacccaggaagg

SEQ ID NO: 29633 - DNA, 20 bp, Artificial Sequence
  chemically synthesized
actgcaacctctgccttcct

SEQ ID NO: 29634 - DNA, 20 bp, Artificial Sequence
  chemically synthesized
cactgcaacctctgccttcc

SEQ ID NO: 29635 - DNA, 20 bp, Artificial Sequence
  chemically synthesized
cacttgaacccaggaaggca

SEQ ID NO: 29636 - DNA, 20 bp, Artificial Sequence
  chemically synthesized
acttgaacccaggaaggcag

SEQ ID NO: 29637 - DNA, 20 bp, Artificial Sequence
  chemically synthesized
acccaggaaggcagaggttg

SEQ ID NO: 29638 - DNA, 20 bp, Artificial Sequence
  chemically synthesized
aggaaggcagaggttgcagt

SEQ ID NO: 29639 - DNA, 20 bp, Artificial Sequence
  chemically synthesized
ggcagaggttgcagtgagcc

SEQ ID NO: 29640 - DNA, 20 bp, Artificial Sequence
  chemically synthesized
ggagtgcagtggcgtgatct

SEQ ID NO: 29641 - DNA, 20 bp, Artificial Sequence
  chemically synthesized
tggagtgcagtggcgtgatc

SEQ ID NO: 29642 - DNA, 20 bp, Artificial Sequence
  chemically synthesized
ttgtccaggctggagtgcag

SEQ ID NO: 29643 - DNA, 20 bp, Artificial Sequence
  chemically synthesized
tagatcacgccactgcactc

SEQ ID NO: 29644 - DNA, 20 bp, Artificial Sequence
  chemically synthesized
atgttgtccaggctggagtg

SEQ ID NO: 29645 - DNA, 20 bp, Artificial Sequence
  chemically synthesized
cacgccactgcactccagcc

SEQ ID NO: 29646 - DNA, 20 bp, Artificial Sequence
  chemically synthesized
ttgctatgttgtccaggctg

SEQ ID NO: 29647 - DNA, 20 bp, Artificial Sequence
  chemically synthesized
tcttgctatgttgtccaggc

SEQ ID NO: 29648 - DNA, 20 bp, Artificial Sequence
  chemically synthesized
acagtcttgctatgttgtcc

SEQ ID NO: 29649 - DNA, 20 bp, Artificial Sequence
  chemically synthesized
gcactccagcctggacaaca

SEQ ID NO: 29650 - DNA, 20 bp, Artificial Sequence
  chemically synthesized
cacagtcttgctatgttgtc

SEQ ID NO: 29651 - DNA, 20 bp, Artificial Sequence
  chemically synthesized
tccagcctggacaacatagc

SEQ ID NO: 29652 - DNA, 20 bp, Artificial Sequence
  chemically synthesized
ttttttttttttttgagaca

SEQ ID NO: 29653 - DNA, 20 bp, Artificial Sequence
  chemically synthesized
tttttttttttttttttttt

SEQ ID NO: 29654 - DNA, 20 bp, Artificial Sequence
  chemically synthesized
aaaaaaaaaaaaaaaatctc

SEQ ID NO: 29655 - DNA, 20 bp, Artificial Sequence
  chemically synthesized
aaaaaaaaaaaaatctctgg

SEQ ID NO: 29656 - DNA, 20 bp, Artificial Sequence
  chemically synthesized
ggcatcaagaatcacttcca

SEQ ID NO: 29657 - DNA, 20 bp, Artificial Sequence
  chemically synthesized
atggcatcaagaatcacttc

SEQ ID NO: 29658 - DNA, 20 bp, Artificial Sequence
  chemically synthesized
caaatgttcttaatggcatc

SEQ ID NO: 29659 - DNA, 20 bp, Artificial Sequence
  chemically synthesized
aagtgattcttgatgccatt

SEQ ID NO: 29660 - DNA, 20 bp, Artificial Sequence
  chemically synthesized
tcaatcacaaatgttcttaa

SEQ ID NO: 29661 - DNA, 20 bp, Artificial Sequence
  chemically synthesized
ttaagaacatttgtgattga

SEQ ID NO: 29662 - DNA, 20 bp, Artificial Sequence
  chemically synthesized
taagaacatttgtgattgat

SEQ ID NO: 29663 - DNA, 20 bp, Artificial Sequence
  chemically synthesized
agaacatttgtgattgatag

SEQ ID NO: 29664 - DNA, 20 bp, Artificial Sequence
  chemically synthesized
gaacatttgtgattgatagg

SEQ ID NO: 29665 - DNA, 20 bp, Artificial Sequence
  chemically synthesized
cgtcaaaatatcaacattac

SEQ ID NO: 29666 - DNA, 20 bp, Artificial Sequence
  chemically synthesized
gtcaaaatatcaacattacc

SEQ ID NO: 29667 - DNA, 20 bp, Artificial Sequence
  chemically synthesized
caaaatatcaacattaccag

SEQ ID NO: 29668 - DNA, 20 bp, Artificial Sequence
  chemically synthesized
tatcaacattaccaggagtt

SEQ ID NO: 29669 - DNA, 20 bp, Artificial Sequence
  chemically synthesized
atcaacgtcttccaaactcc

SEQ ID NO: 29670 - DNA, 20 bp, Artificial Sequence
  chemically synthesized
caacattaccaggagtttgg

SEQ ID NO: 29671 - DNA, 20 bp, Artificial Sequence
  chemically synthesized
gacgttgattccaaccctca

SEQ ID NO: 29672 - DNA, 20 bp, Artificial Sequence
  chemically synthesized
tgacagtcatccatgagggt

SEQ ID NO: 29673 - DNA, 20 bp, Artificial Sequence
  chemically synthesized
cccctgacagtcatccatga

SEQ ID NO: 29674 - DNA, 20 bp, Artificial Sequence
  chemically synthesized
acccctgacagtcatccatg

SEQ ID NO: 29675 - DNA, 20 bp, Artificial Sequence
  chemically synthesized
aacccctgacagtcatccat

SEQ ID NO: 29676 - DNA, 20 bp, Artificial Sequence
  chemically synthesized
caaccctcatggatgactgt

SEQ ID NO: 29677 - DNA, 20 bp, Artificial Sequence
  chemically synthesized
aaccctcatggatgactgtc

SEQ ID NO: 29678 - DNA, 20 bp, Artificial Sequence
  chemically synthesized
accctcatggatgactgtca

SEQ ID NO: 29679 - DNA, 20 bp, Artificial Sequence
  chemically synthesized
ccctcatggatgactgtcag

SEQ ID NO: 29680 - DNA, 20 bp, Artificial Sequence
  chemically synthesized
ctgaagtcttgaacccctga

SEQ ID NO: 29681 - DNA, 20 bp, Artificial Sequence
  chemically synthesized
tggatgactgtcaggggttc

SEQ ID NO: 29682 - DNA, 20 bp, Artificial Sequence
  chemically synthesized
ctgtcaggggttcaagactt

SEQ ID NO: 29683 - DNA, 20 bp, Artificial Sequence
  chemically synthesized
tcaggggttcaagacttcag

SEQ ID NO: 29684 - DNA, 20 bp, Artificial Sequence
  chemically synthesized
aggggttcaagacttcagtg

SEQ ID NO: 29685 - DNA, 20 bp, Artificial Sequence
  chemically synthesized
ggggttcaagacttcagtgg

SEQ ID NO: 29686 - DNA, 20 bp, Artificial Sequence
  chemically synthesized
tgcagttacatcctccactg

SEQ ID NO: 29687 - DNA, 20 bp, Artificial Sequence
  chemically synthesized
ttcagtggaggatgtaactg

SEQ ID NO: 29688 - DNA, 20 bp, Artificial Sequence
  chemically synthesized
ggaggatgtaactgcagatg

SEQ ID NO: 29689 - DNA, 20 bp, Artificial Sequence
  chemically synthesized
tcctgtttccactacatctg

SEQ ID NO: 29690 - DNA, 20 bp, Artificial Sequence
  chemically synthesized
ggatgtaactgcagatgtag

SEQ ID NO: 29691 - DNA, 20 bp, Artificial Sequence
  chemically synthesized
aactgcagatgtagtggaaa

SEQ ID NO: 29692 - DNA, 20 bp, Artificial Sequence
  chemically synthesized
actgcagatgtagtggaaac

SEQ ID NO: 29693 - DNA, 20 bp, Artificial Sequence
  chemically synthesized
gcagatgtagtggaaacagg

SEQ ID NO: 29694 - DNA, 20 bp, Artificial Sequence
  chemically synthesized
aggaagaaaattgaaatcac

SEQ ID NO: 29695 - DNA, 20 bp, Artificial Sequence
  chemically synthesized
aagaaaattgaaatcacaag

SEQ ID NO: 29696 - DNA, 20 bp, Artificial Sequence
  chemically synthesized
agaaaattgaaatcacaagt

SEQ ID NO: 29697 - DNA, 20 bp, Artificial Sequence
  chemically synthesized
gaaaattgaaatcacaagtg

SEQ ID NO: 29698 - DNA, 20 bp, Artificial Sequence
  chemically synthesized
gaaatcacaagtggggcgtg

SEQ ID NO: 29699 - DNA, 20 bp, Artificial Sequence
  chemically synthesized
acaagtggggcgtgaagata

SEQ ID NO: 29700 - DNA, 20 bp, Artificial Sequence
  chemically synthesized
atcatgaaattgcagcaatt

SEQ ID NO: 29701 - DNA, 20 bp, Artificial Sequence
  chemically synthesized
aaagtttgatcatgaaattg

SEQ ID NO: 29702 - DNA, 20 bp, Artificial Sequence
  chemically synthesized
atttcatgatcaaactttaa

SEQ ID NO: 29703 - DNA, 20 bp, Artificial Sequence
  chemically synthesized
catgatcaaactttaatgga

SEQ ID NO: 29704 - DNA, 20 bp, Artificial Sequence
  chemically synthesized
tagcaactccctatccatta

SEQ ID NO: 29705 - DNA, 20 bp, Artificial Sequence
  chemically synthesized
atgatcaaactttaatggat

SEQ ID NO: 29706 - DNA, 20 bp, Artificial Sequence
  chemically synthesized
tgatcaaactttaatggata

SEQ ID NO: 29707 - DNA, 20 bp, Artificial Sequence
  chemically synthesized
atcaaactttaatggatagg

SEQ ID NO: 29708 - DNA, 20 bp, Artificial Sequence
  chemically synthesized
ggatagggagttgctactta

SEQ ID NO: 29709 - DNA, 20 bp, Artificial Sequence
  chemically synthesized
ttactttgctcatccataag

SEQ ID NO: 29710 - DNA, 20 bp, Artificial Sequence
  chemically synthesized
gggagttgctacttatggat

SEQ ID NO: 29711 - DNA, 20 bp, Artificial Sequence
  chemically synthesized
cacttactttgctcatccat

SEQ ID NO: 29712 - DNA, 20 bp, Artificial Sequence
  chemically synthesized
ttgctacttatggatgagca

SEQ ID NO: 29713 - DNA, 20 bp, Artificial Sequence
  chemically synthesized
tacttatggatgagcaaagt

SEQ ID NO: 29714 - DNA, 20 bp, Artificial Sequence
  chemically synthesized
ttatggatgagcaaagtaag

SEQ ID NO: 29715 - DNA, 20 bp, Artificial Sequence
  chemically synthesized
agcaaagtaagtggtttcat

SEQ ID NO: 29716 - DNA, 20 bp, Artificial Sequence
  chemically synthesized
aagtaagtggtttcatgaga

SEQ ID NO: 29717 - DNA, 20 bp, Artificial Sequence
  chemically synthesized
tgagatagtatcacattcta

SEQ ID NO: 29718 - DNA, 20 bp, Artificial Sequence
  chemically synthesized
agatagtatcacattctaca

SEQ ID NO: 29719 - DNA, 20 bp, Artificial Sequence
  chemically synthesized
ttttgtgaaagatttctctg

SEQ ID NO: 29720 - DNA, 20 bp, Artificial Sequence
  chemically synthesized
tacagagaaatctttcacaa

SEQ ID NO: 29721 - DNA, 20 bp, Artificial Sequence
  chemically synthesized
acagagaaatctttcacaaa

SEQ ID NO: 29722 - DNA, 20 bp, Artificial Sequence
  chemically synthesized
gttgactcttccttttgtga

SEQ ID NO: 29723 - DNA, 20 bp, Artificial Sequence
  chemically synthesized
gagaaatctttcacaaaagg

SEQ ID NO: 29724 - DNA, 20 bp, Artificial Sequence
  chemically synthesized
gaaatctttcacaaaaggaa

SEQ ID NO: 29725 - DNA, 20 bp, Artificial Sequence
  chemically synthesized
cacaaaaggaagagtcaact

SEQ ID NO: 29726 - DNA, 20 bp, Artificial Sequence
  chemically synthesized
aaaaggaagagtcaactgag

SEQ ID NO: 29727 - DNA, 20 bp, Artificial Sequence
  chemically synthesized
aggaagagtcaactgagtgg

SEQ ID NO: 29728 - DNA, 20 bp, Artificial Sequence
  chemically synthesized
caacaatgaagactgccact

SEQ ID NO: 29729 - DNA, 20 bp, Artificial Sequence
  chemically synthesized
cttaaaataagacaacaatg

SEQ ID NO: 29730 - DNA, 20 bp, Artificial Sequence
  chemically synthesized
cttcattgttgtcttatttt

SEQ ID NO: 29731 - DNA, 20 bp, Artificial Sequence
  chemically synthesized
ctgtggcaatttcttaaaat

SEQ ID NO: 29732 - DNA, 20 bp, Artificial Sequence
  chemically synthesized
cttattttaagaaattgcca

SEQ ID NO: 29733 - DNA, 20 bp, Artificial Sequence
  chemically synthesized
gctgaaggttggggtggctg

SEQ ID NO: 29734 - DNA, 20 bp, Artificial Sequence
  chemically synthesized
gtggttgctgaaggttgggg

SEQ ID NO: 29735 - DNA, 20 bp, Artificial Sequence
  chemically synthesized
gccacagccaccccaacctt

SEQ ID NO: 29736 - DNA, 20 bp, Artificial Sequence
  chemically synthesized
atggtggttgctgaaggttg

SEQ ID NO: 29737 - DNA, 20 bp, Artificial Sequence
  chemically synthesized
catggtggttgctgaaggtt

SEQ ID NO: 29738 - DNA, 20 bp, Artificial Sequence
  chemically synthesized
gcatggtggttgctgaaggt

SEQ ID NO: 29739 - DNA, 20 bp, Artificial Sequence
  chemically synthesized
cacagcatggtggttgctga

SEQ ID NO: 29740 - DNA, 20 bp, Artificial Sequence
  chemically synthesized
gcacagcatggtggttgctg

SEQ ID NO: 29741 - DNA, 20 bp, Artificial Sequence
  chemically synthesized
ttgatggctgcacagcatgg

SEQ ID NO: 29742 - DNA, 20 bp, Artificial Sequence
  chemically synthesized
tcagcaaccaccatgctgtg

SEQ ID NO: 29743 - DNA, 20 bp, Artificial Sequence
  chemically synthesized
atgttgatggctgcacagca

SEQ ID NO: 29744 - DNA, 20 bp, Artificial Sequence
  chemically synthesized
cctcgatgttgatggctgca

SEQ ID NO: 29745 - DNA, 20 bp, Artificial Sequence
  chemically synthesized
gggtcttgcctcgatgttga

SEQ ID NO: 29746 - DNA, 20 bp, Artificial Sequence
  chemically synthesized
gctgtgcagccatcaacatc

SEQ ID NO: 29747 - DNA, 20 bp, Artificial Sequence
  chemically synthesized
ctgtgcagccatcaacatcg

SEQ ID NO: 29748 - DNA, 20 bp, Artificial Sequence
  chemically synthesized
gcagccatcaacatcgaggc

SEQ ID NO: 29749 - DNA, 20 bp, Artificial Sequence
  chemically synthesized
atcgaggcaagaccctccac

SEQ ID NO: 29750 - DNA, 20 bp, Artificial Sequence
  chemically synthesized
atgatccttttgctggtgga

SEQ ID NO: 29751 - DNA, 20 bp, Artificial Sequence
  chemically synthesized
aatgatccttttgctggtgg

SEQ ID NO: 29752 - DNA, 20 bp, Artificial Sequence
  chemically synthesized
taatgatccttttgctggtg

SEQ ID NO: 29753 - DNA, 20 bp, Artificial Sequence
  chemically synthesized
gcaagaccctccaccagcaa

SEQ ID NO: 29754 - DNA, 20 bp, Artificial Sequence
  chemically synthesized
agtaatgatccttttgctgg

SEQ ID NO: 29755 - DNA, 20 bp, Artificial Sequence
  chemically synthesized
caagaccctccaccagcaaa

SEQ ID NO: 29756 - DNA, 20 bp, Artificial Sequence
  chemically synthesized
gccagtaatgatccttttgc

SEQ ID NO: 29757 - DNA, 20 bp, Artificial Sequence
  chemically synthesized
accagcaaaaggatcattac

SEQ ID NO: 29758 - DNA, 20 bp, Artificial Sequence
  chemically synthesized
aaaaggatcattactggctg

SEQ ID NO: 29759 - DNA, 20 bp, Artificial Sequence
  chemically synthesized
aaaggatcattactggctga

SEQ ID NO: 29760 - DNA, 20 bp, Artificial Sequence
  chemically synthesized
cgatcacctgagccttcagc

SEQ ID NO: 29761 - DNA, 20 bp, Artificial Sequence
  chemically synthesized
atcattactggctgaaggct

SEQ ID NO: 29762 - DNA, 20 bp, Artificial Sequence
  chemically synthesized
tcattactggctgaaggctc

SEQ ID NO: 29763 - DNA, 20 bp, Artificial Sequence
  chemically synthesized
ctaacgatcacctgagcctt

SEQ ID NO: 29764 - DNA, 20 bp, Artificial Sequence
  chemically synthesized
aaaaaagctaacgatcacct

SEQ ID NO: 29765 - DNA, 20 bp, Artificial Sequence
  chemically synthesized
ctgaaggctcaggtgatcgt

SEQ ID NO: 29766 - DNA, 20 bp, Artificial Sequence
  chemically synthesized
aaaatactttattgttaaaa

SEQ ID NO: 29767 - DNA, 20 bp, Artificial Sequence
  chemically synthesized
cgttagcttttttaacaata

SEQ ID NO: 29768 - DNA, 20 bp, Artificial Sequence
  chemically synthesized
acaataaagtattttaaatt

SEQ ID NO: 29769 - DNA, 20 bp, Artificial Sequence
  chemically synthesized
caataaagtattttaaatta

SEQ ID NO: 29770 - DNA, 20 bp, Artificial Sequence
  chemically synthesized
aggtatgtacattgtttttt

SEQ ID NO: 29771 - DNA, 20 bp, Artificial Sequence
  chemically synthesized
gtagtctagtaagtgtgcaa

SEQ ID NO: 29772 - DNA, 20 bp, Artificial Sequence
  chemically synthesized
taatgctgttgcacacttac

SEQ ID NO: 29773 - DNA, 20 bp, Artificial Sequence
  chemically synthesized
actctataatgtagtctagt

SEQ ID NO: 29774 - DNA, 20 bp, Artificial Sequence
  chemically synthesized
gtttactctataatgtagtc

SEQ ID NO: 29775 - DNA, 20 bp, Artificial Sequence
  chemically synthesized
acacttactagactacatta

SEQ ID NO: 29776 - DNA, 20 bp, Artificial Sequence
  chemically synthesized
acttactagactacattata

SEQ ID NO: 29777 - DNA, 20 bp, Artificial Sequence
  chemically synthesized
gttatgtttactctataatg

SEQ ID NO: 29778 - DNA, 20 bp, Artificial Sequence
  chemically synthesized
tttggttttctagtacatat

SEQ ID NO: 29779 - DNA, 20 bp, Artificial Sequence
  chemically synthesized
taaacataacttatatgtac

SEQ ID NO: 29780 - DNA, 20 bp, Artificial Sequence
  chemically synthesized
acacaagtgttttggttttc

SEQ ID NO: 29781 - DNA, 20 bp, Artificial Sequence
  chemically synthesized
agtaagtcacacaagtgttt

SEQ ID NO: 29782 - DNA, 20 bp, Artificial Sequence
  chemically synthesized
cacaataaagtaagtcacac

SEQ ID NO: 29783 - DNA, 20 bp, Artificial Sequence
  chemically synthesized
agcaaatatcacaataaagt

SEQ ID NO: 29784 - DNA, 20 bp, Artificial Sequence
  chemically synthesized
gtaaagcaaatatcacaata

SEQ ID NO: 29785 - DNA, 20 bp, Artificial Sequence
  chemically synthesized
ttgtgatatttgctttactg

SEQ ID NO: 29786 - DNA, 20 bp, Artificial Sequence
  chemically synthesized
agttccagaacacttcagta

SEQ ID NO: 29787 - DNA, 20 bp, Artificial Sequence
  chemically synthesized
ggttcagttccagaacactt

SEQ ID NO: 29788 - DNA, 20 bp, Artificial Sequence
  chemically synthesized
tttgctttactgaagtgttc

SEQ ID NO: 29789 - DNA, 20 bp, Artificial Sequence
  chemically synthesized
agattttgcaggttcagttc

SEQ ID NO: 29790 - DNA, 20 bp, Artificial Sequence
  chemically synthesized
ccttggagattttgcaggtt

SEQ ID NO: 29791 - DNA, 20 bp, Artificial Sequence
  chemically synthesized
acataccttggagattttgc

SEQ ID NO: 29792 - DNA, 20 bp, Artificial Sequence
  chemically synthesized
gacataccttggagattttg

SEQ ID NO: 29793 - DNA, 20 bp, Artificial Sequence
  chemically synthesized
actgaacctgcaaaatctcc

SEQ ID NO: 29794 - DNA, 20 bp, Artificial Sequence
  chemically synthesized
ctgaacctgcaaaatctcca

SEQ ID NO: 29795 - DNA, 20 bp, Artificial Sequence
  chemically synthesized
ctaaatacagacataccttg

SEQ ID NO: 29796 - DNA, 20 bp, Artificial Sequence
  chemically synthesized
gactaaatacagacatacct

SEQ ID NO: 29797 - DNA, 20 bp, Artificial Sequence
  chemically synthesized
ctccaaggtatgtctgtatt

SEQ ID NO: 29798 - DNA, 20 bp, Artificial Sequence
  chemically synthesized
atgactctcaagactaaata

SEQ ID NO: 29799 - DNA, 20 bp, Artificial Sequence
  chemically synthesized
gtatgtctgtatttagtctt

SEQ ID NO: 29800 - DNA, 20 bp, Artificial Sequence
  chemically synthesized
atgtctgtatttagtcttga

SEQ ID NO: 29801 - DNA, 20 bp, Artificial Sequence
  chemically synthesized
tgtttatgctcatgactctc

SEQ ID NO: 29802 - DNA, 20 bp, Artificial Sequence
  chemically synthesized
tatttagtcttgagagtcat

SEQ ID NO: 29803 - DNA, 20 bp, Artificial Sequence
  chemically synthesized
aaagtacttgcgacgtttac

SEQ ID NO: 29804 - DNA, 20 bp, Artificial Sequence
  chemically synthesized
gaaagtacttgcgacgttta

SEQ ID NO: 29805 - DNA, 20 bp, Artificial Sequence
  chemically synthesized
taaacacctgtaaacgtcgc

SEQ ID NO: 29806 - DNA, 20 bp, Artificial Sequence
  chemically synthesized
agcttccatgcatttgatga

SEQ ID NO: 29807 - DNA, 20 bp, Artificial Sequence
  chemically synthesized
aagtactttcatcaaatgca

SEQ ID NO: 29808 - DNA, 20 bp, Artificial Sequence
  chemically synthesized
tactttcatcaaatgcatgg

SEQ ID NO: 29809 - DNA, 20 bp, Artificial Sequence
  chemically synthesized
aatgcatggaagcttatcct

SEQ ID NO: 29810 - DNA, 20 bp, Artificial Sequence
  chemically synthesized
gaagtccaaacactaaggat

SEQ ID NO: 29811 - DNA, 20 bp, Artificial Sequence
  chemically synthesized
ggaagcttatccttagtgtt

SEQ ID NO: 29812 - DNA, 20 bp, Artificial Sequence
  chemically synthesized
gcagagaagtccaaacacta

SEQ ID NO: 29813 - DNA, 20 bp, Artificial Sequence
  chemically synthesized
tgcagagaagtccaaacact

SEQ ID NO: 29814 - DNA, 20 bp, Artificial Sequence
  chemically synthesized
ttagtgtttggacttctctg

SEQ ID NO: 29815 - DNA, 20 bp, Artificial Sequence
  chemically synthesized
aaaacaaattatctgcagag

SEQ ID NO: 29816 - DNA, 20 bp, Artificial Sequence
  chemically synthesized
attaaaacaaattatctgca

SEQ ID NO: 29817 - DNA, 20 bp, Artificial Sequence
  chemically synthesized
caattaaaacaaattatctg

SEQ ID NO: 29818 - DNA, 20 bp, Artificial Sequence
  chemically synthesized
tgatcttaaaggagaggagg

SEQ ID NO: 29819 - DNA, 20 bp, Artificial Sequence
  chemically synthesized
aactgatcttaaaggagagg

SEQ ID NO: 29820 - DNA, 20 bp, Artificial Sequence
  chemically synthesized
aaactgatcttaaaggagag

SEQ ID NO: 29821 - DNA, 20 bp, Artificial Sequence
  chemically synthesized
attgctacctcctctccttt

SEQ ID NO: 29822 - DNA, 20 bp, Artificial Sequence
  chemically synthesized
ggaaactgatcttaaaggag

SEQ ID NO: 29823 - DNA, 20 bp, Artificial Sequence
  chemically synthesized
aggaaactgatcttaaagga

SEQ ID NO: 29824 - DNA, 20 bp, Artificial Sequence
  chemically synthesized
aaaggaaactgatcttaaag

SEQ ID NO: 29825 - DNA, 20 bp, Artificial Sequence
  chemically synthesized
tacctcctctcctttaagat

SEQ ID NO: 29826 - DNA, 20 bp, Artificial Sequence
  chemically synthesized
tcaaaggaaactgatcttaa

SEQ ID NO: 29827 - DNA, 20 bp, Artificial Sequence
  chemically synthesized
ttcaaaggaaactgatctta

SEQ ID NO: 29828 - DNA, 20 bp, Artificial Sequence
  chemically synthesized
agatcagtttcctttgaacc

SEQ ID NO: 29829 - DNA, 20 bp, Artificial Sequence
  chemically synthesized
gaaggacatcctgggttcaa

SEQ ID NO: 29830 - DNA, 20 bp, Artificial Sequence
  chemically synthesized
gatcagtttcctttgaaccc

SEQ ID NO: 29831 - DNA, 20 bp, Artificial Sequence
  chemically synthesized
agaaggacatcctgggttca

SEQ ID NO: 29832 - DNA, 20 bp, Artificial Sequence
  chemically synthesized
agataccagaaggacatcct

SEQ ID NO: 29833 - DNA, 20 bp, Artificial Sequence
  chemically synthesized
aagataccagaaggacatcc

SEQ ID NO: 29834 - DNA, 20 bp, Artificial Sequence
  chemically synthesized
ttgaacccaggatgtccttc

SEQ ID NO: 29835 - DNA, 20 bp, Artificial Sequence
  chemically synthesized
gacatagataagataccaga

SEQ ID NO: 29836 - DNA, 20 bp, Artificial Sequence
  chemically synthesized
tgacatagataagataccag

SEQ ID NO: 29837 - DNA, 20 bp, Artificial Sequence
  chemically synthesized
aggtgacatagataagatac

SEQ ID NO: 29838 - DNA, 20 bp, Artificial Sequence
  chemically synthesized
gagtttgaggtgacatagat

SEQ ID NO: 29839 - DNA, 20 bp, Artificial Sequence
  chemically synthesized
cataggagtttgaggtgaca

SEQ ID NO: 29840 - DNA, 20 bp, Artificial Sequence
  chemically synthesized
aaagctttcataggagtttg

SEQ ID NO: 29841 - DNA, 20 bp, Artificial Sequence
  chemically synthesized
aaaagctttcataggagttt

SEQ ID NO: 29842 - DNA, 20 bp, Artificial Sequence
  chemically synthesized
gtcacctcaaactcctatga

SEQ ID NO: 29843 - DNA, 20 bp, Artificial Sequence
  chemically synthesized
aaactaaaaagctttcatag

SEQ ID NO: 29844 - DNA, 20 bp, Artificial Sequence
  chemically synthesized
aaaaactaaaaagctttcat

SEQ ID NO: 29845 - DNA, 20 bp, Artificial Sequence
  chemically synthesized
aaaaaactaaaaagctttca

SEQ ID NO: 29846 - DNA, 20 bp, Artificial Sequence
  chemically synthesized
aaactcctatgaaagctttt

SEQ ID NO: 29847 - DNA, 20 bp, Artificial Sequence
  chemically synthesized
agaaacataaaaaaactaaa

SEQ ID NO: 29848 - DNA, 20 bp, Artificial Sequence
  chemically synthesized
tatgcagatatttcgggaac

SEQ ID NO: 29849 - DNA, 20 bp, Artificial Sequence
  chemically synthesized
accctctatgcagatatttc

SEQ ID NO: 29850 - DNA, 20 bp, Artificial Sequence
  chemically synthesized
aaccctctatgcagatattt

SEQ ID NO: 29851 - DNA, 20 bp, Artificial Sequence
  chemically synthesized
ttgttcccgaaatatctgca

SEQ ID NO: 29852 - DNA, 20 bp, Artificial Sequence
  chemically synthesized
gttcccgaaatatctgcata

SEQ ID NO: 29853 - DNA, 20 bp, Artificial Sequence
  chemically synthesized
ttcccgaaatatctgcatag

SEQ ID NO: 29854 - DNA, 20 bp, Artificial Sequence
  chemically synthesized
tcccgaaatatctgcataga

SEQ ID NO: 29855 - DNA, 20 bp, Artificial Sequence
  chemically synthesized
aaggcaaccaaccctctatg

SEQ ID NO: 29856 - DNA, 20 bp, Artificial Sequence
  chemically synthesized
gaaatatctgcatagagggt

SEQ ID NO: 29857 - DNA, 20 bp, Artificial Sequence
  chemically synthesized
aggagatcccatggacagta

SEQ ID NO: 29858 - DNA, 20 bp, Artificial Sequence
  chemically synthesized
caggagatcccatggacagt

SEQ ID NO: 29859 - DNA, 20 bp, Artificial Sequence
  chemically synthesized
gttggttgccttactgtcca

SEQ ID NO: 29860 - DNA, 20 bp, Artificial Sequence
  chemically synthesized
ttggttgccttactgtccat

SEQ ID NO: 29861 - DNA, 20 bp, Artificial Sequence
  chemically synthesized
agtacaggagatcccatgga

SEQ ID NO: 29862 - DNA, 20 bp, Artificial Sequence
  chemically synthesized
ttgaagtacaggagatccca

SEQ ID NO: 29863 - DNA, 20 bp, Artificial Sequence
  chemically synthesized
agcaaatgattgaagtacag

SEQ ID NO: 29864 - DNA, 20 bp, Artificial Sequence
  chemically synthesized
caagcaaatgattgaagtac

SEQ ID NO: 29865 - DNA, 20 bp, Artificial Sequence
  chemically synthesized
acaagcaaatgattgaagta

SEQ ID NO: 29866 - DNA, 20 bp, Artificial Sequence
  chemically synthesized
aaccaacaagcaaatgattg

SEQ ID NO: 29867 - DNA, 20 bp, Artificial Sequence
  chemically synthesized
tacttcaatcatttgcttgt

SEQ ID NO: 29868 - DNA, 20 bp, Artificial Sequence
  chemically synthesized
agaaagtatcaaaaaccaac

SEQ ID NO: 29869 - DNA, 20 bp, Artificial Sequence
  chemically synthesized
gagcagagaaaaggcagaga

SEQ ID NO: 29870 - DNA, 20 bp, Artificial Sequence
  chemically synthesized
agcagagcagagaaaaggca

SEQ ID NO: 29871 - DNA, 20 bp, Artificial Sequence
  chemically synthesized
acagcagagcagagaaaagg

SEQ ID NO: 29872 - DNA, 20 bp, Artificial Sequence
  chemically synthesized
taaacagcagagcagagaaa

SEQ ID NO: 29873 - DNA, 20 bp, Artificial Sequence
  chemically synthesized
ataaacagcagagcagagaa

SEQ ID NO: 29874 - DNA, 20 bp, Artificial Sequence
  chemically synthesized
ctgtaataaacagcagagca

SEQ ID NO: 29875 - DNA, 20 bp, Artificial Sequence
  chemically synthesized
tactgtaataaacagcagag

SEQ ID NO: 29876 - DNA, 20 bp, Artificial Sequence
  chemically synthesized
atgtactgtaataaacagca

SEQ ID NO: 29877 - DNA, 20 bp, Artificial Sequence
  chemically synthesized
aaatgtactgtaataaacag

SEQ ID NO: 29878 - DNA, 20 bp, Artificial Sequence
  chemically synthesized
ctctgctctgctgtttatta

SEQ ID NO: 29879 - DNA, 20 bp, Artificial Sequence
  chemically synthesized
ggaaaatgtactgtaataaa

SEQ ID NO: 29880 - DNA, 20 bp, Artificial Sequence
  chemically synthesized
aagccaattggtaagggagc

SEQ ID NO: 29881 - DNA, 20 bp, Artificial Sequence
  chemically synthesized
gaagccaattggtaagggag

SEQ ID NO: 29882 - DNA, 20 bp, Artificial Sequence
  chemically synthesized
ttggaagccaattggtaagg

SEQ ID NO: 29883 - DNA, 20 bp, Artificial Sequence
  chemically synthesized
acttggaagccaattggtaa

SEQ ID NO: 29884 - DNA, 20 bp, Artificial Sequence
  chemically synthesized
tttcctgctcccttaccaat

SEQ ID NO: 29885 - DNA, 20 bp, Artificial Sequence
  chemically synthesized
tacttggaagccaattggta

SEQ ID NO: 29886 - DNA, 20 bp, Artificial Sequence
  chemically synthesized
ttacttggaagccaattggt

SEQ ID NO: 29887 - DNA, 20 bp, Artificial Sequence
  chemically synthesized
aaacttacttggaagccaat

SEQ ID NO: 29888 - DNA, 20 bp, Artificial Sequence
  chemically synthesized
tcccttaccaattggcttcc

SEQ ID NO: 29889 - DNA, 20 bp, Artificial Sequence
  chemically synthesized
ttaccaattggcttccaagt

SEQ ID NO: 29890 - DNA, 20 bp, Artificial Sequence
  chemically synthesized
tattggccaaacttacttgg

SEQ ID NO: 29891 - DNA, 20 bp, Artificial Sequence
  chemically synthesized
tcctattggccaaacttact

SEQ ID NO: 29892 - DNA, 20 bp, Artificial Sequence
  chemically synthesized
aattggcttccaagtaagtt

SEQ ID NO: 29893 - DNA, 20 bp, Artificial Sequence
  chemically synthesized
ttccaagtaagtttggccaa

SEQ ID NO: 29894 - DNA, 20 bp, Artificial Sequence
  chemically synthesized
tccaagtaagtttggccaat

SEQ ID NO: 29895 - DNA, 20 bp, Artificial Sequence
  chemically synthesized
caagtaagtttggccaatag

SEQ ID NO: 29896 - DNA, 20 bp, Artificial Sequence
  chemically synthesized
cttctgccagtgactcctat

SEQ ID NO: 29897 - DNA, 20 bp, Artificial Sequence
  chemically synthesized
gtttggccaataggagtcac

SEQ ID NO: 29898 - DNA, 20 bp, Artificial Sequence
  chemically synthesized
tggccaataggagtcactgg

SEQ ID NO: 29899 - DNA, 20 bp, Artificial Sequence
  chemically synthesized
ccaataggagtcactggcag

SEQ ID NO: 29900 - DNA, 20 bp, Artificial Sequence
  chemically synthesized
cctgccctctaggcttctgc

SEQ ID NO: 29901 - DNA, 20 bp, Artificial Sequence
  chemically synthesized
aggagtcactggcagaagcc

SEQ ID NO: 29902 - DNA, 20 bp, Artificial Sequence
  chemically synthesized
gagtcactggcagaagccta

SEQ ID NO: 29903 - DNA, 20 bp, Artificial Sequence
  chemically synthesized
agtcactggcagaagcctag

SEQ ID NO: 29904 - DNA, 20 bp, Artificial Sequence
  chemically synthesized
gtcactggcagaagcctaga

SEQ ID NO: 29905 - DNA, 20 bp, Artificial Sequence
  chemically synthesized
actggcagaagcctagaggg

SEQ ID NO: 29906 - DNA, 20 bp, Artificial Sequence
  chemically synthesized
ctggcagaagcctagagggc

SEQ ID NO: 29907 - DNA, 20 bp, Artificial Sequence
  chemically synthesized
ctcctttccgcctgccctct

SEQ ID NO: 29908 - DNA, 20 bp, Artificial Sequence
  chemically synthesized
tctcctttccgcctgccctc

SEQ ID NO: 29909 - DNA, 20 bp, Artificial Sequence
  chemically synthesized
gcagaagcctagagggcagg

SEQ ID NO: 29910 - DNA, 20 bp, Artificial Sequence
  chemically synthesized
aagcctagagggcaggcgga

SEQ ID NO: 29911 - DNA, 20 bp, Artificial Sequence
  chemically synthesized
agcctagagggcaggcggaa

SEQ ID NO: 29912 - DNA, 20 bp, Artificial Sequence
  chemically synthesized
cctagagggcaggcggaaag

SEQ ID NO: 29913 - DNA, 20 bp, Artificial Sequence
  chemically synthesized
agagggcaggcggaaaggag

SEQ ID NO: 29914 - DNA, 20 bp, Artificial Sequence
  chemically synthesized
ggcaggcggaaaggagaagc

SEQ ID NO: 29915 - DNA, 20 bp, Artificial Sequence
  chemically synthesized
gcaggcggaaaggagaagcc

SEQ ID NO: 29916 - DNA, 20 bp, Artificial Sequence
  chemically synthesized
aatgaaaaaggaagtacgcc

SEQ ID NO: 29917 - DNA, 20 bp, Artificial Sequence
  chemically synthesized
cggaggtagaatgaaaaagg

SEQ ID NO: 29918 - DNA, 20 bp, Artificial Sequence
  chemically synthesized
tgccggaggtagaatgaaaa

SEQ ID NO: 29919 - DNA, 20 bp, Artificial Sequence
  chemically synthesized
ttgccggaggtagaatgaaa

SEQ ID NO: 29920 - DNA, 20 bp, Artificial Sequence
  chemically synthesized
ttcctttttcattctacctc

SEQ ID NO: 29921 - DNA, 20 bp, Artificial Sequence
  chemically synthesized
gccagacctattgccggagg

SEQ ID NO: 29922 - DNA, 20 bp, Artificial Sequence
  chemically synthesized
tttcattctacctccggcaa

SEQ ID NO: 29923 - DNA, 20 bp, Artificial Sequence
  chemically synthesized
ttagccagacctattgccgg

SEQ ID NO: 29924 - DNA, 20 bp, Artificial Sequence
  chemically synthesized
ttcattctacctccggcaat

SEQ ID NO: 29925 - DNA, 20 bp, Artificial Sequence
  chemically synthesized
gttagccagacctattgccg

SEQ ID NO: 29926 - DNA, 20 bp, Artificial Sequence
  chemically synthesized
cagttagccagacctattgc

SEQ ID NO: 29927 - DNA, 20 bp, Artificial Sequence
  chemically synthesized
tctacctccggcaataggtc

SEQ ID NO: 29928 - DNA, 20 bp, Artificial Sequence
  chemically synthesized
aggaaggagacacagttagc

SEQ ID NO: 29929 - DNA, 20 bp, Artificial Sequence
  chemically synthesized
agccaggaaggagacacagt

SEQ ID NO: 29930 - DNA, 20 bp, Artificial Sequence
  chemically synthesized
ctggagccaggaaggagaca

SEQ ID NO: 29931 - DNA, 20 bp, Artificial Sequence
  chemically synthesized
ggctaactgtgtctccttcc

SEQ ID NO: 29932 - DNA, 20 bp, Artificial Sequence
  chemically synthesized
agggagctggagccaggaag

SEQ ID NO: 29933 - DNA, 20 bp, Artificial Sequence
  chemically synthesized
cgagggagctggagccagga

SEQ ID NO: 29934 - DNA, 20 bp, Artificial Sequence
  chemically synthesized
ccgagggagctggagccagg

SEQ ID NO: 29935 - DNA, 20 bp, Artificial Sequence
  chemically synthesized
ctgtgtctccttcctggctc

SEQ ID NO: 29936 - DNA, 20 bp, Artificial Sequence
  chemically synthesized
gctccgagggagctggagcc

SEQ ID NO: 29937 - DNA, 20 bp, Artificial Sequence
  chemically synthesized
ggctccgagggagctggagc

SEQ ID NO: 29938 - DNA, 20 bp, Artificial Sequence
  chemically synthesized
gaggggctccgagggagctg

SEQ ID NO: 29939 - DNA, 20 bp, Artificial Sequence
  chemically synthesized
cttcctggctccagctccct

SEQ ID NO: 29940 - DNA, 20 bp, Artificial Sequence
  chemically synthesized
gggaggggctccgagggagc

SEQ ID NO: 29941 - DNA, 20 bp, Artificial Sequence
  chemically synthesized
tcctggctccagctccctcg

SEQ ID NO: 29942 - DNA, 20 bp, Artificial Sequence
  chemically synthesized
atgagggaggggctccgagg

SEQ ID NO: 29943 - DNA, 20 bp, Artificial Sequence
  chemically synthesized
caatgagggaggggctccga

SEQ ID NO: 29944 - DNA, 20 bp, Artificial Sequence
  chemically synthesized
ccaatgagggaggggctccg

SEQ ID NO: 29945 - DNA, 20 bp, Artificial Sequence
  chemically synthesized
accaatgagggaggggctcc

SEQ ID NO: 29946 - DNA, 20 bp, Artificial Sequence
  chemically synthesized
agctgggaccaatgagggag

SEQ ID NO: 29947 - DNA, 20 bp, Artificial Sequence
  chemically synthesized
cagctgggaccaatgaggga

SEQ ID NO: 29948 - DNA, 20 bp, Artificial Sequence
  chemically synthesized
cctcggagcccctccctcat

SEQ ID NO: 29949 - DNA, 20 bp, Artificial Sequence
  chemically synthesized
ccagctgggaccaatgaggg

SEQ ID NO: 29950 - DNA, 20 bp, Artificial Sequence
  chemically synthesized
gccagctgggaccaatgagg

SEQ ID NO: 29951 - DNA, 20 bp, Artificial Sequence
  chemically synthesized
tggccagctgggaccaatga

SEQ ID NO: 29952 - DNA, 20 bp, Artificial Sequence
  chemically synthesized
ttggccagctgggaccaatg

SEQ ID NO: 29953 - DNA, 20 bp, Artificial Sequence
  chemically synthesized
tttggccagctgggaccaat

SEQ ID NO: 29954 - DNA, 20 bp, Artificial Sequence
  chemically synthesized
agcccctccctcattggtcc

SEQ ID NO: 29955 - DNA, 20 bp, Artificial Sequence
  chemically synthesized
cctccctcattggtcccagc

SEQ ID NO: 29956 - DNA, 20 bp, Artificial Sequence
  chemically synthesized
gttggaacctttggccagct

SEQ ID NO: 29957 - DNA, 20 bp, Artificial Sequence
  chemically synthesized
agttggaacctttggccagc

SEQ ID NO: 29958 - DNA, 20 bp, Artificial Sequence
  chemically synthesized
tcattggtcccagctggcca

SEQ ID NO: 29959 - DNA, 20 bp, Artificial Sequence
  chemically synthesized
cattggtcccagctggccaa

SEQ ID NO: 29960 - DNA, 20 bp, Artificial Sequence
  chemically synthesized
gcggagttggaacctttggc

SEQ ID NO: 29961 - DNA, 20 bp, Artificial Sequence
  chemically synthesized
caaggcggagttggaacctt

SEQ ID NO: 29962 - DNA, 20 bp, Artificial Sequence
  chemically synthesized
catgggcatcaaggcggagt

SEQ ID NO: 29963 - DNA, 20 bp, Artificial Sequence
  chemically synthesized
atgtcatgggcatcaaggcg

SEQ ID NO: 29964 - DNA, 20 bp, Artificial Sequence
  chemically synthesized
agatgtcatgggcatcaagg

SEQ ID NO: 29965 - DNA, 20 bp, Artificial Sequence
  chemically synthesized
cccagatgtcatgggcatca

SEQ ID NO: 29966 - DNA, 20 bp, Artificial Sequence
  chemically synthesized
ccccagatgtcatgggcatc

SEQ ID NO: 29967 - DNA, 20 bp, Artificial Sequence
  chemically synthesized
accagagccccagatgtcat

SEQ ID NO: 29968 - DNA, 20 bp, Artificial Sequence
  chemically synthesized
gccttgatgcccatgacatc

SEQ ID NO: 29969 - DNA, 20 bp, Artificial Sequence
  chemically synthesized
caccagagccccagatgtca

SEQ ID NO: 29970 - DNA, 20 bp, Artificial Sequence
  chemically synthesized
ccttgatgcccatgacatct

SEQ ID NO: 29971 - DNA, 20 bp, Artificial Sequence
  chemically synthesized
cttgatgcccatgacatctg

SEQ ID NO: 29972 - DNA, 20 bp, Artificial Sequence
  chemically synthesized
gcccatgacatctggggctc

SEQ ID NO: 29973 - DNA, 20 bp, Artificial Sequence
  chemically synthesized
aggtggtatcaccagagccc

SEQ ID NO: 29974 - DNA, 20 bp, Artificial Sequence
  chemically synthesized
gacaagaggtggtatcacca

SEQ ID NO: 29975 - DNA, 20 bp, Artificial Sequence
  chemically synthesized
atgacaagaggtggtatcac

SEQ ID NO: 29976 - DNA, 20 bp, Artificial Sequence
  chemically synthesized
ggagggacaatgacaagagg

SEQ ID NO: 29977 - DNA, 20 bp, Artificial Sequence
  chemically synthesized
gctggagggacaatgacaag

SEQ ID NO: 29978 - DNA, 20 bp, Artificial Sequence
  chemically synthesized
ggctggagggacaatgacaa

SEQ ID NO: 29979 - DNA, 20 bp, Artificial Sequence
  chemically synthesized
agggctggagggacaatgac

SEQ ID NO: 29980 - DNA, 20 bp, Artificial Sequence
  chemically synthesized
acctcttgtcattgtccctc

SEQ ID NO: 29981 - DNA, 20 bp, Artificial Sequence
  chemically synthesized
ctgttatacctagggctgga

SEQ ID NO: 29982 - DNA, 20 bp, Artificial Sequence
  chemically synthesized
tgtcattgtccctccagccc

SEQ ID NO: 29983 - DNA, 20 bp, Artificial Sequence
  chemically synthesized
tctgttatacctagggctgg

SEQ ID NO: 29984 - DNA, 20 bp, Artificial Sequence
  chemically synthesized
gtcattgtccctccagccct

SEQ ID NO: 29985 - DNA, 20 bp, Artificial Sequence
  chemically synthesized
ttctgttatacctagggctg

SEQ ID NO: 29986 - DNA, 20 bp, Artificial Sequence
  chemically synthesized
gtttctgttatacctagggc

SEQ ID NO: 29987 - DNA, 20 bp, Artificial Sequence
  chemically synthesized
tgaagtttctgttataccta

SEQ ID NO: 29988 - DNA, 20 bp, Artificial Sequence
  chemically synthesized
atgaagtttctgttatacct

SEQ ID NO: 29989 - DNA, 20 bp, Artificial Sequence
  chemically synthesized
ccctccagccctaggtataa

SEQ ID NO: 29990 - DNA, 20 bp, Artificial Sequence
  chemically synthesized
catgaagtttctgttatacc

SEQ ID NO: 29991 - DNA, 20 bp, Artificial Sequence
  chemically synthesized
gaagccacacacacagcatg

SEQ ID NO: 29992 - DNA, 20 bp, Artificial Sequence
  chemically synthesized
gaaacttcatgctgtgtgtg

SEQ ID NO: 29993 - DNA, 20 bp, Artificial Sequence
  chemically synthesized
gtgctgagaagccacacaca

SEQ ID NO: 29994 - DNA, 20 bp, Artificial Sequence
  chemically synthesized
atgctgtgtgtgtggcttct

SEQ ID NO: 29995 - DNA, 20 bp, Artificial Sequence
  chemically synthesized
tcaagaatggaagtgctgag

SEQ ID NO: 29996 - DNA, 20 bp, Artificial Sequence
  chemically synthesized
tactcaagaatggaagtgct

SEQ ID NO: 29997 - DNA, 20 bp, Artificial Sequence
  chemically synthesized
aattggttactcaagaatgg

SEQ ID NO: 29998 - DNA, 20 bp, Artificial Sequence
  chemically synthesized
ttctcagcacttccattctt

SEQ ID NO: 29999 - DNA, 20 bp, Artificial Sequence
  chemically synthesized
ggaaattggttactcaagaa

SEQ ID NO: 30000 - DNA, 20 bp, Artificial Sequence
  chemically synthesized
atgcgggaaattggttactc

SEQ ID NO: 30001 - DNA, 20 bp, Artificial Sequence
  chemically synthesized
gggaatttaatgcgggaaat

SEQ ID NO: 30002 - DNA, 20 bp, Artificial Sequence
  chemically synthesized
aaacaaagggaatttaatgc

SEQ ID NO: 30003 - DNA, 20 bp, Artificial Sequence
  chemically synthesized
caaacaaagggaatttaatg

SEQ ID NO: 30004 - DNA, 20 bp, Artificial Sequence
  chemically synthesized
ctctagttatttcaaacaaa

SEQ ID NO: 30005 - DNA, 20 bp, Artificial Sequence
  chemically synthesized
cctctagttatttcaaacaa

SEQ ID NO: 30006 - DNA, 20 bp, Artificial Sequence
  chemically synthesized
ccctctagttatttcaaaca

SEQ ID NO: 30007 - DNA, 20 bp, Artificial Sequence
  chemically synthesized
ttccctttgtttgaaataac

SEQ ID NO: 30008 - DNA, 20 bp, Artificial Sequence
  chemically synthesized
ccctttgtttgaaataacta

SEQ ID NO: 30009 - DNA, 20 bp, Artificial Sequence
  chemically synthesized
cctttgtttgaaataactag

SEQ ID NO: 30010 - DNA, 20 bp, Artificial Sequence
  chemically synthesized
ctttgtttgaaataactaga

SEQ ID NO: 30011 - DNA, 20 bp, Artificial Sequence
  chemically synthesized
gtcagaaaacataaaccctc

SEQ ID NO: 30012 - DNA, 20 bp, Artificial Sequence
  chemically synthesized
gagggtttatgttttctgac

SEQ ID NO: 30013 - DNA, 20 bp, Artificial Sequence
  chemically synthesized
agggtttatgttttctgacc

SEQ ID NO: 30014 - DNA, 20 bp, Artificial Sequence
  chemically synthesized
gtttatgttttctgaccagg

SEQ ID NO: 30015 - DNA, 20 bp, Artificial Sequence
  chemically synthesized
tcaatcagggtctgcctggt

SEQ ID NO: 30016 - DNA, 20 bp, Artificial Sequence
  chemically synthesized
tgtatcaatcagggtctgcc

SEQ ID NO: 30017 - DNA, 20 bp, Artificial Sequence
  chemically synthesized
tttggaagatgtatcaatca

SEQ ID NO: 30018 - DNA, 20 bp, Artificial Sequence
  chemically synthesized
atttggaagatgtatcaatc

SEQ ID NO: 30019 - DNA, 20 bp, Artificial Sequence
  chemically synthesized
gatttggaagatgtatcaat

SEQ ID NO: 30020 - DNA, 20 bp, Artificial Sequence
  chemically synthesized
tactaaggtttttgatttgg

SEQ ID NO: 30021 - DNA, 20 bp, Artificial Sequence
  chemically synthesized
ttatactaaggtttttgatt

SEQ ID NO: 30022 - DNA, 20 bp, Artificial Sequence
  chemically synthesized
atcttccaaatcaaaaacct

SEQ ID NO: 30023 - DNA, 20 bp, Artificial Sequence
  chemically synthesized
gttgaaggttttttatacta

SEQ ID NO: 30024 - DNA, 20 bp, Artificial Sequence
  chemically synthesized
tgttgaaggttttttatact

SEQ ID NO: 30025 - DNA, 20 bp, Artificial Sequence
  chemically synthesized
agccttatatggtatgttga

SEQ ID NO: 30026 - DNA, 20 bp, Artificial Sequence
  chemically synthesized
aagccttatatggtatgttg

SEQ ID NO: 30027 - DNA, 20 bp, Artificial Sequence
  chemically synthesized
aaaccttcaacataccatat

SEQ ID NO: 30028 - DNA, 20 bp, Artificial Sequence
  chemically synthesized
aaccttcaacataccatata

SEQ ID NO: 30029 - DNA, 20 bp, Artificial Sequence
  chemically synthesized
aaactgtgaaaagccttata

SEQ ID NO: 30030 - DNA, 20 bp, Artificial Sequence
  chemically synthesized
ataccatataaggcttttca

SEQ ID NO: 30031 - DNA, 20 bp, Artificial Sequence
  chemically synthesized
aggagggctaaaactgtgaa

SEQ ID NO: 30032 - DNA, 20 bp, Artificial Sequence
  chemically synthesized
tataaggcttttcacagttt

SEQ ID NO: 30033 - DNA, 20 bp, Artificial Sequence
  chemically synthesized
aatggctgtagagatgagga

SEQ ID NO: 30034 - DNA, 20 bp, Artificial Sequence
  chemically synthesized
gaatggctgtagagatgagg

SEQ ID NO: 30035 - DNA, 20 bp, Artificial Sequence
  chemically synthesized
agaatggctgtagagatgag

SEQ ID NO: 30036 - DNA, 20 bp, Artificial Sequence
  chemically synthesized
acagaatggctgtagagatg

SEQ ID NO: 30037 - DNA, 20 bp, Artificial Sequence
  chemically synthesized
tttagccctcctcatctcta

SEQ ID NO: 30038 - DNA, 20 bp, Artificial Sequence
  chemically synthesized
cacagaatggctgtagagat

SEQ ID NO: 30039 - DNA, 20 bp, Artificial Sequence
  chemically synthesized
ggtatcacagaatggctgta

SEQ ID NO: 30040 - DNA, 20 bp, Artificial Sequence
  chemically synthesized
gaggtatcacagaatggctg

SEQ ID NO: 30041 - DNA, 20 bp, Artificial Sequence
  chemically synthesized
gtagtggaggtatcacagaa

SEQ ID NO: 30042 - DNA, 20 bp, Artificial Sequence
  chemically synthesized
ctgtggtagtggaggtatca

SEQ ID NO: 30043 - DNA, 20 bp, Artificial Sequence
  chemically synthesized
gtactagtctgtggtagtgg

SEQ ID NO: 30044 - DNA, 20 bp, Artificial Sequence
  chemically synthesized
ggtactagtctgtggtagtg

SEQ ID NO: 30045 - DNA, 20 bp, Artificial Sequence
  chemically synthesized
ctgtgatacctccactacca

SEQ ID NO: 30046 - DNA, 20 bp, Artificial Sequence
  chemically synthesized
gtggtactagtctgtggtag

SEQ ID NO: 30047 - DNA, 20 bp, Artificial Sequence
  chemically synthesized
atggtggtactagtctgtgg

SEQ ID NO: 30048 - DNA, 20 bp, Artificial Sequence
  chemically synthesized
atacctccactaccacagac

SEQ ID NO: 30049 - DNA, 20 bp, Artificial Sequence
  chemically synthesized
atgatggtggtactagtctg

SEQ ID NO: 30050 - DNA, 20 bp, Artificial Sequence
  chemically synthesized
ctaataaatgatggtggtac

SEQ ID NO: 30051 - DNA, 20 bp, Artificial Sequence
  chemically synthesized
aaatatctaataaatgatgg

SEQ ID NO: 30052 - DNA, 20 bp, Artificial Sequence
  chemically synthesized
cataaatatctaataaatga

SEQ ID NO: 30053 - DNA, 20 bp, Artificial Sequence
  chemically synthesized
ctagtaccaccatcatttat

SEQ ID NO: 30054 - DNA, 20 bp, Artificial Sequence
  chemically synthesized
agatatttatgctctttttt

SEQ ID NO: 30055 - DNA, 20 bp, Artificial Sequence
  chemically synthesized
tgagactctgtctcaaaaaa

SEQ ID NO: 30056 - DNA, 20 bp, Artificial Sequence
  chemically synthesized
agtgagactctgtctcaaaa

SEQ ID NO: 30057 - DNA, 20 bp, Artificial Sequence
  chemically synthesized
atttatgctcttttttgaga

SEQ ID NO: 30058 - DNA, 20 bp, Artificial Sequence
  chemically synthesized
ttatgctcttttttgagaca

SEQ ID NO: 30059 - DNA, 20 bp, Artificial Sequence
  chemically synthesized
ttcagcctgggcaacagagt

SEQ ID NO: 30060 - DNA, 20 bp, Artificial Sequence
  chemically synthesized
cagagtctcactctgttgcc

SEQ ID NO: 30061 - DNA, 20 bp, Artificial Sequence
  chemically synthesized
gcacttcagcctgggcaaca

SEQ ID NO: 30062 - DNA, 20 bp, Artificial Sequence
  chemically synthesized
agagtctcactctgttgccc

SEQ ID NO: 30063 - DNA, 20 bp, Artificial Sequence
  chemically synthesized
ctgcacttcagcctgggcaa

SEQ ID NO: 30064 - DNA, 20 bp, Artificial Sequence
  chemically synthesized
tcactctgttgcccaggctg

SEQ ID NO: 30065 - DNA, 20 bp, Artificial Sequence
  chemically synthesized
gcaccactgcacttcagcct

SEQ ID NO: 30066 - DNA, 20 bp, Artificial Sequence
  chemically synthesized
cgcaccactgcacttcagcc

SEQ ID NO: 30067 - DNA, 20 bp, Artificial Sequence
  chemically synthesized
ctgttgcccaggctgaagtg

SEQ ID NO: 30068 - DNA, 20 bp, Artificial Sequence
  chemically synthesized
aagatcgcaccactgcactt

SEQ ID NO: 30069 - DNA, 20 bp, Artificial Sequence
  chemically synthesized
ttgcccaggctgaagtgcag

SEQ ID NO: 30070 - DNA, 20 bp, Artificial Sequence
  chemically synthesized
gaagtgcagtggtgcgatct

SEQ ID NO: 30071 - DNA, 20 bp, Artificial Sequence
  chemically synthesized
ggcacgggttgcagtgagcc

SEQ ID NO: 30072 - DNA, 20 bp, Artificial Sequence
  chemically synthesized
tgggaggcacgggttgcagt

SEQ ID NO: 30073 - DNA, 20 bp, Artificial Sequence
  chemically synthesized
aacctgggaggcacgggttg

SEQ ID NO: 30074 - DNA, 20 bp, Artificial Sequence
  chemically synthesized
tgcttgaacctgggaggcac

SEQ ID NO: 30075 - DNA, 20 bp, Artificial Sequence
  chemically synthesized
tcactgcaacccgtgcctcc

SEQ ID NO: 30076 - DNA, 20 bp, Artificial Sequence
  chemically synthesized
ttgcttgaacctgggaggca

SEQ ID NO: 30077 - DNA, 20 bp, Artificial Sequence
  chemically synthesized
cactgcaacccgtgcctccc

SEQ ID NO: 30078 - DNA, 20 bp, Artificial Sequence
  chemically synthesized
gagaattgcttgaacctggg

SEQ ID NO: 30079 - DNA, 20 bp, Artificial Sequence
  chemically synthesized
ggagaattgcttgaacctgg

SEQ ID NO: 30080 - DNA, 20 bp, Artificial Sequence
  chemically synthesized
aacccgtgcctcccaggttc

SEQ ID NO: 30081 - DNA, 20 bp, Artificial Sequence
  chemically synthesized
caggagaattgcttgaacct

SEQ ID NO: 30082 - DNA, 20 bp, Artificial Sequence
  chemically synthesized
gcaggagaattgcttgaacc

SEQ ID NO: 30083 - DNA, 20 bp, Artificial Sequence
  chemically synthesized
ttcaagcaattctcctgcct

SEQ ID NO: 30084 - DNA, 20 bp, Artificial Sequence
  chemically synthesized
tactcgggaagctgaggcag

SEQ ID NO: 30085 - DNA, 20 bp, Artificial Sequence
  chemically synthesized
gatactcgggaagctgaggc

SEQ ID NO: 30086 - DNA, 20 bp, Artificial Sequence
  chemically synthesized
agatactcgggaagctgagg

SEQ ID NO: 30087 - DNA, 20 bp, Artificial Sequence
  chemically synthesized
accagatactcgggaagctg

SEQ ID NO: 30088 - DNA, 20 bp, Artificial Sequence
  chemically synthesized
taccagatactcgggaagct

SEQ ID NO: 30089 - DNA, 20 bp, Artificial Sequence
  chemically synthesized
ttctcctgcctcagcttccc

SEQ ID NO: 30090 - DNA, 20 bp, Artificial Sequence
  chemically synthesized
tgtagtaccagatactcggg

SEQ ID NO: 30091 - DNA, 20 bp, Artificial Sequence
  chemically synthesized
gcctcagcttcccgagtatc

SEQ ID NO: 30092 - DNA, 20 bp, Artificial Sequence
  chemically synthesized
gcctgtagtaccagatactc

SEQ ID NO: 30093 - DNA, 20 bp, Artificial Sequence
  chemically synthesized
tgcctgtagtaccagatact

SEQ ID NO: 30094 - DNA, 20 bp, Artificial Sequence
  chemically synthesized
ttcccgagtatctggtacta

SEQ ID NO: 30095 - DNA, 20 bp, Artificial Sequence
  chemically synthesized
tcccgagtatctggtactac

SEQ ID NO: 30096 - DNA, 20 bp, Artificial Sequence
  chemically synthesized
gtggcgtctgcctgtagtac

SEQ ID NO: 30097 - DNA, 20 bp, Artificial Sequence
  chemically synthesized
cgagtatctggtactacagg

SEQ ID NO: 30098 - DNA, 20 bp, Artificial Sequence
  chemically synthesized
gaagtggtggcgtctgcctg

SEQ ID NO: 30099 - DNA, 20 bp, Artificial Sequence
  chemically synthesized
caggcagacgccaccacttc

SEQ ID NO: 30100 - DNA, 20 bp, Artificial Sequence
  chemically synthesized
tttaaaaaagccagaagtgg

SEQ ID NO: 30101 - DNA, 20 bp, Artificial Sequence
  chemically synthesized
aaatttaaaaaagccagaag

SEQ ID NO: 30102 - DNA, 20 bp, Artificial Sequence
  chemically synthesized
taaaaatttaaaaaagccag

SEQ ID NO: 30103 - DNA, 20 bp, Artificial Sequence
  chemically synthesized
aaataaaaatttaaaaaagc

SEQ ID NO: 30104 - DNA, 20 bp, Artificial Sequence
  chemically synthesized
actaaaataaaaatttaaaa

SEQ ID NO: 30105 - DNA, 20 bp, Artificial Sequence
  chemically synthesized
gcttttttaaatttttattt

SEQ ID NO: 30106 - DNA, 20 bp, Artificial Sequence
  chemically synthesized
tttttaaatttttattttag

SEQ ID NO: 30107 - DNA, 20 bp, Artificial Sequence
  chemically synthesized
tttaaatttttattttagta

SEQ ID NO: 30108 - DNA, 20 bp, Artificial Sequence
  chemically synthesized
aatttttattttagtagaga

SEQ ID NO: 30109 - DNA, 20 bp, Artificial Sequence
  chemically synthesized
atttttattttagtagagat

SEQ ID NO: 30110 - DNA, 20 bp, Artificial Sequence
  chemically synthesized
tttttattttagtagagatg

SEQ ID NO: 30111 - DNA, 20 bp, Artificial Sequence
  chemically synthesized
tggggtttcaccgtgttgcc

SEQ ID NO: 30112 - DNA, 20 bp, Artificial Sequence
  chemically synthesized
cgagaccagcctgggcaaca

SEQ ID NO: 30113 - DNA, 20 bp, Artificial Sequence
  chemically synthesized
ggggtttcaccgtgttgccc

SEQ ID NO: 30114 - DNA, 20 bp, Artificial Sequence
  chemically synthesized
tttcaccgtgttgcccaggc

SEQ ID NO: 30115 - DNA, 20 bp, Artificial Sequence
  chemically synthesized
caggagttcgagaccagcct

SEQ ID NO: 30116 - DNA, 20 bp, Artificial Sequence
  chemically synthesized
tcaggagttcgagaccagcc

SEQ ID NO: 30117 - DNA, 20 bp, Artificial Sequence
  chemically synthesized
tgaggtcaggagttcgagac

SEQ ID NO: 30118 - DNA, 20 bp, Artificial Sequence
  chemically synthesized
tcacctgaggtcaggagttc

SEQ ID NO: 30119 - DNA, 20 bp, Artificial Sequence
  chemically synthesized
tggtctcgaactcctgacct

SEQ ID NO: 30120 - DNA, 20 bp, Artificial Sequence
  chemically synthesized
ggtggatcacctgaggtcag

SEQ ID NO: 30121 - DNA, 20 bp, Artificial Sequence
  chemically synthesized
ggtctcgaactcctgacctc

SEQ ID NO: 30122 - DNA, 20 bp, Artificial Sequence
  chemically synthesized
caggtggatcacctgaggtc

SEQ ID NO: 30123 - DNA, 20 bp, Artificial Sequence
  chemically synthesized
gcaggtggatcacctgaggt

SEQ ID NO: 30124 - DNA, 20 bp, Artificial Sequence
  chemically synthesized
cgaggcaggtggatcacctg

SEQ ID NO: 30125 - DNA, 20 bp, Artificial Sequence
  chemically synthesized
ccgaggcaggtggatcacct

SEQ ID NO: 30126 - DNA, 20 bp, Artificial Sequence
  chemically synthesized
ctcaggtgatccacctgcct

SEQ ID NO: 30127 - DNA, 20 bp, Artificial Sequence
  chemically synthesized
ctttgggaggccgaggcagg

SEQ ID NO: 30128 - DNA, 20 bp, Artificial Sequence
  chemically synthesized
acactttgggaggccgaggc

SEQ ID NO: 30129 - DNA, 20 bp, Artificial Sequence
  chemically synthesized
tacactttgggaggccgagg

SEQ ID NO: 30130 - DNA, 20 bp, Artificial Sequence
  chemically synthesized
gactacactttgggaggccg

SEQ ID NO: 30131 - DNA, 20 bp, Artificial Sequence
  chemically synthesized
agactacactttgggaggcc

SEQ ID NO: 30132 - DNA, 20 bp, Artificial Sequence
  chemically synthesized
ccacctgcctcggcctccca

SEQ ID NO: 30133 - DNA, 20 bp, Artificial Sequence
  chemically synthesized
aaaaaagactacactttggg

SEQ ID NO: 30134 - DNA, 20 bp, Artificial Sequence
  chemically synthesized
taaaaaagactacactttgg

SEQ ID NO: 30135 - DNA, 20 bp, Artificial Sequence
  chemically synthesized
tgcctcggcctcccaaagtg

SEQ ID NO: 30136 - DNA, 20 bp, Artificial Sequence
  chemically synthesized
gataaaaaagactacacttt

SEQ ID NO: 30137 - DNA, 20 bp, Artificial Sequence
  chemically synthesized
ggataaaaaagactacactt

SEQ ID NO: 30138 - DNA, 20 bp, Artificial Sequence
  chemically synthesized
atatatcattcaggataaaa

SEQ ID NO: 30139 - DNA, 20 bp, Artificial Sequence
  chemically synthesized
tctaaaataatatatcattc

SEQ ID NO: 30140 - DNA, 20 bp, Artificial Sequence
  chemically synthesized
ttctaaaataatatatcatt

SEQ ID NO: 30141 - DNA, 20 bp, Artificial Sequence
  chemically synthesized
tcctgaatgatatattattt

SEQ ID NO: 30142 - DNA, 20 bp, Artificial Sequence
  chemically synthesized
atgatatattattttagaat

SEQ ID NO: 30143 - DNA, 20 bp, Artificial Sequence
  chemically synthesized
tgatatattattttagaatt

SEQ ID NO: 30144 - DNA, 20 bp, Artificial Sequence
  chemically synthesized
gatatattattttagaattg

SEQ ID NO: 30145 - DNA, 20 bp, Artificial Sequence
  chemically synthesized
atatattattttagaattgg

SEQ ID NO: 30146 - DNA, 20 bp, Artificial Sequence
  chemically synthesized
atattattttagaattgggg

SEQ ID NO: 30147 - DNA, 20 bp, Artificial Sequence
  chemically synthesized
tattattttagaattggggg

SEQ ID NO: 30148 - DNA, 20 bp, Artificial Sequence
  chemically synthesized
attattttagaattggggga

SEQ ID NO: 30149 - DNA, 20 bp, Artificial Sequence
  chemically synthesized
ttgggggagggcaaacaaca

SEQ ID NO: 30150 - DNA, 20 bp, Artificial Sequence
  chemically synthesized
ttaatttgcatgtcaaatta

SEQ ID NO: 30151 - DNA, 20 bp, Artificial Sequence
  chemically synthesized
agtacgtgtatgctttccaa

SEQ ID NO: 30152 - DNA, 20 bp, Artificial Sequence
  chemically synthesized
aatttatcctaacttttgga

SEQ ID NO: 30153 - DNA, 20 bp, Artificial Sequence
  chemically synthesized
cgtgtatgctttccaaaagt

SEQ ID NO: 30154 - DNA, 20 bp, Artificial Sequence
  chemically synthesized
gtgtatgctttccaaaagtt

SEQ ID NO: 30155 - DNA, 20 bp, Artificial Sequence
  chemically synthesized
tcacaatttatcctaacttt

SEQ ID NO: 30156 - DNA, 20 bp, Artificial Sequence
  chemically synthesized
aagttaggataaattgtgat

SEQ ID NO: 30157 - DNA, 20 bp, Artificial Sequence
  chemically synthesized
agttaggataaattgtgatc

SEQ ID NO: 30158 - DNA, 20 bp, Artificial Sequence
  chemically synthesized
acttcttaaccaaggtgata

SEQ ID NO: 30159 - DNA, 20 bp, Artificial Sequence
  chemically synthesized
tcaggtgatctttatcacct

SEQ ID NO: 30160 - DNA, 20 bp, Artificial Sequence
  chemically synthesized
tgatctttatcaccttggtt

SEQ ID NO: 30161 - DNA, 20 bp, Artificial Sequence
  chemically synthesized
agtattttacttcttaacca

SEQ ID NO: 30162 - DNA, 20 bp, Artificial Sequence
  chemically synthesized
tctttatcaccttggttaag

SEQ ID NO: 30163 - DNA, 20 bp, Artificial Sequence
  chemically synthesized
aagtattttacttcttaacc

SEQ ID NO: 30164 - DNA, 20 bp, Artificial Sequence
  chemically synthesized
ggttaagaagtaaaatactt

SEQ ID NO: 30165 - DNA, 20 bp, Artificial Sequence
  chemically synthesized
ggagccactaaatttttctg

SEQ ID NO: 30166 - DNA, 20 bp, Artificial Sequence
  chemically synthesized
taaaatacttcagaaaaatt

SEQ ID NO: 30167 - DNA, 20 bp, Artificial Sequence
  chemically synthesized
aatacttcagaaaaatttag

SEQ ID NO: 30168 - DNA, 20 bp, Artificial Sequence
  chemically synthesized
gaaaaatttagtggctcctt

SEQ ID NO: 30169 - DNA, 20 bp, Artificial Sequence
  chemically synthesized
cttcacatttgacactcaag

SEQ ID NO: 30170 - DNA, 20 bp, Artificial Sequence
  chemically synthesized
gtcttcacatttgacactca

SEQ ID NO: 30171 - DNA, 20 bp, Artificial Sequence
  chemically synthesized
ggtcttcacatttgacactc

SEQ ID NO: 30172 - DNA, 20 bp, Artificial Sequence
  chemically synthesized
ctccttgagtgtcaaatgtg

SEQ ID NO: 30173 - DNA, 20 bp, Artificial Sequence
  chemically synthesized
caaatgtgaagacctaaacc

SEQ ID NO: 30174 - DNA, 20 bp, Artificial Sequence
  chemically synthesized
aaatgtgaagacctaaacct

SEQ ID NO: 30175 - DNA, 20 bp, Artificial Sequence
  chemically synthesized
agtgagagacacctaggttt

SEQ ID NO: 30176 - DNA, 20 bp, Artificial Sequence
  chemically synthesized
tagtgagagacacctaggtt

SEQ ID NO: 30177 - DNA, 20 bp, Artificial Sequence
  chemically synthesized
tcagatagtgagagacacct

SEQ ID NO: 30178 - DNA, 20 bp, Artificial Sequence
  chemically synthesized
ttcagatagtgagagacacc

SEQ ID NO: 30179 - DNA, 20 bp, Artificial Sequence
  chemically synthesized
accaagaattcagatagtga

SEQ ID NO: 30180 - DNA, 20 bp, Artificial Sequence
  chemically synthesized
ataccaagaattcagatagt

SEQ ID NO: 30181 - DNA, 20 bp, Artificial Sequence
  chemically synthesized
tgagataccaagaattcaga

SEQ ID NO: 30182 - DNA, 20 bp, Artificial Sequence
  chemically synthesized
tctctcactatctgaattct

SEQ ID NO: 30183 - DNA, 20 bp, Artificial Sequence
  chemically synthesized
gaattgagataccaagaatt

SEQ ID NO: 30184 - DNA, 20 bp, Artificial Sequence
  chemically synthesized
ggttcctgaattgagatacc

SEQ ID NO: 30185 - DNA, 20 bp, Artificial Sequence
  chemically synthesized
gaattcttggtatctcaatt

SEQ ID NO: 30186 - DNA, 20 bp, Artificial Sequence
  chemically synthesized
aattcttggtatctcaattc

SEQ ID NO: 30187 - DNA, 20 bp, Artificial Sequence
  chemically synthesized
atctattgggttcctgaatt

SEQ ID NO: 30188 - DNA, 20 bp, Artificial Sequence
  chemically synthesized
atctcaattcaggaacccaa

SEQ ID NO: 30189 - DNA, 20 bp, Artificial Sequence
  chemically synthesized
tccttatttaataatctatt

SEQ ID NO: 30190 - DNA, 20 bp, Artificial Sequence
  chemically synthesized
ctccttatttaataatctat

SEQ ID NO: 30191 - DNA, 20 bp, Artificial Sequence
  chemically synthesized
aacccaatagattattaaat

SEQ ID NO: 30192 - DNA, 20 bp, Artificial Sequence
  chemically synthesized
acccaatagattattaaata

SEQ ID NO: 30193 - DNA, 20 bp, Artificial Sequence
  chemically synthesized
ccaatagattattaaataag

SEQ ID NO: 30194 - DNA, 20 bp, Artificial Sequence
  chemically synthesized
aatagattattaaataagga

SEQ ID NO: 30195 - DNA, 20 bp, Artificial Sequence
  chemically synthesized
tattaaataaggagagacac

SEQ ID NO: 30196 - DNA, 20 bp, Artificial Sequence
  chemically synthesized
tagttattattatcatatac

SEQ ID NO: 30197 - DNA, 20 bp, Artificial Sequence
  chemically synthesized
gtgatatgcattattattat

SEQ ID NO: 30198 - DNA, 20 bp, Artificial Sequence
  chemically synthesized
ataataatgcatatcactaa

SEQ ID NO: 30199 - DNA, 20 bp, Artificial Sequence
  chemically synthesized
caaggaattataattgctat

SEQ ID NO: 30200 - DNA, 20 bp, Artificial Sequence
  chemically synthesized
aatagcaattataattcctt

SEQ ID NO: 30201 - DNA, 20 bp, Artificial Sequence
  chemically synthesized
agcaattataattccttgag

SEQ ID NO: 30202 - DNA, 20 bp, Artificial Sequence
  chemically synthesized
tctgatgtagtaactgctca

SEQ ID NO: 30203 - DNA, 20 bp, Artificial Sequence
  chemically synthesized
gtctgatgtagtaactgctc

SEQ ID NO: 30204 - DNA, 20 bp, Artificial Sequence
  chemically synthesized
tccttgagcagttactacat

SEQ ID NO: 30205 - DNA, 20 bp, Artificial Sequence
  chemically synthesized
aggtaacagaatgtctgatg

SEQ ID NO: 30206 - DNA, 20 bp, Artificial Sequence
  chemically synthesized
gaatgacatatgtaaggtaa

SEQ ID NO: 30207 - DNA, 20 bp, Artificial Sequence
  chemically synthesized
ggattagaatgacatatgta

SEQ ID NO: 30208 - DNA, 20 bp, Artificial Sequence
  chemically synthesized
aggattagaatgacatatgt

SEQ ID NO: 30209 - DNA, 20 bp, Artificial Sequence
  chemically synthesized
ttatcttgtgttgtgaggat

SEQ ID NO: 30210 - DNA, 20 bp, Artificial Sequence
  chemically synthesized
gagacttatcttgtgttgtg

SEQ ID NO: 30211 - DNA, 20 bp, Artificial Sequence
  chemically synthesized
cattctaatcctcacaacac

SEQ ID NO: 30212 - DNA, 20 bp, Artificial Sequence
  chemically synthesized
tgagacttatcttgtgttgt

SEQ ID NO: 30213 - DNA, 20 bp, Artificial Sequence
  chemically synthesized
taatcctcacaacacaagat

SEQ ID NO: 30214 - DNA, 20 bp, Artificial Sequence
  chemically synthesized
atgtattaaatagttatgat

SEQ ID NO: 30215 - DNA, 20 bp, Artificial Sequence
  chemically synthesized
cagttatgtgatgtattaaa

SEQ ID NO: 30216 - DNA, 20 bp, Artificial Sequence
  chemically synthesized
atttaatacatcacataact

SEQ ID NO: 30217 - DNA, 20 bp, Artificial Sequence
  chemically synthesized
tttaatacatcacataactg

SEQ ID NO: 30218 - DNA, 20 bp, Artificial Sequence
  chemically synthesized
ccactaataattttaaacct

SEQ ID NO: 30219 - DNA, 20 bp, Artificial Sequence
  chemically synthesized
taactgaggtttaaaattat

SEQ ID NO: 30220 - DNA, 20 bp, Artificial Sequence
  chemically synthesized
ctgaggtttaaaattattag

SEQ ID NO: 30221 - DNA, 20 bp, Artificial Sequence
  chemically synthesized
gttctctgtggtcaaaaagg

SEQ ID NO: 30222 - DNA, 20 bp, Artificial Sequence
  chemically synthesized
ccagttctctgtggtcaaaa

SEQ ID NO: 30223 - DNA, 20 bp, Artificial Sequence
  chemically synthesized
accagttctctgtggtcaaa

SEQ ID NO: 30224 - DNA, 20 bp, Artificial Sequence
  chemically synthesized
agtggcttcctttttgacca

SEQ ID NO: 30225 - DNA, 20 bp, Artificial Sequence
  chemically synthesized
tggcttcctttttgaccaca

SEQ ID NO: 30226 - DNA, 20 bp, Artificial Sequence
  chemically synthesized
attctgtcaccagttctctg

SEQ ID NO: 30227 - DNA, 20 bp, Artificial Sequence
  chemically synthesized
cctttttgaccacagagaac

SEQ ID NO: 30228 - DNA, 20 bp, Artificial Sequence
  chemically synthesized
tgaccacagagaactggtga

SEQ ID NO: 30229 - DNA, 20 bp, Artificial Sequence
  chemically synthesized
ttaaattctgattctgtcac

SEQ ID NO: 30230 - DNA, 20 bp, Artificial Sequence
  chemically synthesized
cagagaactggtgacagaat

SEQ ID NO: 30231 - DNA, 20 bp, Artificial Sequence
  chemically synthesized
acagaatcagaatttaaatc

SEQ ID NO: 30232 - DNA, 20 bp, Artificial Sequence
  chemically synthesized
agaatttaaatccagcctca

SEQ ID NO: 30233 - DNA, 20 bp, Artificial Sequence
  chemically synthesized
ttgttcattgactttgaggc

SEQ ID NO: 30234 - DNA, 20 bp, Artificial Sequence
  chemically synthesized
aaaattgttcattgactttg

SEQ ID NO: 30235 - DNA, 20 bp, Artificial Sequence
  chemically synthesized
caaaattgttcattgacttt

SEQ ID NO: 30236 - DNA, 20 bp, Artificial Sequence
  chemically synthesized
ggtttggaggcaatgttttg

SEQ ID NO: 30237 - DNA, 20 bp, Artificial Sequence
  chemically synthesized
ctttatgagtttaggtttgg

SEQ ID NO: 30238 - DNA, 20 bp, Artificial Sequence
  chemically synthesized
actttatgagtttaggtttg

SEQ ID NO: 30239 - DNA, 20 bp, Artificial Sequence
  chemically synthesized
tcactttatgagtttaggtt

SEQ ID NO: 30240 - DNA, 20 bp, Artificial Sequence
  chemically synthesized
tattgtcactttatgagttt

SEQ ID NO: 30241 - DNA, 20 bp, Artificial Sequence
  chemically synthesized
ctattgtcactttatgagtt

SEQ ID NO: 30242 - DNA, 20 bp, Artificial Sequence
  chemically synthesized
cctccaaacctaaactcata

SEQ ID NO: 30243 - DNA, 20 bp, Artificial Sequence
  chemically synthesized
ctttcctattgtcactttat

SEQ ID NO: 30244 - DNA, 20 bp, Artificial Sequence
  chemically synthesized
ctaaactcataaagtgacaa

SEQ ID NO: 30245 - DNA, 20 bp, Artificial Sequence
  chemically synthesized
taaactcataaagtgacaat

SEQ ID NO: 30246 - DNA, 20 bp, Artificial Sequence
  chemically synthesized
ctcataaagtgacaatagga

SEQ ID NO: 30247 - DNA, 20 bp, Artificial Sequence
  chemically synthesized
aagtgacaataggaaagtca

SEQ ID NO: 30248 - DNA, 20 bp, Artificial Sequence
  chemically synthesized
aaagtcacagtataatcaat

SEQ ID NO: 30249 - DNA, 20 bp, Artificial Sequence
  chemically synthesized
ttatggggtgcattcagtgg

SEQ ID NO: 30250 - DNA, 20 bp, Artificial Sequence
  chemically synthesized
tttatggggtgcattcagtg

SEQ ID NO: 30251 - DNA, 20 bp, Artificial Sequence
  chemically synthesized
ctttatggggtgcattcagt

SEQ ID NO: 30252 - DNA, 20 bp, Artificial Sequence
  chemically synthesized
tctttatggggtgcattcag

SEQ ID NO: 30253 - DNA, 20 bp, Artificial Sequence
  chemically synthesized
cactctttatggggtgcatt

SEQ ID NO: 30254 - DNA, 20 bp, Artificial Sequence
  chemically synthesized
cccactgaatgcaccccata

SEQ ID NO: 30255 - DNA, 20 bp, Artificial Sequence
  chemically synthesized
cactgaatgcaccccataaa

SEQ ID NO: 30256 - DNA, 20 bp, Artificial Sequence
  chemically synthesized
tgatatatgcactctttatg

SEQ ID NO: 30257 - DNA, 20 bp, Artificial Sequence
  chemically synthesized
gtgatatatgcactctttat

SEQ ID NO: 30258 - DNA, 20 bp, Artificial Sequence
  chemically synthesized
tgtgatatatgcactcttta

SEQ ID NO: 30259 - DNA, 20 bp, Artificial Sequence
  chemically synthesized
cataaagagtgcatatatca

SEQ ID NO: 30260 - DNA, 20 bp, Artificial Sequence
  chemically synthesized
atatatcacagtttatattc

SEQ ID NO: 30261 - DNA, 20 bp, Artificial Sequence
  chemically synthesized
acagtttatattctagataa

SEQ ID NO: 30262 - DNA, 20 bp, Artificial Sequence
  chemically synthesized
aatacaggtttgcttttatc

SEQ ID NO: 30263 - DNA, 20 bp, Artificial Sequence
  chemically synthesized
atgtgataagtttaaaatac

SEQ ID NO: 30264 - DNA, 20 bp, Artificial Sequence
  chemically synthesized
aatgtgataagtttaaaata

SEQ ID NO: 30265 - DNA, 20 bp, Artificial Sequence
  chemically synthesized
tataatgtatataatgtgat

SEQ ID NO: 30266 - DNA, 20 bp, Artificial Sequence
  chemically synthesized
atatacattatatttaatta

SEQ ID NO: 30267 - DNA, 20 bp, Artificial Sequence
  chemically synthesized
tatacattatatttaattat

SEQ ID NO: 30268 - DNA, 20 bp, Artificial Sequence
  chemically synthesized
atacattatatttaattata

SEQ ID NO: 30269 - DNA, 20 bp, Artificial Sequence
  chemically synthesized
tacattatatttaattatag

SEQ ID NO: 30270 - DNA, 20 bp, Artificial Sequence
  chemically synthesized
acattatatttaattatagg

SEQ ID NO: 30271 - DNA, 20 bp, Artificial Sequence
  chemically synthesized
tatttaattatagggggtgc

SEQ ID NO: 30272 - DNA, 20 bp, Artificial Sequence
  chemically synthesized
tttaattatagggggtgcga

SEQ ID NO: 30273 - DNA, 20 bp, Artificial Sequence
  chemically synthesized
gggtgcgagagacattaaac

SEQ ID NO: 30274 - DNA, 20 bp, Artificial Sequence
  chemically synthesized
ggtgcgagagacattaaact

SEQ ID NO: 30275 - DNA, 20 bp, Artificial Sequence
  chemically synthesized
gcgagagacattaaactagg

SEQ ID NO: 30276 - DNA, 20 bp, Artificial Sequence
  chemically synthesized
agagacattaaactaggcag

SEQ ID NO: 30277 - DNA, 20 bp, Artificial Sequence
  chemically synthesized
gcggcagagccactgctgcc

SEQ ID NO: 30278 - DNA, 20 bp, Artificial Sequence
  chemically synthesized
gacattaaactaggcagcag

SEQ ID NO: 30279 - DNA, 20 bp, Artificial Sequence
  chemically synthesized
gaaccagagattaagcggca

SEQ ID NO: 30280 - DNA, 20 bp, Artificial Sequence
  chemically synthesized
aggaaccagagattaagcgg

SEQ ID NO: 30281 - DNA, 20 bp, Artificial Sequence
  chemically synthesized
ggaaggaaccagagattaag

SEQ ID NO: 30282 - DNA, 20 bp, Artificial Sequence
  chemically synthesized
tggctctgccgcttaatctc

SEQ ID NO: 30283 - DNA, 20 bp, Artificial Sequence
  chemically synthesized
acaggaaggaaccagagatt

SEQ ID NO: 30284 - DNA, 20 bp, Artificial Sequence
  chemically synthesized
tgtgttacaggaaggaacca

SEQ ID NO: 30285 - DNA, 20 bp, Artificial Sequence
  chemically synthesized
attgtgttacaggaaggaac

SEQ ID NO: 30286 - DNA, 20 bp, Artificial Sequence
  chemically synthesized
gaaatcattgtgttacagga

SEQ ID NO: 30287 - DNA, 20 bp, Artificial Sequence
  chemically synthesized
agaaatcattgtgttacagg

SEQ ID NO: 30288 - DNA, 20 bp, Artificial Sequence
  chemically synthesized
catagaaatcattgtgttac

SEQ ID NO: 30289 - DNA, 20 bp, Artificial Sequence
  chemically synthesized
gcatagaaatcattgtgtta

SEQ ID NO: 30290 - DNA, 20 bp, Artificial Sequence
  chemically synthesized
ttgttttagaagacaaagca

SEQ ID NO: 30291 - DNA, 20 bp, Artificial Sequence
  chemically synthesized
agcaattgttttagaagaca

SEQ ID NO: 30292 - DNA, 20 bp, Artificial Sequence
  chemically synthesized
ctccttagcaattgttttag

SEQ ID NO: 30293 - DNA, 20 bp, Artificial Sequence
  chemically synthesized
gctctccttagcaattgttt

SEQ ID NO: 30294 - DNA, 20 bp, Artificial Sequence
  chemically synthesized
tgtcttctaaaacaattgct

SEQ ID NO: 30295 - DNA, 20 bp, Artificial Sequence
  chemically synthesized
gtcttctaaaacaattgcta

SEQ ID NO: 30296 - DNA, 20 bp, Artificial Sequence
  chemically synthesized
cttctaaaacaattgctaag

SEQ ID NO: 30297 - DNA, 20 bp, Artificial Sequence
  chemically synthesized
tctaaaacaattgctaagga

SEQ ID NO: 30298 - DNA, 20 bp, Artificial Sequence
  chemically synthesized
tcccacttggtagctctcct

SEQ ID NO: 30299 - DNA, 20 bp, Artificial Sequence
  chemically synthesized
aattgctaaggagagctacc

SEQ ID NO: 30300 - DNA, 20 bp, Artificial Sequence
  chemically synthesized
tgctaaggagagctaccaag

SEQ ID NO: 30301 - DNA, 20 bp, Artificial Sequence
  chemically synthesized
gctaaggagagctaccaagt

SEQ ID NO: 30302 - DNA, 20 bp, Artificial Sequence
  chemically synthesized
ctattttctttcccacttgg

SEQ ID NO: 30303 - DNA, 20 bp, Artificial Sequence
  chemically synthesized
aggagagctaccaagtggga

SEQ ID NO: 30304 - DNA, 20 bp, Artificial Sequence
  chemically synthesized
gatctattttctttcccact

SEQ ID NO: 30305 - DNA, 20 bp, Artificial Sequence
  chemically synthesized
ctaccaagtgggaaagaaaa

SEQ ID NO: 30306 - DNA, 20 bp, Artificial Sequence
  chemically synthesized
agtcaagttcaggcagagga

SEQ ID NO: 30307 - DNA, 20 bp, Artificial Sequence
  chemically synthesized
gagtcaagttcaggcagagg

SEQ ID NO: 30308 - DNA, 20 bp, Artificial Sequence
  chemically synthesized
tgagtcaagttcaggcagag

SEQ ID NO: 30309 - DNA, 20 bp, Artificial Sequence
  chemically synthesized
gttgagtcaagttcaggcag

SEQ ID NO: 30310 - DNA, 20 bp, Artificial Sequence
  chemically synthesized
agttgagtcaagttcaggca

SEQ ID NO: 30311 - DNA, 20 bp, Artificial Sequence
  chemically synthesized
ccagttgagtcaagttcagg

SEQ ID NO: 30312 - DNA, 20 bp, Artificial Sequence
  chemically synthesized
ttgccagttgagtcaagttc

SEQ ID NO: 30313 - DNA, 20 bp, Artificial Sequence
  chemically synthesized
tttgccagttgagtcaagtt

SEQ ID NO: 30314 - DNA, 20 bp, Artificial Sequence
  chemically synthesized
aatgttttgccagttgagtc

SEQ ID NO: 30315 - DNA, 20 bp, Artificial Sequence
  chemically synthesized
ctgcctgaacttgactcaac

SEQ ID NO: 30316 - DNA, 20 bp, Artificial Sequence
  chemically synthesized
ggtttaatgttttgccagtt

SEQ ID NO: 30317 - DNA, 20 bp, Artificial Sequence
  chemically synthesized
tatgcggtttaatgttttgc

SEQ ID NO: 30318 - DNA, 20 bp, Artificial Sequence
  chemically synthesized
acctgaaaatgttatttatg

SEQ ID NO: 30319 - DNA, 20 bp, Artificial Sequence
  chemically synthesized
aaccgcataaataacatttt

SEQ ID NO: 30320 - DNA, 20 bp, Artificial Sequence
  chemically synthesized
accgcataaataacattttc

SEQ ID NO: 30321 - DNA, 20 bp, Artificial Sequence
  chemically synthesized
cattttcaggtgttcctgtt

SEQ ID NO: 30322 - DNA, 20 bp, Artificial Sequence
  chemically synthesized
gggaggataattaaccaaac

SEQ ID NO: 30323 - DNA, 20 bp, Artificial Sequence
  chemically synthesized
ggggaggataattaaccaaa

SEQ ID NO: 30324 - DNA, 20 bp, Artificial Sequence
  chemically synthesized
caagtgactcaggtcggggg

SEQ ID NO: 30325 - DNA, 20 bp, Artificial Sequence
  chemically synthesized
tcaagtgactcaggtcgggg

SEQ ID NO: 30326 - DNA, 20 bp, Artificial Sequence
  chemically synthesized
taattatcctcccccgacct

SEQ ID NO: 30327 - DNA, 20 bp, Artificial Sequence
  chemically synthesized
aatcaagtgactcaggtcgg

SEQ ID NO: 30328 - DNA, 20 bp, Artificial Sequence
  chemically synthesized
aaatcaagtgactcaggtcg

SEQ ID NO: 30329 - DNA, 20 bp, Artificial Sequence
  chemically synthesized
caaatcaagtgactcaggtc

SEQ ID NO: 30330 - DNA, 20 bp, Artificial Sequence
  chemically synthesized
tcaaatcaagtgactcaggt

SEQ ID NO: 30331 - DNA, 20 bp, Artificial Sequence
  chemically synthesized
aaactcaaatcaagtgactc

SEQ ID NO: 30332 - DNA, 20 bp, Artificial Sequence
  chemically synthesized
taaactcaaatcaagtgact

SEQ ID NO: 30333 - DNA, 20 bp, Artificial Sequence
  chemically synthesized
cgacctgagtcacttgattt

SEQ ID NO: 30334 - DNA, 20 bp, Artificial Sequence
  chemically synthesized
tataaatgtaaactcaaatc

SEQ ID NO: 30335 - DNA, 20 bp, Artificial Sequence
  chemically synthesized
ctagagcacttaatttttga

SEQ ID NO: 30336 - DNA, 20 bp, Artificial Sequence
  chemically synthesized
catttatactttcaaaaatt

SEQ ID NO: 30337 - DNA, 20 bp, Artificial Sequence
  chemically synthesized
ctttcaaaaattaagtgctc

SEQ ID NO: 30338 - DNA, 20 bp, Artificial Sequence
  chemically synthesized
aaaaattaagtgctctagaa

SEQ ID NO: 30339 - DNA, 20 bp, Artificial Sequence
  chemically synthesized
ttttgagtagcactgttcta

SEQ ID NO: 30340 - DNA, 20 bp, Artificial Sequence
  chemically synthesized
tattttgagtagcactgttc

SEQ ID NO: 30341 - DNA, 20 bp, Artificial Sequence
  chemically synthesized
gtgaaagaccatattttgag

SEQ ID NO: 30342 - DNA, 20 bp, Artificial Sequence
  chemically synthesized
gaacagtgctactcaaaata

SEQ ID NO: 30343 - DNA, 20 bp, Artificial Sequence
  chemically synthesized
cttgtgaaagaccatatttt

SEQ ID NO: 30344 - DNA, 20 bp, Artificial Sequence
  chemically synthesized
ctcaaaatatggtctttcac

SEQ ID NO: 30345 - DNA, 20 bp, Artificial Sequence
  chemically synthesized
gtccatatctatgcttgtga

SEQ ID NO: 30346 - DNA, 20 bp, Artificial Sequence
  chemically synthesized
aatatggtctttcacaagca

SEQ ID NO: 30347 - DNA, 20 bp, Artificial Sequence
  chemically synthesized
gtctttcacaagcatagata

SEQ ID NO: 30348 - DNA, 20 bp, Artificial Sequence
  chemically synthesized
ttcacaagcatagatatgga

SEQ ID NO: 30349 - DNA, 20 bp, Artificial Sequence
  chemically synthesized
atagatatggacagtgtgtt

SEQ ID NO: 30350 - DNA, 20 bp, Artificial Sequence
  chemically synthesized
agtgtgttaagtaacttcta

SEQ ID NO: 30351 - DNA, 20 bp, Artificial Sequence
  chemically synthesized
gcaatgtcaaattgctatag

SEQ ID NO: 30352 - DNA, 20 bp, Artificial Sequence
  chemically synthesized
atggcaatgtcaaattgcta

SEQ ID NO: 30353 - DNA, 20 bp, Artificial Sequence
  chemically synthesized
gatcatgaatttggatgtca

SEQ ID NO: 30354 - DNA, 20 bp, Artificial Sequence
  chemically synthesized
gaattcattgatcatgaatt

SEQ ID NO: 30355 - DNA, 20 bp, Artificial Sequence
  chemically synthesized
tgatcaatgaattcatctca

SEQ ID NO: 30356 - DNA, 20 bp, Artificial Sequence
  chemically synthesized
atcaatgaattcatctcatg

SEQ ID NO: 30357 - DNA, 20 bp, Artificial Sequence
  chemically synthesized
aatgaattcatctcatggag

SEQ ID NO: 30358 - DNA, 20 bp, Artificial Sequence
  chemically synthesized
atgaattcatctcatggagc

SEQ ID NO: 30359 - DNA, 20 bp, Artificial Sequence
  chemically synthesized
tcgtctgtaccctgctccat

SEQ ID NO: 30360 - DNA, 20 bp, Artificial Sequence
  chemically synthesized
tgaattcatctcatggagca

SEQ ID NO: 30361 - DNA, 20 bp, Artificial Sequence
  chemically synthesized
tcatctcatggagcagggta

SEQ ID NO: 30362 - DNA, 20 bp, Artificial Sequence
  chemically synthesized
tcatggagcagggtacagac

SEQ ID NO: 30363 - DNA, 20 bp, Artificial Sequence
  chemically synthesized
catggagcagggtacagacg

SEQ ID NO: 30364 - DNA, 20 bp, Artificial Sequence
  chemically synthesized
agcagggtacagacgaggtc

SEQ ID NO: 30365 - DNA, 20 bp, Artificial Sequence
  chemically synthesized
tgttgttgaacttgactgtt

SEQ ID NO: 30366 - DNA, 20 bp, Artificial Sequence
  chemically synthesized
ccacatgtaactcaacagtc

SEQ ID NO: 30367 - DNA, 20 bp, Artificial Sequence
  chemically synthesized
tcacaccacatgtaactcaa

SEQ ID NO: 30368 - DNA, 20 bp, Artificial Sequence
  chemically synthesized
cttgactgttgagttacatg

SEQ ID NO: 30369 - DNA, 20 bp, Artificial Sequence
  chemically synthesized
tggtgtgaatgcatacttgt

SEQ ID NO: 30370 - DNA, 20 bp, Artificial Sequence
  chemically synthesized
gtggtgctaatgaaactgac

SEQ ID NO: 30371 - DNA, 20 bp, Artificial Sequence
  chemically synthesized
tgcatacttgtcagtttcat

SEQ ID NO: 30372 - DNA, 20 bp, Artificial Sequence
  chemically synthesized
acacatcacagatttttagg

SEQ ID NO: 30373 - DNA, 20 bp, Artificial Sequence
  chemically synthesized
actacacatcacagattttt

SEQ ID NO: 30374 - DNA, 20 bp, Artificial Sequence
  chemically synthesized
tactacacatcacagatttt

SEQ ID NO: 30375 - DNA, 20 bp, Artificial Sequence
  chemically synthesized
acctaaaaatctgtgatgtg

SEQ ID NO: 30376 - DNA, 20 bp, Artificial Sequence
  chemically synthesized
ttttaacatactacacatca

SEQ ID NO: 30377 - DNA, 20 bp, Artificial Sequence
  chemically synthesized
tatgttaaaaaccaccaccg

SEQ ID NO: 30378 - DNA, 20 bp, Artificial Sequence
  chemically synthesized
actgcacccagccgcggtgg

SEQ ID NO: 30379 - DNA, 20 bp, Artificial Sequence
  chemically synthesized
ttaaaaaccaccaccgcggc

SEQ ID NO: 30380 - DNA, 20 bp, Artificial Sequence
  chemically synthesized
accactgcacccagccgcgg

SEQ ID NO: 30381 - DNA, 20 bp, Artificial Sequence
  chemically synthesized
taaaaaccaccaccgcggct

SEQ ID NO: 30382 - DNA, 20 bp, Artificial Sequence
  chemically synthesized
tgaaccactgcacccagccg

SEQ ID NO: 30383 - DNA, 20 bp, Artificial Sequence
  chemically synthesized
accaccaccgcggctgggtg

SEQ ID NO: 30384 - DNA, 20 bp, Artificial Sequence
  chemically synthesized
accaccgcggctgggtgcag

SEQ ID NO: 30385 - DNA, 20 bp, Artificial Sequence
  chemically synthesized
caggcgtgaaccactgcacc

SEQ ID NO: 30386 - DNA, 20 bp, Artificial Sequence
  chemically synthesized
gtggttcacgcctgtaatcc

SEQ ID NO: 30387 - DNA, 20 bp, Artificial Sequence
  chemically synthesized
tcccaaactgctgggattac

SEQ ID NO: 30388 - DNA, 20 bp, Artificial Sequence
  chemically synthesized
ctcccaaactgctgggatta

SEQ ID NO: 30389 - DNA, 20 bp, Artificial Sequence
  chemically synthesized
gttcacgcctgtaatcccag

SEQ ID NO: 30390 - DNA, 20 bp, Artificial Sequence
  chemically synthesized
cgcctgtaatcccagcagtt

SEQ ID NO: 30391 - DNA, 20 bp, Artificial Sequence
  chemically synthesized
cctccgcctcccaaactgct

SEQ ID NO: 30392 - DNA, 20 bp, Artificial Sequence
  chemically synthesized
gcctgtaatcccagcagttt

SEQ ID NO: 30393 - DNA, 20 bp, Artificial Sequence
  chemically synthesized
gcctccgcctcccaaactgc

SEQ ID NO: 30394 - DNA, 20 bp, Artificial Sequence
  chemically synthesized
ctgtaatcccagcagtttgg

SEQ ID NO: 30395 - DNA, 20 bp, Artificial Sequence
  chemically synthesized
tgtaatcccagcagtttggg

SEQ ID NO: 30396 - DNA, 20 bp, Artificial Sequence
  chemically synthesized
aatcccagcagtttgggagg

SEQ ID NO: 30397 - DNA, 20 bp, Artificial Sequence
  chemically synthesized
tcccagcagtttgggaggcg

SEQ ID NO: 30398 - DNA, 20 bp, Artificial Sequence
  chemically synthesized
cccagcagtttgggaggcgg

SEQ ID NO: 30399 - DNA, 20 bp, Artificial Sequence
  chemically synthesized
gcagtttgggaggcggaggc

SEQ ID NO: 30400 - DNA, 20 bp, Artificial Sequence
  chemically synthesized
gtttgggaggcggaggctgg

SEQ ID NO: 30401 - DNA, 20 bp, Artificial Sequence
  chemically synthesized
ctcttgacctcatgatctgc

SEQ ID NO: 30402 - DNA, 20 bp, Artificial Sequence
  chemically synthesized
ggcggaggctggcagatcat

SEQ ID NO: 30403 - DNA, 20 bp, Artificial Sequence
  chemically synthesized
gcggaggctggcagatcatg

SEQ ID NO: 30404 - DNA, 20 bp, Artificial Sequence
  chemically synthesized
ggctggcagatcatgaggtc

SEQ ID NO: 30405 - DNA, 20 bp, Artificial Sequence
  chemically synthesized
ctggcagatcatgaggtcaa

SEQ ID NO: 30406 - DNA, 20 bp, Artificial Sequence
  chemically synthesized
gatcatgaggtcaagagatc

SEQ ID NO: 30407 - DNA, 20 bp, Artificial Sequence
  chemically synthesized
tcaagagatcgagaccatcc

SEQ ID NO: 30408 - DNA, 20 bp, Artificial Sequence
  chemically synthesized
tttcaccatgttggctagga

SEQ ID NO: 30409 - DNA, 20 bp, Artificial Sequence
  chemically synthesized
ggggtttcaccatgttggct

SEQ ID NO: 30410 - DNA, 20 bp, Artificial Sequence
  chemically synthesized
cgagaccatcctagccaaca

SEQ ID NO: 30411 - DNA, 20 bp, Artificial Sequence
  chemically synthesized
cggggtttcaccatgttggc

SEQ ID NO: 30412 - DNA, 20 bp, Artificial Sequence
  chemically synthesized
gagacggggtttcaccatgt

SEQ ID NO: 30413 - DNA, 20 bp, Artificial Sequence
  chemically synthesized
ttgcatttttagtagagacg

SEQ ID NO: 30414 - DNA, 20 bp, Artificial Sequence
  chemically synthesized
tttgcatttttagtagagac

SEQ ID NO: 30415 - DNA, 20 bp, Artificial Sequence
  chemically synthesized
ttttgcatttttagtagaga

SEQ ID NO: 30416 - DNA, 20 bp, Artificial Sequence
  chemically synthesized
taatttttgcatttttagta

SEQ ID NO: 30417 - DNA, 20 bp, Artificial Sequence
  chemically synthesized
gctaatttttgcatttttag

SEQ ID NO: 30418 - DNA, 20 bp, Artificial Sequence
  chemically synthesized
ccagctaatttttgcatttt

SEQ ID NO: 30419 - DNA, 20 bp, Artificial Sequence
  chemically synthesized
tctactaaaaatgcaaaaat

SEQ ID NO: 30420 - DNA, 20 bp, Artificial Sequence
  chemically synthesized
ctaaaaatgcaaaaattagc

SEQ ID NO: 30421 - DNA, 20 bp, Artificial Sequence
  chemically synthesized
taaaaatgcaaaaattagct

SEQ ID NO: 30422 - DNA, 20 bp, Artificial Sequence
  chemically synthesized
atgcaaaaattagctgggtg

SEQ ID NO: 30423 - DNA, 20 bp, Artificial Sequence
  chemically synthesized
caaaaattagctgggtgtgg

SEQ ID NO: 30424 - DNA, 20 bp, Artificial Sequence
  chemically synthesized
caggtgtgcaccaccacacc

SEQ ID NO: 30425 - DNA, 20 bp, Artificial Sequence
  chemically synthesized
gtggtgcacacctgtaatcc

SEQ ID NO: 30426 - DNA, 20 bp, Artificial Sequence
  chemically synthesized
tcccgagtagctgggattac

SEQ ID NO: 30427 - DNA, 20 bp, Artificial Sequence
  chemically synthesized
ctcccgagtagctgggatta

SEQ ID NO: 30428 - DNA, 20 bp, Artificial Sequence
  chemically synthesized
cacctgtaatcccagctact

SEQ ID NO: 30429 - DNA, 20 bp, Artificial Sequence
  chemically synthesized
cctcagcctcccgagtagct

SEQ ID NO: 30430 - DNA, 20 bp, Artificial Sequence
  chemically synthesized
acctgtaatcccagctactc

SEQ ID NO: 30431 - DNA, 20 bp, Artificial Sequence
  chemically synthesized
gcctcagcctcccgagtagc

SEQ ID NO: 30432 - DNA, 20 bp, Artificial Sequence
  chemically synthesized
ctgtaatcccagctactcgg

SEQ ID NO: 30433 - DNA, 20 bp, Artificial Sequence
  chemically synthesized
tgtaatcccagctactcggg

SEQ ID NO: 30434 - DNA, 20 bp, Artificial Sequence
  chemically synthesized
tcctgcctcagcctcccgag

SEQ ID NO: 30435 - DNA, 20 bp, Artificial Sequence
  chemically synthesized
ttttcctgcctcagcctccc

SEQ ID NO: 30436 - DNA, 20 bp, Artificial Sequence
  chemically synthesized
tcccagctactcgggaggct

SEQ ID NO: 30437 - DNA, 20 bp, Artificial Sequence
  chemically synthesized
cccagctactcgggaggctg

SEQ ID NO: 30438 - DNA, 20 bp, Artificial Sequence
  chemically synthesized
agctactcgggaggctgagg

SEQ ID NO: 30439 - DNA, 20 bp, Artificial Sequence
  chemically synthesized
gctactcgggaggctgaggc

SEQ ID NO: 30440 - DNA, 20 bp, Artificial Sequence
  chemically synthesized
ttcaagcgattttcctgcct

SEQ ID NO: 30441 - DNA, 20 bp, Artificial Sequence
  chemically synthesized
gcaggaaaatcgcttgaacc

SEQ ID NO: 30442 - DNA, 20 bp, Artificial Sequence
  chemically synthesized
caggaaaatcgcttgaaccc

SEQ ID NO: 30443 - DNA, 20 bp, Artificial Sequence
  chemically synthesized
aaactctgcctcccgggttc

SEQ ID NO: 30444 - DNA, 20 bp, Artificial Sequence
  chemically synthesized
ggaaaatcgcttgaacccgg

SEQ ID NO: 30445 - DNA, 20 bp, Artificial Sequence
  chemically synthesized
gaaaatcgcttgaacccggg

SEQ ID NO: 30446 - DNA, 20 bp, Artificial Sequence
  chemically synthesized
aatcgcttgaacccgggagg

SEQ ID NO: 30447 - DNA, 20 bp, Artificial Sequence
  chemically synthesized
cactgcaaactctgcctccc

SEQ ID NO: 30448 - DNA, 20 bp, Artificial Sequence
  chemically synthesized
tcgcttgaacccgggaggca

SEQ ID NO: 30449 - DNA, 20 bp, Artificial Sequence
  chemically synthesized
tcactgcaaactctgcctcc

SEQ ID NO: 30450 - DNA, 20 bp, Artificial Sequence
  chemically synthesized
aacccgggaggcagagtttg

SEQ ID NO: 30451 - DNA, 20 bp, Artificial Sequence
  chemically synthesized
cgggaggcagagtttgcagt

SEQ ID NO: 30452 - DNA, 20 bp, Artificial Sequence
  chemically synthesized
ggagtgcagtggtgcgattt

SEQ ID NO: 30453 - DNA, 20 bp, Artificial Sequence
  chemically synthesized
gttgccaggctggagtgcag

SEQ ID NO: 30454 - DNA, 20 bp, Artificial Sequence
  chemically synthesized
aaaatcgcaccactgcactc

SEQ ID NO: 30455 - DNA, 20 bp, Artificial Sequence
  chemically synthesized
tctgttgccaggctggagtg

SEQ ID NO: 30456 - DNA, 20 bp, Artificial Sequence
  chemically synthesized
cgcaccactgcactccagcc

SEQ ID NO: 30457 - DNA, 20 bp, Artificial Sequence
  chemically synthesized
cttgctctgttgccaggctg

SEQ ID NO: 30458 - DNA, 20 bp, Artificial Sequence
  chemically synthesized
gtcttgctctgttgccaggc

SEQ ID NO: 30459 - DNA, 20 bp, Artificial Sequence
  chemically synthesized
actgcactccagcctggcaa

SEQ ID NO: 30460 - DNA, 20 bp, Artificial Sequence
  chemically synthesized
tgcactccagcctggcaaca

SEQ ID NO: 30461 - DNA, 20 bp, Artificial Sequence
  chemically synthesized
cagagtcttgctctgttgcc

SEQ ID NO: 30462 - DNA, 20 bp, Artificial Sequence
  chemically synthesized
acagagtcttgctctgttgc

SEQ ID NO: 30463 - DNA, 20 bp, Artificial Sequence
  chemically synthesized
ctccagcctggcaacagagc

SEQ ID NO: 30464 - DNA, 20 bp, Artificial Sequence
  chemically synthesized
ttttttgtttttttgagaca

SEQ ID NO: 30465 - DNA, 20 bp, Artificial Sequence
  chemically synthesized
ttttttttgtttttttgaga

SEQ ID NO: 30466 - DNA, 20 bp, Artificial Sequence
  chemically synthesized
gtttttttttttgttttttt

SEQ ID NO: 30467 - DNA, 20 bp, Artificial Sequence
  chemically synthesized
gccaggtttttgttggtggt

SEQ ID NO: 30468 - DNA, 20 bp, Artificial Sequence
  chemically synthesized
ggccaggtttttgttggtgg

SEQ ID NO: 30469 - DNA, 20 bp, Artificial Sequence
  chemically synthesized
aagggccaggtttttgttgg

SEQ ID NO: 30470 - DNA, 20 bp, Artificial Sequence
  chemically synthesized
gtgaagggccaggtttttgt

SEQ ID NO: 30471 - DNA, 20 bp, Artificial Sequence
  chemically synthesized
acccaccaccaacaaaaacc

SEQ ID NO: 30472 - DNA, 20 bp, Artificial Sequence
  chemically synthesized
tctcaaactggtgaagggcc

SEQ ID NO: 30473 - DNA, 20 bp, Artificial Sequence
  chemically synthesized
ttctcaaactggtgaagggc

SEQ ID NO: 30474 - DNA, 20 bp, Artificial Sequence
  chemically synthesized
acaaaaacctggcccttcac

SEQ ID NO: 30475 - DNA, 20 bp, Artificial Sequence
  chemically synthesized
gtgcttctcaaactggtgaa

SEQ ID NO: 30476 - DNA, 20 bp, Artificial Sequence
  chemically synthesized
agtgcttctcaaactggtga

SEQ ID NO: 30477 - DNA, 20 bp, Artificial Sequence
  chemically synthesized
cagtgcttctcaaactggtg

SEQ ID NO: 30478 - DNA, 20 bp, Artificial Sequence
  chemically synthesized
acctggcccttcaccagttt

SEQ ID NO: 30479 - DNA, 20 bp, Artificial Sequence
  chemically synthesized
tggcccttcaccagtttgag

SEQ ID NO: 30480 - DNA, 20 bp, Artificial Sequence
  chemically synthesized
aagagcagtgcttctcaaac

SEQ ID NO: 30481 - DNA, 20 bp, Artificial Sequence
  chemically synthesized
gtttgagaagcactgctctt

SEQ ID NO: 30482 - DNA, 20 bp, Artificial Sequence
  chemically synthesized
aagaagctatcactgaagag

SEQ ID NO: 30483 - DNA, 20 bp, Artificial Sequence
  chemically synthesized
aaaaagaagctatcactgaa

SEQ ID NO: 30484 - DNA, 20 bp, Artificial Sequence
  chemically synthesized
gaagcactgctcttcagtga

SEQ ID NO: 30485 - DNA, 20 bp, Artificial Sequence
  chemically synthesized
aaaaaaagaagctatcactg

SEQ ID NO: 30486 - DNA, 20 bp, Artificial Sequence
  chemically synthesized
tcttagaaaaaaaaaaaaag

SEQ ID NO: 30487 - DNA, 20 bp, Artificial Sequence
  chemically synthesized
ttgtcttagaaaaaaaaaaa

SEQ ID NO: 30488 - DNA, 20 bp, Artificial Sequence
  chemically synthesized
gcttctttttttttttttct

SEQ ID NO: 30489 - DNA, 20 bp, Artificial Sequence
  chemically synthesized
aatatagcaagacgttgtct

SEQ ID NO: 30490 - DNA, 20 bp, Artificial Sequence
  chemically synthesized
tccagcctgggcaatatagc

SEQ ID NO: 30491 - DNA, 20 bp, Artificial Sequence
  chemically synthesized
caacgtcttgctatattgcc

SEQ ID NO: 30492 - DNA, 20 bp, Artificial Sequence
  chemically synthesized
tgagtccagcctgggcaata

SEQ ID NO: 30493 - DNA, 20 bp, Artificial Sequence
  chemically synthesized
aacgtcttgctatattgccc

SEQ ID NO: 30494 - DNA, 20 bp, Artificial Sequence
  chemically synthesized
tcttgctatattgcccaggc

SEQ ID NO: 30495 - DNA, 20 bp, Artificial Sequence
  chemically synthesized
caggaatttgagtccagcct

SEQ ID NO: 30496 - DNA, 20 bp, Artificial Sequence
  chemically synthesized
ccaggaatttgagtccagcc

SEQ ID NO: 30497 - DNA, 20 bp, Artificial Sequence
  chemically synthesized
tgagcccaggaatttgagtc

SEQ ID NO: 30498 - DNA, 20 bp, Artificial Sequence
  chemically synthesized
ccaggctggactcaaattcc

SEQ ID NO: 30499 - DNA, 20 bp, Artificial Sequence
  chemically synthesized
tcccttgagcccaggaattt

SEQ ID NO: 30500 - DNA, 20 bp, Artificial Sequence
  chemically synthesized
caggctggactcaaattcct

SEQ ID NO: 30501 - DNA, 20 bp, Artificial Sequence
  chemically synthesized
ggactcaaattcctgggctc

SEQ ID NO: 30502 - DNA, 20 bp, Artificial Sequence
  chemically synthesized
gactcaaattcctgggctca

SEQ ID NO: 30503 - DNA, 20 bp, Artificial Sequence
  chemically synthesized
cagaaggatcccttgagccc

SEQ ID NO: 30504 - DNA, 20 bp, Artificial Sequence
  chemically synthesized
actcaaattcctgggctcaa

SEQ ID NO: 30505 - DNA, 20 bp, Artificial Sequence
  chemically synthesized
gcagaaggatcccttgagcc

SEQ ID NO: 30506 - DNA, 20 bp, Artificial Sequence
  chemically synthesized
ctgaggcagaaggatccctt

SEQ ID NO: 30507 - DNA, 20 bp, Artificial Sequence
  chemically synthesized
ctcaagggatccttctgcct

SEQ ID NO: 30508 - DNA, 20 bp, Artificial Sequence
  chemically synthesized
cttccagaggctgaggcaga

SEQ ID NO: 30509 - DNA, 20 bp, Artificial Sequence
  chemically synthesized
gcttccagaggctgaggcag

SEQ ID NO: 30510 - DNA, 20 bp, Artificial Sequence
  chemically synthesized
agcgcttccagaggctgagg

SEQ ID NO: 30511 - DNA, 20 bp, Artificial Sequence
  chemically synthesized
gatccttctgcctcagcctc

SEQ ID NO: 30512 - DNA, 20 bp, Artificial Sequence
  chemically synthesized
cccagcgcttccagaggctg

SEQ ID NO: 30513 - DNA, 20 bp, Artificial Sequence
  chemically synthesized
tcccagcgcttccagaggct

SEQ ID NO: 30514 - DNA, 20 bp, Artificial Sequence
  chemically synthesized
ccttctgcctcagcctctgg

SEQ ID NO: 30515 - DNA, 20 bp, Artificial Sequence
  chemically synthesized
tgtagtcccagcgcttccag

SEQ ID NO: 30516 - DNA, 20 bp, Artificial Sequence
  chemically synthesized
ctgtagtcccagcgcttcca

SEQ ID NO: 30517 - DNA, 20 bp, Artificial Sequence
  chemically synthesized
gcctcagcctctggaagcgc

SEQ ID NO: 30518 - DNA, 20 bp, Artificial Sequence
  chemically synthesized
acctgtagtcccagcgcttc

SEQ ID NO: 30519 - DNA, 20 bp, Artificial Sequence
  chemically synthesized
cctcagcctctggaagcgct

SEQ ID NO: 30520 - DNA, 20 bp, Artificial Sequence
  chemically synthesized
ctctggaagcgctgggacta

SEQ ID NO: 30521 - DNA, 20 bp, Artificial Sequence
  chemically synthesized
tctggaagcgctgggactac

SEQ ID NO: 30522 - DNA, 20 bp, Artificial Sequence
  chemically synthesized
gtggcacgcacctgtagtcc

SEQ ID NO: 30523 - DNA, 20 bp, Artificial Sequence
  chemically synthesized
ggcatggtggcacgcacctg

SEQ ID NO: 30524 - DNA, 20 bp, Artificial Sequence
  chemically synthesized
caggtgcgtgccaccatgcc

SEQ ID NO: 30525 - DNA, 20 bp, Artificial Sequence
  chemically synthesized
cactttaaggccaggcatgg

SEQ ID NO: 30526 - DNA, 20 bp, Artificial Sequence
  chemically synthesized
tatcactttaaggccaggca

SEQ ID NO: 30527 - DNA, 20 bp, Artificial Sequence
  chemically synthesized
tgccaccatgcctggcctta

SEQ ID NO: 30528 - DNA, 20 bp, Artificial Sequence
  chemically synthesized
gaggctatcactttaaggcc

SEQ ID NO: 30529 - DNA, 20 bp, Artificial Sequence
  chemically synthesized
agaggctatcactttaaggc

SEQ ID NO: 30530 - DNA, 20 bp, Artificial Sequence
  chemically synthesized
gtaaagaggctatcacttta

SEQ ID NO: 30531 - DNA, 20 bp, Artificial Sequence
  chemically synthesized
catgcctggccttaaagtga

SEQ ID NO: 30532 - DNA, 20 bp, Artificial Sequence
  chemically synthesized
tgtaaagaggctatcacttt

SEQ ID NO: 30533 - DNA, 20 bp, Artificial Sequence
  chemically synthesized
ttaaagtgatagcctcttta

SEQ ID NO: 30534 - DNA, 20 bp, Artificial Sequence
  chemically synthesized
tactttcttggtctgtaaag

SEQ ID NO: 30535 - DNA, 20 bp, Artificial Sequence
  chemically synthesized
ttactttcttggtctgtaaa

SEQ ID NO: 30536 - DNA, 20 bp, Artificial Sequence
  chemically synthesized
ttttactttcttggtctgta

SEQ ID NO: 30537 - DNA, 20 bp, Artificial Sequence
  chemically synthesized
tgatagcctctttacagacc

SEQ ID NO: 30538 - DNA, 20 bp, Artificial Sequence
  chemically synthesized
agcctctttacagaccaaga

SEQ ID NO: 30539 - DNA, 20 bp, Artificial Sequence
  chemically synthesized
gtttttatattttactttct

SEQ ID NO: 30540 - DNA, 20 bp, Artificial Sequence
  chemically synthesized
aagcattaattttggtaaga

SEQ ID NO: 30541 - DNA, 20 bp, Artificial Sequence
  chemically synthesized
taccaagcattaattttggt

SEQ ID NO: 30542 - DNA, 20 bp, Artificial Sequence
  chemically synthesized
tctttaccaagcattaattt

SEQ ID NO: 30543 - DNA, 20 bp, Artificial Sequence
  chemically synthesized
ttcttaccaaaattaatgct

SEQ ID NO: 30544 - DNA, 20 bp, Artificial Sequence
  chemically synthesized
accaaaattaatgcttggta

SEQ ID NO: 30545 - DNA, 20 bp, Artificial Sequence
  chemically synthesized
tacatacagatttctttacc

SEQ ID NO: 30546 - DNA, 20 bp, Artificial Sequence
  chemically synthesized
tatattgatatatttacata

SEQ ID NO: 30547 - DNA, 20 bp, Artificial Sequence
  chemically synthesized
gtatgtaaatatatcaatat

SEQ ID NO: 30548 - DNA, 20 bp, Artificial Sequence
  chemically synthesized
aaatagaagcttatataacg

SEQ ID NO: 30549 - DNA, 20 bp, Artificial Sequence
  chemically synthesized
aacatttgtctccgttatat

SEQ ID NO: 30550 - DNA, 20 bp, Artificial Sequence
  chemically synthesized
ataaatagaagcttatataa

SEQ ID NO: 30551 - DNA, 20 bp, Artificial Sequence
  chemically synthesized
ttacaccccctcataaatag

SEQ ID NO: 30552 - DNA, 20 bp, Artificial Sequence
  chemically synthesized
ttatataagcttctatttat

SEQ ID NO: 30553 - DNA, 20 bp, Artificial Sequence
  chemically synthesized
tatataagcttctatttatg

SEQ ID NO: 30554 - DNA, 20 bp, Artificial Sequence
  chemically synthesized
atataagcttctatttatga

SEQ ID NO: 30555 - DNA, 20 bp, Artificial Sequence
  chemically synthesized
tcattacaccccctcataaa

SEQ ID NO: 30556 - DNA, 20 bp, Artificial Sequence
  chemically synthesized
tataagcttctatttatgag

SEQ ID NO: 30557 - DNA, 20 bp, Artificial Sequence
  chemically synthesized
ataagcttctatttatgagg

SEQ ID NO: 30558 - DNA, 20 bp, Artificial Sequence
  chemically synthesized
agggggtgtaatgactttcc

SEQ ID NO: 30559 - DNA, 20 bp, Artificial Sequence
  chemically synthesized
ggggtgtaatgactttcctg

SEQ ID NO: 30560 - DNA, 20 bp, Artificial Sequence
  chemically synthesized
tcgcttgcataactccagga

SEQ ID NO: 30561 - DNA, 20 bp, Artificial Sequence
  chemically synthesized
ttcatcgcttgcataactcc

SEQ ID NO: 30562 - DNA, 20 bp, Artificial Sequence
  chemically synthesized
gttcatcgcttgcataactc

SEQ ID NO: 30563 - DNA, 20 bp, Artificial Sequence
  chemically synthesized
tgactttcctggagttatgc

SEQ ID NO: 30564 - DNA, 20 bp, Artificial Sequence
  chemically synthesized
tgcaagcgatgaacgctttg

SEQ ID NO: 30565 - DNA, 20 bp, Artificial Sequence
  chemically synthesized
gcgatgaacgctttgtggaa

SEQ ID NO: 30566 - DNA, 20 bp, Artificial Sequence
  chemically synthesized
tcaaaatttgctattccaca

SEQ ID NO: 30567 - DNA, 20 bp, Artificial Sequence
  chemically synthesized
caaattttgaaacattccca

SEQ ID NO: 30568 - DNA, 20 bp, Artificial Sequence
  chemically synthesized
atgaattggtgatattctgt

SEQ ID NO: 30569 - DNA, 20 bp, Artificial Sequence
  chemically synthesized
tatgaattggtgatattctg

SEQ ID NO: 30570 - DNA, 20 bp, Artificial Sequence
  chemically synthesized
tcattagcttatttatgaat

SEQ ID NO: 30571 - DNA, 20 bp, Artificial Sequence
  chemically synthesized
aatatcaccaattcataaat

SEQ ID NO: 30572 - DNA, 20 bp, Artificial Sequence
  chemically synthesized
tgacatagtggatgaatcat

SEQ ID NO: 30573 - DNA, 20 bp, Artificial Sequence
  chemically synthesized
aagtctctcttatgacatag

SEQ ID NO: 30574 - DNA, 20 bp, Artificial Sequence
  chemically synthesized
tgattcatccactatgtcat

SEQ ID NO: 30575 - DNA, 20 bp, Artificial Sequence
  chemically synthesized
tgaaagtctctcttatgaca

SEQ ID NO: 30576 - DNA, 20 bp, Artificial Sequence
  chemically synthesized
attcatccactatgtcataa

SEQ ID NO: 30577 - DNA, 20 bp, Artificial Sequence
  chemically synthesized
tcatccactatgtcataaga

SEQ ID NO: 30578 - DNA, 20 bp, Artificial Sequence
  chemically synthesized
tatgtcataagagagacttt

SEQ ID NO: 30579 - DNA, 20 bp, Artificial Sequence
  chemically synthesized
atgacctaaaaatattctga

SEQ ID NO: 30580 - DNA, 20 bp, Artificial Sequence
  chemically synthesized
agagactttcagaatatttt

SEQ ID NO: 30581 - DNA, 20 bp, Artificial Sequence
  chemically synthesized
gagactttcagaatattttt

SEQ ID NO: 30582 - DNA, 20 bp, Artificial Sequence
  chemically synthesized
aggtcattttattactaccg

SEQ ID NO: 30583 - DNA, 20 bp, Artificial Sequence
  chemically synthesized
gtcattttattactaccgta

SEQ ID NO: 30584 - DNA, 20 bp, Artificial Sequence
  chemically synthesized
tcattttattactaccgtag

SEQ ID NO: 30585 - DNA, 20 bp, Artificial Sequence
  chemically synthesized
cattttattactaccgtaga

SEQ ID NO: 30586 - DNA, 20 bp, Artificial Sequence
  chemically synthesized
aaagtctgtaccctctacgg

SEQ ID NO: 30587 - DNA, 20 bp, Artificial Sequence
  chemically synthesized
tttaaagtctgtaccctcta

SEQ ID NO: 30588 - DNA, 20 bp, Artificial Sequence
  chemically synthesized
tattactaccgtagagggta

SEQ ID NO: 30589 - DNA, 20 bp, Artificial Sequence
  chemically synthesized
cataaaatagatagttttta

SEQ ID NO: 30590 - DNA, 20 bp, Artificial Sequence
  chemically synthesized
gagcactcacataaaataga

SEQ ID NO: 30591 - DNA, 20 bp, Artificial Sequence
  chemically synthesized
gtcagagcactcacataaaa

SEQ ID NO: 30592 - DNA, 20 bp, Artificial Sequence
  chemically synthesized
aaaaactatctattttatgt

SEQ ID NO: 30593 - DNA, 20 bp, Artificial Sequence
  chemically synthesized
aaagagattcagaacagtca

SEQ ID NO: 30594 - DNA, 20 bp, Artificial Sequence
  chemically synthesized
ggaaagagattcagaacagt

SEQ ID NO: 30595 - DNA, 20 bp, Artificial Sequence
  chemically synthesized
tgctggaaagagattcagaa

SEQ ID NO: 30596 - DNA, 20 bp, Artificial Sequence
  chemically synthesized
aattttgctggaaagagatt

SEQ ID NO: 30597 - DNA, 20 bp, Artificial Sequence
  chemically synthesized
gactgttctgaatctctttc

SEQ ID NO: 30598 - DNA, 20 bp, Artificial Sequence
  chemically synthesized
agctgcaattttgctggaaa

SEQ ID NO: 30599 - DNA, 20 bp, Artificial Sequence
  chemically synthesized
ggagctgcaattttgctgga

SEQ ID NO: 30600 - DNA, 20 bp, Artificial Sequence
  chemically synthesized
cttgggagctgcaattttgc

SEQ ID NO: 30601 - DNA, 20 bp, Artificial Sequence
  chemically synthesized
atctctttccagcaaaattg

SEQ ID NO: 30602 - DNA, 20 bp, Artificial Sequence
  chemically synthesized
ccagcaaaattgcagctccc

SEQ ID NO: 30603 - DNA, 20 bp, Artificial Sequence
  chemically synthesized
agcaaaattgcagctcccaa

SEQ ID NO: 30604 - DNA, 20 bp, Artificial Sequence
  chemically synthesized
tacctctgtatgtctcttgg

SEQ ID NO: 30605 - DNA, 20 bp, Artificial Sequence
  chemically synthesized
attacctctgtatgtctctt

SEQ ID NO: 30606 - DNA, 20 bp, Artificial Sequence
  chemically synthesized
gattacctctgtatgtctct

SEQ ID NO: 30607 - DNA, 20 bp, Artificial Sequence
  chemically synthesized
tgcagctcccaagagacata

SEQ ID NO: 30608 - DNA, 20 bp, Artificial Sequence
  chemically synthesized
cagctcccaagagacataca

SEQ ID NO: 30609 - DNA, 20 bp, Artificial Sequence
  chemically synthesized
agctcccaagagacatacag

SEQ ID NO: 30610 - DNA, 20 bp, Artificial Sequence
  chemically synthesized
aagagacatacagaggtaat

SEQ ID NO: 30611 - DNA, 20 bp, Artificial Sequence
  chemically synthesized
tacagaggtaatcagacttg

SEQ ID NO: 30612 - DNA, 20 bp, Artificial Sequence
  chemically synthesized
acagaggtaatcagacttgt

SEQ ID NO: 30613 - DNA, 20 bp, Artificial Sequence
  chemically synthesized
tatttcttttttaagcccac

SEQ ID NO: 30614 - DNA, 20 bp, Artificial Sequence
  chemically synthesized
tcagacttgtgggcttaaaa

SEQ ID NO: 30615 - DNA, 20 bp, Artificial Sequence
  chemically synthesized
atttccaatatttctttttt

SEQ ID NO: 30616 - DNA, 20 bp, Artificial Sequence
  chemically synthesized
tgggcttaaaaaagaaatat

SEQ ID NO: 30617 - DNA, 20 bp, Artificial Sequence
  chemically synthesized
aatattggaaatgtctgaat

SEQ ID NO: 30618 - DNA, 20 bp, Artificial Sequence
  chemically synthesized
tattggaaatgtctgaataa

SEQ ID NO: 30619 - DNA, 20 bp, Artificial Sequence
  chemically synthesized
aaaacgtgtctgctcttatt

SEQ ID NO: 30620 - DNA, 20 bp, Artificial Sequence
  chemically synthesized
tggaaatgtctgaataagag

SEQ ID NO: 30621 - DNA, 20 bp, Artificial Sequence
  chemically synthesized
aataagagcagacacgtttt

SEQ ID NO: 30622 - DNA, 20 bp, Artificial Sequence
  chemically synthesized
gatttttgcacacagagtaa

SEQ ID NO: 30623 - DNA, 20 bp, Artificial Sequence
  chemically synthesized
tgatttttgcacacagagta

SEQ ID NO: 30624 - DNA, 20 bp, Artificial Sequence
  chemically synthesized
gaagatgatttttgcacaca

SEQ ID NO: 30625 - DNA, 20 bp, Artificial Sequence
  chemically synthesized
cagaagatgatttttgcaca

SEQ ID NO: 30626 - DNA, 20 bp, Artificial Sequence
  chemically synthesized
tgtgcaaaaatcatcttctg

SEQ ID NO: 30627 - DNA, 20 bp, Artificial Sequence
  chemically synthesized
ttatgtagctggatctgcag

SEQ ID NO: 30628 - DNA, 20 bp, Artificial Sequence
  chemically synthesized
aaaatcatcttctgcagatc

SEQ ID NO: 30629 - DNA, 20 bp, Artificial Sequence
  chemically synthesized
attttatgtagctggatctg

SEQ ID NO: 30630 - DNA, 20 bp, Artificial Sequence
  chemically synthesized
tatgtacaattttatgtagc

SEQ ID NO: 30631 - DNA, 20 bp, Artificial Sequence
  chemically synthesized
tggatatgtacaattttatg

SEQ ID NO: 30632 - DNA, 20 bp, Artificial Sequence
  chemically synthesized
tacataaaattgtacatatc

SEQ ID NO: 30633 - DNA, 20 bp, Artificial Sequence
  chemically synthesized
tgcagctagaagaaaagtgc

SEQ ID NO: 30634 - DNA, 20 bp, Artificial Sequence
  chemically synthesized
catatccagcacttttcttc

SEQ ID NO: 30635 - DNA, 20 bp, Artificial Sequence
  chemically synthesized
tacacctgcagctagaagaa

SEQ ID NO: 30636 - DNA, 20 bp, Artificial Sequence
  chemically synthesized
cagcacttttcttctagctg

SEQ ID NO: 30637 - DNA, 20 bp, Artificial Sequence
  chemically synthesized
aaggttacacctgcagctag

SEQ ID NO: 30638 - DNA, 20 bp, Artificial Sequence
  chemically synthesized
agcacttttcttctagctgc

SEQ ID NO: 30639 - DNA, 20 bp, Artificial Sequence
  chemically synthesized
attaaggttacacctgcagc

SEQ ID NO: 30640 - DNA, 20 bp, Artificial Sequence
  chemically synthesized
gaacattaaggttacacctg

SEQ ID NO: 30641 - DNA, 20 bp, Artificial Sequence
  chemically synthesized
tctaaataagaggaacatta

SEQ ID NO: 30642 - DNA, 20 bp, Artificial Sequence
  chemically synthesized
atctaaataagaggaacatt

SEQ ID NO: 30643 - DNA, 20 bp, Artificial Sequence
  chemically synthesized
accttaatgttcctcttatt

SEQ ID NO: 30644 - DNA, 20 bp, Artificial Sequence
  chemically synthesized
agtttactgatctaaataag

SEQ ID NO: 30645 - DNA, 20 bp, Artificial Sequence
  chemically synthesized
tagtttactgatctaaataa

SEQ ID NO: 30646 - DNA, 20 bp, Artificial Sequence
  chemically synthesized
tgtagtttactgatctaaat

SEQ ID NO: 30647 - DNA, 20 bp, Artificial Sequence
  chemically synthesized
aatgttcctcttatttagat

SEQ ID NO: 30648 - DNA, 20 bp, Artificial Sequence
  chemically synthesized
tagatcagtaaactacaatt

SEQ ID NO: 30649 - DNA, 20 bp, Artificial Sequence
  chemically synthesized
ttaaaagagctgccaaattg

SEQ ID NO: 30650 - DNA, 20 bp, Artificial Sequence
  chemically synthesized
atcagtaaactacaatttgg

SEQ ID NO: 30651 - DNA, 20 bp, Artificial Sequence
  chemically synthesized
actggtttacagttttaaaa

SEQ ID NO: 30652 - DNA, 20 bp, Artificial Sequence
  chemically synthesized
tgactggtttacagttttaa

SEQ ID NO: 30653 - DNA, 20 bp, Artificial Sequence
  chemically synthesized
gctcttttaaaactgtaaac

SEQ ID NO: 30654 - DNA, 20 bp, Artificial Sequence
  chemically synthesized
cttagactttgactggttta

SEQ ID NO: 30655 - DNA, 20 bp, Artificial Sequence
  chemically synthesized
ttaaaactgtaaaccagtca

SEQ ID NO: 30656 - DNA, 20 bp, Artificial Sequence
  chemically synthesized
attgttccttagactttgac

SEQ ID NO: 30657 - DNA, 20 bp, Artificial Sequence
  chemically synthesized
ctgtaaaccagtcaaagtct

SEQ ID NO: 30658 - DNA, 20 bp, Artificial Sequence
  chemically synthesized
tgtaaaccagtcaaagtcta

SEQ ID NO: 30659 - DNA, 20 bp, Artificial Sequence
  chemically synthesized
actcaaaaagaattgttcct

SEQ ID NO: 30660 - DNA, 20 bp, Artificial Sequence
  chemically synthesized
tctaaggaacaattcttttt

SEQ ID NO: 30661 - DNA, 20 bp, Artificial Sequence
  chemically synthesized
atttcagaaggaaactcaaa

SEQ ID NO: 30662 - DNA, 20 bp, Artificial Sequence
  chemically synthesized
ctctccaagcttatttcaga

SEQ ID NO: 30663 - DNA, 20 bp, Artificial Sequence
  chemically synthesized
tttgagtttccttctgaaat

SEQ ID NO: 30664 - DNA, 20 bp, Artificial Sequence
  chemically synthesized
tctctccaagcttatttcag

SEQ ID NO: 30665 - DNA, 20 bp, Artificial Sequence
  chemically synthesized
gcatctctccaagcttattt

SEQ ID NO: 30666 - DNA, 20 bp, Artificial Sequence
  chemically synthesized
gtttccttctgaaataagct

SEQ ID NO: 30667 - DNA, 20 bp, Artificial Sequence
  chemically synthesized
ttccttctgaaataagcttg

SEQ ID NO: 30668 - DNA, 20 bp, Artificial Sequence
  chemically synthesized
ccttctgaaataagcttgga

SEQ ID NO: 30669 - DNA, 20 bp, Artificial Sequence
  chemically synthesized
tttctgaattgcatctctcc

SEQ ID NO: 30670 - DNA, 20 bp, Artificial Sequence
  chemically synthesized
aagcttggagagatgcaatt

SEQ ID NO: 30671 - DNA, 20 bp, Artificial Sequence
  chemically synthesized
cttctaattgaagaacataa

SEQ ID NO: 30672 - DNA, 20 bp, Artificial Sequence
  chemically synthesized
tatctattatgttcttcaat

SEQ ID NO: 30673 - DNA, 20 bp, Artificial Sequence
  chemically synthesized
ctattatgttcttcaattag

SEQ ID NO: 30674 - DNA, 20 bp, Artificial Sequence
  chemically synthesized
tgatttaaagcttctaattg

SEQ ID NO: 30675 - DNA, 20 bp, Artificial Sequence
  chemically synthesized
tcaattagaagctttaaatc

SEQ ID NO: 30676 - DNA, 20 bp, Artificial Sequence
  chemically synthesized
tgttcaaataacttgattta

SEQ ID NO: 30677 - DNA, 20 bp, Artificial Sequence
  chemically synthesized
ttaaatcaagttatttgaac

SEQ ID NO: 30678 - DNA, 20 bp, Artificial Sequence
  chemically synthesized
agaaaaaatattataatatt

SEQ ID NO: 30679 - DNA, 20 bp, Artificial Sequence
  chemically synthesized
aaatattataatatttagaa

SEQ ID NO: 30680 - DNA, 20 bp, Artificial Sequence
  chemically synthesized
caaaatttatggcattttaa

SEQ ID NO: 30681 - DNA, 20 bp, Artificial Sequence
  chemically synthesized
aacttccaaatcaaaattta

SEQ ID NO: 30682 - DNA, 20 bp, Artificial Sequence
  chemically synthesized
aaatgccataaattttgatt

SEQ ID NO: 30683 - DNA, 20 bp, Artificial Sequence
  chemically synthesized
tgccataaattttgatttgg

SEQ ID NO: 30684 - DNA, 20 bp, Artificial Sequence
  chemically synthesized
gactttccccatttgtaaaa

SEQ ID NO: 30685 - DNA, 20 bp, Artificial Sequence
  chemically synthesized
ttacatttctattttacaaa

SEQ ID NO: 30686 - DNA, 20 bp, Artificial Sequence
  chemically synthesized
tacatttctattttacaaat

SEQ ID NO: 30687 - DNA, 20 bp, Artificial Sequence
  chemically synthesized
acatttctattttacaaatg

SEQ ID NO: 30688 - DNA, 20 bp, Artificial Sequence
  chemically synthesized
ttctattttacaaatgggga

SEQ ID NO: 30689 - DNA, 20 bp, Artificial Sequence
  chemically synthesized
ttacaaatggggaaagtcaa

SEQ ID NO: 30690 - DNA, 20 bp, Artificial Sequence
  chemically synthesized
aagtcaatggatcctaatca

(The sequence listing continues in the following parts.)

What is claimed is:

1. A single-molecule guide RNA (sgRNA) comprising in the 5' to 3' direction, a spacer sequence, a minimum CRISPR repeat sequence and a tracrRNA sequence, wherein the spacer sequence consists of an RNA sequence encoded by SEQ ID NO: 1410444, and wherein the sgRNA is capable of removing an AG sequence upstream of Exon 51 in the DMD gene when administered to a cell with a Cas9 protein or a nucleic acid encoding a Cas9 protein.

2. The sgRNA of claim 1, wherein the sgRNA comprises an RNA modification.

3. The sgRNA of claim 1, wherein the sgRNA is complexed with a Cas9 protein.

* * * * *

UNITED STATES PATENT AND TRADEMARK OFFICE
CERTIFICATE OF CORRECTION

| | |
|---|---|
| PATENT NO. | : 11,369,692 B2 |
| APPLICATION NO. | : 15/763328 |
| DATED | : June 28, 2022 |
| INVENTOR(S) | : Kabadi et al. |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 692 days.

Signed and Sealed this
Eleventh Day of February, 2025

Coke Morgan Stewart
*Acting Director of the United States Patent and Trademark Office*